US009902956B2

(12) United States Patent
Maor et al.

(10) Patent No.: US 9,902,956 B2
(45) Date of Patent: Feb. 27, 2018

(54) NUCLEIC ACID AGENTS FOR OVEREXPRESSING OR DOWNREGULATING RNA INTERFERENCE TARGETS AND USES OF SAME IN IMPROVING NITROGEN USE EFFICIENCY, ABIOTIC STRESS TOLERANCE, BIOMASS, VIGOR OR YIELD OF A PLANT

(75) Inventors: Rudy Maor, Rechovot (IL); Iris Nesher, Tel-Aviv (IL); Orly Noivirt-Brik, Givataim (IL)

(73) Assignee: A.B. Seeds Ltd., Lod, IL (US)

( * ) Notice: Subject to any disclaimer, the term of this patent is extended or adjusted under 35 U.S.C. 154(b) by 387 days.

(21) Appl. No.: 14/238,745

(22) PCT Filed: Aug. 14, 2012

(86) PCT No.: PCT/IB2012/054149

§ 371 (c)(1),
(2), (4) Date: Jun. 19, 2014

(87) PCT Pub. No.: WO2013/024440

PCT Pub. Date: Feb. 21, 2013

(65) Prior Publication Data

US 2014/0298542 A1    Oct. 2, 2014

Related U.S. Application Data

(60) Provisional application No. 61/523,355, filed on Aug. 14, 2011.

(51) Int. Cl.
*C12N 15/82* (2006.01)
*C12N 15/113* (2010.01)
*C07K 14/415* (2006.01)

(52) U.S. Cl.
CPC .......... *C12N 15/113* (2013.01); *C07K 14/415* (2013.01); *C12N 15/8261* (2013.01); *C12N 15/8271* (2013.01)

(58) Field of Classification Search
None
See application file for complete search history.

(56) References Cited

U.S. PATENT DOCUMENTS

| | | | |
|---|---|---|---|
| 2004/0214272 A1 | 10/2004 | La Rosa et al. | |
| 2009/0070899 A1* | 3/2009 | Apuya ............... | C12N 15/8255 800/286 |
| 2009/0094747 A1* | 4/2009 | Bly .................. | A61G 7/012 5/611 |
| 2009/0217414 A1* | 8/2009 | La Rosa .............. | C07K 14/415 800/278 |
| 2010/0162433 A1* | 6/2010 | McLaren ........... | C12N 15/8261 800/278 |
| 2011/0179529 A1* | 7/2011 | Kwok ................ | C12N 15/8261 800/306 |
| 2014/0298541 A1 | 10/2014 | Maor et al. | |

FOREIGN PATENT DOCUMENTS

| | | |
|---|---|---|
| WO | WO 2009/141824 | 11/2009 |
| WO | WO 2013/024438 | 2/2013 |
| WO | WO 2013/024440 | 2/2013 |

OTHER PUBLICATIONS

International Search Report and the Written Opinion dated Dec. 27, 2012 From the International Searching Authority Re. Application No. PCT/IB2012/054149.
Invitation to Pay Additional Fees dated Nov. 25, 2012 From the International Searching Authority Re. Application No. PCT/IB2012/054147.
Invitation to Pay Additional Fees dated Nov. 25, 2012 From the International Searching Authority Re. Application No. PCT/IB2012/054149.
Glick et al. "Promotion of Plant Growth by ACC Deaminase-Producing Soil Bacteria", European Journal of Plant Pathology, 119: 329-339, Nov. 30, 2007.
Paterson et al. "Hypothetical Protein SORBIDRAFT_03g031980 [Sorghum Bicolor]", Database NBCI [Online], Database Accession No. XP002458357, Jul. 13, 2009.
Puzey et al. "Identification of Conserved Aquilegia Coerulea MicroRNAs and Their Targets", Gene, 448(1): 46-56, Dec. 1, 2009. Table 3, Part 3.5.3 of Results.
Shaharoona et al. "Fertilizer-Dependent Efficiency of Psuedomonads for Improving Growth, Yield, and Nutrient Use Efficiency of Wheat (*Triticum aestivum* L.)", Applied Microbiology and Biotechnology, 79(1): 147-155, May 2008. Abstract. Abstract.
Sunkar et al. "Small RNAs as Big Players in Plant Abiotic Stress Responses and Nutrient Deprivation", Trends in Plant Sciences, 12(7): 301-309, 2007. Table 1.
International Preliminary Report on Patentability dated Feb. 27, 2014 From the International Bureau of WIPO Re. Application No. PCT/IB2012/054149.

* cited by examiner

*Primary Examiner* — Brent T Page
(74) *Attorney, Agent, or Firm* — Arnold & Porter Kaye Scholer LLP

(57) ABSTRACT

A method of improving nitrogen use efficiency, abiotic stress tolerance, biomass, vigor or yield of a plant is provided by expressing within the plant an exogenous polynucleotide encoding a polypeptide having an amino acid sequence at least 80% homologous to SEQ ID NOs: 687-981, 992-1248, 1281-1310, 1389-1391, and 2806-3081. Also provided is a method of improving nitrogen use efficiency, abiotic stress tolerance, biomass, vigor or yield of a plan by expressing within the plant an exogenous polynucleotide which down-regulates an activity or expression of a polypeptide having an amino acid sequence at least 80% homologous to SEQ ID NOs: 311-514, 2007-2436, 1311-1320, 982-991, 1249-1280, 1321-1388. Transgenic plants and constructs are provided as well.

12 Claims, 1 Drawing Sheet

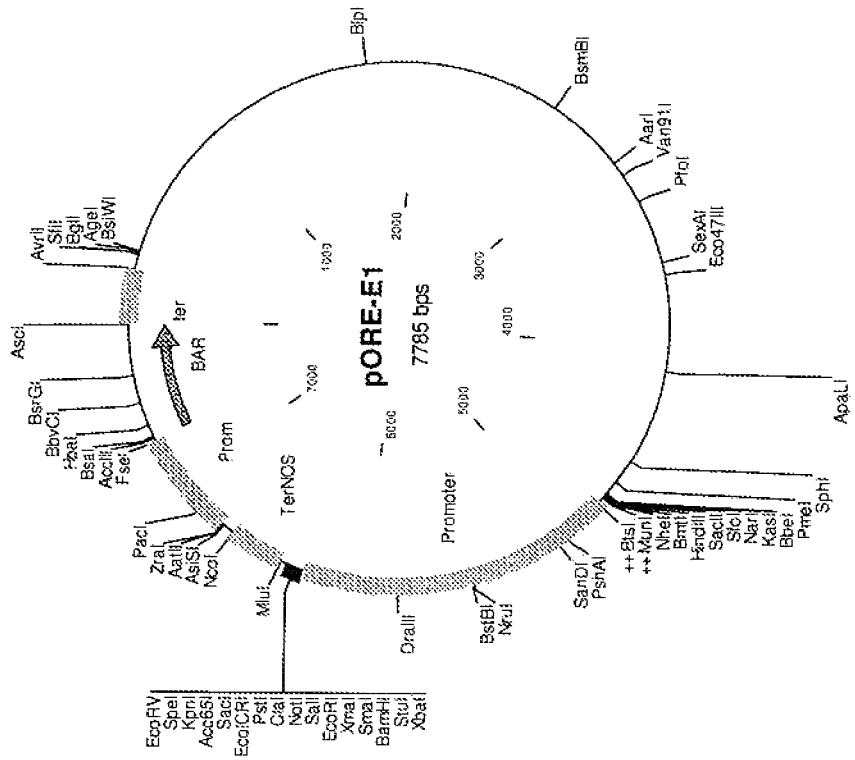

NUCLEIC ACID AGENTS FOR OVEREXPRESSING OR DOWNREGULATING RNA INTERFERENCE TARGETS AND USES OF SAME IN IMPROVING NITROGEN USE EFFICIENCY, ABIOTIC STRESS TOLERANCE, BIOMASS, VIGOR OR YIELD OF A PLANT

RELATED APPLICATIONS

This application is a National Phase of PCT Patent Application No. PCT/IB2012/054149 having International filing date of Aug. 14, 2012, which claims the benefit of priority under 35 USC § 119(e) of U.S. Provisional Patent Application No. 61/523,355 filed on Aug. 14, 2011. The contents of the above applications are all incorporated by reference as if fully set forth herein in their entirety.

SEQUENCE LISTING STATEMENT

The ASCII file, entitled 58604SequenceListing.txt, created on Feb. 13, 2014, comprising 9,493,532 bytes, submitted concurrently with the filing of this application is incorporated herein by reference.

FIELD AND BACKGROUND OF THE INVENTION

The present invention, in some embodiments thereof, relates to nucleic acid agents for overexpressing or down-regulating RNA interference targets and uses of same in improving nitrogen use efficiency, abiotic stress tolerance, biomass, vigor or yield of a plant.

Plant growth is reliant on a number of basic factors: light, air, water, nutrients, and physical support. All these factors, with the exception of light, are controlled by soil to some extent, which integrates non-living substances (minerals, organic matter, gases and liquids) and living organisms (bacteria, fungi, insects, worms, etc.). The soil's volume is almost equally divided between solids and water/gases. An adequate nutrition in the form of natural as well as synthetic fertilizers, may affect crop yield and quality, and its response to stress factors such as disease and adverse weather. The great importance of fertilizers can best be appreciated when considering the direct increase in crop yields over the last 40 years, and the fact that they account for most of the overhead expense in agriculture. Sixteen natural nutrients are essential for plant growth, three of which, carbon, hydrogen and oxygen, are retrieved from air and water. The soil provides the remaining 13 nutrients.

Nutrients are naturally recycled within a self-sufficient environment, such as a rainforest. However, when grown in a commercial situation, plants consume nutrients for their growth and these nutrients need to be replenished in the system. Several nutrients are consumed by plants in large quantities and are referred to as macronutrients. Three macronutrients are considered the basic building blocks of plant growth, and are provided as main fertilizers; Nitrogen (N), Phosphate (P) and Potassium (K). Yet, only nitrogen needs to be replenished every year since plants only absorb approximately half of the nitrogen fertilizer applied. A proper balance of nutrients is crucial; when too much of an essential nutrient is available, it may become toxic to plant growth. Utilization efficiencies of macronutrients directly correlate with yield and general plant tolerance, and increasing them will benefit the plants themselves and the environment by decreasing seepage to ground water.

Nitrogen is responsible for biosynthesis of amino and nucleic acids, prosthetic groups, plant hormones, plant chemical defenses, etc, and thus is utterly essential for the plant. For this reason, plants store nitrogen throughout their developmental stages, in the specific case of corn during the period of grain germination, mostly in the leaves and stalk. However, due to the low nitrogen use efficiency (NUE) of the main crops (e.g., in the range of only 30-70%), nitrogen supply needs to be replenished at least twice during the growing season. This requirement for fertilizer refill may become the rate-limiting element in plant growth and increase fertilizer expenses for the farmer. Limited land resources combined with rapid population growth will inevitably lead to added increase in fertilizer use. In light of this prediction, advanced, biotechnology-based solutions to allow stable high yields with an added potential to reduce fertilizer costs are highly desirable. Subsequently, developing plants with increased NUE will lower fertilizer input in crop cultivation, and allow growth on lower-quality soils.

The major agricultural crops (corn, rice, wheat, canola and soybean) account for over half of total human caloric intake, giving their yield and quality vast importance. They can be consumed either directly (eating their seeds which are also used as a source of sugars, oils and metabolites), or indirectly (eating meat products raised on processed seeds or forage). Various factors may influence a crop's yield, including but not limited to, quantity and size of the plant organs, plant architecture, vigor (e.g. seedling), growth rate, root development, utilization of water and nutrients (e.g., nitrogen), and stress tolerance. Plant yield may be amplified through multiple approaches; (1) enhancement of innate traits (e.g., dry matter accumulation rate, cellulose/lignin composition), (2) improvement of structural features (e.g., stalk strength, meristem size, plant branching pattern), and (3) amplification of seed yield and quality (e.g., fertilization efficiency, seed development, seed filling or content of oil, starch or protein). Increasing plant yield through any of the above methods would ultimately have many applications in agriculture and additional fields such as in the biotechnology industry.

Two main adverse environmental conditions, malnutrition (nutrient deficiency) and drought, elicit a response in the plant that mainly affects root architecture (Jiang and Huang (2001), *Crop Sci* 41:1168-1173; Lopez-Bucio et al. (2003), *Curr Opin Plant Biol*, 6:280-287; Morgan and Condon (1986), *Aust J Plant Physiol* 13:523-532), causing activation of plant metabolic pathways to maximize water assimilation. Improvement of root architecture, i.e. making branched and longer roots, allows the plant to reach water and nutrient/fertilizer deposits located deeper in the soil by an increase in soil coverage. Root morphogenesis has already shown to increase tolerance to low phosphorus availability in soybean (Miller et al., (2003), *Funct Plant Biol* 30:973-985) and maize (Zhu and Lynch (2004), *Funct Plant Biol* 31:949-958). Thus, genes governing enhancement of root architecture may be used to improve NUE and drought tolerance. An example for a gene associated with root developmental changes is ANR1, a putative transcription factor with a role in nitrate ($NO3^-$) signaling. When expression of ANR1 is down-regulated, the resulting transgenic lines are defective in their root response to localized supplies of nitrate (Zhang and Forde (1998), *Science* 270:407). Enhanced root system and/or increased storage capabilities, which are seen in responses to different environmental stresses, are strongly favorable at normal or optimal growing conditions as well.

Abiotic stress refers to a range of suboptimal conditions as water deficit or drought, extreme temperatures and salt levels, and high or low light levels. High or low nutrient level also falls into the category of abiotic stress. The response to any stress may involve both stress specific and common stress pathways (Pastori and Foyer (2002), *Plant Physiol,* 129: 460-468), and drains energy from the plant, eventually resulting in lowered yield. Thus, distinguishing between the genes activated in each pathway and subsequent manipulation of only specific relevant genes could lead to a partial stress response without the parallel loss in yield. Contrary to the complex polygenic nature of plant traits responsible for adaptations to adverse environmental stresses, information on miRNAs involved in these responses is very limited. The most common approach for crop and horticultural improvements is through cross breeding, which is relatively slow, inefficient, and limited in the degree of variability achieved because it can only manipulate the naturally existing genetic diversity. Taken together with the limited genetic resources (i.e., compatible plant species) for crop improvement, conventional breeding is evidently unfavorable. By creating a pool of genetically modified plants, one broadens the possibilities for producing crops with improved economic or horticultural traits.

SUMMARY OF THE INVENTION

According to an aspect of some embodiments of the present invention there is provided a method of improving nitrogen use efficiency, abiotic stress tolerance, biomass, vigor or yield of a plant, the method comprising expressing within the plant an exogenous polynucleotide encoding a polypeptide having an amino acid sequence at least 80% homologous to the polypeptide selected from the group consisting of SEQ ID NOs: 687-981, 992-1248, 1281-1310, 1389-1391, and 2806-3081, wherein the polypeptide is capable of regulating nitrogen use efficiency of the plant, thereby improving nitrogen use efficiency, abiotic stress tolerance, biomass, vigor or yield of the plant.

According to an aspect of some embodiments of the present invention there is provided a transgenic plant exogenously expressing a polynucleotide encoding a polypeptide having an amino acid sequence at least 80% homologous to the polypeptide selected from the group consisting of SEQ ID NOs: 687-981, 992-1248, 1281-1310, 1389-1391, and 2806-3081, wherein the polypeptide is capable of regulating nitrogen use efficiency of the plant.

According to an aspect of some embodiments of the present invention there is provided a nucleic acid construct comprising a polynucleotide encoding a polypeptide having an amino acid sequence at least 80% homologous to SEQ ID NOs:687-981, 992-1248, 1281-1310, 1389-1391, and 2806-3081, wherein the polypeptide is capable of regulating nitrogen use efficiency of the plant, and wherein the polynucleotide is under a transcriptional control of a cis-acting regulatory element.

According to an aspect of some embodiments of the present invention there is provided a method of improving nitrogen use efficiency, abiotic stress tolerance, biomass, vigor or yield of a plant, the method comprising expressing within the plant an exogenous polynucleotide which downregulates an activity or expression of a polypeptide having an amino acid sequence at least 80% homologous to SEQ ID NOs: 311-514, 2007-2436, 1311-1320, 982-991, 1249-1280, 1321-1388, wherein the polypeptide is capable of regulating nitrogen use efficiency of the plant, thereby improving nitrogen use efficiency, abiotic stress tolerance, biomass, vigor or yield of the plant.

According to an aspect of some embodiments of the present invention there is provided a transgenic plant exogenously expressing a polynucleotide which downregulates an activity or expression of a polypeptide having an amino acid sequence at least 80% homologous to SEQ ID NOs: 311-514, 2007-2436, 1311-1320, 982-991, 1249-1280, 1321-1388, wherein the polypeptide is capable of regulating nitrogen use efficiency of the plant.

According to an aspect of some embodiments of the present invention there is provided a nucleic acid construct comprising a polynucleotide which downregulates an activity or expression of a polypeptide having an amino acid sequence at least 80% homologous to SEQ ID NOs: 311-514, 2007-2436, 1311-1320, 982-991, 1249-1280, 1321-1388, wherein the polypeptide is capable of regulating nitrogen use efficiency of a plant, the nucleic acid sequence being under the regulation of a cis-acting regulatory element.

According to some embodiments of the invention, the polynucleotide is selected from the group consisting of SEQ ID NO: 1392-1646, 1655-1888, 1911-1938, 3082-3316.

According to some embodiments of the invention, the polypeptide is selected from the group consisting of SEQ ID NO: 687-981, 992-1248, 1281-1310, 1389-1391, and 2806-3081.

According to some embodiments of the invention, the cis-acting regulatory element comprises a promoter.

According to some embodiments of the invention, the promoter comprises a tissue-specific promoter.

According to some embodiments of the invention, the tissue-specific promoter comprises a root specific promoter.

According to some embodiments of the invention, the method further comprising growing the plant under limiting nitrogen conditions.

According to some embodiments of the invention, the method further comprising growing the plant under abiotic stress.

According to some embodiments of the invention, the abiotic stress is selected from the group consisting of salinity, drought, water deprivation, flood, etiolation, low temperature, high temperature, heavy metal toxicity, anaerobiosis, nutrient deficiency, nutrient excess, atmospheric pollution and UV irradiation.

According to some embodiments of the invention, the plant of some embodiments of the invention being a monocotyledon.

According to some embodiments of the invention, the plant of some embodiments of the invention being a dicotyledon.

According to some embodiments of the invention, the polynucleotide acts by a mechanism selected from the group consisting of sense suppression, antisense suppression, ribozyme inhibition, and gene disruption.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIG. 1 is a scheme of a binary vector that can be used according to some embodiments of the invention.

DESCRIPTION OF SPECIFIC EMBODIMENTS OF THE INVENTION

The present invention, in some embodiments thereof, relates to nucleic acid agents for overexpressing or down-regulating RNA interference targets and uses of same in improving nitrogen use efficiency, abiotic stress tolerance, biomass, vigor or yield of a plant.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The doubling of agricultural food production worldwide over the past four decades has been associated with a 7-fold increase in the use of nitrogen (N) fertilizers. As a consequence, both the recent and future intensification of the use of nitrogen fertilizers in agriculture already has and will continue to have major detrimental impacts on the diversity and functioning of the non-agricultural neighbouring bacterial, animal, and plant ecosystems. The most typical examples of such an impact are the eutrophication of freshwater and marine ecosystems as a result of leaching when high rates of nitrogen fertilizers are applied to agricultural fields. In addition, there can be gaseous emission of nitrogen oxides reacting with the stratospheric ozone and the emission of toxic ammonia into the atmosphere. Furthermore, farmers are facing increasing economic pressures with the rising fossil fuels costs required for production of nitrogen fertilizers.

It is therefore of major importance to identify the critical steps controlling plant nitrogen use efficiency (NUE). Such studies can be harnessed towards generating new energy crop species that have a larger capacity to produce biomass with the minimal amount of nitrogen fertilizer.

While reducing the present invention to practice, the present inventors have uncovered dsRNA sequences that are differentially expressed in maize plants grown under nitrogen limiting conditions versus corn plants grown under conditions wherein nitrogen is a non-limiting factor. Following further screening the present inventors were able to identify the target genes of these dsRNA sequences and suggest using same or sequences modulating expression of same in the generation of transgenic plants having improved nitrogen use efficiency.

According to some embodiments, the target genes or nucleic acid sequences controlling expression of same relay their effect by affecting at least one of:

root architecture so as to increase nutrient uptake;

activation of plant metabolic pathways so as to maximize nitrogen absorption or localization; or alternatively or additionally modulating plant surface permeability.

Each of the above mechanisms may affect water uptake as well as salt absorption and therefore embodiments of the invention further relate to enhancement of abiotic stress tolerance, biomass, vigor or yield of the plant.

Thus, according to an aspect of the invention there is provided a method of improving nitrogen use efficiency, abiotic stress tolerance, biomass, vigor or yield of a plant, the method comprising expressing within the plant an exogenous polynucleotide encoding a polypeptide having an amino acid sequence at least 80% homologous to SEQ ID NOs: 687-981, 992-1248, 1281-1310, 1389-1391, and 2806-3081—wherein the polypeptide is capable of regulating nitrogen use efficiency of the plant, thereby improving nitrogen use efficiency, abiotic stress tolerance, biomass, vigor or yield of the plant.

As used herein the phrase "nitrogen use efficiency (NUE)" refers to a measure of crop production per unit of nitrogen fertilizer input. Fertilizer use efficiency (FUE) is a measure of NUE. Crop production can be measured by biomass, vigor or yield. The plant's nitrogen use efficiency is typically a result of an alteration in at least one of the uptake, spread, absorbance, accumulation, relocation (within the plant) and use of nitrogen absorbed by the plant. Improved NUE is with respect to that of a non-transgenic plant (i.e., lacking the transgene of the transgenic plant) of the same species and of the same developmental stage and grown under the same conditions.

As used herein the phrase "nitrogen-limiting conditions" refers to growth conditions which include a level (e.g., concentration) of nitrogen (e.g., ammonium or nitrate) applied, which is below the level needed for optimal plant metabolism, growth, reproduction and/or viability.

The phrase "abiotic stress" as used herein refers to any adverse effect on metabolism, growth, viability and/or reproduction of a plant. Abiotic stress can be induced by any of suboptimal environmental growth conditions such as, for example, water deficit or drought, flooding, freezing, low or high temperature, strong winds, heavy metal toxicity, anaerobiosis, high or low nutrient levels (e.g. nutrient deficiency), high or low salt levels (e.g. salinity), atmospheric pollution, high or low light intensities (e.g. insufficient light) or UV irradiation. Abiotic stress may be a short term effect (e.g. acute effect, e.g. lasting for about a week) or alternatively may be persistent (e.g. chronic effect, e.g. lasting for example 10 days or more). The present invention contemplates situations in which there is a single abiotic stress condition or alternatively situations in which two or more abiotic stresses occur.

According to an exemplary embodiment the abiotic stress refers to salinity.

According to another exemplary embodiment the abiotic stress refers to drought.

As used herein the phrase "abiotic stress tolerance" refers to the ability of a plant to endure an abiotic stress without exhibiting substantial physiological or physical damage (e.g. alteration in metabolism, growth, viability and/or reproductivity of the plant).

As used herein the term/phrase "biomass", "biomass of a plant" or "plant biomass" refers to the amount (e.g., measured in grams of air-dry tissue) of a tissue produced from the plant in a growing season. An increase in plant biomass can be in the whole plant or in parts thereof such as aboveground (e.g. harvestable) parts, vegetative biomass, roots and/or seeds.

As used herein the term/phrase "vigor", "vigor of a plant" or "plant vigor" refers to the amount (e.g., measured by weight) of tissue produced by the plant in a given time.

Increased vigor could determine or affect the plant yield or the yield per growing time or growing area. In addition, early vigor (e.g. seed and/or seedling) results in improved field stand.

As used herein the term/phrase "yield", "yield of a plant" or "plant yield" refers to the amount (e.g., as determined by weight or size) or quantity (e.g., numbers) of tissues or organs produced per plant or per growing season. Increased yield of a plant can affect the economic benefit one can obtain from the plant in a certain growing area and/or growing time.

According to an exemplary embodiment the yield is measured by cellulose content.

According to another exemplary embodiment the yield is measured by oil content.

According to another exemplary embodiment the yield is measured by protein content.

According to another exemplary embodiment, the yield is measured by seed number per plant or part thereof (e.g., kernel).

A plant yield can be affected by various parameters including, but not limited to, plant biomass; plant vigor; plant growth rate; seed yield; seed or grain quantity; seed or grain quality; oil yield; content of oil, starch and/or protein in harvested organs (e.g., seeds or vegetative parts of the plant); number of flowers (e.g. florets) per panicle (e.g. expressed as a ratio of number of filled seeds over number of primary panicles); harvest index; number of plants grown per area; number and size of harvested organs per plant and per area; number of plants per growing area (e.g. density); number of harvested organs in field; total leaf area; carbon assimilation and carbon partitioning (e.g. the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the term "improving" or "increasing" refers to at least about 2%, at least about 3%, at least about 4%, at least about 5%, at least about 10%, at least about 15%, at least about 20%, at least about 25%, at least about 30%, at least about 35%, at least about 40%, at least about 45%, at least about 50%, at least about 60%, at least about 70%, at least about 80%, at least about 90% or greater increase in NUE, in tolerance to abiotic stress, in yield, in biomass or in vigor of a plant, as compared to a native or wild-type plants [i.e., plants not genetically modified to express the biomolecules (polynucleotides or polypeptides) of the invention, e.g., a non-transformed plant of the same species and of the same developmental stage which is grown under the same growth conditions as the transformed plant].

Improved plant NUE is translated in the field into either harvesting similar quantities of yield, while implementing less fertilizers, or increased yields gained by implementing the same levels of fertilizers. Thus, improved NUE or FUE has a direct effect on plant yield in the field.

The term "plant" as used herein encompasses whole plants, ancestors and progeny of the plants and plant parts, including seeds, shoots, stems, roots (including tubers), and isolated plant cells, tissues and organs. The plant may be in any form including suspension cultures, embryos, meristematic regions, callus tissue, leaves, gametophytes, sporophytes, pollen, and microspores.

As used herein the phrase "plant cell" refers to plant cells which are derived and isolated from disintegrated plant cell tissue or plant cell cultures.

As used herein the phrase "plant cell culture" refers to any type of native (naturally occurring) plant cells, plant cell lines and genetically modified plant cells, which are not assembled to form a complete plant, such that at least one biological structure of a plant is not present. Optionally, the plant cell culture of this aspect of the present invention may comprise a particular type of a plant cell or a plurality of different types of plant cells. It should be noted that optionally plant cultures featuring a particular type of plant cell may be originally derived from a plurality of different types of such plant cells.

Any commercially or scientifically valuable plant is envisaged in accordance with these embodiments of the invention. Plants that are particularly useful in the methods of the invention include all plants which belong to the super family Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis*, *Albizia amara*, *Alsophila tricolor*, *Andropogon* spp., *Arachis* spp, *Areca catechu*, *Astelia fragrans*, *Astragalus cicer*, *Baikiaea plurijuga*, *Betula* spp., *Brassica* spp., *Bruguiera gymnorrhiza*, *Burkea africana*, *Butea frondosa*, *Cadaba farinosa*, *Calliandra* spp, *Camellia sinensis*, *Canna indica*, *Capsicum* spp., *Cassia* spp., *Centroema pubescens*, *Chacoomeles* spp., *Cinnamomum cassia*, *Coffea arabica*, *Colophospermum mopane*, *Coronillia varia*, *Cotoneaster serotina*, *Crataegus* spp., *Cucumis* spp., *Cupressus* spp., *Cyathea dealbata*, *Cydonia oblonga*, *Cryptomeria japonica*, *Cymbopogon* spp., *Cynthea dealbata*, *Cydonia oblonga*, *Dalbergia monetaria*, *Davallia divaricata*, *Desmodium* spp., *Dicksonia squarosa*, *Dibeteropogon amplectens*, *Dioclea* spp, *Dolichos* spp., *Dorycnium* rectum, *Echinochloa pyramidalis*, *Ehraffia* spp., *Eleusine coracana*, *Eragrestis* spp., *Erythrina* spp., *Eucalyptus* spp., *Euclea schimperi*, *Eulalia vi/losa*, *Pagopyrum* spp., *Feijoa sellowlana*, *Fragaria* spp., *Flemingia* spp, *Freycinetia banksli*, *Geranium thunbergii*, *GinAgo biloba*, *Glycine javanica*, *Gliricidia* spp, *Gossypium hirsutum*, *Grevillea* spp., *Guibourtia coleosperma*, *Hedysarum* spp., *Hemaffhia altissima*, *Heteropogon contoffus*, *Hordeum vulgare*, *Hyparrhenia rufa*, *Hypericum erectum*, *Hypeffhelia dissolute*, *Indigo incamata*, *Iris* spp., *Leptarrhena pyrolifolia*, *Lespediza* spp., *Lettuca* spp., *Leucaena leucocephala*, *Loudetia simplex*, *Lotonus bainesli*, *Lotus* spp., *Macrotyloma axillare*, *Malus* spp., *Manihot esculenta*, *Medicago saliva*, *Metasequoia glyptostroboides*, *Musa sapientum*, *Nicotianum* spp., *Onobrychis* spp., *Ornithopus* spp., *Oryza* spp., *Peltophorum africanum*, *Pennisetum* spp., *Persea gratissima*, *Petunia* spp., *Phaseolus* spp., *Phoenix canariensis*, *Phormium cookianum*, *Photinia* spp., *Picea glauca*, *Pinus* spp., *Pisum sativam*, *Podocarpus totara*, *Pogonarthria fleckii*, *Pogonaffhria squarrosa*, *Populus* spp., *Prosopis cineraria*, *Pseudotsuga menziesii*, *Pterolobium stellatum*, *Pyrus communis*, *Quercus* spp., *Rhaphiolepsis umbellata*, *Rhopalostylis sapida*, *Rhus natalensis*, *Ribes grossularia*, *Ribes* spp., *Robinia pseudoacacia*, *Rosa* spp., *Rubus* spp., *Salix* spp., *Schyzachyrium sanguineum*, *Sciadopitys vefficillata*, *Sequoia sempervirens*, *Sequoiadendron giganteum*, *Sorghum bicolor*, *Spinacia* spp., *Sporobolus fimbriatus*, *Stiburus alopecuroides*, *Stylosanthos humilis*, *Tadehagi* spp, *Taxodium distichum*, *Themeda triandra*, *Trifolium* spp., *Triticum* spp., *Tsuga heterophylla*, *Vaccinium* spp., *Vicia* spp., *Vitis vinifera*, *Watsonia pyramidata*, *Zantedeschia aethiopica*, *Zea mays*, amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barely, rye, oat, peanut, pea, lentil and alfalfa, cotton, rapeseed, canola, pepper, sunflower, tobacco, eggplant, *eucalyptus*, a tree, an ornamental plant, a perennial grass and a forage crop. Alternatively algae and other non-Viridiplantae can be used for the methods of the present invention.

According to some embodiments of the invention, the plant used by the method of the invention is a crop plant including, but not limited to, cotton, *Brassica* vegetables, oilseed rape, sesame, olive tree, palm oil, banana, wheat, corn or maize, barley, alfalfa, peanuts, sunflowers, rice, oats, sugarcane, soybean, turf grasses, barley, rye, *sorghum*, sugar cane, chicory, lettuce, tomato, zucchini, bell pepper, eggplant, cucumber, melon, watermelon, beans, hibiscus, okra, apple, rose, strawberry, chile, garlic, pea, lentil, canola, mums, *arabidopsis*, broccoli, cabbage, beet, *quinoa*, spinach, squash, onion, leek, tobacco, potato, sugarbeet, *papaya*, pineapple, mango, *Arabidopsis thaliana*, and also plants used in horticulture, floriculture or forestry, such as, but not limited to, poplar, fir, *eucalyptus*, pine, an ornamental plant, a perennial grass and a forage crop, coniferous plants, moss, algae, as well as other plants listed in World Wide Web (dot) nationmaster (dot) com/encyclopedia/Plantae.

According to a specific embodiment of the present invention, the plant comprises corn.

According to a specific embodiment of the present invention, the plant comprises *sorghum*.

As used herein, the phrase "exogenous polynucleotide" refers to a heterologous nucleic acid sequence or amino acid sequence which may not be naturally expressed within the plant or which overexpression in the plant is desired. The exogenous polynucleotide may be introduced into the plant in a stable or transient manner, so as to produce a ribonucleic acid (RNA) molecule or a polypeptide. It should be noted that the exogenous polynucleotide may comprise a nucleic acid sequence which is identical or partially homologous to an endogenous nucleic acid sequence of the plant.

A "transgenic plant" refers to a plant that has incorporated a nucleic acid sequence (i.e., polynucleotides encoding target genes or a silencing polynucleotide), including but not limited to genes that are not normally present in a host plant genome, nucleic acid sequences not normally transcribed into RNA, or any other genes or nucleic acid sequences that one desires to exogenously introduce into the wild-type plant, such as genes that normally may be present in the wild-type plant (control) but that one desires either to genetically engineer or to have altered expression.

Also contemplated are hybrids of the above described transgenic plants. A "hybrid plant" refers to a plant or a part thereof resulting from a cross between two parent plants, wherein one parent is a genetically engineered plant of the invention (transgenic plant expressing the polypeptides of the present invention). Such a cross can occur naturally by, for example, sexual reproduction, or artificially by, for example, in vitro nuclear fusion. Methods of plant breeding are well-known and within the level of one of ordinary skill in the art of plant biology.

The terms siRNA and miRNA are collectively referred to herein as RNA interfering molecules (RNAi).

As used herein, the phrase "siRNA" (also referred to herein interchangeably as "small interfering RNA" or "silencing RNA", is a class of double-stranded RNA molecules, 20-25 nucleotides in length. The most notable role of siRNA is its involvement in the RNA interference (RNAi) pathway, where it interferes with the expression of a specific gene.

The siRNA precursor relates to a long dsRNA structure (at least 90% complementarity) of at least 30 bp.

As used herein, the phrase "microRNA (also referred to herein interchangeably as "miRNA" or "miR") or a precursor thereof" refers to a microRNA (miRNA) molecule acting as a post-transcriptional regulator. Typically, the miRNA molecules are RNA molecules of about 20 to 22 nucleotides in length which can be loaded into a RISC complex and which direct the cleavage of another RNA molecule, wherein the other RNA molecule comprises a nucleotide sequence essentially complementary to the nucleotide sequence of the miRNA molecule.

Typically, a miRNA molecule is processed from a "pre-miRNA" or as used herein a precursor of a pre-miRNA molecule by proteins, such as DCL proteins, present in any plant cell and loaded onto a RISC complex where it can guide the cleavage of the target RNA molecules.

Pre-microRNA molecules are typically processed from pri-microRNA molecules (primary transcripts). The single stranded RNA segments flanking the pre-microRNA are important for processing of the pri-miRNA into the pre-miRNA. The cleavage site appears to be determined by the distance from the stem-ssRNA junction (Han et al. 2006, Cell 125, 887-901, 887-901).

As used herein, a "pre-miRNA" molecule is an RNA molecule of about 100 to about 200 nucleotides, preferably about 100 to about 130 nucleotides which can adopt a secondary structure comprising a double stranded RNA stem and a single stranded RNA loop (also referred to as "hairpin") and further comprising the nucleotide sequence of the miRNA (and its complement sequence) in the double stranded RNA stem. According to a specific embodiment, the miRNA and its complement are located about 10 to about 20 nucleotides from the free ends of the miRNA double stranded RNA stem. The length and sequence of the single stranded loop region are not critical and may vary considerably, e.g. between 30 and 50 nt in length. The complementarity between the miRNA and its complement need not be perfect and about 1 to 3 bulges of unpaired nucleotides can be tolerated. The secondary structure adopted by an RNA molecule can be predicted by computer algorithms conventional in the art such as mFOLD. The particular strand of the double stranded RNA stem from the pre-miRNA which is released by DCL activity and loaded onto the RISC complex is determined by the degree of complementarity at the 5' end, whereby the strand which at its 5' end is the least involved in hydrogen bounding between the nucleotides of the different strands of the cleaved dsRNA stem is loaded onto the RISC complex and will determine the sequence specificity of the target RNA molecule degradation. However, if empirically the miRNA molecule from a particular synthetic pre-miRNA molecule is not functional (because the "wrong" strand is loaded on the RISC complex), it will be immediately evident that this problem can be solved by exchanging the position of the miRNA molecule and its complement on the respective strands of the dsRNA stem of the pre-miRNA molecule. As is known in the art, binding between A and U involving two hydrogen bounds, or G and U involving two hydrogen bounds is less strong that between G and C involving three hydrogen bounds. Exemplary siRNA sequences or precursors thereof as well as hairpin sequences and miRNA sequences are provided in Tables 1-4, below.

The tables provided in the Examples section are to be considered an integral part of the specification.

As used herein a "target gene" refers to a gene that is processed by microRNA activity. Typically the gene encodes a polypeptide which expression is downregulated due to microRNA processing.

Target genes are typically identified using the WMD3 website (http://wmd3dotweigelworlddotorg/).

As mentioned, the method of the present invention is effected by expressing within a plant an exogenous polynucleotide encoding a target gene of the RNA interfering molecules uncovered by the present inventors, as explained below.

As used herein, the phrase "expressing within the plant an exogenous polynucleotide" refers to upregulating the expression level of an exogenous polynucleotide within the plant e.g., by introducing the exogenous polynucleotide into a plant or plant cell and expressing by recombinant means, as described in detail hereinbelow.

As used herein "expressing" refers to expression at the mRNA level (e.g., in case the target gene expresses an mRNA product but no protein) or at the polypeptide level of the desired exogenous polynucleotide.

As used herein, the phrase "exogenous polynucleotide" refers to a heterologous nucleic acid sequence which may not be naturally expressed within the plant or which overexpression in the plant is desired (i.e., overexpression of an endogenous gene). The exogenous polynucleotide may be introduced into the plant in a stable or transient manner, so as to produce a ribonucleic acid (RNA) molecule and/or a polypeptide molecule. The exogenous polynucleotide may comprise a nucleic acid sequence which is identical or partially homologous to an endogenous nucleic acid sequence expressed within the plant.

The term "endogenous" as used herein refers to any polynucleotide or polypeptide which is present and/or naturally expressed within a plant or a cell thereof.

As used herein the term "polynucleotide" refers to a single or double stranded nucleic acid sequence which is isolated and provided in the form of an RNA sequence, a complementary polynucleotide sequence (cDNA), a genomic polynucleotide sequence (e.g. sequence isolated from a chromosome) and/or a composite polynucleotide sequences (e.g., a combination of the above). This term includes polynucleotides and/or oligonucleotides derived from naturally occurring nucleic acid molecules (e.g., RNA or DNA), synthetic polynucleotide and/or oligonucleotide molecules composed of naturally occurring bases, sugars, and covalent internucleoside linkages (e.g., backbone), as well as synthetic polynucleotides and/or oligonucleotides having non-naturally occurring portions, which function similarly to the respective naturally occurring portions.

The term "isolated" refers to at least partially separated from the natural environment e.g., from a plant cell.

Nucleic acid sequences of the polypeptides of some embodiments of the invention may be optimized for expression in a specific plant host. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N [(Xn-Yn)/Yn]2/N, where Xn refers to the frequency of usage of codon n in highly expressed plant genes, where Yn to the frequency of usage of codon n in the gene of interest and N refers to the total number of codons in the gene of interest. A table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization tables such as those provided on-line at the Codon Usage Database through the NIAS (National Institute of Agrobiological Sciences) DNA bank in Japan (wwwdotkazusadotor-dotjp/codon/). The Codon Usage Database contains codon usage tables for a number of different species, with each codon usage table having been statistically determined based on the data present in Genbank.

By using the above tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

Target genes which are contemplated according to the present teachings are provided in the polynucleotide sequences which comprise nucleic acid sequences as set forth in SEQ ID NO: 1392-1646, 1655-1888, 1911-1938, 3082-3316. However the present teachings also relate to orthologs or homologs at least about 60%, at least about 65%, at least about 70%, at least about 75%, at least about 80%, at least about 85%, at least about 90%, or at least about 95% or more identical or similar to SEQ ID NO: 1392-1646, 1655-1888, 1911-1938, 3082-3316. Parameters for determining the level of identity are provided hereinbelow.

Alternatively or additionally, target genes which are contemplated according to the present teachings are provided in the polypeptide sequences which comprise amino acid sequences as set forth in SEQ ID NO: 687-981, 992-1248, 1281-1310, 1389-1391, and 2806-3081 (Tables 6 and 8). However the present teachings also relate to of orthologs or homologs at least about 60%, at least about 65%, at least about 70%, at least about 75%, at least about 80%, at least about 85%, at least about 90%, or at least about 95% or more identical or similar to SEQ ID NO: 687-981, 992-1248, 1281-1310, 1389-1391, and 2806-3081 (Tables 6 and 8).

Homology (e.g., percent homology, identity+similarity) can be determined using any homology comparison software, including for example, the TBLASTN software of the National Center of Biotechnology Information (NCBI) such as by using default parameters, when starting from a polypeptide sequence; or the tBLASTX algorithm (available via the NCBI) such as by using default parameters, which compares the six-frame conceptual translation products of a nucleotide query sequence (both strands) against a protein sequence database.

According to some embodiments of the invention, the term "homology" or "homologous" refers to identity of two or more nucleic acid sequences; or identity of two or more amino acid sequences.

Homologous sequences include both orthologous and paralogous sequences. The term "paralogous" relates to gene-duplications within the genome of a species leading to paralogous genes. The term "orthologous" relates to homologous genes in different organisms due to ancestral relationship.

One option to identify orthologues in monocot plant species is by performing a reciprocal blast search. This may be done by a first blast involving blasting the sequence-of-interest against any sequence database, such as the publicly available NCBI database which may be found at: Hypertext Transfer Protocol://World Wide Web (dot) ncbi (dot) nlm (dot) nih (dot) gov. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a paralogue (homolog to a gene in the same organism) is found. In case of large sequence families, the ClustalW program may be used [Hypertext Transfer Protocol://World Wide Web (dot) ebi (dot) ac (dot) uk/Tools/clustalw2/index (dot) html], followed by a neighbor-joining tree (Hypertext Transfer Protocol://en (dot) wikipedia (dot) org/wiki/Neighbor-joining) which helps visualizing the clustering.

As mentioned the present inventors have also identified genes which down-regulation thereof may be done in order to improve their NUE, biomass, vigor, yield and abiotic stress tolerance.

Thus, according to an aspect of the invention there is provided a method of improving nitrogen use efficiency, abiotic stress tolerance, biomass, vigor or yield of a plant, the method comprising expressing within the plant an exogenous polynucleotide which downregulates an activity or expression of a polypeptide having an amino acid sequence at least 80%, 85%, 90%, 95%, or 100% homologous or identical to SEQ ID NOs: 311-514, 2007-2436, 1311-1320, 982-991, 1249-1280, 1321-1388 (Tables 5, 7 and 9), wherein the polypeptide is capable of regulating nitrogen use efficiency of the plant, thereby improving nitrogen use efficiency, abiotic stress tolerance, biomass, vigor or yield of the plant.

Down regulation of activity or expression is by at least 10%, 20%, 30%, 40%, 50%, 60%, 70%, 80%, 90% or even complete (100%) loss of activity or expression. Assays for measuring gene expression can be effected at the protein level (e.g., Western blot, ELISA) or at the mRNA level such as by RT-PCR.

According to a specific embodiment the amino acid sequence of the target gene is as set forth in SEQ ID NOs: 311-514, 2007-2436, 1311-1320, 982-991, 1249-1280, 1321-1388 of Tables 5, 7 and 9.

Alternatively or additionally, the amino acid sequence of the target gene is encoded by a polynucleotide sequence as set forth in SEQ ID NOs: 515-686, 2437-2805, 1939-1948, 1647-1654, 1889-1910, 1949-2004 of Tables 5, 7 and 9.

Examples of polynucleotide downregulating agents that inhibit (also referred to herein as inhibitors or nucleic acid agents) the expression of a target gene are given below.

1. Polynucleotide-Based Inhibition of Gene Expression.

It will be appreciated, that any of these methods when specifically referring to downregulating expression/activity of the target genes can be used, at least in part, to downregulate expression or activity of endogenous RNA molecules.

i. Sense Suppression/Cosuppression

In some embodiments of the invention, inhibition of the expression of target gene may be obtained by sense suppression or cosuppression. For cosuppression, an expression cassette is designed to express an RNA molecule corresponding to all or part of a messenger RNA encoding a target gene in the "sense" orientation. Over-expression of the RNA molecule can result in reduced expression of the native gene. Accordingly, multiple plant lines transformed with the cosuppression expression cassette are screened to identify those that show the greatest inhibition of target gene expression.

The polynucleotide used for cosuppression may correspond to all or part of the sequence encoding the target gene, all or part of the 5' and/or 3' untranslated region of a target transcript, or all or part of both the coding sequence and the untranslated regions of a transcript encoding the target gene. In some embodiments where the polynucleotide comprises all or part of the coding region for the target gene, the expression cassette is designed to eliminate the start codon of the polynucleotide so that no protein product will be transcribed.

Cosuppression may be used to inhibit the expression of plant genes to produce plants having undetectable protein levels for the proteins encoded by these genes. See, for example, Broin, et al., (2002) Plant Cell 15:1517-1532. Cosuppression may also be used to inhibit the expression of multiple proteins in the same plant. Methods for using cosuppression to inhibit the expression of endogenous genes in plants are described in Flavell, et al., (1995) Proc. Natl. Acad. Sci. USA 91:3590-3596; Jorgensen, et al., (1996) Plant Mol. Biol. 31:957-973; Johansen and Carrington, (2001) Plant Physiol. 126:930-938; Broin, et al., (2002) Plant Cell 15:1517-1532; Stoutjesdijk, et al., (2002) Plant Physiol. 129:1723-1731; Yu, et al., (2003) Phytochemistry 63:753-763; and U.S. Pat. Nos. 5,035,323, 5,283,185 and 5,952,657; each of which is herein incorporated by reference. The efficiency of cosuppression may be increased by including a poly-dt region in the expression cassette at a position 3' to the sense sequence and 5' of the polyadenylation signal. See, US Patent Publication Number 20020058815, herein incorporated by reference. Typically, such a nucleotide sequence has substantial sequence identity to the sequence of the transcript of the endogenous gene, optimally greater than about 65% sequence identity, more optimally greater than about 85% sequence identity, most optimally greater than about 95% sequence identity. See, U.S. Pat. Nos. 5,283,185 and 5,035,323; herein incorporated by reference.

Transcriptional gene silencing (TGS) may be accomplished through use of hpRNA constructs wherein the inverted repeat of the hairpin shares sequence identity with the promoter region of a gene to be silenced. Processing of the hpRNA into short RNAs which can interact with the homologous promoter region may trigger degradation or methylation to result in silencing. (Aufsatz, et al., (2002) PNAS 99(4):16499-16506; Mette, et al., (2000) EMBO J. 19(19):5194-5201), ii. Antisense Suppression In some embodiments of the invention, inhibition of the expression of the target gene may be obtained by antisense suppression. For antisense suppression, the expression cassette is designed to express an RNA molecule complementary to all or part of a messenger RNA encoding the target gene. Over-expression of the antisense RNA molecule can result in reduced expression of the native gene. Accordingly, multiple plant lines transformed with the antisense suppression expression cassette are screened to identify those that show the greatest inhibition of target gene expression.

The polynucleotide for use in antisense suppression may correspond to all or part of the complement of the sequence encoding the target gene, all or part of the complement of the 5' and/or 3' untranslated region of the target gene transcript, or all or part of the complement of both the coding sequence and the untranslated regions of a transcript encoding the target gene. In addition, the antisense polynucleotide may be fully complementary (i.e., 100% identical to the complement of the target sequence) or partially complementary (i.e., less than 100% identical to the complement of the target sequence) to the target sequence. Antisense suppression may be used to inhibit the expression of multiple proteins in the same plant. Furthermore, portions of the antisense nucleotides may be used to disrupt the expression of the target gene. Generally, sequences of at least 50 nucleotides, 100 nucleotides, 200 nucleotides, 300, 500, 550, 500, 550 or greater may be used. Methods for using antisense suppression to inhibit the expression of endogenous genes in plants are described, for example, in Liu, et al., (2002) Plant Physiol. 129:1732-1753 and U.S. Pat. No. 5,759,829, which is herein incorporated by reference. Efficiency of antisense suppression may be increased by including a poly-dt region in the expression cassette at a position 3' to the antisense sequence and 5' of the polyadenylation signal. See, US Patent Publication Number 20020058815.

iii. Double-Stranded RNA Interference

In some embodiments of the invention, inhibition of the expression of a target gene may be obtained by double-stranded RNA (dsRNA) interference. For dsRNA interference, a sense RNA molecule like that described above for cosuppression and an antisense RNA molecule that is fully or partially complementary to the sense RNA molecule are expressed in the same cell, resulting in inhibition of the expression of the corresponding endogenous messenger RNA.

Expression of the sense and antisense molecules can be accomplished by designing the expression cassette to comprise both a sense sequence and an antisense sequence. Alternatively, separate expression cassettes may be used for the sense and antisense sequences. Multiple plant lines transformed with the dsRNA interference expression cassette or expression cassettes are then screened to identify plant lines that show the greatest inhibition of target gene expression. Methods for using dsRNA interference to inhibit the expression of endogenous plant genes are described in Waterhouse, et al., (1998) Proc. Natl. Acad. Sci. USA 95:13959-13965, Liu, et al., (2002) Plant Physiol. 129:1732-1753, and WO 99/59029, WO 99/53050, WO 99/61631, and WO 00/59035, iv. Hairpin RNA Interference and Intron-Containing Hairpin RNA Interference In some embodiments of the invention, inhibition of the expression of one or more target gene may be obtained by hairpin RNA (hpRNA) interference or intron-containing hairpin RNA (ihpRNA) interference. These methods are highly efficient at downregulating the expression of endogenous genes. See, Waterhouse and Helliwell, (2003) Nat. Rev. Genet. 5:29-38 and the references cited therein.

For hpRNA interference, the expression cassette is designed to express an RNA molecule that hybridizes with itself to form a hairpin structure that comprises a single-stranded loop region and a base-paired stem. The base-paired stem region comprises a sense sequence corresponding to all or part of the endogenous messenger RNA encoding the gene whose expression is to be inhibited, and an antisense sequence that is fully or partially complementary to the sense sequence. Thus, the base-paired stem region of the molecule generally determines the specificity of the RNA interference. hpRNA molecules are highly efficient at inhibiting the expression of endogenous genes, and the RNA interference they induce is inherited by subsequent generations of plants. See, for example, Chuang and Meyerowitz, (2000) Proc. Natl. Acad. Sci. USA 97:5985-5990; Stoutjesdijk, et al., (2002) Plant Physiol. 129:1723-1731; and Waterhouse and Helliwell, (2003) Nat. Rev. Genet. 5:29-38. Methods for using hpRNA interference to inhibit or silence the expression of genes are described, for example, in Chuang and Meyerowitz, (2000) Proc. Natl. Acad. Sci. USA 97:5985-5990; Stoutjesdijk, et al., (2002) Plant Physiol. 129:1723-1731; Waterhouse and Helliwell, (2003) Nat. Rev. Genet. 5:29-38; Pandolfini, et al., BMC Biotechnology 3:7, and US Patent Publication Number 20030175965; each of which is herein incorporated by reference. A transient assay for the efficiency of hpRNA constructs to silence gene expression in vivo has been described by Panstruga, et al., (2003) Mol. Biol. Rep. 30:135-150, herein incorporated by reference.

ForihpRNA, the interfering molecules have the same general structure as for hpRNA, but the RNA molecule additionally comprises an intron that is capable of being spliced in the cell in which the ihpRNA is expressed. The use of an intron minimizes the size of the loop in the hairpin RNA molecule following splicing, and this increases the efficiency of interference. See, for example, Smith, et al., (2000) Nature 507:319-320. In fact, Smith, et al., show 100% suppression of endogenous gene expression using ihpRNA-mediated interference. Methods for using ihpRNA interference to inhibit the expression of endogenous plant genes are described, for example, in Smith, et al., (2000)

Nature 507:319-320; Wesley, et al., (2001) Plant J. 27:581-590; Wang and Waterhouse, (2001) Curr. Opin. Plant Biol. 5:156-150; Waterhouse and Helliwell, (2003) Nat. Rev. Genet. 5:29-38; Helliwell and Waterhouse, (2003) Methods 30:289-295, and US Patent Publication Number 20030180955, each of which is herein incorporated by reference.

The expression cassette for hpRNA interference may also be designed such that the sense sequence and the antisense sequence do not correspond to an endogenous RNA. In this embodiment, the sense and antisense sequence flank a loop sequence that comprises a nucleotide sequence corresponding to all or part of the endogenous messenger RNA of the target gene. Thus, it is the loop region that determines the specificity of the RNA interference. See, for example, WO 02/00905, herein incorporated by reference.

v. Amplicon-Mediated Interference

Amplicon expression cassettes comprise a plant virus-derived sequence that contains all or part of the target gene but generally not all of the genes of the native virus. The viral sequences present in the transcription product of the expression cassette allow the transcription product to direct its own replication. The transcripts produced by the amplicon may be either sense or antisense relative to the target sequence (i.e., the messenger RNA for target gene). Methods of using amplicons to inhibit the expression of endogenous plant genes are described, for example, in Angell and Baulcombe, (1997) EMBO J. 16:3675-3685, Angell and Baulcombe, (1999) Plant J. 20:357-362, and U.S. Pat. No. 6,656,805, each of which is herein incorporated by reference.

vi. Ribozymes

In some embodiments, the polynucleotide expressed by the expression cassette of the invention is catalytic RNA or has ribozyme activity specific for the messenger RNA of target gene. Thus, the polynucleotide causes the degradation of the endogenous messenger RNA, resulting in reduced expression of the target gene. This method is described, for example, in U.S. Pat. No. 5,987,071, herein incorporated by reference.

2. Gene Disruption

In some embodiments of the present invention, the activity of a miRNA or a target gene is reduced or eliminated by disrupting the gene encoding the target polypeptide. The gene encoding the target polypeptide may be disrupted by any method known in the art. For example, in one embodiment, the gene is disrupted by transposon tagging. In another embodiment, the gene is disrupted by mutagenizing plants using random or targeted mutagenesis, and selecting for plants that have reduced response regulator activity.

Any of the nucleic acid agents described herein (for overexpression or downregulation) can be provided to the plant as naked RNA or expressed from a nucleic acid expression construct, where it is operaly linked to a regulatory sequence.

According to a specific embodiment of the invention, there is provided a nucleic acid construct comprising a nucleic acid sequence (a polynucleotide) encoding the RNAi target polypeptide or the nucleic acid agent for downregulating the expression of the target gene, the nucleic acid sequence being under a transcriptional control a cis-acting regulatory element.

Exemplary nucleic acid constructs which can be used for plant transformation include, but are not limited to, pORE156, pORE164, pORE167 and pORE169, which are all constructed by ligating the appropriate DNA fragments into the pORE E2 binary vector (Accession number: AY562535, FIG. 1) under the transcriptional control of a promoter.

A coding nucleic acid sequence is "operably linked" or "transcriptionally linked to a regulatory sequence (e.g., promoter)" if the regulatory sequence is capable of exerting a regulatory effect on the coding sequence linked thereto. Thus the regulatory sequence controls the transcription of the target polynucleotide.

The term "regulatory sequence", as used herein, means any DNA, that is involved in driving transcription and controlling (i.e., regulating) the timing and level of transcription of a given DNA sequence, such as a DNA coding for the target polypeptide, as described above. For example, a 5' regulatory region (or "promoter region") is a DNA sequence located upstream (i.e., 5') of a coding sequence and which comprises the promoter and the 5'-untranslated leader sequence. A 3' regulatory region is a DNA sequence located downstream (i.e., 3') of the coding sequence and which comprises suitable transcription termination (and/or regulation) signals, including one or more polyadenylation signals.

For the purpose of the invention, the promoter is a plant-expressible promoter. As used herein, the term "plant-expressible promoter" means a DNA sequence which is capable of controlling (initiating) transcription in a plant cell. This includes any promoter of plant origin, but also any promoter of non-plant origin which is capable of directing transcription in a plant cell, i.e., certain promoters of viral or bacterial origin Thus, any suitable promoter sequence can be used by the nucleic acid construct of the present invention. According to some embodiments of the invention, the promoter is a constitutive promoter, a tissue-specific promoter or an inducible promoter (e.g. an abiotic stress-inducible promoter).

Suitable constitutive promoters include, for example, hydroperoxide lyase (HPL) promoter, CaMV 35S promoter (Odell et al, Nature 313:810-812, 1985); Arabidopsis At6669 promoter (see PCT Publication No. WO04081173A2); Arabidopsis new At6669 promoter; maize Ubi 1 (Christensen et al., Plant Sol. Biol. 18:675-689, 1992); rice actin (McElroy et al., Plant Cell 2:163-171, 1990); pEMU (Last et al, Theor. Appl. Genet. 81:581-588, 1991); CaMV 19S (Nilsson et al, Physiol. Plant 100:456-462, 1997); GOS2 (de Pater et al, Plant J November; 2(6):837-44, 1992); ubiquitin (Christensen et al, Plant MoI. Biol. 18: 675-689, 1992); Rice cyclophilin (Bucholz et al, Plant MoI Biol. 25(5):837-43, 1994); Maize H3 histone (Lepetit et al, MoI. Gen. Genet. 231: 276-285, 1992); Actin 2 (An et al, Plant J. 10(1);107-121, 1996) and Synthetic Super MAS (Ni et al., The Plant Journal 7: 661-76, 1995). Other constitutive promoters include those in U.S. Pat. Nos. 5,659,026, 5,608,149; 5,608,144; 5,604,121; 5,569,597; 5,466,785; 5,399,680; 5,268,463; and 5,608,142.

Suitable tissue-specific promoters include, but not limited to, leaf-specific promoters [such as described, for example, by Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant MoI. Biol. 23:1129-1138, 1993; and Matsuoka et al., Proc. Natl. Acad. Sci. USA 90:9586-9590, 1993], seed-preferred promoters [e.g., from seed specific genes (Simon, et al., Plant MoI. Biol. 5. 191, 1985; Scofield, et al., J. Biol. Chem. 262: 12202, 1987; Baszczynski, et al., Plant MoI. Biol. 14: 633, 1990), Brazil Nut albumin (Pearson' et al., Plant MoI. Biol. 18: 235-245, 1992), legumin (Ellis, et al. Plant MoI. Biol. 10: 203-214, 1988), Glutelin (rice) (Takaiwa, et al., MoI. Gen. Genet.

208: 15-22, 1986; Takaiwa, et al., FEBS Letts. 221: 43-47, 1987), Zein (Matzke et al., Plant MoI Biol, 143)323-32 1990), napA (Stalberg, et al., Planta 199: 515-519, 1996), Wheat SPA (Albani et al, Plant Cell, 9: 171-184, 1997), sunflower oleosin (Cummins, et al, Plant MoI. Biol. 19: 873-876, 1992)], endosperm specific promoters [e.g., wheat LMW and HMW, glutenin-1 (MoI Gen Genet 216:81-90, 1989; NAR 17:461-2), wheat a, b and g gliadins (EMBO3: 1409-15, 1984), Barley ltrl promoter, barley Bl, C, D hordein (Theor Appl Gen 98:1253-62, 1999; Plant J 4:343-55, 1993; MoI Gen Genet 250:750-60, 1996), Barley DOF (Mena et al., The Plant Journal, 116(1): 53-62, 1998), Biz2 (EP99106056.7), Synthetic promoter (Vicente-Carbajosa et al., Plant J. 13: 629-640, 1998), rice prolamin NRP33, rice-globulin GIb-I (Wu et al., Plant Cell Physiology 39(8) 885-889, 1998), rice alpha-globulin REB/OHP-1 (Nakase et al. Plant MoI. Biol. 33: 513-S22, 1997), rice ADP-glucose PP (Trans Res 6:157-68, 1997), maize ESR gene family (Plant J 12:235-46, 1997), *sorghum* gamma-kafirin (PMB 32:1029-35, 1996); e.g., the Napin promoter], embryo specific promoters [e.g., rice OSH1 (Sato et al, Proc. Natl. Acad. Sci. USA, 93: 8117-8122), KNOX (Postma-Haarsma et al, Plant MoI. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant MoI. Biol. 15, 95-109, 1990), LAT52 (Twell et al., MoI. Gen Genet. 217:240-245; 1989), apetala-3]. Also contemplated are root-specific promoters such as the ROOTP promoter described in Vissenberg K, et al. Plant Cell Physiol. 2005 January; 46(1):192-200.

The nucleic acid construct of some embodiments of the invention can further include an appropriate selectable marker and/or an origin of replication.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, L, Annu. Rev. Plant. Physiol, Plant. MoI. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer (e.g., T-DNA using *Agrobacterium tumefaciens* or *Agrobacterium rhizogenes*); see for example, Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S, and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

According to a specific embodiment of the present invention, the exogenous polynucleotide is introduced into the plant by infecting the plant with a bacteria, such as using a floral dip transformation method (as described in further detail in Example 5, of the Examples section which follows).

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. For this reason it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

Although stable transformation is presently preferred, transient transformation of leaf cells, meristematic cells or the whole plant is also envisaged by the present invention.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261. According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Galon et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Tatlor, Eds. "Plant Virology Protocols: From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al, Virology (1989) 172: 285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat proteins which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral nucleic acid is provided in which the native coat protein coding sequence has been deleted from a viral nucleic acid, a non-native plant viral coat protein coding sequence and a non-native promoter, preferably the subgenomic promoter of the non-native coat protein coding sequence, capable of expression in the plant host, packaging of the recombinant plant viral nucleic acid, and ensuring a systemic infection of the host by the recombinant plant viral nucleic acid, has been inserted. Alternatively, the coat protein gene may be inactivated by insertion of the non-native nucleic acid sequence within it, such that a protein is produced. The recombinant plant viral nucleic acid may contain one or more additional non-native subgenomic promoters. Each non-native subgenomic promoter is capable of transcribing or expressing adjacent genes or nucleic acid sequences in the plant host and incapable of recombination with each other and with native subgenomic promoters. Non-native (foreign) nucleic acid sequences may be inserted adjacent the native plant viral subgenomic promoter or the native and a non-native plant viral subgenomic promoters if more than one nucleic acid sequence is included. The non-native nucleic acid sequences are transcribed or expressed in the host plant under control of the subgenomic promoter to produce the desired products.

In a second embodiment, a recombinant plant viral nucleic acid is provided as in the first embodiment except that the native coat protein coding sequence is placed adjacent one of the non-native coat protein subgenomic promoters instead of a non-native coat protein coding sequence.

In a third embodiment, a recombinant plant viral nucleic acid is provided in which the native coat protein gene is adjacent its subgenomic promoter and one or more non-native subgenomic promoters have been inserted into the viral nucleic acid. The inserted non-native subgenomic promoters are capable of transcribing or expressing adjacent genes in a plant host and are incapable of recombination with each other and with native subgenomic promoters. Non-native nucleic acid sequences may be inserted adjacent the non-native subgenomic plant viral promoters such that the sequences are transcribed or expressed in the host plant under control of the subgenomic promoters to produce the desired product.

In a fourth embodiment, a recombinant plant viral nucleic acid is provided as in the third embodiment except that the native coat protein coding sequence is replaced by a non-native coat protein coding sequence.

The viral vectors are encapsidated by the coat proteins encoded by the recombinant plant viral nucleic acid to produce a recombinant plant virus. The recombinant plant viral nucleic acid or recombinant plant virus is used to infect appropriate host plants. The recombinant plant viral nucleic acid is capable of replication in the host, systemic spread in the host, and transcription or expression of foreign gene(s) (isolated nucleic acid) in the host to produce the desired protein.

In addition to the above, the nucleic acid molecule of the present invention can also be introduced into a chloroplast genome thereby enabling chloroplast expression.

A technique for introducing exogenous nucleic acid sequences to the genome of the chloroplasts is known. This technique involves the following procedures. First, plant cells are chemically treated so as to reduce the number of chloroplasts per cell to about one. Then, the exogenous nucleic acid is introduced via particle bombardment into the cells with the aim of introducing at least one exogenous nucleic acid molecule into the chloroplasts. The exogenous nucleic acid is selected such that it is integratable into the chloroplast's genome via homologous recombination which is readily effected by enzymes inherent to the chloroplast. To this end, the exogenous nucleic acid includes, in addition to a gene of interest, at least one nucleic acid stretch which is derived from the chloroplast's genome. In addition, the exogenous nucleic acid includes a selectable marker, which serves by sequential selection procedures to ascertain that all or substantially all of the copies of the chloroplast genomes following such selection will include the exogenous nucleic acid. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

Since NUE, abiotic stress tolerance as well as yield, vigor or biomass of the plant can involve multiple genes acting additively or in synergy (see, for example, in Quesda et al., Plant Physiol. 130:951-063, 2002), the invention also envisages expressing a plurality of exogenous polynucleotides in a single host plant to thereby achieve superior effect on NUE, abiotic stress tolerance, yield, vigor and biomass of the plant.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove. Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides can be regenerated into a mature plant, using the methods described hereinabove.

Alternatively, expressing a plurality of exogenous polynucleotides can be effected by introducing different nucleic acid constructs, including different exogenous polynucleotides, into a plurality of plants. The regenerated transformed plants can then be cross-bred and resultant progeny selected for superior NUE, abiotic stress tolerance, yield as described above, using conventional plant breeding techniques.

As mentioned, expression (or reduction in a level of expression) of the target polynucleotides/polypeptides of the present invention can be qualified using methods which are well known in the art such as those involving gene amplification Western blotting, ELISA, or at the mRNA level involving e.g., PCR or RT-PCR or Northern blot or in-situ hybridization (in which one monitors the level of target gene expression).

According to some embodiments of the invention, the plant expressing the exogenous polynucleotide(s) is grown under stress (nitrogen or abiotic) or normal conditions (e.g., biotic conditions and/or conditions with sufficient water, nutrients such as nitrogen and fertilizer). Such conditions, which depend on the plant being grown, are known to those skilled in the art of agriculture, and are further, described above.

According to some embodiments of the invention, the method further comprises growing the plant expressing the exogenous polynucleotide(s) under abiotic stress or nitrogen limiting conditions. Non-limiting examples of abiotic stress conditions include, water deprivation, drought, excess of water (e.g., flood, waterlogging), freezing, low temperature, high temperature, strong winds, heavy metal toxicity, anaerobiosis, nutrient deficiency, nutrient excess, salinity, atmospheric pollution, intense light, insufficient light, or UV irradiation, etiolation and atmospheric pollution.

Thus, the invention encompasses plants exogenously expressing the polynucleotide(s), the nucleic acid constructs of the invention.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or determinants of a trait of interest (e.g., tolerance to abiotic stress). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides described hereinabove can be used in a wide range of economical plants, in a safe and cost effective manner.

Plant lines exogenously expressing the polynucleotide of the invention can be screened to identify those that show the greatest increase of the desired plant trait.

Thus, according to an additional embodiment of the present invention, there is provided a method of evaluating a trait of a plant, the method comprising: (a) expressing in a plant or a portion thereof the nucleic acid construct; and (b) evaluating a trait of a plant as compared to a wild type plant of the same type; thereby evaluating the trait of the plant.

Thus, the effect of the transgene (the exogenous polynucleotide) on different plant characteristics may be determined any method known to one of ordinary skill in the art.

Thus, for example, tolerance to limiting nitrogen conditions may be compared in transformed plants {i.e., expressing the transgene) compared to non-transformed (wild type) plants exposed to the same stress conditions (other stress conditions are contemplated as well, e.g. water deprivation, salt stress e.g. salinity, suboptimal temperature, osmotic stress, and the like), using the following assays.

Methods of qualifying plants as being tolerant or having improved tolerance to abiotic stress or limiting nitrogen levels are well known in the art and are further described hereinbelow.

Fertilizer use efficiency—To analyze whether the transgenic plants are more responsive to fertilizers, plants are grown in agar plates or pots with a limited amount of fertilizer, as described, for example, in Yanagisawa et al (Proc Natl Acad Sci USA. 2004; 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen use efficiency—To analyze whether the transgenic plants (e.g., *Arabidopsis* plants) are more responsive to nitrogen, plant are grown in 0.75-3 millimolar (mM, nitrogen deficient conditions) or 6-10 mM (optimal nitrogen concentration). Plants are allowed to grow for additional 25 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen Use efficiency assay using plantlets—The assay is done according to Yanagisawa-S. et al. with minor modifications ("Metabolic engineering with Dof1 transcription factor in plants: Improved nitrogen assimilation and growth under low-nitrogen conditions" Proc. Natl. Acad. Sci. USA 101, 7833-7838). Briefly, transgenic plants which are grown for 7-10 days in 0.5×MS [Murashige-Skoog] supplemented with a selection agent are transferred to two nitrogen-limiting conditions: MS media in which the combined nitrogen concentration ($NH_4NO_3$ and $KNO_3$) was 0.75 mM (nitrogen deficient conditions) or 6-15 mM (optimal nitrogen concentration). Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 20 seedlings (each one representing an independent transformation event) are carefully transferred to the nitrogen-limiting media. For constructs for which T2 seeds are available, different transformation events are analyzed. Usually, 20 randomly selected plants from each event are transferred to the nitrogen-limiting media allowed to grow for 3-4 additional weeks and individually weighed at the end of that period. Transgenic plants are compared to control plants grown in parallel under the same conditions. Mock-transgenic plants expressing the uidA reporter gene (GUS) under the same promoter or transgenic plants carrying the same promoter but lacking a reporter gene are used as control.

Nitrogen determination—The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 Agron. J. 98:168-176.

Tolerance to abiotic stress (e.g. tolerance to drought or salinity) can be evaluated by determining the differences in physiological and/or physical condition, including but not limited to, vigor, growth, size, or root length, or specifically, leaf color or leaf area size of the transgenic plant compared to a non-modified plant of the same species grown under the same conditions. Other techniques for evaluating tolerance to abiotic stress include, but are not limited to, measuring chlorophyll fluorescence, photosynthetic rates and gas exchange rates. Further assays for evaluating tolerance to abiotic stress are provided hereinbelow and in the Examples section which follows.

Drought tolerance assay—Soil-based drought screens are performed with plants overexpressing the polynucleotides detailed above. Seeds from control *Arabidopsis* plants, or other transgenic plants overexpressing nucleic acid of the invention are germinated and transferred to pots. Drought stress is obtained after irrigation is ceased. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as drought stress tolerant plants, Salinity tolerance assay—Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution with added salt), or by culturing the plants in a hyperosmotic growth medium [e.g., 50% Murashige-Skoog medium (MS medium) with added salt]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 150 mM, 300 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of chlorosis and overall success to reach maturity and yield progeny are compared between control and transgenic plants. Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic tolerance test—Osmotic stress assays (including sodium chloride and PEG assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress experiments, the medium is supplemented for example with 50 mM, 100 mM, 200 mM NaCl or 15%, 20% or 25% PEG.

Cold stress tolerance—One way to analyze cold stress is as follows. Mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between control and transgenic plants, by measuring plant weight (wet and dry), and by comparing growth rates measured as time to flowering, plant size, yield, and the like.

Heat stress tolerance—One way to measure heat stress tolerance is by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

The biomass, vigor and yield of the plant can also be evaluated using any method known to one of ordinary skill in the art. Thus, for example, plant vigor can be calculated by the increase in growth parameters such as leaf area, fiber length, rosette diameter, plant fresh weight and the like per time.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture. Similarly, increased yield of soybean may be manifested by an increase in one or more of the following: number of plants per growing area, number of pods per plant, number of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Thus, the present invention is of high agricultural value for increasing tolerance of plants to nitrogen deficiency or abiotic stress as well as promoting the yield, biomass and vigor of commercially desired crops.

According to another embodiment of the present invention, there is provided a food or feed comprising the plants or a portion thereof of the present invention.

In a further aspect the invention, the transgenic plants of the present invention or parts thereof are comprised in a food or feed product (e.g., dry, liquid, paste). A food or feed product is any ingestible preparation containing the transgenic plants, or parts thereof, of the present invention, or preparations made from these plants. Thus, the plants or preparations are suitable for human (or animal) consumption, i.e. the transgenic plants or parts thereof are more readily digested. Feed products of the present invention further include a oil or a beverage adapted for animal consumption.

It will be appreciated that the transgenic plants, or parts thereof, of the present invention may be used directly as feed products or alternatively may be incorporated or mixed with feed products for consumption. Furthermore, the food or feed products may be processed or used as is. Exemplary feed products comprising the transgenic plants, or parts thereof, include, but are not limited to, grains, cereals, such as oats, e.g. black oats, barley, wheat, rye, *sorghum*, corn, vegetables, leguminous plants, especially soybeans, root vegetables and cabbage, or green forage, such as grass or hay.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

As used herein, the term "treating" includes abrogating, substantially inhibiting, slowing or reversing the progression of a condition, substantially ameliorating clinical or aesthetical symptoms of a condition or substantially preventing the appearance of clinical or aesthetical symptoms of a condition.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Example 1

Differential Expression of dsRNAs in Maize Plant Under Optimal Versus Deficient Nitrogen Conditions Experimental Procedures Plant Material Corn seeds were obtained from Galil seeds (Israel). Corn variety 5605 was used in all experiments. Plants were grown at 24° C. under a 16 hr light:8 hr dark regime.

Stress Induction

Corn seeds were germinated and grown on agar with defined growth media containing either optimal (100% $N_2$, 20.61 mM) or suboptimal nitrogen levels (1% or 10% $N_2$, 0.2 mM or 2.06 mM, respectively). Seedlings aged one or two weeks were used for tissue samples for RNA analysis, as described below.

Total RNA Extraction

Total RNA of leaf or root samples from four to eight biological repeats were extracted using the mirVana™ kit (Ambion, Austin, Tex.) by pooling 3-4 plants to one biological repeat.

Microarray Design

Custom microarrays were manufactured by Agilent Technologies by in situ synthesis. The first generation microarray consisted of a total of 13619 non-redundant DNA probes, the majority of which arose from deep sequencing data and includes different small RNA molecules (i.e. miRNAs, siRNA and predicted small RNA sequences), with each probe being printed once. An in-depth analysis of the first generation microarray, which included hybridization experiments as well as structure and orientation verifications on all its small RNAs, resulted in the formation of an improved, second generation, microarray. The second generation microarray consists of a total 4721 non-redundant DNA 45-nucleotide long probes for all known plant small RNAs, with 912 sequences (19.32%) from Sanger version 15 and the rest (3809), encompassing miRNAs (968=20.5%), siRNAs (1626=34.44%) and predicted small RNA sequences (1215=25.74%), from deep sequencing data accumulated by the inventors, with each probe being printed in triplicate.

Results

Wild type maize plants were allowed to grow at standard, optimal conditions or nitrogen deficient conditions for one or two weeks, at the end of which they were evaluated for NUE. Three to four plants from each group were used for reproducibility. Four to eight repeats were obtained for each group and RNA was extracted from leaf or root tissue. The expression level of the maize miRNAs was analyzed by high throughput microarray to identify miRNAs that were differentially expressed between the experimental groups.

Tables 1-4 below present dsRNA sequences that were found to be differentially expressed (upregulated=up; downregulated=down) in corn grown under low nitrogen conditions (nitrogen limiting conditions, as described above).

TABLE 1 miRNAs found upregulated in Plants Growing under Nitrogen Deficient Conditions versus Optimal conditions

| Mir Name | SEQ ID NO: | Stem Loop SEQ ID NO: | Direction | Fold Change Leaf | Fold Change Root |
| --- | --- | --- | --- | --- | --- |
| osa-miR1430 | TGGTGAGCCTTCCTGGCTAAG/1 | 196 | Up | | 3.99 |
| osa-miR1868 | TCACGGAAAACGAGGGAGCAGCCA/2 | 197 | Up | | 2.63 |
| osa-miR2096-3p | CCTGAGGGGAAATCGGCGGGA/3 | 198 | Up | 3.48 | 2.71 |
| zma-miR399f* | GGGCAACTTCTCCTTTGGCAGA/4 | 199 | Up | | 2.13 |
| Predicted folded 24-nts-long seq 50935 | AACTAAAACGAAACGGAAGGAGTA/5 | 200 | Up | 2.1 | |
| Predicted folded 24-nts-long seq 51052 | AAGGTGCTTTTAGGAGTAGGACGG/6 | 201 | Up | 2.08 | |
| Predicted folded 24-nts-long seq 51215 | ACAAAGGAATTAGAACGGAATGGC/7 | 202 | Up | 3.23 | 2.49 |
| Predicted folded 24-nts-long seq 51468 | AGAATCAGGAATGGAACGGCTCCG/8 | 203 | Up | | 1.54 |
| Predicted folded 24-nts-long seq 51469 | AGAATCAGGGATGGAACGGCTCTA/9 | 204 | Up | | 1.9 |
| Predicted folded 24-nts-long seq 51577 | AGAGTCACGGGCGAGAAGAGGACG/10 | 205 | Up | | 2.34 |
| Predicted folded 24-nts-long seq 51691 | AGGACCTAGATGAGCGGGCGGTTT/11 | 206 | Up | | 1.72 |
| Predicted folded 24-nts-long seq 51695 | AGGACGCTGCTGGAGACGGAGAAT/12 | 207 | Up | | 2.4 |

TABLE 1-continued miRNAs found upregulated in Plants Growing under Nitrogen
Deficient Conditions versus Optimal conditions

| Mir Name | SEQ ID NO: | Stem Loop SEQ ID NO: | Direction | Fold Change Leaf | Fold Change Root |
|---|---|---|---|---|---|
| Predicted folded 24-nts-long seq 51814 | AGGGCTTGTTCGGTTTG AAGGGGT/13 | 208 | Up | 2.52 | |
| Predicted folded 24-nts-long seq 52057 | ATCTTTCAACGGCTGCG AAGAAGG/14 | 209 | Up | | 2.11 |
| Predicted folded 24-nts-long seq 52327 | CTAGAATTAGGGATGG AACGGCTC/15 | 210 | Up | | 1.57 |
| Predicted folded 24-nts-long seq 52499 | GAGGGATAACTGGGGA CAACACGG/16 | 211 | Up | 2.97 | |
| Predicted folded 24-nts-long seq 52633 | GCGGAGTGGGATGGGG AGTGTTGC/17 | 212 | Up | | 1.51 |
| Predicted folded 24-nts-long seq 52688 | GGAGACGGATGCGGAG ACTGCTGG/18 | 213 | Up | | 1.51 |
| Predicted folded 24-nts-long seq 52805 | GGTTAGGAGTGGATTG AGGGGGAT/19 | 214 | Up | 3.77 | |
| Predicted folded 24-nts-long seq 52850 | GTCAAGTGACTAAGAG CATGTGGT/20 | 215 | Up | 4.93 | 10.17 |
| Predicted folded 24-nts-long seq 52882 | GTGGAATGGAGGAGAT TGAGGGA/21 | 216 | Up | 2.01 | |
| Predicted folded 24-nts-long seq 53118 | TGGCTGAAGGCAGAAC CAGGGGAG/22 | 217 | Up | | 4.45 |
| Predicted folded 24-nts-long seq 53149 | TGTGGTAGAGAGGAAG AACAGGAC/23 | 218 | Up | 3.25 | |
| Predicted folded 24-nts-long seq 53594 | AGGGACTCTCTTTATTT CCGACGG/24 | 219 | Up | | 1.83 |
| Predicted folded 24-nts-long seq 53604 | AGGGTTCGTTTCCTGGG AGCGCGG/25 | 220 | Up | | 1.66 |
| Predicted folded 24-nts-long seq 54081 | TCCTAGAATCAGGGAT GGAACGGC/26 | 221 | Up | | 1.6 |
| Predicted folded 24-nts-long seq 54132 | TGGGAGCTCTCTGTTCG ATGGCGC/27 | 222 | Up | | 3.47 |
| Predicted zma mir 48061 | AACGTCGTGTCGTGCTT GGGCT/28 | 223 | Up | | 1.62 |
| Predicted zma mir 48295 | ACCTGGACCAATACAT GAGATT/29 | 224 | Up | 2.58 | |
| Predicted zma mir 48350 | AGAAGCGACAATGGGA CGGAGT/30 | 225 | Up | 4.65 | |
| Predicted zma mir 48457 | AGGAAGGAACAAACGA GGATAAG/31 | 226 | Up | | 2.08 |

TABLE 1-continued miRNAs found upregulated in Plants Growing under Nitrogen Deficient Conditions versus Optimal conditions

| Mir Name | SEQ ID NO: | Stem Loop SEQ ID NO: | Direction | Fold Change Leaf | Fold Change Root |
|---|---|---|---|---|---|
| Predicted zma mir 48877 | CCAAGAGATGGAAGGG CAGAGC/32 | 227 | Up | 2 | |
| Predicted zma mir 48922 | CGACAACGGGACGGAG TTCAA/33 | 228 | Up | | 1.58 |
| Predicted zma mir 49123 | GAGGATGGAGAGGTAC GTCAGA/34 | 229 | Up | 2.02 | |
| Predicted zma mir 49161 | GATGGGTAGGAGAGCG TCGTGTG/35 | 230 | Up | 1.51 | 1.55 |
| Predicted zma mir 49162 | GATGGTTCATAGGTGA CGGTAG/36 | 231 | Up | | 4.2 |
| Predicted zma mir 49262 | GGGAGCCGAGACATAG AGATGT/37 | 232 | Up | | 2.64 |
| Predicted zma mir 49323 | GTGAGGAGTGATAATG AGACGG/38 | 233 | Up | | 2.17 |
| Predicted zma mir 49369 | GTTTGGGGCTTTAGCAG GTTTAT/39 | 234 | Up | 1.58 | |
| Predicted zma mir 49609 | TCCATAGCTGGGCGGA AGAGAT/40 | 235 | Up | | 5.52 |
| Predicted zma mir 49638 | TCGGCATGTGTAGGAT AGGTG/41 | 236 | Up | 3.24 ± 1.00 | 3.235 ± 0.205 |
| Predicted zma mir 49761 | TGATAGGCTGGGTGTG GAAGCG/42 | 237 | Up | 2.01 | 1.73 |
| Predicted zma mir 49787 | TGCAAACAGACTGGGG AGGCGA/43 | 238 | Up | | 3 |
| Predicted zma mir 50077 | TTTGGCTGACAGGATA AGGGAG/44 | 239 | Up | 2.44 | |
| Predicted zma mir 50095 | TTTTCATAGCTGGGCGG AAGAG/45 | 240 | Up | 19.94 | |
| Predicted zma mir 50110 | AACTTTAAATAGGTAG GACGGCGC/46 | 241 | Up | | 1.51 |
| Predicted zma mir 50204 | GGAATGTTGTCTGGTTC AAGG/47 | 242 | Up | 14.34 | |
| Predicted zma mir 50261 | TGTAATGTTCGCGGAA GGCCAC/48 | 243 | Up | | 1.7 |
| Predicted zma mir 50267 | TGTTGGCATGGCTCAAT CAAC/49 | 244 | Up | | 1.82 |
| Predicted zma mir 50460 | CGCTGACGCCGTGCCA CCTCAT/50 | 245 | Up | | 2.33 |
| Predicted zma mir 50545 | GCCTGGGCCTCTTTAGA CCT/51 | 246 | Up | | 1.5 |
| Predicted zma mir 50578 | GTAGGATGGATGGAGA GGGTTC/52 | 247 | Up | | 2.07 |
| Predicted zma mir 50611 | TCAACGGGCTGGCGGA TGTG/53 | 248 | Up | | 1.55 |

Table 1. provided are miRNAs that were found upregulated in Plants Growing under Nitrogen Deficient Conditions versus Optimal conditions.

TABLE 2 miRNAs found downregulated in Plants Growing under Nitrogen Deficient Conditions versus Optimal conditions

| Mir Name | Mature Sequence/seq id no: | Stem Loop Sequence/ seq id no: | Direction | Fold Change Leaf | Fold Change Root |
|---|---|---|---|---|---|
| aqc-miR529 | AGAAGAGAGAGAGCACAACCC/54 | 249 | Down | 1.53 | |
| ath-miR2936 | CTTGAGAGAGAGAACACAGACG/55 | 250 | Down | 1.54 | |
| mtr-miR169q | TGAGCCAGGATGACTTGCCGG/56 | 251 | Down | 3.04 | |
| peu-miR2911 | GGCCGGGGGACGGGCTGGGA/59 | 254 | Down | 1.66 | |
| Predicted folded 24-nts-long seq 50703 | AAAAAAGACTGAGCCGAATTGAAA/60 | 255 | Down | | 2.66 |
| Predicted folded 24-nts-long seq 51022 | AAGGAGTTTAATGAAGAAAGAGAG/61 | 256 | Down | 1.62 | |
| Predicted folded 24-nts-long seq 51381 | ACTGATGACGACACTGAGGAGGCT/62 | 257 | Down | 7.7 | |
| Predicted folded 24-nts-long seq 51542 | AGAGGAACCAGAGCCGAAGCCGTT/63 | 258 | Down | 1.52 | |
| Predicted folded 24-nts-long seq 51757 | AGGCAAGGTGGAGGACGTTGATGA/64 | 259 | Down | 2.07 | |
| Predicted folded 24-nts-long seq 51802 | AGGGCTGATTTGGTGACAAGGGGA/65 | 260 | Down | 3.7 | 2.04 |
| Predicted folded 24-nts-long seq 51966 | ATATAAAGGGAGGAGGTATGGACC/66 | 261 | Down | 2.1 | |
| Predicted folded 24-nts-long seq 52041 | ATCGGTCAGCTGGAGGAGACAGGT/67 | 262 | Down | 1.7 | |
| Predicted folded 24-nts-long seq 52109 | ATGGTAAGAGACTATGATCCAACT/68 | 263 | Down | | 1.62 |
| Predicted folded 24-nts-long seq 52212 | CAATTTTGTACTGGATCGGGGCAT/69 | 264 | Down | | 1.53 |
| Predicted folded 24-nts-long seq 52218 | CAGAGGAACCAGAGCCGAAGCCGT/70 | 265 | Down | 1.58 | |
| Predicted folded 24-nts-long seq 52299 | CGGCTGGACAGGGAAGAAGAGCAC/71 | 266 | Down | 1.63 | |

TABLE 2-continued miRNAs found downregulated in Plants Growing under Nitrogen Deficient Conditions versus Optimal conditions

| Mir Name | Mature Sequence/seq id no: | Stem Loop Sequence/ seq id no: | Direction | Fold Change Leaf | Fold Change Root |
|---|---|---|---|---|---|
| Predicted folded 24-nts-long seq 52347 | GAAACTTGGAGAGATGGAGGCTTT/72 | 267 | Down | | 1.7 |
| Predicted folded 24-nts-long seq 52452 | GAGAGAGAAGGGAGCGGATCTGGT/73 | 268 | Down | 3.25 | 2.52 |
| Predicted folded 24-nts-long seq 52648 | GCTGCACGGGATTGGTGGAGAGGT/74 | 269 | Down | 2.34 | |
| Predicted folded 24-nts-long seq 52739 | GGCTGCTGGAGAGCGTAGAGGACC/75 | 270 | Down | 2.13 | |
| Predicted folded 24-nts-long seq 52792 | GGGTTTTGAGAGCGAGTGAAGGGG/76 | 271 | Down | | 2.9 |
| Predicted folded 24-nts-long seq 52795 | GGTATTGGGGTGGATTGAGGTGGA/77 | 272 | Down | 1.59 | |
| Predicted folded 24-nts-long seq 52801 | GGTGGCGATGCAAGAGGAGCTCAA/78 | 273 | Down | 2.52 | 3.87 |
| Predicted folded 24-nts-long seq 52955 | GTTGCTGGAGAGAGTAGAGGACGT/79 | 274 | Down | | 2.35 |
| Predicted zma mir 47944 | AAAAGAGAAACCGAAGACACAT/80 | 275 | Down | | 1.78 |
| Predicted zma mir 47976 | AAAGAGGATGAGGAGTAGCATG/81 | 276 | Down | 4.09 | |
| Predicted zma mir 48185 | AATACACATGGGTTGAGGAGG/82 | 277 | Down | 1.85 | |
| Predicted zma mir 48351 | AGAAGCGGACTGCCAAGGAGGC/83 | 278 | Down | 3.18 | |
| Predicted zma mir 48397 | AGAGGGTTTGGGGATAGAGGGAC/84 | 279 | Down | | 8.95 |
| Predicted zma mir 48588 | TAAGGGATGAGGCAGAGCATG/85 | 280 | Down | | 2.1 |
| Predicted zma mir 48669 | ATGCTATTTGTACCCGTCACCG/86 | 281 | Down | | 1.67 |
| Predicted zma mir 48708 | ATGTGGATAAAAGGAGGGATGA/87 | 282 | Down | | 1.61 |

TABLE 2-continued miRNAs found downregulated in Plants Growing under Nitrogen Deficient Conditions versus Optimal conditions

| Mir Name | Mature Sequence/seq id no: | Stem Loop Sequence/ seq id no: | Direction | Fold Change Leaf | Fold Change Root |
|---|---|---|---|---|---|
| Predicted zma mir 48771 | CAACAGGAACAAGGAGGACCAT/88 | 283 | Down | 1.52 | |
| Predicted zma mir 49002 | CTCGAGTTGAGAAAGAGATGCT/89 | 284 | Down | | 1.51 |
| Predicted zma mir 49003 | CTCGATGGGAGGTGGAGTTGCAT/90 | 285 | Down | 1.61 | |
| Predicted zma mir 49011 | CTGGGAAGATGGAACATTTTGGT/91 | 286 | Down | | 1.64 |
| Predicted zma mir 49053 | GAAGATATACGATGATGAGGAG/92 | 287 | Down | 1.55 | |
| Predicted zma mir 49070 | GAATCTATCGTTTGGGCTCAT/93 | 288 | Down | 1.65 | 2.01 |
| Predicted zma mir 49082 | GAGCGAGCTACAAAAGGATTCG/94 | 289 | Down | 1.6 | |
| Predicted zma mir 49155 | GAGTGACGAGGAGTGAGAGTAGG/95 | 290 | Down | | 3.64 |
| Predicted zma mir 49269 | GGGCATCTTCTGGCAGGAGGACA/96 | 291 | Down | 1.64 | |
| Predicted zma mir 49435 | TACGGAAGAAGAGCAAGTTTT/97 | 292 | Down | 1.64 | |
| Predicted zma mir 49445 | TAGAAAGAGCGAGAGAACAAAG/98 | 293 | Down | | 1.55 |
| Predicted zma mir 49762 | TGATATTATGGACGACTGGTT/99 | 294 | Down | 1.54 | 1.57 |
| Predicted zma mir 49816 | TGGAAGGGCCATGCCGAGGAG/100 | 295 | Down | | 2.45 |
| Predicted zma mir 49985 | TTGAGCGCAGCGTTGATGAGC/101 | 296 | Down | | 2.93 |
| Predicted zma mir 50021 | TTGGATAACGGGTAGTTTGGAGT/102 | 297 | Down | | 1.79 |
| Predicted zma mir 50144 | AGCTGCCGACTCATTCACCCA/103 | 298 | Down | | 1.54 |
| Predicted zma mir 50263 | TGTACGATGATCAGGAGGAGGT/104 | 299 | Down | 1.53 | |
| Predicted zma mir 50266 | TGTGTTCTCAGGTCGCCCCCG/105 | 300 | Down | | 2.51 |

TABLE 2-continued miRNAs found downregulated in Plants Growing under Nitrogen Deficient Conditions versus Optimal conditions

| Mir Name | Mature Sequence/seq id no: | Stem Loop Sequence/seq id no: | Direction | Fold Change Leaf | Fold Change Root |
|---|---|---|---|---|---|
| Predicted zma mir 50318 | ACTAAAAAGAAACAGAGGGAG/106 | 301 | Down | 1.5 | |
| Predicted zma mir 50517 | GACCGGCTCGACCCTTCTGC/107 | 302 | Down | 1.55 | |
| Predicted zma mir 50670 | TGGTAGGATGGATGGAGAGGGT/108 | 303 | Down | 1.55 | |
| zma-miR166d* | GGAATGTTGTCTGGTTCAAGG/109 | 304 | Down | 1.73 | |
| zma-miR169c* | GGCAAGTCTGTCCTTGGCTACA/110 | 305 | Down | 2.41 | |
| zma-miR399g | TGCCAAAGGGGATTTGCCCGG/113 | 309 | Down | | 1.55 |

Table 2. provided are miRNAs that were found downregulated in Plants Growing under Nitrogen Deficient Conditions versus Optimal conditions.

TABLE 3 siRNAs found upregulated in Plants Growing under Nitrogen Deficient Conditions versus Optimal conditions

| Mir Name | Mature Sequence/SEQ ID NO: | Direction | Fold Change Leaf | Fold Change Root |
|---|---|---|---|---|
| Predicted siRNA 54339 | AAGAAACGGGGCAGTGAGATGGAC/114 | Up | | 1.51 |
| Predicted siRNA 54631 | AGAAAAGATTGAGCCGAATTGAATT/115 | Up | 2.02 | |
| Predicted siRNA 54991 | AGAGCCTGTAGCTAATGGTGGG/116 | Up | 1.95 | |
| Predicted siRNA 55111 | AGGTAGCGGCCTAAGAACGACACA/117 | Up | 2.36 | 1.67 |
| Predicted siRNA 55423 | CCTATATACTGGAACGGAACGGCT/118 | Up | | 1.57 |
| Predicted siRNA 55806 | CTATATACTGGAACGGAACGGCTT/119 | Up | | 2.23 |
| Predicted siRNA 56052 | GACGAGATCGAGTCTGGAGCGAGC/120 | Up | 1.86 | |
| Predicted siRNA 56106 | GAGTATGGGGAGGGACTAGGGA/121 | Up | | 2.3 |
| Predicted siRNA 56353 | GACGAAATAGAGGCTCAGGAGAGG/122 | Up | 2.08 | |
| Predicted siRNA 56388 | GGATTCGTGATTGGCGATGGGG/123 | Up | | 1.51 |
| Predicted siRNA 56406 | GGTGAGAAACGGAAAGGCAGGACA/124 | Up | 4.04 | |
| Predicted siRNA 56443 | GTGTCTGAGCAGGGTGAGAAGGCT/125 | Up | 1.53 | 1.58 |
| Predicted siRNA 56450 | GTTTTGGAGGCGTAGGCGAGGGAT/126 | Up | 3.04 | |

TABLE 3-continued siRNAs found upregulated in Plants Growing under Nitrogen Deficient Conditions versus Optimal conditions

| Mir Name | Mature Sequence/SEQ ID NO: | Direction | Fold Change Leaf | Fold Change Root |
|---|---|---|---|---|
| Predicted siRNA 56542 | TGGGACGCTGCATCTGTTGAT/127 | Up | 2.96 | |
| Predicted siRNA 56706 | TCTATATACTGGAACGGAACGGCT/128 | Up | | 1.76 |
| Predicted siRNA 56856 | GTTGTTGGAGGGGTAGAGGACGTC/129 | Up | 1.55 | |
| Predicted siRNA 57034 | AATGACAGGACGGGATGGGACGGG/130 | Up | | 2.87 |
| Predicted siRNA 57054 | ACGGAACGGCTTCATACCACAATA/131 | Up | | 2.43 |
| Predicted siRNA 57193 | GACGGGCCGACATTTAGAGCACGG/132 | Up | | 1.69 |
| Predicted siRNA 57884 | ACGGATAAAAGGTACTCT/133 | Up | | 2.82 |
| Predicted siRNA 58292 | AGTATGTCGAAAACTGGAGGGC/134 | Up | 4.54 | |
| Predicted siRNA 58362 | ATAAGCACCGGCTAACTCT/135 | Up | | 2.87 |
| Predicted siRNA 58665 | ATTCAGCGGGCGTGGTTATTGGCA/136 | Up | | 1.55 |
| Predicted siRNA 58872 | CAGCGGGTGCCATAGTCGAT/137 | Up | | 1.92 |
| Predicted siRNA 58940 | CATTGCGACGGTCCTCAA/138 | Up | | 1.57 |
| Predicted siRNA 59380 | CTCAACGGATAAAGGTAC/139 | Up | | 2.21 |
| Predicted siRNA 59626 | GACAGTCAGGATGTTGGCT/140 | Up | 2.68 | 2.12 |
| Predicted siRNA 59659 | GACTGATCCTTCGGTGTCGGCG/141 | Up | | 1.67 |
| Predicted siRNA 59846 | GCCGAAGATTAAAAGACGAGACGA/142 | Up | 1.64 | |
| Predicted siRNA 59867 | GCCTTTGCCGACCATCCTGA/143 | Up | | 1.6 |
| Predicted siRNA 59952 | GGAATCGCTAGTAATCGTGGAT/144 | Up | 1.87 | 1.76 |
| Predicted siRNA 59961 | GGAGCAGCTCTGGTCGTGGG/145 | Up | | 1.85 ± 0.007 |
| Predicted siRNA 59965 | GGAGGCTCGACTATGTTCAAA/146 | Up | | 2.97 |
| Predicted siRNA 59966 | GGAGGGATGTGAGAACATGGGC/147 | Up | | 1.62 |
| Predicted siRNA 60081 | GTCCCCTTCGTCTAGAGGC/148 | Up | | 2.82 |
| Predicted siRNA 60095 | GTCTGAGTGGTGTAGTTGGT/149 | Up | 2.12 | |
| Predicted siRNA 60188 | GTTGGTAGAGCAGTTGGC/150 | Up | | 4.11 |
| Predicted siRNA 60285 | TACGTTCCCGGGTCTTGTACA/151 | Up | | 1.95 |

TABLE 3-continued siRNAs found upregulated in Plants Growing under Nitrogen Deficient Conditions versus Optimal conditions

| Mir Name | Mature Sequence/SEQ ID NO: | Direction | Fold Change Leaf | Fold Change Root |
|---|---|---|---|---|
| Predicted siRNA 60387 | TATGGATGAAGATGGGGGTG/152 | Up | 3.68 | |
| Predicted siRNA 60434 | TCAACGGATAAAAGGTACTCCG/153 | Up | | 2.23 |
| Predicted siRNA 60837 | TGCCCAGTGCTTTGAATG/154 | Up | | 3.37 |
| Predicted siRNA 60850 | TGCGAGACCGACAAGTCGAGC/155 | Up | 1.64 | 1.86 |
| Predicted siRNA 61382 | TTTGCGACACGGGCTGCTCT/156 | Up | | 1.52 |

Table 3. Provided are siRNAs that were found upregulated in Plants Growing under Nitrogen Deficient Conditions versus Optimal conditions.

TABLE 4 siRNAs found downregulated in Plants Growing under Nitrogen Deficient Conditions versus Optimal conditions

| Mir Name | Mature Sequence/SEQ ID No: | Direction | Fold Change Leaf | Fold Change Root |
|---|---|---|---|---|
| Predicted siRNA 58924 | CATCGCTCAACGGACAAAAGGT/157 | Down | | 1.55 |
| Predicted siRNA 54240 | AAGACGAAGGTAGCAGCGCGATAT/158 | Down | 2.79 | |
| Predicted siRNA 54957 | AGCCAGACTGATGAGAGAAGGAGG/159 | Down | 1.51 | |
| Predicted siRNA 55081 | ACGTTGTTGGAAGGGTAGAGGACG/160 | Down | 1.56 | |
| Predicted siRNA 55393 | CAAGTTATGCAGTTGCTGCCT/161 | Down | | 5.98 |
| Predicted siRNA 55404 | CAGAATGGAGGAAGAGATGGTG/162 | Down | 3.49 | |
| Predicted siRNA 55472 | ATCTGTGGAGAGAGAAGGTTGCCC/163 | Down | 1.58 | |
| Predicted siRNA 55720 | ATGTCAGGGGGCCATGCAGTAT/164 | Down | 2.41 | |
| Predicted siRNA 55732 | ATCCTGACTGTGCCGGGCCGGCCC/165 | Down | 1.96 | |
| Predicted siRNA 56034 | CGAGTTCGCCGTAGAGAAAGCT/166 | Down | | 2.24 |
| Predicted siRNA 56162 | GACTGATTCGGACGAAGGAGGGTT/167 | Down | | 3.23 |
| Predicted siRNA 56205 | GTCTGAACACTAAACGAAGCACA/168 | Down | 1.87 | |
| Predicted siRNA 56277 | GACGTTGTTGGAAGGGTAGAGGAC/169 | Down | 3.94 | |
| Predicted siRNA 56307 | GCTACTGTAGTTCACGGGCCGGCC/170 | Down | 1.71 | |
| Predicted siRNA 56425 | GGTATTCGTGAGCCTGTTTCTGGTT/171 | Down | 1.67 | |

TABLE 4-continued siRNAs found downregulated in Plants Growing under Nitrogen Deficient Conditions versus Optimal conditions

| Mir Name | Mature Sequence/SEQ ID No: | Direction | Fold Change Leaf | Fold Change Root |
|---|---|---|---|---|
| Predicted siRNA 56837 | TGGAAGGAGCATGCATCTTGAG/172 | Down | | 2.68 |
| Predicted siRNA 56965 | TTCTTGACCTTGTAAGACCCA/173 | Down | | 3.66 |
| Predicted siRNA 57088 | AGCAGAATGGAGGAAGAGATGG/174 | Down | 1.53 | |
| Predicted siRNA 57179 | CTGGACACTGTTGCAGAAGGAGGA/175 | Down | 1.58 | |
| Predicted siRNA 57181 | GAAATAGGATAGGAGGAGGGATGA/176 | Down | 3.34 | 2.91 |
| Predicted siRNA 57228 | GGCACGACTAACAGACTCACGGGC/177 | Down | | 2.45 |
| Predicted siRNA 57685 | AATCCCGGTGGAACCTCCA/178 | Down | 3.6 | 2.7 |
| Predicted siRNA 57772 | ACACGACAAGACGAATGAGAGAGA/179 | Down | | 1.57 |
| Predicted siRNA 57863 | ACGACGAGGACTTCGAGACG/180 | Down | 1.53 | |
| Predicted siRNA 58721 | CAAAGTGGTCGTGCCGGAG/181 | Down | 1.61 | |
| Predicted siRNA 58877 | CAGCTTGAGAATCGGGCCGC/182 | Down | 3.8 | |
| Predicted siRNA 59032 | CCCTGTGACAAGAGGAGGA/183 | Down | 1.6 | |
| Predicted siRNA 59102 | CCTGCTAACTAGTTATGCGGAGC/184 | Down | 1.74 | |
| Predicted siRNA 59123 | CGAACTCAGAAGTGAAACC/185 | Down | 2.11 | 2.62 |
| Predicted siRNA 59235 | CGCTTCGTCAAGGAGAAGGGC/186 | Down | 1.59 | |
| Predicted siRNA 59485 | CTTAACTGGGCGTTAAGTTGCAGGGT/187 | Down | | 2.17 |
| Predicted siRNA 59954 | GGACGAACCTCTGGTGTACC/188 | Down | | 1.76 |
| Predicted siRNA 59993 | GGCGCTGGAGAACTGAGGG/189 | Down | | 2.58 |
| Predicted siRNA 60012 | GGGGGCCTAAATAAAGACT/190 | Down | 2.48 | |
| Predicted siRNA 60123 | GTGCTAACGTCCGTCGTGAA/191 | Down | | 3.15 |
| Predicted siRNA 60334 | TAGCTTAACCTTCGGGAGGG/192 | Down | | 1.9 |
| Predicted siRNA 60750 | TGAGAAAGAAAGAGAAGGCTCA/193 | Down | 1.64 | |
| Predicted siRNA 60803 | TGATGTCCTTAGATGTTCTGGGC/194 | Down | | 1.99 |

TABLE 4-continued siRNAs found downregulated in Plants Growing under Nitrogen Deficient Conditions versus Optimal conditions

| Mir Name | Mature Sequence/SEQ ID No: | Direction | Fold Change Leaf | Fold Change Root |
|---|---|---|---|---|
| Predicted siRNA 55413 | CATGTGTTCTCAGGTCGCCC C/195 | Down | | 2.55 |

Table 4. Provided are siRNAs that were found downregulated in Plants Growing under Nitrogen Deficient Conditions versus Optimal conditions.

Example 2

Target Prediction Using Bioinformatics Tools

A high throughput screening was performed on microarrays loaded with miRNAs/siRNAs that were found to be differentially expressed under multiple stress and optimal environmental conditions and in different plant tissues. The initial trait-associated miRNAs are later validated by quantitative Real Time PCR (qRT-PCR).

Target prediction—orthologous genes to the genes of interest in maize and/or *Arabidopsis* are found through a proprietary tool that analyzes publicly available genomic as well as expression and gene annotation databases from multiple plant species. Homologous as well as orthologous protein and nucleotide sequences of target genes of the small RNA sequences of the invention, were found using BLAST having at least 70% identity on at least 60% of the entire master gene length, and are summarized in Tables 5-8 below. BLAST version used was Version 2.2.25+, Released March 2011, at default parameters as follows: For step 1 using BlastX to find the master homolog: Word size 3, Gap open 11, gap extend 1. For step 2 using BlastN to find orthologs from other organisms: Word size 28, Gap open 0, Gap extend 0, Reward (match score) 1, Penalty (mismatch score)-2.

TABLE 5

Target Genes of miRNAs Associated with Increased NUE (Table 1)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| osa-miR2096-3p | 95-115 | XP_002468137 | hypothetical protein SORBIDRAFT_01g040220 [*Sorghum bicolor*] > gi|241921991|gb|EER95135.1| hypothetical protein SORBIDRAFT_01g040220 [*Sorghum bicolor*] | 1.00 | 311 | 515 |
| | | ACN26598 | unknown [*Zea mays*] | 0.95 | 312 | 516 |
| | | NP_001148956 | LOC100282576 [*Zea mays*] > gi|195623616|gb|ACG33638.1| CONSTANS interacting protein 4 [*Zea mays*] | 0.95 | 313 | 517 |
| | | ACG37488 | CONSTANS interacting protein 4 [*Zea mays*] | 0.96 | 314 | 518 |
| | | NP_001148721 | CONSTANS interacting protein 4 [*Zea mays*] > gi|195621640|gb|ACG32650.1| CONSTANS interacting protein 4 [*Zea mays*] | 0.96 | 315 | 519 |
| | | NP_001049637 | Os03g0263800 [*Oryza sativa Japonica* Group] > gi|29893607|gb|AAP06861.1| unknown protein [*Oryza sativa Japonica* Group] > gi|108707320|gb|ABF95115.1| S-ribonuclease binding protein SBP1, putative, expressed [*Oryza sativa Japonica* Group] > gi|113548108|dbj|BAF11551.1| Os03g0263800 [*Oryza sativa Japonica* Group] > gi|215696696|dbj|BAG88116.1| unnamed protein product [*Oryza sativa Japonica* Group] | 0.89 | 316 | 520 |

TABLE 5-continued

Target Genes of miRNAs Associated with Increased NUE (Table 1)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | > gi|215704492|dbj|BAG93926.1| unnamed protein product [*Oryza sativa Japonica* Group] > gi|222624614|gb|EEE58746.1| hypothetical protein OsJ_10235 [*Oryza sativa Japonica* Group] | | | |
| | | EEC74912 | hypothetical protein OsI_10851 [*Oryza sativa Indica* Group] | 0.88 | 317 | |
| | | BAJ94154 | predicted protein [*Hordeum vulgare* subsp. *vulgare*] > gi|326493392|dbj|BAJ85157.1| predicted protein [*Hordeum vulgare* subsp. *vulgare*] | 0.85 | 318 | 521 |
| Predicted zma mir 49161 | 292-314 | NP_001169860 | hypothetical protein LOC100383754 [*Zea mays*] > gi|224032063|gb|ACN35107.1| unknown [*Zea mays*] | 1.00 | 319 | 522 |
| | | XP_002458357 | hypothetical protein SORBIDRAFT_03g031980 [*Sorghum bicolor*] > gi|241930332|gb|EES03477.1| hypothetical protein SORBIDRAFT_03g031980 [*Sorghum bicolor*] | 0.88 | 320 | 523 |
| | 282-304 | ACN34890 | unknown [*Zea mays*] | 1.00 | 321 | 524 |
| | | EEC71328 | hypothetical protein OsI_03374 [*Oryza sativa Indica* Group] > gi|222619103|gb|EEE55235.1| hypothetical protein OsJ_03112 [*Oryza sativa Japonica* Group] | 0.74 | 322 | |
| | | BAD81811 | hypothetical protein [*Oryza sativa Japonica* Group] | 0.74 | 323 | 525 |
| | | BAJ90295 | predicted protein [*Hordeum vulgare* subsp. *vulgare*] | 0.74 | 324 | 526 |
| | 353-375 | XP_002458357 | hypothetical protein SORBIDRAFT_03g031980 [*Sorghum bicolor*] > gi|241930332|gb|EES03477.1| hypothetical protein SORBIDRAFT_03g031980 [*Sorghum bicolor*] | 1.00 | 325 | 527 |
| | | NP_001169860 | hypothetical protein LOC100383754 [*Zea mays*] > gi|224032063|gb|ACN35107.1| unknown [*Zea mays*] | 0.88 | 326 | 528 |
| Predicted zma mir 50460 | 982-1003 | XP_002446326 | hypothetical protein SORBIDRAFT_06g014320 [*Sorghum bicolor*] > gi|241937509|gb|EES10654.1| hypothetical protein SORBIDRAFT_06g014320 [*Sorghum bicolor*] | 1.00 | 327 | 529 |
| | | NP_001169348 | hypothetical protein LOC100383215 [*Zea mays*] > gi|224028855|gb|ACN33503.1| unknown [*Zea mays*] | 0.84 | 328 | 530 |
| | | ACN25775 | unknown [*Zea mays*] | 0.75 | 329 | 531 |
| | 426-447 | NP_001136483 | hypothetical protein LOC100216597 [*Zea mays*] > gi|194695886|gb|ACF82027.1| unknown [*Zea mays*] | 1.00 | 330 | 532 |
| | 295-316 | ACG40990 | RING-H2 finger protein ATL5I [*Zea mays*] | 1.00 | 331 | 533 |
| | | NP_001159129 | hypothetical protein LOC100304207 [*Zea mays*] > gi|223942155|gb|ACN25161.1| unknown [*Zea mays*] | 0.85 | 332 | 534 |

TABLE 5-continued

Target Genes of miRNAs Associated with Increased NUE (Table 1)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | NP_001130949 | hypothetical protein LOC100192054 [*Zea mays*] > gi|194690534|gb|ACF79351.1| unknown [*Zea mays*] | 0.77 | 333 | 535 |
| | | BAJ92353 | predicted protein [*Hordeum vulgare* subsp. *vulgare*] | 0.76 | 334 | 536 |
| | | NP_001057231 | Os06g0233200 [*Oryza sativa Japonica* Group] > gi|51535192|dbj|BAD38165.1| putative RING finger 1 [*Oryza sativa Japonica* Group] > gi|113595271|dbj|BAF19145.1| Os06g0233200 [*Oryza sativa Japonica* Group] > gi|125554660|gb|EAZ00266.1| hypothetical protein OsI_22277 [*Oryza sativa Indica* Group] > gi|215766038|dbj|BAG98266.1| unnamed protein product [*Oryza sativa Japonica* Group] > gi|222635260|gb|EEE65392.1| hypothetical protein OsJ_20714 [*Oryza sativa Japonica* Group] | 0.76 | 335 | 537 |
| | 154-175 | NP_001183617 | hypothetical protein LOC100502211 [*Zea mays*] > gi|238013474|gb|ACR37772.1| unknown [*Zea mays*] | 1.00 | 336 | 538 |
| | | XP_002465702 | hypothetical protein SORBIDRAFT_01g044080 [*Sorghum bicolor*] > gi|241919556|gb|EER92700.1| hypothetical protein SORBIDRAFT_01g044080 [*Sorghum bicolor*] | 0.73 | 337 | 539 |
| | 93-114 | NP_001152266 | BHLH transcription factor [*Zea mays*] > gi|195654447|gb|ACG46691.1| BHLH transcription factor [*Zea mays*] | 1.00 | 338 | 540 |
| | 1159-1180 | ACN25775 | unknown [*Zea mays*] | 1.00 | 339 | 541 |
| | | NP_001169348 | hypothetical protein LOC100383215 [*Zea mays*] > gi|224028855|gb|ACN33503.1| unknown [*Zea mays*] | 1.00 | 340 | 542 |
| | | XP_002446326 | hypothetical protein SORBIDRAFT_06g014320 [*Sorghum bicolor*] > gi|241937509|gb|EES10654.1| hypothetical protein SORBIDRAFT_06g014320 [*Sorghum bicolor*] | 0.80 | 341 | 543 |
| Predicted folded 24-nts-long seq 51695 | 1984-2007 | XP_002444807 | hypothetical protein SORBIDRAFT_07g028330 [*Sorghum bicolor*] > gi|241941157|gb|EES14302.1| hypothetical protein SORBIDRAFT_07g028330 [*Sorghum bicolor*] | 1.00 | 342 | 544 |
| | | NP_001169681 | hypothetical protein LOC100383562 [*Zea mays*] > gi|224030801|gb|ACN34476.1| unknown [*Zea mays*] > gi|224030845|gb|ACN34498.1| unknown [*Zea mays*] | 0.90 | 343 | 545 |
| Predicted zma mir 48457 | 584-606 | NP_001161741 | hypothetical protein LOC100192929 isoform 3 [*Zea mays*] > gi|226713359|sp|B6UGG4.1| NNJA4_MAIZE | 1.00 | 344 | 546 |

TABLE 5-continued

Target Genes of miRNAs Associated with Increased NUE (Table 1)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | RecName: Full = Ninja-family protein 4<br>> gi|195657959|gb|ACG48447.1| hypothetical protein [*Zea mays*] | | | |
| | | NP_001161740 | hypothetical protein LOC100192929 isoform 2 [*Zea mays*]<br>> gi|226713259|sp|B4FM28.1| NNJA2_MAIZE RecName: Full = Ninja-family protein 2<br>> gi|194698174|gb|ACF83171.1| unknown [*Zea mays*] | 1.00 | 345 | 547 |
| | | B6SLJ0 | RecName: Full = Ninja-family protein 3<br>> gi|195607786|gb|ACG25723.1| hypothetical protein [*Zea mays*] | 0.98 | 346 | |
| | | ACN33721 | unknown [*Zea mays*] | 0.97 | 347 | 548 |
| | 62-84 | B6SLJ0 | RecName: Full = Ninja-family protein 3<br>> gi|195607786|gb|ACG25723.1| hypothetical protein [*Zea mays*] | 1.00 | 348 | |
| | | NP_001161740 | hypothetical protein LOC100192929 isoform 2 [*Zea mays*]<br>> gi|226713259|sp|B4FM28.1| NNJA2_MAIZE RecName: Full = Ninja-family protein 2<br>> gi|194698174|gb|ACF83171.1| unknown [*Zea mays*] | 0.98 | 349 | 549 |
| | | ACN33721 | unknown [*Zea mays*] | 0.95 | 350 | 550 |
| | | NP_001161741 | hypothetical protein LOC100192929 isoform 3 [*Zea mays*]<br>> gi|226713359|sp|B6UGG4.1| NNJA4_MAIZE RecName: Full = Ninja-family protein 4<br>> gi|195657959|gb|ACG48447.1| hypothetical protein [*Zea mays*] | 0.97 | 351 | 551 |
| | 543-565 | NP_001161740 | hypothetical protein LOC100192929 isoform 2 [*Zea mays*]<br>> gi|226713259|sp|B4FM28.1| NNJA2_MAIZE RecName: Full = Ninja-family protein 2<br>> gi|194698174|gb|ACF83171.1| unknown [*Zea mays*] | 1.00 | 352 | 552 |
| | | ACN33721 | unknown [*Zea mays*] | 0.97 | 353 | 553 |
| | | NP_001161741 | hypothetical protein LOC100192929 isoform 3 [*Zea mays*]<br>> gi|226713359|sp|B6UGG4.1| NNJA4_MAIZE RecName: Full = Ninja-family protein 4<br>> gi|195657959|gb|ACG48447.1| hypothetical protein [*Zea mays*] | 0.99 | 354 | 554 |
| | | B6SLJ0 | RecName: Full = Ninja-family protein 3<br>> gi|195607786|gb|ACG25723.1| hypothetical protein [*Zea mays*] | 0.98 | 355 | |

TABLE 5-continued

Target Genes of miRNAs Associated with Increased NUE (Table 1)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | 450-472 | NP_001131584 | hypothetical protein LOC100192929 isoform 1 [*Zea mays*] > gi|226713190|sp|B4FAF3.1| NNJA1_MAIZE RecName: Full = Ninja-family protein 1 > gi|194690024|gb|ACF79096.1| unknown [*Zea mays*] > gi|194691932|gb|ACF80050.1| unknown [*Zea mays*] > gi|195638284|gb|ACG38610.1| hypothetical protein [*Zea mays*] | 1.00 | 356 | 555 |
| | | XP_002465644 | hypothetical protein SORBIDRAFT_01g042880 [*Sorghum bicolor*] > gi|241919498|gb|EER92642.1| hypothetical protein SORBIDRAFT_01g042880 [*Sorghum bicolor*] | 0.83 | 357 | 556 |
| Predicted zma mir 50261 | 1313-1334 | NP_001182893 | hypothetical protein LOC100501172 [*Zea mays*] > gi|238008020|gb|ACR35045.1| unknown [*Zea mays*] | 1.00 | 358 | 557 |
| Predicted folded 24-nts-long seq 52805 | 86-109 | XP_002447337 | hypothetical protein SORBIDRAFT_06g033160 [*Sorghum bicolor*] > gi|241938520|gb|EES11665.1| hypothetical protein SORBIDRAFT_06g033160 [*Sorghum bicolor*] | 1.00 | 359 | 558 |
| | | NP_001142056 | hypothetical protein LOC100274212 [*Zea mays*] > gi|194706940|gb|ACF87554.1| unknown [*Zea mays*] > gi|223947485|gb|ACN27826.1| unknown [*Zea mays*] | 0.96 | 360 | 559 |
| | | ACG45259 | hypothetical protein [*Zea mays*] | 0.96 | 361 | 560 |
| | | EEC78262 | hypothetical protein OsI_17948 [*Oryza sativa* Indica Group] | 0.86 | 362 | |
| | | EEE61915 | hypothetical protein OsJ_16648 [*Oryza sativa* Japonica Group] | 0.86 | 363 | |
| | | BAJ96591 | predicted protein [*Hordeum vulgare* subsp. *vulgare*] | 0.86 | 364 | 561 |
| | | CAJ86266 | H0901F07.3 [*Oryza sativa* Indica Group] | 0.76 | 365 | 562 |
| | 596-619 | AAY57857 | cysteine proteinase inhibitor [*Zea mays* subsp. *parviglumis*] > gi|66866419|gb|AAY57858.1| cysteine proteinase inhibitor [*Zea mays* subsp. *parviglumis*] > gi|66866423|gb|AAY57860.1| cysteine proteinase inhibitor [*Zea mays* subsp. *parviglumis*] > gi|66866425|gb|AAY57861.1| cysteine proteinase inhibitor [*Zea mays* subsp. *parviglumis*] > gi|66866427|gb|AAY57862.1| cysteine proteinase inhibitor [*Zea mays* subsp. *parviglumis*] > gi|66866429|gb|AAY57863.1| cysteine proteinase inhibitor [*Zea mays* subsp. *parviglumis*] | 1.00 | 366 | 563 |

TABLE 5-continued

Target Genes of miRNAs Associated with Increased NUE (Table 1)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | > gi|66866435|gb|AAY57866.1| cysteine proteinase inhibitor [*Zea mays* subsp. *parviglumis*] | | | |
| | | AAY57867 | cysteine proteinase inhibitor [*Zea mays* subsp. *parviglumis*] | 0.99 | 367 | 564 |
| | | ABQ32295 | cysteine protease inhibitor [*Zea mays*] | 0.99 | 368 | 565 |
| | | AAY57864 | cysteine proteinase inhibitor [*Zea mays* subsp. *parviglumis*] > gi|66866439|gb|AAY57868.1| cysteine proteinase inhibitor [*Zea mays* subsp. *parviglumis*] | 0.96 | 369 | 566 |
| | | AAY57859 | cysteine proteinase inhibitor [*Zea mays* subsp. *parviglumis*] | 0.98 | 370 | 567 |
| | | BAA09666 | cysteine proteinase inhibitor [*Zea mays*] > gi|66866433|gb|AAY57865.1| cysteine proteinase inhibitor [*Zea mays* subsp. *parviglumis*] > gi|71794635|emb|CAJ20024.1| putative cystatin [*Zea mays*] | 0.95 | 371 | 568 |
| | | CAA60610 | cysteine proteinase inhibitor [*Zea mays*] | 0.94 | 372 | 569 |
| | | NP_001106013 | cystatin2 [*Zea mays*] > gi|1008922|dbj|BAA07327.1| cystatin II [*Zea mays*] | 0.94 | 373 | 570 |
| | | BAB21558 | cystatin [*Coix lacryma-jobi*] | 0.86 | 374 | 571 |
| | | NP_001105295 | cystatin-1 precursor [*Zea mays*] > gi|399334|sp|P31726.1|CYT1_MAIZE RecName: Full = Cystatin-1; AltName: Full = Corn kernel cysteine proteinase inhibitor; AltName: Full = Cystatin I; Flags: Precursor > gi|217962|dbj|BAA01472.1| corn cystatin I [*Zea mays*] | 0.84 | 375 | 572 |
| | 2324-2347 | BAJ85758 | predicted protein [*Hordeum vulgare* subsp. *vulgare*] | 1.00 | 376 | 573 |
| | | NP_001044791 | Os01g0846600 [*Oryza sativa* Japonica Group] > gi|15408875|dbj|BAB64266.1| ankyrin-like protein [*Oryza sativa* Japonica Group] > gi|20160625|dbj|BAB89571.1| ankyrin-like protein [*Oryza sativa* Japonica Group] > gi|113534322|dbj|BAF06705.1| Os01g0846600 [*Oryza sativa* Japonica Group] > gi|215687255|dbj|BAG91820.1| unnamed protein product [*Oryza sativa* Japonica Group] > gi|222619533|gb|EEE55665.1| hypothetical protein OsJ_04065 [*Oryza sativa* Japonica Group] | 0.81 | 377 | 574 |
| | | XP_002458754 | hypothetical protein SORBIDRAFT_03g039680 [*Sorghum bicolor*] > gi|241930729|gb|EES03874.1| hypothetical protein | 0.81 | 378 | 575 |

TABLE 5-continued

Target Genes of miRNAs Associated with Increased NUE (Table 1)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | SORBIDRAFT_03g039680 [*Sorghum bicolor*] | | | |
| | | ACR35053 | unknown [*Zea mays*] | 0.81 | 379 | 576 |
| | | NP_001147927 | LOC100281537 [*Zea mays*] > gi|195614640|gb|ACG29150.1| ankyrin-like protein [*Zea mays*] | 0.79 | 380 | 577 |
| Predicted folded 24-nts-long seq 51469 | 1320-1343 | XP_002457719 | hypothetical protein SORBIDRAFT_03g012350 [*Sorghum bicolor*] > gi|241929694|gb|EES02839.1| hypothetical protein SORBIDRAFT_03g012350 [*Sorghum bicolor*] | 1.00 | 381 | 578 |
| | | NP_001183022 | hypothetical protein LOC100501344 [*Zea mays*] > gi|238008824|gb|ACR35447.1| unknown [*Zea mays*] | 0.85 | 382 | 579 |
| | | XP_002457721 | hypothetical protein SORBIDRAFT_03g012360 [*Sorghum bicolor*] > gi|241929696|gb|EES02841.1| hypothetical protein SORBIDRAFT_03g012360 [*Sorghum bicolor*] | 0.77 | 383 | 580 |
| | | XP_002457722 | hypothetical protein SORBIDRAFT_03g012370 [*Sorghum bicolor*] > gi|241929697|gb|EES02842.1| hypothetical protein SORBIDRAFT_03g012370 [*Sorghum bicolor*] | 0.73 | 384 | 581 |
| zma-miR399f* | 158-179 | NP_001147885 | LOC100281495 [*Zea mays*] > gi|195611982|gb|ACG27821.1| citrate transporter family protein [*Zea mays*] > gi|195614372|gb|ACG29016.1| citrate transporter family protein [*Zea mays*] | 1.00 | 385 | 582 |
| | | ACF86945 | unknown [*Zea mays*] | 0.93 | 386 | 583 |
| | | ACG28034 | citrate transporter family protein [*Zea mays*] | 0.98 | 387 | 584 |
| | | NP_001048962 | Os03g0147400 [*Oryza sativa* Japonica Group] > gi|15451603|gb|AAK98727.1| AC090485_6 Putative anion transporter [*Oryza sativa* Japonica Group] > gi|108706182|gb|ABF93977.1| transmembrane protein, putative, expressed [*Oryza sativa* Japonica Group] > gi|108706183|gb|ABF93978.1| transmembrane protein, putative, expressed [*Oryza sativa* Japonica Group] > gi|108706184|gb|ABF93979.1| transmembrane protein, putative, expressed [*Oryza sativa* Japonica Group] > gi|108706185|gb|ABF93980.1| transmembrane protein, putative, expressed [*Oryza sativa* Japonica Group] > gi|13547433|dbj|BAF10876.1| Os03g0147400 [*Oryza sativa* Japonica Group] > gi|125542408|gb|EAY88547.1| hypothetical protein | 0.80 | 388 | 585 |

TABLE 5-continued

Target Genes of miRNAs Associated with Increased NUE (Table 1)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | EAY78724 | OsI_10021 [*Oryza sativa Indica* Group] > gi\|125584918\|gb\|EAZ25582.1\| hypothetical protein OsJ_09409 [*Oryza sativa Japonica* Group] hypothetical protein OsI_33828 [*Oryza sativa Indica* Group] > gi\|125574971\|gb\|EAZ16255.1\| hypothetical protein OsJ_31712 [*Oryza sativa Japonica* Group] | 0.83 | 389 | |
| | | NP_001151517 | LOC100285151 [*Zea mays*] > gi\|195647360\|gb\|ACG43148.1\| citrate transporter family protein [*Zea mays*] > gi\|223948219\|gb\|ACN28193.1\| unknown [*Zea mays*] > gi\|223974939\|gb\|ACN31657.1\| unknown [*Zea mays*] > gi\|238009364\|gb\|ACR35717.1\| unknown [*Zea mays*] | 0.80 | 390 | 586 |
| | | ACG43196 | citrate transporter family protein [*Zea mays*] | 0.80 | 391 | 587 |
| | | ACL54556 | unknown [*Zea mays*] | 0.77 | 392 | 588 |
| | | BAK05230 | predicted protein [*Hordeum vulgare* subsp. *vulgare*] | 0.78 | 393 | 589 |
| | | BAK06146 | predicted protein [*Hordeum vulgare* subsp. *vulgare*] | 0.78 | 394 | 590 |
| | 650-671 | XP_002460963 | hypothetical protein SORBIDRAFT_02g038300 [*Sorghum bicolor*] > gi\|241924340\|gb\|EER97484.1\| hypothetical protein SORBIDRAFT_02g038300 [*Sorghum bicolor*] | 1.00 | 395 | 591 |
| | | NP_001148467 | LOC100282082 [*Zea mays*] > gi\|195619570\|gb\|ACG31615.1\| saccharopine dehydrogenase [*Zea mays*] | 0.92 | 396 | 592 |
| | | EAZ04584 | hypothetical protein OsI_26734 [*Oryza sativa Indica* Group] | 0.79 | 397 | |
| | | BAJ97022 | predicted protein [*Hordeum vulgare* subsp. *vulgare*] | 0.79 | 398 | 593 |
| | | EAZ40532 | hypothetical protein OsJ_24988 [*Oryza sativa Japonica* Group] | 0.73 | 399 | |
| Predicted folded 24-nts-long seq 52499 | 2327-2350 | NP_001169325 | hypothetical protein LOC100383191 [*Zea mays*] > gi\|224028683\|gb\|ACN33417.1\| unknown [*Zea mays*] | 1.00 | 400 | 594 |
| | | XP_002447125 | hypothetical protein SORBIDRAFT_06g029090 [*Sorghum bicolor*] > gi\|241938308\|gb\|EES11453.1\| hypothetical protein SORBIDRAFT_06g029090 [*Sorghum bicolor*] | 0.98 | 401 | 595 |
| Predicted zma mir 50545 | 287-306 | XP_002447878 | hypothetical protein SORBIDRAFT_06g017360 [*Sorghum bicolor*] > gi\|241939061\|gb\|EES12206.1\| hypothetical protein SORBIDRAFT_06g017360 [*Sorghum bicolor*] | 1.00 | 402 | 596 |
| | | NP_001151469 | translocon Tic40 [*Zea mays*] > gi\|219887501\|gb\|ACL54125.1\| unknown [*Zea mays*] | 0.90 | 403 | 597 |

TABLE 5-continued

Target Genes of miRNAs Associated with Increased NUE (Table 1)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | ACG42966 | translocon Tic40 [*Zea mays*] | 0.90 | 404 | 598 |
| | | NP_001149949 | translocon Tic40 [*Zea mays*] > gi|195635683|gb|ACG37310.1| translocon Tic40 [*Zea mays*] | 0.90 | 405 | 599 |
| | | NP_001052871 | Os04g0439900 [*Oryza sativa Japonica* Group] > gi|113564442|dbj|BAF14785.1| Os04g0439900 [*Oryza sativa Japonica* Group] > gi|116309806|emb|CAH66845.1| H0525C06.8 [*Oryza sativa Indica* Group] > gi|215704350|dbj|BAG93784.1| unnamed protein product [*Oryza sativa Japonica* Group] > gi|218194904|gb|EEC77331.1| hypothetical protein OsI_16005 [*Oryza sativa Indica* Group] > gi|222628923|gb|EEE61055.1| hypothetical protein OsJ_14912 [*Oryza sativa Japonica* Group] | 0.81 | 406 | 600 |
| | | BAJ97578 | predicted protein [*Hordeum vulgare* subsp. *vulgare*] | 0.78 | 407 | 601 |
| | 46-65 | NP_001182915 | hypothetical protein LOC100501201 [*Zea mays*] > gi|238008164|gb|ACR35117.1| unknown [*Zea mays*] | 1.00 | 408 | 602 |
| | | ACN33347 | unknown [*Zea mays*] | 0.84 | 409 | 603 |
| | | NP_001150079 | CID11 [*Zea mays*] > gi|195636508|gb|ACG37722.1| CID11 [*Zea mays*] | 0.83 | 410 | 604 |
| | | XP_002444926 | hypothetical protein SORBIDRAFT_07g001560 [*Sorghum bicolor*] > gi|241941276|gb|EES14421.1| hypothetical protein SORBIDRAFT_07g001560 [*Sorghum bicolor*] | 0.78 | 411 | 605 |
| | | BAD33089 | putative RNA-binding protein RBP37 [*Oryza sativa Japonica* Group] > gi|182375457|dbj|BAG24017.1| RNA-binding protein [*Oryza sativa Japonica* Group] > gi|215736921|dbj|BAG95850.1| unnamed protein product [*Oryza sativa Japonica* Group] > gi|222639804|gb|EEE67936.1| hypothetical protein OsJ_25822 [*Oryza sativa Japonica* Group] | 0.74 | 412 | |
| | | EEC82815 | hypothetical protein OsI_27601 [*Oryza sativa Indica* Group] | 0.72 | 413 | |
| | | BAJ96189 | predicted protein [*Hordeum vulgare* subsp. *vulgare*] | 0.75 | 414 | 606 |
| | | XP_002518926 | RNA-binding protein, putative [*Ricinus communis*] > gi|223541913|gb|EEF43459.1| RNA-binding protein, putative [*Ricinus communis*] | 0.75 | 415 | 607 |
| | | XP_002272223 | PREDICTED: hypothetical protein [*Vitis vinifera*] > gi|302143972|emb|CBI23077.3| unnamed protein product [*Vitis vinifera*] | 0.75 | 416 | 608 |

TABLE 5-continued

Target Genes of miRNAs Associated with Increased NUE (Table 1)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | 605-624 | NP_001142867 | hypothetical protein LOC100275266 [Zea mays] > gi|195610696|gb|ACG27178.1| hypothetical protein [Zea mays] | 1.00 | 417 | 609 |
| | | XP_002448750 | hypothetical protein SORBIDRAFT_06g032540 [Sorghum bicolor] > gi|241939933|gb|EES13078.1| hypothetical protein SORBIDRAFT_06g032540 [Sorghum bicolor] | 0.83 | 418 | 610 |
| | | NP_001143447 | hypothetical protein LOC100276102 [Zea mays] > gi|195620654|gb|ACG32157.1| hypothetical protein [Zea mays] | 0.78 | 419 | 611 |
| | | NP_001054225 | Os04g0672300 [Oryza sativa Japonica Group] > gi|90265231|emb|CAH67766.1| H0322F07.3 [Oryza sativa Indica Group] > gi|113565796|dbj|BAF16139.1| Os04g0672300 [Oryza sativa Japonica Group] > gi|215715224|dbj|BAG94975.1| unnamed protein product [Oryza sativa Japonica Group] | 0.72 | 420 | 612 |
| | 360-379 | NP_001043014 | Os01g0358300 [Oryza sativa Japonica Group] > gi|53791615|dbj|BAD52962.1| unknown protein [Oryza sativa Japonica Group] > gi|113532545|dbj|BAF04928.1| Os01g0358300 [Oryza sativa Japonica Group] > gi|215765732|dbj|BAG87429.1| unnamed protein product [Oryza sativa Japonica Group] > gi|218188197|gb|EEC70624.1| hypothetical protein OsI_01883 [Oryza sativa Indica Group] > gi|222618419|gb|EEE54551.1| hypothetical protein OsJ_01736 [Oryza sativa Japonica Group] | 1.00 | 421 | 613 |
| | | ACF87799 | unknown [Zea mays] | 0.86 | 422 | 614 |
| | | ACN30638 | unknown [Zea mays] | 0.85 | 423 | 615 |
| | | BAJ94646 | predicted protein [Hordeum vulgare subsp. vulgare] | 0.84 | 424 | 616 |
| | 557-576 | XP_002455496 | hypothetical protein SORBIDRAFT_03g011990 [Sorghum bicolor] > gi|241927471|gb|EES00616.1| hypothetical protein SORBIDRAFT_03g011990 [Sorghum bicolor] | 1.00 | 425 | 617 |
| | | XP_002457709 | hypothetical protein SORBIDRAFT_03g011980 [Sorghum bicolor] > gi|241929684|gb|EES02829.1| hypothetical protein SORBIDRAFT_03g011980 [Sorghum bicolor] | 0.98 | 426 | 618 |
| | | ACN26409 | unknown [Zea mays] | 0.93 | 427 | 619 |
| | | ACN27987 | unknown [Zea mays] | 0.93 | 428 | 620 |
| | | NP_001152255 | peroxidase 1 [Zea mays] > gi|195654333|gb|ACG46634.1| peroxidase 1 precursor [Zea mays] | 0.93 | 429 | 621 |

TABLE 5-continued

Target Genes of miRNAs Associated with Increased NUE (Table 1)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | EAY73614 | hypothetical protein OsI_01501 [*Oryza sativa Indica* Group] | 0.81 | 430 | |
| | | NP_001042800 | Os01g0294700 [*Oryza sativa Japonica* Group] > gi|9909174|dbj|BAB12033.1| putative peroxidase [*Oryza sativa Japonica* Group] > gi|55700889|tpe|CAH69254.1| TPA: class III peroxidase 11 precursor [*Oryza sativa Japonica* Group] > gi|113532331|dbj|BAF04714.1| Os01g0294700 [*Oryza sativa Japonica* Group] > gi|215697074|dbj|BAG91068.1| unnamed protein product [*Oryza sativa Japonica* Group] > gi|215737508|dbj|BAG96638.1| unnamed protein product [*Oryza sativa Japonica* Group] > gi|215740794|dbj|BAG96950.1| unnamed protein product [*Oryza sativa Japonica* Group] | 0.81 | 431 | 622 |
| | | EEE54389 | hypothetical protein OsJ_01407 [*Oryza sativa Japonica* Group] | 0.76 | 432 | |
| | 517-536 | ACN27987 | unknown [*Zea mays*] | 1.00 | 433 | 623 |
| | | NP_001152255 | peroxidase 1 [*Zea mays*] > gi|195654333|gb|ACG46634.1| peroxidase 1 precursor [*Zea mays*] | 1.00 | 434 | 624 |
| | | ACN26409 | unknown [*Zea mays*] | 0.94 | 435 | 625 |
| | | XP_002457709 | hypothetical protein SORBIDRAFT_03g011980 [*Sorghum bicolor*] > gi|241929684|gb|EES02829.1| hypothetical protein SORBIDRAFT_03g011980 [*Sorghum bicolor*] | 0.93 | 436 | 626 |
| | | XP_002455496 | hypothetical protein SORBIDRAFT_03g011990 [*Sorghum bicolor*] > gi|241927471|gb|EES00616.1| hypothetical protein SORBIDRAFT_03g011990 [*Sorghum bicolor*] | 0.93 | 437 | 627 |
| | | EAY73614 | hypothetical protein OsI_01501 [*Oryza sativa Indica* Group] | 0.81 | 438 | |
| | | NP_001042800 | Os01g0294700 [*Oryza sativa Japonica* Group] > gi|9909174|dbj|BAB12033.1| putative peroxidase [*Oryza sativa Japonica* Group] > gi|55700889|tpe|CAH69254.1| TPA: class III peroxidase 11 precursor [*Oryza sativa Japonica* Group] > gi|113532331|dbj|BAF04714.1| Os01g0294700 [*Oryza sativa Japonica* Group] > gi|215697074|dbj|BAG91068.1| unnamed protein product [*Oryza sativa Japonica* Group] | 0.81 | 439 | 628 |

TABLE 5-continued

Target Genes of miRNAs Associated with Increased NUE (Table 1)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | > gi|215737508|dbj|BAG96638.1| unnamed protein product [Oryza sativa Japonica Group] > gi|215740794|dbj|BAG96950.1| unnamed protein product [Oryza sativa Japonica Group] | | | |
| | | EEE54389 | hypothetical protein OsJ_01407 [Oryza sativa Japonica Group] | 0.76 | 440 | |
| | 286-305 | ACG31680 | pepsin A [Zea mays] | 1.00 | 441 | 629 |
| | | NP_001141522 | hypothetical protein LOC100273634 [Zea mays] > gi|194704920|gb|ACF86544.1| unknown [Zea mays] > gi|223949445|gb|ACN28806.1| unknown [Zea mays] | 0.99 | 442 | 630 |
| | | ACL54367 | unknown [Zea mays] | 0.99 | 443 | 631 |
| | | NP_001132197 | hypothetical protein LOC100193625 [Zea mays] > gi|194693730|gb|ACF80949.1| unknown [Zea mays] > gi|195605492|gb|ACG24576.1| pepsin A [Zea mays] | 0.89 | 444 | 632 |
| | | NP_001048134 | Os02g0751100 [Oryza sativa Japonica Group] > gi|46390211|dbj|BAD15642.1| aspartyl protease-like [Oryza sativa Japonica Group] > gi|113537665|dbj|BAF10048.1| Os02g0751100 [Oryza sativa Japonica Group] > gi|222623681|gb|EEE57813.1| hypothetical protein OsJ_08401 [Oryza sativa Japonica Group] | 0.80 | 445 | 633 |
| | | EEC74016 | hypothetical protein OsI_08957 [Oryza sativa Indica Group] | 0.79 | 446 | |
| | | ACN27411 | unknown [Zea mays] | 0.77 | 447 | 634 |
| | | BAK05106 | predicted protein [Hordeum vulgare subsp. vulgare] | 0.75 | 448 | 635 |
| | 309-328 | NP_001143133 | hypothetical protein LOC100275611 [Zea mays] > gi|195614826|gb|ACG29243.1| hypothetical protein [Zea mays] | 1.00 | 449 | 636 |
| | | ACF83002 | unknown [Zea mays] | 0.99 | 450 | 637 |
| | | BAJ87435 | predicted protein [Hordeum vulgare subsp. vulgare] | 0.72 | 451 | 638 |
| | 46-65 | XP_002444926 | hypothetical protein SORBIDRAFT_07g001560 [Sorghum bicolor] > gi|241941276|gb|EES14421.1| hypothetical protein SORBIDRAFT_07g001560 [Sorghum bicolor] | 1.00 | 452 | 639 |
| | | ACN33347 | unknown [Zea mays] | 0.85 | 453 | 640 |
| | | NP_001182915 | hypothetical protein LOC100501201 [Zea mays] > gi|238008164|gb|ACR35117.1| unknown [Zea mays] | 0.87 | 454 | 641 |
| | | NP_001150079 | CID11 [Zea mays] > gi|195636508|gb|ACG37722.1| CID11 [Zea mays] | 0.86 | 455 | 642 |
| | | BAD33089 | putative RNA-binding protein RBP37 [Oryza sativa Japonica Group] > gi|182375457|dbj|BAG24017.1| | 0.75 | 456 | |

TABLE 5-continued

Target Genes of miRNAs Associated with Increased NUE (Table 1)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | RNA-binding protein [*Oryza sativa Japonica* Group] > gi|215736921|dbj|BAG95850.1| unnamed protein product [*Oryza sativa Japonica* Group] > gi|222639804|gb|EEE67936.1| hypothetical protein OsJ_25822 [*Oryza sativa Japonica* Group] | | | |
| | | EEC82815 | hypothetical protein OsI_27601 [*Oryza sativa Indica* Group] | 0.72 | 457 | |
| | 40563 | NP_001059821 | Os07g0524100 [*Oryza sativa Japonica* Group] > gi|75118816|sp|Q69SA9.1| PDI54_ORYSJ RecName: Full = Protein disulfide isomerase-like 5-4; Short = OsPDIL5-4; AltName: Full = Protein disulfide isomerase-like 8-1; Short = OsPDIL8-1; Flags: Precursor > gi|50508559|dbj|BAD30858.1| thioredoxin family-like protein [*Oryza sativa Japonica* Group] > gi|113611357|dbj|BAF21735.1| Os07g0524100 [*Oryza sativa Japonica* Group] > gi|215704615|dbj|BAG94243.1| unnamed protein product [*Oryza sativa Japonica* Group] > gi|218199742|gb|EEC82169.1| hypothetical protein OsI_26259 [*Oryza sativa Indica* Group] > gi|222637167|gb|EEE67299.1| hypothetical protein OsJ_24505 [*Oryza sativa Japonica* Group] | 1.00 | 458 | 643 |
| | | BAJ86285 | predicted protein [*Hordeum vulgare* subsp. *vulgare*] | 0.93 | 459 | 644 |
| | | CBG91903 | putative PDI-like protein [*Triticum aestivum*] > gi|299469398|emb|CBG91917.1| putative PDI-like protein [*Triticum aestivum*] | 0.93 | 460 | |
| | | ACG39185 | PDIL5-4-*Zea mays* protein disulfide isomerase | 0.91 | 461 | 645 |
| | | NP_001105762 | protein disulfide isomerase12 [*Zea mays*] > gi|59861281|gb|AAX09970.1| protein disulfide isomerase [*Zea mays*] | 0.91 | 462 | 646 |
| | | ACN34146 | unknown [*Zea mays*] | 0.91 | 463 | 647 |
| | | XP_002522864 | thioredoxin domain-containing protein, putative [*Ricinus communis*] > gi|223537948|gb|EEF39562.1| thioredoxin domain-containing protein, putative [*Ricinus communis*] | 0.76 | 464 | 648 |
| | | XP_002281649 | PREDICTED: hypothetical protein [*Vitis vinifera*] > gi|297735969|emb|CBI23943.3| unnamed protein product [*Vitis vinifera*] | 0.74 | 465 | 649 |

TABLE 5-continued

Target Genes of miRNAs Associated with Increased NUE (Table 1)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | XP_002319814 | predicted protein [*Populus trichocarpa*] > gi|222858190|gb|EEE95737.1| predicted protein [*Populus trichocarpa*] | 0.74 | 466 | 650 |
| | | XP_002317580 | predicted protein [*Populus trichocarpa*] > gi|222860645|gb|EEE98192.1| predicted protein [*Populus trichocarpa*] | 0.74 | 467 | 651 |
| | 301-320 | ACF87799 | unknown [*Zea mays*] | 1.00 | 468 | 652 |
| | | ACN30638 | unknown [*Zea mays*] | 0.97 | 469 | 653 |
| | | NP_001043014 | Os01g0358300 [*Oryza sativa Japonica* Group] > gi|53791615|dbj|BAD52962.1| unknown protein [*Oryza sativa Japonica* Group] > gi|113532545|dbj|BAF04928.1| Os01g0358300 [*Oryza sativa Japonica* Group] > gi|215765732|dbj|BAG87429.1| unnamed protein product [*Oryza sativa Japonica* Group] > gi|218188197|gb|EEC70624.1| hypothetical protein OsI_01883 [*Oryza sativa Indica* Group] > gi|222618419|gb|EEE54551.1| hypothetical protein OsJ_01736 [*Oryza sativa Japonica* Group] | 0.87 | 470 | 654 |
| | | BAJ94646 | predicted protein [*Hordeum vulgare* subsp. *vulgare*] | 0.83 | 471 | 655 |
| Predicted zma mir 48350 | 40752 | ACF86440 | unknown [*Zea mays*] | 1.00 | 472 | 656 |
| | 22-43 | ABF67946 | putative Opie4 pol protein [*Zea mays*] | 1.00 | 473 | |
| | | AAC49502 | Pol [*Zea mays*] | 0.97 | 474 | 657 |
| | | ABF67947 | Opie2 pol protein [*Zea mays*] | 0.96 | 475 | |
| | | ABF67934 | Opie3 pol polyprotein [*Zea mays*] | 0.96 | 476 | |
| | | AAL35396 | Opie2a pol [*Zea mays*] > gi|168251075|gb|ACA21858.1| Opie2a pol protein [*Zea mays*] | 0.92 | 477 | |
| | | ABF67921 | Ji1 putative pol protein [*Zea mays*] | 0.79 | 478 | |
| | | AAD20307 | copia-type pol polyprotein [*Zea mays*] | 0.79 | 479 | |
| Predicted zma mir 49162 | 810-831 | XP_002455047 | hypothetical protein SORBIDRAFT_03g003530 [*Sorghum bicolor*] > gi|241927022|gb|EES00167.1| hypothetical protein SORBIDRAFT_03g003530 [*Sorghum bicolor*] | 1.00 | 480 | 658 |
| | | AAK51797 | small heat shock protein HSP17.8 [*Triticum aestivum*] | 0.83 | 481 | 659 |
| | | BAJ86365 | predicted protein [*Hordeum vulgare* subsp. *vulgare*] | 0.82 | 482 | 660 |
| | | NP_001105954 | 17.8 kDa class II heat shock protein [*Zea mays*] > gi|123553|sp|P24632.1|HSP22_MAIZE RecName: Full = 17.8 kDa class II heat shock protein > gi|22337|emb|CAA38012.1| 18 kDa heat shock protein [*Zea mays*] | 0.87 | 483 | 661 |

TABLE 5-continued

Target Genes of miRNAs Associated with Increased NUE (Table 1)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | > gi|238009918|gb|ACR35994.1| unknown [*Zea mays*] > gi|238015198|gb|ACR38634.1| unknown [*Zea mays*] | | | |
| | | CAI96500 | 17.6 kDa heat-shock protein [*Triticum turgidum* subsp. *dicoccon*] | 0.83 | 484 | 662 |
| | | BAK07165 | predicted protein [*Hordeum vulgare* subsp. *vulgare*] | 0.81 | 485 | 663 |
| | | CAI96499 | 17.5 kDa heat-shock protein [*Triticum turgidum* subsp. *dicoccoides*] | 0.81 | 486 | 664 |
| | | CAI96501 | 17.6 kDa heat-shock protein [*Triticum turgidum* subsp. *durum*] | 0.82 | 487 | 665 |
| | | NP_001148454 | 17.5 kDa class II heat shock protein [*Zea mays*] > gi|195619384|gb|ACG31522.1| 17.5 kDa class II heat shock protein [*Zea mays*] | 0.87 | 488 | 666 |
| | | BAK05681 | predicted protein [*Hordeum vulgare* subsp. *vulgare*] | 0.80 | 489 | 667 |
| Predicted zma mir 48877 | 597-618 | XP_002456299 | hypothetical protein SORBIDRAFT_03g033710 [*Sorghum bicolor*] > gi|241928274|gb|EES01419.1| hypothetical protein SORBIDRAFT_03g033710 [*Sorghum bicolor*] | 1.00 | 490 | 668 |
| | | ACF79056 | unknown [*Zea mays*] > gi|194693496|gb|ACF80832.1| unknown [*Zea mays*] > gi|195626284|gb|ACG34972.1| GTP-binding protein [*Zea mays*] > gi|223946703|gb|ACN27435.1| unknown [*Zea mays*] | 0.92 | 491 | 669 |
| | | NP_001140242 | hypothetical protein LOC100272283 [*Zea mays*] > gi|194698666|gb|ACF8417.1| unknown [*Zea mays*] | 0.92 | 492 | 670 |
| | | NP_001044154 | Os01g0732200 [*Oryza sativa Japonica* Group] > gi|57899709|dbj|BAD87429.1| putative GTP-binding protein [*Oryza sativa Japonica* Group] > gi|113533685|dbj|BAF06068.1| Os01g0732200 [*Oryza sativa Japonica* Group] > gi|215695283|dbj|BAG90474.1| unnamed protein product [*Oryza sativa Japonica* Group] | 0.84 | 493 | 671 |
| | | EEC71435 | hypothetical protein OsI_03633 [*Oryza sativa Indica* Group] > gi|222619209|gb|EEE5541.1| hypothetical protein OsJ_03357 [*Oryza sativa Japonica* Group] | 0.84 | 494 | |
| | 218-239 | XP_002463058 | hypothetical protein SORBIDRAFT_02g036900 [*Sorghum bicolor*] > gi|241926435|gb|EER99579.1| hypothetical protein SORBIDRAFT_02g036900 [*Sorghum bicolor*] | 1.00 | 495 | 672 |
| | | NP_001142066 | hypothetical protein LOC100274223 [*Zea mays*] > gi|194706978|gb|ACF87573.1| unknown [*Zea mays*] | 0.90 | 496 | 673 |

TABLE 5-continued

Target Genes of miRNAs Associated with Increased NUE (Table 1)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | BAJ95349 | predicted protein [*Hordeum vulgare* subsp. *vulgare*] > gi\|326526013\|dbj\|BAJ93183.1\| predicted protein [*Hordeum vulgare* subsp. *vulgare*] | 0.75 | 497 | 674 |
| | | EAZ40364 | hypothetical protein OsJ_24810 [*Oryza sativa Japonica* Group] | 0.73 | 498 | |
| | | EAZ04406 | hypothetical protein OsI_26550 [*Oryza sativa Indica* Group] | 0.73 | 499 | |
| Predicted folded 24-nts-long seq 52057 | 63-86 | AAD11615 | prpol [*Zea mays*] | 1.00 | 500 | 675 |
| | | AAL76007 | prpol [*Zea mays*] | 0.97 | 501 | |
| | 907-930 | AAD11616 | prpol [*Zea mays*] | 1.00 | 502 | 676 |
| Predicted folded 24-nts-long seq 52633 | 387-410 | XP_002445682 | hypothetical protein SORBIDRAFT_07g024170 [*Sorghum bicolor*] > gi\|241942032\|gb\|EES15177.1\| hypothetical protein SORBIDRAFT_07g024170 [*Sorghum bicolor*] | 1.00 | 503 | 677 |
| | | ACF83553 | unknown [*Zea mays*] > gi\|195646380\|gb\|ACG42658.1\| glutathione S-transferase, N-terminal domain containing protein [*Zea mays*] | 0.90 | 504 | 678 |
| | | ACN26529 | unknown [*Zea mays*] | 0.89 | 505 | 679 |
| Predicted zma mir 48922 | 450-470 | NP_001141971 | hypothetical protein LOC100274121 [*Zea mays*] > gi\|194706630\|gb\|ACF87399.1\| unknown [*Zea mays*] | 1.00 | 506 | 680 |
| | | XP_002455881 | hypothetical protein SORBIDRAFT_03g026750 [*Sorghum bicolor*] > gi\|241927856\|gb\|EES01001.1\| hypothetical protein SORBIDRAFT_03g026750 [*Sorghum bicolor*] | 0.79 | 507 | 681 |
| Predicted zma mir 50077 | 1046-1067 | XP_002465053 | hypothetical protein SORBIDRAFT_01g031330 [*Sorghum bicolor*] > gi\|241918907\|gb\|EER92051.1\| hypothetical protein SORBIDRAFT_01g031330 [*Sorghum bicolor*] | 1.00 | 508 | 682 |
| | | NP_001137129 | hypothetical protein LOC100217311 [*Zea mays*] > gi\|194698486\|gb\|ACF83327.1\| unknown [*Zea mays*] | 0.90 | 509 | 683 |
| | | NP_001149312 | fas-associated factor 1-like protein [*Zea mays*] > gi\|195626306\|gb\|ACG34983.1\| fas-associated factor 1-like protein [*Zea mays*] > gi\|223975789\|gb\|ACN32082.1\| unknown [*Zea mays*] | 0.93 | 510 | 684 |
| | | BAJ89712 | predicted protein [*Hordeum vulgare* subsp. *vulgare*] > gi\|326495414\|dbj\|BAJ85803.1\| predicted protein [*Hordeum vulgare* subsp. *vulgare*] | 0.83 | 511 | 685 |
| | | AAG13433 | unknown protein [*Oryza sativa Japonica* Group] > gi\|31433109\|gb\|AAP54662.1\| | 0.85 | 512 | 686 |

TABLE 5-continued

Target Genes of miRNAs Associated with Increased NUE (Table 1)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | UBX domain containing protein, expressed [*Oryza sativa Japonica* Group] > gi\|215678662\|dbj\|BAG92317.1\| unnamed protein product [*Oryza sativa Japonica* Group] | | | |
| | | EAY79232 | hypothetical protein OsI_34349 [*Oryza sativa Indica* Group] | 0.85 | 513 | |
| | | EAZ16707 | hypothetical protein OsJ_32183 [*Oryza sativa Japonica* Group] | 0.81 | 514 | |

Table 5: Provided are the target Genes of miRNAs Associated with Increased NUE (Table 1) along with their GenBank Accession numbers and sequence identifiers (SEQ ID NO:).
"bind" = binding;
"pos" = position;
"hom" = homologue;
"p.p." = polypeptide;
"p.n." = polynucleotide.

TABLE 6

Target Genes of down regulated miRNAs Associated with Increased NUE (Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| Predicted zma mir 50318 | 743-763 | NP_001148146 | terpene synthase 7 [*Zea mays*] > gi\|195616112\|gb\|ACG29886.1\| terpene synthase 7 [*Zea mays*] | 1.00 | 687 | 1392 |
| | | ACL54589 | unknown [*Zea mays*] | 0.99 | 688 | 1393 |
| | | XP_002447434 | hypothetical protein SORBIDRAFT_06g001020 [*Sorghum bicolor*] > gi\|241938617\|gb\|EES11762.1\| hypothetical protein SORBIDRAFT_06g001020 [*Sorghum bicolor*] | 0.71 | 689 | 1394 |
| | 776-796 | XP_002455470 | hypothetical protein SORBIDRAFT_03g011420 [*Sorghum bicolor*] > gi\|241927445\|gb\|EES00590.1\| hypothetical protein SORBIDRAFT_03g011420 [*Sorghum bicolor*] | 1.00 | 690 | 1395 |
| | | NP_001151624 | cyclin-like F-box [*Zea mays*] > gi\|195648178\|gb\|ACG43557.1\| cyclin-like F-box [*Zea mays*] | 0.90 | 691 | 1396 |
| | | BAJ88045 | predicted protein [*Hordeum vulgare* subsp. *vulgare*] > gi\|326521874\|dbj\|BAK04065.1\| predicted protein [*Hordeum vulgare* subsp. *vulgare*] | 0.79 | 692 | 1397 |
| | | NP_001042756 | Os01g0281000 [*Oryza sativa Japonica* Group] > gi\|6498442\|dbj\|BAA87845.1\| unknown protein [*Oryza sativa Japonica* Group] > gi\|11041564\|dbj\|BAB00648.2\| unnamed protein product [*Oryza sativa Japonica* Group] > gi\|11138071\|dbj\|BAB17744.1\| OSJNBa0036E02.18 [*Oryza sativa Japonica* Group] > gi\|13873014\|dbj\|BAB44118.1\| | 0.81 | 693 | 1398 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | unknown protein [*Oryza sativa Japonica* Group] > gi|113532287|dbj|BAF04670.1| Os01g0281000 [*Oryza sativa Japonica* Group] > gi|215694300|dbj|BAG89293.1| unnamed protein product [*Oryza sativa Japonica* Group] | | | |
| | | EEE54342 | hypothetical protein OsJ_01321 [*Oryza sativa Japonica* Group] | 0.75 | 694 | |
| | | EEC70414 | hypothetical protein OsI_01411 [*Oryza sativa Indica* Group] | 0.75 | 695 | |
| | 2058-2078 | XP_002468633 | hypothetical protein SORBIDRAFT_01g049370 [*Sorghum bicolor*] > gi|241922487|gb|EER95631.1| hypothetical protein SORBIDRAFT_01g049370 [*Sorghum bicolor*] | 1.00 | 696 | 1399 |
| | | NP_001130361 | hypothetical protein LOC100191456 [*Zea mays*] > gi|194688936|gb|ACF78552.1| unknown [*Zea mays*] > gi|194707734|gb|ACF87951.1| unknown [*Zea mays*] | 0.98 | 697 | 1400 |
| | | NP_001167830 | hypothetical protein LOC100381530 [*Zea mays*] > gi|223944309|gb|ACN26238.1| unknown [*Zea mays*] | 0.96 | 698 | 1401 |
| | | NP_001046725 | Os02g0332200 [*Oryza sativa Japonica* Group] > gi|46390985|dbj|BAD16520.1| putative cytosolic chaperonin delta-subunit [*Oryza sativa Japonica* Group] > gi|113536256|dbj|BAF08639.1| Os02g0332200 [*Oryza sativa Japonica* Group] > gi|215695341|dbj|BAG90532.1| unnamed protein product [*Oryza sativa Japonica* Group] > gi|222636848|gb|EEE66980.1| hypothetical protein OsJ_23870 [*Oryza sativa Japonica* Group] | 0.95 | 699 | 1402 |
| | | EAZ06856 | hypothetical protein OsI_29091 [*Oryza sativa Indica* Group] | 0.95 | 700 | |
| | | BAJ97289 | predicted protein [*Hordeum vulgare* subsp. *vulgare*] | 0.92 | 701 | 1403 |
| | | NP_001065054 | Os10g0514600 [*Oryza sativa Japonica* Group] > gi|10140686|gb|AAG13521.1| AC068924_26 putative cytosolic chaperonin, delta-subunit [*Oryza sativa Japonica* Group] > gi|31433047|gb|AAP54607.1| T-complex protein 1, delta subunit, putative, expressed [*Oryza sativa Japonica* Group] > gi|113639663|dbj|BAF26968.1| Os10g0514600 [*Oryza sativa Japonica* Group] > gi|215687328|dbj|BAG91872.1| unnamed protein product [*Oryza sativa Japonica* Group] | 0.88 | 702 | 1404 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | XP_002322076 | predicted protein [*Populus trichocarpa*] > gi\|222869072\|gb\|EEF06203.1\| predicted protein [*Populus trichocarpa*] | 0.81 | 703 | 1405 |
| | | XP_002317895 | predicted protein [*Populus trichocarpa*] > gi\|222858568\|gb\|EEE96115.1\| predicted protein [*Populus trichocarpa*] | 0.80 | 704 | 1406 |
| | | CAN70636 | hypothetical protein VITISV_008621 [*Vitis vinifera*] | 0.82 | 705 | 1407 |
| | 554-574 | XP_002465983 | hypothetical protein SORBIDRAFT_01g049510 [*Sorghum bicolor*] > gi\|241919837\|gb\|EER92981.1\| hypothetical protein SORBIDRAFT_01g049510 [*Sorghum bicolor*] | 1.00 | 706 | 1408 |
| | | NP_001149716 | fusca homolog [*Zea mays*] > gi\|195629716\|gb\|ACG36499.1\| COP9 signalosome complex subunit 1 [*Zea mays*] | 0.95 | 707 | 1409 |
| | | NP_00148760 | Os03g0116500 [*Oryza sativa Japonica* Group] > gi\|108705858\|gb\|ABF93653.1\| COP9 signalosome complex subunit 1, putative, expressed [*Oryza sativa Japonica* Group] > gi\|113547231\|dbj\|BAF10674.1\| Os03g0116500 [*Oryza sativa Japonica* Group] > gi\|125542143\|gb\|EAY88282.1\| hypothetical protein OsI_09737 [*Oryza sativa Indica* Group] > gi\|125584695\|gb\|EAZ25359.1\| hypothetical protein OsJ_09174 [*Oryza sativa Japonica* Group] > gi\|215678827\|dbj\|BAG95264.1\| unnamed protein product [*Oryza sativa Japonica* Group] | 0.89 | 708 | 1410 |
| | | AAF40112 | constitutive photomorphogenic 11 [*Oryza sativa Indica* Group] | 0.88 | 709 | 1411 |
| | | AAG17476 | rCOP11 protein [*Oryza sativa Indica* Group] | 0.88 | 710 | 1412 |
| | | BAJ99160 | predicted protein [*Hordeum vulgare* subsp. *vulgare*] | 0.84 | 711 | 1413 |
| | | BAK01545 | predicted protein [*Hordeum vulgare* subsp. *vulgare*] | 0.78 | 712 | 1414 |
| | | XP_002275895 | PREDICTED: hypothetical protein [*Vitis vinifera*] > gi\|296089065\|emb\|CBI38768.3\| unnamed protein product [*Vitis vinifera*] | 0.72 | 713 | 1415 |
| | | CAN74681 | hypothetical protein VITISV_025856 [*Vitis vinifera*] | 0.72 | 714 | |
| | 372-392 | XP_002448372 | hypothetical protein SORBIDRAFT_06g026160 [*Sorghum bicolor*] > gi\|241939555\|gb\|EES12700.1\| hypothetical protein SORBIDRAFT_06g026160 [*Sorghum bicolor*] | 1.00 | 715 | 1416 |
| | | ADZ96243 | ACC synthase 1 [*Saccharum* hybrid cultivar SP80-3280] | 0.92 | 716 | 1417 |
| | | AAR25558 | acc synthase [*Zea mays*] | 0.92 | 717 | 1418 |
| | | AAR25559 | acc synthase [*Zea mays*] | 0.91 | 718 | 1419 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | NP_001146401 | 1-aminocyclopropane-1-carboxylate synthase7 [Zea mays] > gi|219886697|gb|ACL53723.1| unknown [Zea mays] | 0.91 | 719 | 1420 |
| | | ACN31344 | unknown [Zea mays] | 0.90 | 720 | 1421 |
| | | BAJ95898 | predicted protein [Hordeum vulgare subsp. vulgare] | 0.81 | 721 | 1422 |
| | | NP_001053637 | Os04g0578000 [Oryza sativa Japonica Group] > gi|32488497|emb|CAE03249.1| OSJNBa0011J08.4 [Oryza sativa Japonica Group] > gi|113565208|dbj|BAF15551.1| Os04g0578000 [Oryza sativa Japonica Group] > gi|215693849|dbj|BAG89048.1| unnamed protein product [Oryza sativa Japonica Group] | 0.80 | 722 | 1423 |
| | | CAH66732 | H0404F02.8 [Oryza sativa Indica Group] > gi|125549433|gb|EAY95255.1| hypothetical protein OsI_17075 [Oryza sativa Indica Group] | 0.80 | 723 | 1424 |
| | | AAB18416 | ACC synthase [Triticum aestivum] | 0.80 | 724 | 1425 |
| | 1204-1224 | ACN26771 | unknown [Zea mays] | 1.00 | 725 | 1426 |
| | | ACG31388 | F-box domain containing protein [Zea mays] | 1.00 | 726 | 1427 |
| | | ACG45892 | F-box domain containing protein [Zea mays] | 1.00 | 727 | 1428 |
| | | ACG25717 | F-box domain containing protein [Zea mays] | 0.99 | 728 | 1429 |
| | | NP_001152119 | F-box domain containing protein [Zea mays] > gi|195652827|gb|ACG45881.1| F-box domain containing protein [Zea mays] | 0.96 | 729 | 1430 |
| | | XP_002467684 | hypothetical protein SORBIDRAFT_01g032310 [Sorghum bicolor] > gi|241921538|gb|EER94682.1| hypothetical protein SORBIDRAFT_01g032310 [Sorghum bicolor] | 0.89 | 730 | 1431 |
| | | EAY90508 | hypothetical protein OsI_12108 [Oryza sativa Indica Group] | 0.82 | 731 | |
| | | NP_001050391 | Os03g0423000 [Oryza sativa Japonica Group] > gi|30089733|gb|AAP20837.1| expressed protein [Oryza sativa Japonica Group] > gi|108708889|gb|ABF96684.1| F-box domain containing protein, expressed [Oryza sativa Japonica Group] > gi|113548862|dbj|BAF12305.1| Os03g0423000 [Oryza sativa Japonica Group] > gi|125586708|gb|EAZ27372.1| hypothetical protein OsJ_11320 [Oryza sativa Japonica Group] > gi|215697584|dbj|BAG91578.1| unnamed protein product [Oryza sativa Japonica Group] | 0.82 | 732 | 1432 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | 1019-1039 | XP_002464111 | hypothetical protein SORBIDRAFT_01g012470 [*Sorghum bicolor*] > gi|241917965|gb|EER91109.1| hypothetical protein SORBIDRAFT_01g012470 [*Sorghum bicolor*] | 1.00 | 733 | 1433 |
| | | NP_001140844 | hypothetical protein LOC100272920 [*Zea mays*] > gi|194701412|gb|ACF84790.1| unknown [*Zea mays*] > gi|223943945|gb|ACN26056.1| unknown [*Zea mays*] | 0.97 | 734 | 1434 |
| | | NP_001149791 | transmembrane protein 56 [*Zea mays*] > gi|195634693|gb|ACG36815.1| transmembrane protein 56 [*Zea mays*] | 0.94 | 735 | 1435 |
| | | NP_001050848 | Os03g0666700 [*Oryza sativa Japonica* Group] > gi|40538924|gb|AAR87181.1| expressed protein [*Oryza sativa Japonica* Group] > gi|108710279|gb|ABF98074.1| expressed protein [*Oryza sativa Japonica* Group] > gi|113549319|dbj|BAF12762.1| Os03g0666700 [*Oryza sativa Japonica* Group] > gi|215692429|dbj|BAG87849.1| unnamed protein product [*Oryza sativa Japonica* Group] > gi|215692647|dbj|BAG88067.1| unnamed protein product [*Oryza sativa Japonica* Group] > gi|215716974|dbj|BAG95337.1| unnamed protein product [*Oryza sativa Japonica* Group] | 0.90 | 736 | 1436 |
| | | BAJ94278 | predicted protein [*Hordeum vulgare* subsp. *vulgare*] > gi|326505624|dbj|BAJ95483.1| predicted protein [*Hordeum vulgare* subsp. *vulgare*] > gi|326513826|dbj|BAJ87931.1| predicted protein [*Hordeum vulgare* subsp. *vulgare*] > gi|326518414|dbj|BAJ88236.1| predicted protein [*Hordeum vulgare* subsp. *vulgare*] | 0.91 | 737 | 1437 |
| | | ACF84098 | unknown [*Zea mays*] | 0.93 | 738 | 1438 |
| | | EEE53990 | hypothetical protein OsJ_00621 [*Oryza sativa Japonica* Group] | 0.90 | 739 | |
| | 1917-1937 | XP_002453927 | hypothetical protein SORBIDRAFT_04g021570 [*Sorghum bicolor*] > gi|241933758|gb|EES06903.1| hypothetical protein SORBIDRAFT_04g021570 [*Sorghum bicolor*] | 1.00 | 740 | 1439 |
| | | NP_001105849 | putative glycosyltransferase [*Zea mays*] > gi|84794314|emb|CAJ57382.1| putative glycosyltransferase [*Zea mays*] | 0.96 | 741 | 1440 |
| | | BAK03947 | predicted protein [*Hordeum vulgare* subsp. *vulgare*] | 0.86 | 742 | 1441 |

TABLE 6-continued

Target Genes of down regulated miRNAs Associated with Increased NUE (Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | NP_001047014 | Os02g0529600 [*Oryza sativa Japonica* Group] > gi|49388322|dbj|BAD25434.1| putative galactomannan galactosyltransferase [*Oryza sativa Japonica* Group] > gi|113536545|dbj|BAF08928.1| Os02g0529600 [*Oryza sativa Japonica* Group] > gi|215704838|dbj|BAG94866.1| unnamed protein product [*Oryza sativa Japonica* Group] > gi|218190881|gb|EEC73308.1| hypothetical protein OsI_07488 [*Oryza sativa Indica* Group] > gi|222622984|gb|EEE57116.1| hypothetical protein OsJ_06989 [*Oryza sativa Japonica* Group] | 0.86 | 743 | 1442 |
| | 1590-1610 | NP_001131407 | hypothetical protein LOC100192736 [*Zea mays*] > gi|194691442|gb|ACF79805.1 unknown [*Zea mays*] | 1.00 | 744 | 1443 |
| | | NP_001141840 | hypothetical protein LOC100273982 [*Zea mays*] > gi|194706136|gb|ACF87152.1| unknown [*Zea mays*] | 0.78 | 745 | 1444 |
| | 510-530 | XP_002460574 | hypothetical protein SORBIDRAFT_02g031070 [*Sorghum bicolor*] > gi|241923951|gb|EER97095.1| hypothetical protein SORBIDRAFT_02g031070 [*Sorghum bicolor*] | 1.00 | 746 | 1445 |
| | | NP_001151754 | collagen, type IV, alpha 5 [*Zea mays*] > gi|195649521|gb|ACG44228.1 collagen, type IV, alpha 5 [*Zea mays*] | 0.87 | 747 | 1446 |
| | 876-896 | XP_002437709 | hypothetical protein SORBIDRAFT_10g001120 [*Sorghum bicolor*] > gi|241915932|gb|EER89076.1| hypothetical protein SORBIDRAFT_10g001120 [*Sorghum bicolor*] | 1.00 | 748 | 1447 |
| | | ACN34709 | unknown [*Zea mays*] | 0.99 | 749 | 1448 |
| | | ACN28096 | unknown [*Zea mays*] > gi|223948483|gb|ACN28325.1| unknown [*Zea mays*] | 0.99 | 750 | 1449 |
| | | NP_001056601 | Os06g0114000 [*Oryza sativa Japonica* Group] > gi|7248401|dbj|BAA92724.1| putative chaperonin 60 beta precursor [*Oryza sativa Japonica* Group] > gi|113594641|dbj|BAF18515.1| Os06g0114000 [*Oryza sativa Japonica* Group] > gi|164375533|gb|ABY52934.1| RuBisCo subunit binding-protein beta subunit [*Oryza sativa Japonica* Group] > gi|215715264|dbj|BAG95015.1| unnamed protein product [*Oryza sativa Japonica* Group] | 0.97 | 751 | 1450 |
| | | EEE64974 | hypothetical protein OsJ_19883 [*Oryza sativa Japonica* Group] | 0.93 | 752 | |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | NP_001045601 | Os02g0102900 [*Oryza sativa Japonica* Group] > gi|41052909|dbj|BAD07821.1| putative RuBisCO subunit binding-protein beta subunit, chloroplast precursor [*Oryza sativa Japonica* Group] > gi|113535132|dbj|BAF07515.1| Os02g0102900 [*Oryza sativa Japonica* Group] > gi|218189867|gb|EEC72294.1| hypothetical protein OsI_05469 [*Oryza sativa Indica* Group] > gi|222621999|gb|EEE56131.1| hypothetical protein OsJ_05004 [*Oryza sativa Japonica* Group] > gi|313575775|gb|ADR66967.1| 60 kDa chaperonin beta subunit [*Oryza sativa Japonica* Group] | 0.87 | 753 | 1451 |
| | | XP_002285746 | PREDICTED: hypothetical protein [*Vitis vinifera*] > gi|297746501|emb|CBI16557.3| unnamed protein product [*Vitis vinifera*] | 0.88 | 754 | 1452 |
| | | XP_002303983 | predicted protein [*Populus trichocarpa*] > gi|222841415|gb|EEE78962.1| predicted protein [*Populus trichocarpa*] | 0.87 | 755 | 1453 |
| | | XP_002523404 | rubisco subunit binding-protein beta subunit, rubb, putative [*Ricinus communis*] > gi|223537354|gb|EEF38983.1| rubisco subunit binding-protein beta subunit, rubb, putative [*Ricinus communis*] | 0.87 | 756 | 1454 |
| | | XP_002894506 | CPN60B [*Arabidopsis lyrata* subsp. *lyrata*] > gi|297340348|gb|EFH70765.1| CPN60B [*Arabidopsis lyrata* subsp. *lyrata*] | 0.87 | 757 | 1455 |
| | 640-660 | XP_002456142 | hypothetical protein SORBIDRAFT_03g031180 [*Sorghum bicolor*] > gi|241928117|gb|EES01262.1| hypothetical protein SORBIDRAFT_03g031180 [*Sorghum bicolor*] | 1.00 | 758 | 1456 |
| | | NP_001148838 | LOC100282456 [*Zea mays*] > gi|195622536|gb|ACG33098.1| THAP domain-containing protein 4 [*Zea mays*] | 0.94 | 759 | 1457 |
| | | EEC71270 | hypothetical protein OsI_03268 [*Oryza sativa Indica* Group] | 0.87 | 760 | |
| | | CBH32601 | conserved hypothetical protein, expressed [*Triticum aestivum*] | 0.83 | 761 | 1458 |
| | | NP_001043867 | Os01g0679600 [*Oryza sativa Japonica* Group] > gi|56202146|dbj|BAD73479.1| unknown protein [*Oryza sativa Japonica* Group] > gi|255673554|dbj|BAF05781.2| Os01g0679600 [*Oryza sativa Japonica* Group] | 0.80 | 762 | 1459 |
| | | BAJ94714 | predicted protein [*Hordeum vulgare* subsp. *vulgare*] | 0.78 | 763 | 1460 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | BAD73478 | unknown protein [*Oryza sativa Japonica* Group] > gi|215693000|dbj|BAG88420.1| unnamed protein product [*Oryza sativa Japonica* Group] > gi|222619045|gb|EEE55177.1| hypothetical protein OsJ_03010 [*Oryza sativa Japonica* Group] | 0.78 | 764 | 1461 |
| | 1204-1224 | ACR38511 | unknown [*Zea mays*] | 1.00 | 765 | 1462 |
| | | ACG45146 | hypothetical protein [*Zea mays*] | 1.00 | 766 | 1463 |
| | | XP_002440220 | hypothetical protein SORBIDRAFT_09g027950 [*Sorghum bicolor*] > gi|241945505|gb|EES18650.1| hypothetical protein SORBIDRAFT_09g027950 [*Sorghum bicolor*] | 0.71 | 767 | 1464 |
| | | NP_001144829 | hypothetical protein LOC100277913 [*Zea mays*] > gi|195647628|gb|ACG43282.1| hypothetical protein [*Zea mays*] | 0.71 | 768 | 1465 |
| | 916-936 | NP_001143951 | hypothetical protein LOC100276764 [*Zea mays*] > gi|195631554|gb|ACG36672.1| hypothetical protein [*Zea mays*] | 1.00 | 769 | 1466 |
| | | NP_001169519 | hypothetical protein LOC100383393 [*Zea mays*] > gi|224029837|gb|ACN33994.1| unknown [*Zea mays*] | 0.81 | 770 | 1467 |
| | 1178-1198 | XP_002468109 | hypothetical protein SORBIDRAFT_01g039740 [*Sorghum bicolor*] > gi|241921963|gb|EER95107.1| hypothetical protein SORBIDRAFT_01g039740 [*Sorghum bicolor*] | 1.00 | 771 | 1468 |
| | | NP_001131833 | hypothetical protein LOC100193208 [*Zea mays*] > gi|194688576|gb|ACF78372.1| unknown [*Zea mays*] > gi|195627610|gb|ACG35635.1| protein binding protein [*Zea mays*] | 0.95 | 772 | 1469 |
| | | ACL53375 | unknown [*Zea mays*] | 0.94 | 773 | 1470 |
| | | NP_001147045 | protein binding protein [*Zea mays*] > gi|195606842|gb|ACG25251.1| protein binding protein [*Zea mays*] | 0.93 | 774 | 1471 |
| | | ABF95226 | zinc finger family protein, putative, expressed [*Oryza sativa Japonica* Group] > gi|108707432|gb|ABF95227.1| zinc finger family protein, putative, expressed [*Oryza sativa Japonica* Group] > gi|218192524|gb|EEC74951.1| hypothetical protein OsI_10935 [*Oryza sativa Indica* Group] > gi|222624650|gb|EEE58782.1| hypothetical protein OsJ_10309 [*Oryza sativa Japonica* Group] | 0.86 | 775 | |
| | | BAJ90599 | predicted protein [*Hordeum vulgare* subsp. *vulgare*] | 0.81 | 776 | 1472 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | ADX86798 | zinc-finger transcription factor [*Triticum aestivum*] | 0.79 | 777 | 1473 |
| | | ACN35095 | unknown [*Zea mays*] | 0.70 | 778 | 1474 |
| | | NP_001049696 | Os03g0272300 [*Oryza sativa Japonica* Group] > gi|108707430|gb|ABF95225.1| zinc finger family protein, putative, expressed [*Oryza sativa Japonica* Group] > gi|215765669|dbj|BAG87366.1| unnamed protein product [*Oryza sativa Japonica* Group] > gi|255674397|dbj|BAF11610.2| Os03g0272300 [*Oryza sativa Japonica* Group] | 0.70 | 779 | 1475 |
| | 1068-1088 | NP_001144727 | hypothetical protein LOC100277769 [*Zea mays*] > gi|195646260|gb|ACG42598.1| hypothetical protein [*Zea mays*] | 1.00 | 780 | 1476 |
| | | NP_001141817 | hypothetical protein LOC100273956 [*Zea mays*] > gi|194706038|gb|ACF87103.1| unknown [*Zea mays*] | 0.99 | 781 | 1477 |
| | | NP_001170260 | hypothetical protein LOC100384217 [*Zea mays*] > gi|224034675|gb|ACN36413.1| unknown [*Zea mays*] | 0.96 | 782 | 1478 |
| | | NP_001170241 | hypothetical protein LOC100384195 [*Zea mays*] > gi|224034547|gb|ACN36349.1| unknown [*Zea mays*] | 0.71 | 783 | 1479 |
| | 573-593 | XP_002454448 | hypothetical protein SORBIDRAFT_04g031260 [*Sorghum bicolor*] > gi|241934279|gb|EES07424.1| hypothetical protein SORBIDRAFT_04g031260 [*Sorghum bicolor*] | 1.00 | 784 | 1480 |
| | | NP_001149829 | LOC100283456 [*Zea mays*] > gi|195634913|gb|ACG36925.1| acetylornithine deacetylase [*Zea mays*] | 0.97 | 785 | 1481 |
| | | EEC73818 | hypothetical protein OsI_08537 [*Oryza sativa Indica* Group] | 0.85 | 786 | |
| | | NP_001047794 | Os02g0690800 [*Oryza sativa Japonica* Group] > gi|41053258|dbj|BAD07684.1| putative silverleaf whitefly-induced protein 1 [*Oryza sativa Japonica* Group] > gi|113537325|dbj|BAF09708.1| Os02g0690800 [*Oryza sativa Japonica* Group] > gi|215715374|dbj|BAG95125.1| unnamed protein product [*Oryza sativa Japonica* Group] > gi|215740943|dbj|BAG97438.1| unnamed protein product [*Oryza sativa Japonica* Group] > gi|222623478|gb|EEE57610.1| hypothetical protein OsJ_07995 [*Oryza sativa Japonica* Group] | 0.85 | 787 | 1482 |
| | 1820-1840 | XP_002456060 | hypothetical protein SORBIDRAFT_03g029660 [*Sorghum bicolor*] > gi|241928035|gb|EES01180.1| hypothetical protein | 1.00 | 788 | 1483 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | SORBIDRAFT_03g029660 [*Sorghum bicolor*] | | | |
| | | ACG31412 | wax synthase isoform 3 [*Zea mays*] | 0.86 | 789 | 1484 |
| | | NP_001150127 | wax synthase [*Zea mays*] > gi|195636988|gb|ACG37962.1| wax synthase isoform 3 [*Zea mays*] | 0.86 | 790 | 1485 |
| | | NP_001043733 | Os01g0651500 [*Oryza sativa Japonica* Group] > gi|20146429|dbj|BAB89209.1| wax synthase-like [*Oryza sativa Japonica* Group] > gi|113533264|dbj|BAF05647.1| Os01g0651500 [*Oryza sativa Japonica* Group] > gi|125571401|gb|EAZ12916.1| hypothetical protein OsJ_02839 [*Oryza sativa Japonica* Group] | 0.73 | 791 | 1486 |
| | | EAY75194 | hypothetical protein OsI_03086 [*Oryza sativa Indica* Group] | 0.72 | 792 | |
| | | BAK07830 | predicted protein [*Hordeum vulgare* subsp. *vulgare*] | 0.70 | 793 | 1487 |
| | 1709-1729 | XP_002448959 | hypothetical protein SORBIDRAFT_05g002450 [*Sorghum bicolor*] > gi|241934802|gb|EES07947.1| hypothetical protein SORBIDRAFT_05g002450 [*Sorghum bicolor*] | 1.00 | 794 | 1488 |
| | | ACF84627 | unknown [*Zea mays*] > gi|223942887|gb|ACN25527.1| unknown [*Zea mays*] | 0.95 | 795 | 1489 |
| | | NP_001150994 | PP2A regulatory subunit TAP46 [*Zea mays*] > gi|195643460|gb|ACG41198.1| PP2A regulatory subunit TAP46 [*Zea mays*] | 0.95 | 796 | 1490 |
| | | ACF84366 | unknown [*Zea mays*] | 0.94 | 797 | 1491 |
| | | EAY79895 | hypothetical protein OsI_35058 [*Oryza sativa Indica* Group] | 0.89 | 798 | |
| | | NP_001066109 | Os12g0137500 [*Oryza sativa Japonica* Group] > gi|77552970|gb|ABA95766.1| TAP42-like family protein, expressed [*Oryza sativa Japonica* Group] > gi|113648616|dbj|BAF29128.1| Os12g0137500 [*Oryza sativa Japonica* Group] > gi|215769083|dbj|BAH01312.1| unnamed protein product [*Oryza sativa Japonica* Group] | 0.89 | 799 | 1492 |
| | | EAZ19586 | hypothetical protein OsJ_35163 [*Oryza sativa Japonica* Group] | 0.89 | 800 | |
| | | AAO72555 | PP2A regulatory subunit-like protein [*Oryza sativa Japonica* Group] | 0.89 | 801 | 1493 |
| | | ABA91420 | TAP42-like family protein, expressed [*Oryza sativa Japonica* Group] > gi|222615497|gb|EEE51629.1| hypothetical protein OsJ_32912 [*Oryza sativa Japonica* Group] | 0.88 | 802 | 1494 |
| | | NP_001148561 | PP2A regulatory subunit TAP46 [*Zea mays*] > gi|195620440|gb|ACG32050.1| | 0.86 | 803 | 1495 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | 1417-1437 | XP_002465624 | PP2A regulatory subunit TAP46 [Zea mays] hypothetical protein SORBIDRAFT_01g042450 [Sorghum bicolor] > gi|194326198|emb|CAQ86599.1| glutamine synthetase [Sorghum bicolor] > gi|241919478|gb|EER92622.1| hypothetical protein SORBIDRAFT_01g042450 [Sorghum bicolor] | 1.00 | 804 | 1496 |
| | | AAW21274 | glutamine synthetase [Saccharum officinarum] | 0.98 | 805 | 1497 |
| | | NP_001105538 | glutamine synthetase root isozyme 1 [Zea mays] > gi|6996235|dbj|BAA03433.1| glutamine synthetase [Zea mays] > gi|194701040|gb|ACF84604.1| unknown [Zea mays] | 0.97 | 806 | 1498 |
| | | P38559 | RecName: Full = Glutamine synthetase root isozyme 1; AltName: Full = GS122; AltName: Full = Glutamate-- ammonia ligase > gi|434324|emb|CAA46719.1| glutamine synthetase [Zea mays] | 0.97 | 807 | |
| | | P38563 | RecName: Full = Glutamine synthetase root isozyme 5; AltName: Full = GS117; AltName: Full = Glutamate-- ammonia ligase | 0.96 | 808 | |
| | | NP_001105297 | glutamine synthetase root isozyme 5 [Zea mays] > gi|699621|dbj|BAA03432.1| glutamine synthetase [Zea mays] | 0.96 | 809 | 1499 |
| | | ACG47508 | glutamine synthetase root isozyme 5 [Zea mays] | 0.95 | 810 | 1500 |
| | | NP_001049424 | Os03g0223400 [Oryza sativa Japonica Group] > gi|121332|sp|P14654.1|GLN12_ORYSJ RecName: Full = Glutamine synthetase cytosolic isozyme 1-2; AltName: Full = Glutamate-- ammonia ligase GLN1; 2; Short = OsGLN1; 2; AltName: Full = Glutamine synthetase root isozyme; AltName: Full = OsGS1; 2 > gi|20358|emb|CAA32460.1| unnamed protein product [Oryza sativa Japonica Group] > gi|565414215|dbj|BAD77931.1| cytosolic glutamine synthetase 1; 2 [Oryza sativa Japonica Group] > gi|108706922|gb|ABF94717.1| Glutamine synthetase root isozyme 5, putative, expressed [Oryza sativa Japonica Group] > gi|1135478955|dbj|BAF11338.1| Os03g0223400 [Oryza sativa Japonica Group] > gi|215769188|dbj|BAH01417.1| unnamed protein | 0.91 | 811 | 1501 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | product [*Oryza sativa Japonica* Group] > gi\|218192361\|gb\|EEC74788.1\| hypothetical protein OsI_10575 [*Oryza sativa Indica* Group] > gi\|222624488\|gb\|EEE58620.1\| hypothetical protein OsJ_09974 [*Oryza sativa Japonica* Group] | | | |
| | | AAR84347 | glutamine synthetase isoform GSr1 [*Triticum aestivum*] | 0.89 | 812 | 1502 |
| | | AAR84348 | glutamine synthetase isoform GSr2 [*Triticum aestivum*] | 0.89 | 813 | 1503 |
| | 1527-1547 | XP_002454761 | hypothetical protein SORBIDRAFT_04g036890 [*Sorghum bicolor*] > gi\|241934592\|gb\|EES07737.1\| hypothetical protein SORBIDRAFT_04g036890 [*Sorghum bicolor*] | 1.00 | 814 | 1504 |
| | | NP_001130621 | hypothetical protein LOC100191720 [*Zea mays*] > gi\|194689664\|gb\|ACF78916.1\| unknown [*Zea mays*] | 0.87 | 815 | 1505 |
| | | XP_002454762 | hypothetical protein SORBIDRAFT_04g036900 [*Sorghum bicolor*] > gi\|241934593\|gb\|EES07738.1\| hypothetical protein SORBIDRAFT_04g036900 [*Sorghum bicolor*] | 0.78 | 816 | 1506 |
| | | XP_002437453 | hypothetical protein SORBIDRAFT_10g027360 [*Sorghum bicolor*] > gi\|241915676\|gb\|EER88820.1\| hypothetical protein SORBIDRAFT_10g027360 [*Sorghum bicolor*] | 0.70 | 817 | 1507 |
| | | XP_002438878 | hypothetical protein SORBIDRAFT_10g027650 [*Sorghum bicolor*] > gi\|241917101\|gb\|EER90245.1\| hypothetical protein SORBIDRAFT_10g027650 [*Sorghum bicolor*] | 0.69 | 818 | 1508 |
| | | XP_002438877 | hypothetical protein SORBIDRAFT_10g027640 [*Sorghum bicolor*] > gi\|241917100\|gb\|EER90244.1\| hypothetical protein SORBIDRAFT_10g027640 [*Sorghum bicolor*] | 0.70 | 819 | 1509 |
| | 2363-2383 | XP_002436826 | hypothetical protein SORBIDRAFT_10g009530 [*Sorghum bicolor*] > gi\|241915049\|gb\|EER88193.1\| hypothetical protein SORBIDRAFT_10g009530 [*Sorghum bicolor*] | 1.00 | 820 | 1510 |
| | | ACN31818 | unknown [*Zea mays*] | 0.94 | 821 | 1511 |
| | | BAJ98035 | predicted protein [*Hordeum vulgare* subsp. *vulgare*] | 0.81 | 822 | 1512 |
| | | NP_001057335 | Os06g0264500 [*Oryza sativa Japonica* Group] > gi\|53793159\|dbj\|BAD54367.1\| putative nitrite transporter [*Oryza sativa Japonica* Group] > gi\|53793165\|dbj\|BAD54372.1\| putative nitrite transporter [*Oryza sativa* | 0.79 | 823 | 1513 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | Japonica Group]<br>> gi|113595375|dbj|BAF19249.1|<br>Os06g0264500 [Oryza sativa Japonica Group]<br>> gi|215767857|dbj|BAH00086.1|<br>unnamed protein product [Oryza sativa Japonica Group]<br>> gi|218197932|gb|EEC80359.1|<br>hypothetical protein OsI_22454 [Oryza sativa Indica Group]<br>> gi|222635351|gb|EEE65483.1|<br>hypothetical protein OsJ_20894 [Oryza sativa Japonica Group] | | | |
| | 2309-2329 | XP_002446671 | hypothetical protein SORBIDRAFT_06g020190 [Sorghum bicolor]<br>> gi|241937854|gb|EES10999.1|<br>hypothetical protein SORBIDRAFT_06g020190 [Sorghum bicolor] | 1.00 | 824 | 1514 |
| | | NP_001151527 | ATSWI3A [Zea mays]<br>> gi|195647424|gb|ACG43180.1|<br>ATSWI3A [Zea mays] | 0.92 | 825 | 1515 |
| | | NP_001053100 | Os04g0480300 [Oryza sativa Japonica Group]<br>> gi|113564671|dbj|BAF15014.1|<br>Os04g0480300 [Oryza sativa Japonica Group]<br>> gi|215734840|dbj|BAG95562.1|<br>unnamed protein product [Oryza sativa Japonica Group] | 0.76 | 826 | 1516 |
| | | CAH66875 | OSIGBa0158F13.6 [Oryza sativa Indica Group] | 0.76 | 827 | 1517 |
| | | EEC77490 | hypothetical protein OsI_16334 [Oryza sativa Indica Group] | 0.73 | 828 | |
| | 1469-1489 | NP_001148712 | plant-specific domain TIGR01589 family protein [Zea mays]<br>> gi|195621580|gb|ACG32620.1|<br>plant-specific domain TIGR01589 family protein [Zea mays] | 1.00 | 829 | 1518 |
| | 2030-2050 | NP_001105116 | SBP-domain protein3 [Zea mays]<br>> gi|5931782|emb|CAB56629.1|<br>SBP-domain protein 3 [Zea mays] | 1.00 | 830 | 1519 |
| | | XP_002437398 | hypothetical protein SORBIDRAFT_10g026200 [Sorghum bicolor]<br>> gi|241915621|gb|EER88765.1|<br>hypothetical protein SORBIDRAFT_10g026200 [Sorghum bicolor] | 0.78 | 831 | 1520 |
| | | ACF78942 | unknown [Zea mays]<br>> gi|194690438|gb|ACF79303.1|<br>unknown [Zea mays]<br>> gi|223974801|gb|ACN31588.1|<br>unknown [Zea mays] | 0.70 | 832 | 1521 |
| | | NP_001105656 | SBP-domain protein4 [Zea mays]<br>> gi|5931784|emb|CAB56630.1|<br>SBP-domain protein 4 [Zea mays] | 0.69 | 833 | 1522 |
| | 1925-1945 | NP_001142263 | hypothetical protein LOC100274432 [Zea mays]<br>> gi|194707898|gb|ACF88033.1|<br>unknown [Zea mays] | 1.00 | 834 | 1523 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | XP_002468497 | hypothetical protein SORBIDRAFT_01g046950 [*Sorghum bicolor*] > gi|241922351|gb|EER95495.1| hypothetical protein SORBIDRAFT_01g046950 [*Sorghum bicolor*] | 0.81 | 835 | 1524 |
| | 88-108 | XP_002448249 | hypothetical protein SORBIDRAFT_06g023950 [*Sorghum bicolor*] > gi|241939432|gb|EES12577.1| hypothetical protein SORBIDRAFT_06g023950 [*Sorghum bicolor*] | 1.00 | 836 | 1525 |
| | | NP_001141834 | hypothetical protein LOC100273976 [*Zea mays*] > gi|194706118|gb|ACF87143.1| unknown [*Zea mays*] | 0.92 | 837 | 1526 |
| | | BAJ88132 | predicted protein [*Hordeum vulgare* subsp. *vulgare*] | 0.86 | 838 | 1527 |
| | | CAE02784 | OSJNBa0011L07.8 [*Oryza sativa Japonica* Group] > gi|116310379|emb|CAH67390.1| H0115B09.2 [*Oryza sativa Indica* Group] > gi|215768681|dbj|BAH00910.1| unnamed protein product [*Oryza sativa Japonica* Group] > gi|218195296|gb|EEC77723.1| hypothetical protein OsI_16815 [*Oryza sativa Indica* Group] > gi|222629289|gb|EEE61421.1| hypothetical protein OsJ_15623 [*Oryza sativa Japonica* Group] | 0.87 | 839 | 1528 |
| | | ACF88110 | unknown [*Zea mays*] | 0.76 | 840 | 1529 |
| | | NP_001065045 | Os10g0512700 [*Oryza sativa Japonica* Group] > gi|78708906|gb|ABB47881.1| SH3 domain-containing protein 3, putative, expressed [*Oryza sativa Japonica* Group] > gi|113639654|dbj|BAF26959.1| Os10g0512700 [*Oryza sativa Japonica* Group] > gi|218184876|gb|EEC67303.1| hypothetical protein OsI_34298 [*Oryza sativa Indica* Group] > gi|222613131|gb|EEE51263.1| hypothetical protein OsJ_32141 [*Oryza sativa Japonica* Group] | 0.73 | 841 | 1530 |
| | | BAJ89635 | predicted protein [*Hordeum vulgare* subsp. *vulgare*] | 0.72 | 842 | 1531 |
| | | ACG28140 | clathrin binding protein [*Zea mays*] | 0.72 | 843 | 1532 |
| | | NP_001130175 | hypothetical protein LOC100191269 [*Zea mays*] > gi|194688470|gb|ACF78319.1| unknown [*Zea mays*] | 0.72 | 844 | 1533 |
| | | XP_002464381 | hypothetical protein SORBIDRAFT_01g017250 [*Sorghum bicolor*] > gi|241918235|gb|EER91379.1| hypothetical protein SORBIDRAFT_01g017250 [*Sorghum bicolor*] | 0.71 | 845 | 1534 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | 2810-2830 | XP_002458234 | hypothetical protein SORBIDRAFT_03g029520 [Sorghum bicolor] > gi|241930209|gb|EES03354.1| hypothetical protein SORBIDRAFT_03g029520 [Sorghum bicolor] | 1.00 | 846 | 1535 |
| | | CAI77627 | potassium uptake channel [Zea mays] | 0.93 | 847 | |
| | | NP_001105480 | potassium channel5 [Zea mays] > gi|2104908|emb|CAA68912.1| potassium channel [Zea mays] | 0.91 | 848 | 1536 |
| | | NP_001043713 | Os01g0648000 [Oryza sativa Japonica Group] > gi|122241153|sp|Q0JKV1.1| AKT1_ORYSJ RecName: Full = Potassium channel AKT1; Short = OsAKT1 > gi|113533244|dbj|BAF05627.1| Os01g0648000 [Oryza sativa Japonica Group] | 0.82 | 849 | 1537 |
| | | P0C550 | RecName: Full = Potassium channel AKT1; Short = OsAKT1 | 0.82 | 850 | |
| | | ABE99810 | inwardly rectifying potassium channel AKT1 [Hordeum vulgare] > gi|326519172|dbj|BAJ96585.1| predicted protein [Hordeum vulgare subsp. vulgare] | 0.81 | 851 | 1538 |
| | | AAF36832 | AKT1-like potassium channel [Triticum aestivum] | 0.81 | 852 | 1539 |
| | | AAL40894 | AKT1-like potassium channel [Oryza sativa] | 0.78 | 853 | 1540 |
| | | ADK93728 | inward-rectifying potassium channel [Puccinellia tenuiflora] | 0.79 | 854 | 1541 |
| | | EEE55080 | hypothetical protein OsJ_02815 [Oryza sativa Japonica Group] | 0.78 | 855 | |
| | 1465-1485 | NP_001151754 | collagen, type IV, alpha 5 [Zea mays] > gi|195649521|gb|ACG44228.1| collagen, type IV, alpha 5 [Zea mays] | 1.00 | 856 | 1542 |
| | | XP_002460574 | hypothetical protein SORBIDRAFT_02g031070 [Sorghum bicolor] > gi|241923951|gb|EER97095.1| hypothetical protein SORBIDRAFT_02g031070 [Sorghum bicolor] | 0.87 | 857 | 1543 |
| | 1702-1722 | XP_002460183 | hypothetical protein SORBIDRAFT_02g024090 [Sorghum bicolor] > gi|241923560|gb|EER96704.1| hypothetical protein SORBIDRAFT_02g024090 [Sorghum bicolor] | 1.00 | 858 | 1544 |
| | | NP_001149599 | LOC100283225 [Zea mays] > gi|194705944|gb|ACF87056.1| unknown [Zea mays] > gi|195628360|gb|ACG36010.1| annexin A4 [Zea mays] | 0.96 | 859 | 1545 |
| | | ACG40326 | annexin A4 [Zea mays] | 0.95 | 860 | 1546 |
| | | NP_001063096 | Os09g0394900 [Oryza sativa Japonica Group] > gi|49389155|dbj|BAD26449.1| putative annexin [Oryza sativa Japonica Group] | 0.89 | 861 | 1547 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | > gi|49389211|dbj|BAD26499.1| putative annexin [*Oryza sativa Japonica* Group] > gi|113631329|dbj|BAF25010.1| Os09g0394900 [*Oryza sativa Japonica* Group] > gi|215692709|dbj|BAG88129.1| unnamed protein product [*Oryza sativa Japonica* Group] > gi|215704491|dbj|BAG93925.1| unnamed protein product [*Oryza sativa Japonica* Group] > gi|222641513|gb|EEE69645.1| hypothetical protein OsJ_29255 [*Oryza sativa Japonica* Group] | | | |
| | | EEC84533 | hypothetical protein OsI_31267 [*Oryza sativa Indica* Group] | 0.89 | 862 | |
| | | NP_001132118 | hypothetical protein LOC100193535 [*Zea mays*] > gi|238908661|gb|ACF80822.2| unknown [*Zea mays*] | 0.86 | 863 | 1548 |
| | | BAJ85227 | predicted protein [*Hordeum vulgare* subsp. *vulgare*] > gi|326510845|dbj|BAJ91770.1| predicted protein [*Hordeum vulgare* subsp. *vulgare*] | 0.73 | 864 | 1549 |
| | | NP_001147343 | annexin A4 [*Zea mays*] > gi|195610314|gb|ACG26987.1| annexin A4 [*Zea mays*] > gi|219887403|gb|ACL54076.1| unknown [*Zea mays*] | 0.72 | 865 | 1550 |
| | | AAR25142 | annexin [*Triticum aestivum*] | 0.73 | 866 | 1551 |
| | | ACF06448 | annexin [*Elaeis guineensis*] | 0.74 | 867 | 1552 |
| Predicted folded 24-nts-long seq 51802 | 891-914 | ACG34432 | L-allo-threonine aldolase [*Zea mays*] | 1.00 | 868 | 1553 |
| | | ACG33933 | L-allo-threonine aldolase [*Zea mays*] | 0.99 | 869 | 1554 |
| | | NP_001149239 | L-allo-threonine aldolase [*Zea mays*] > gi|195625716|gb|ACG34688.1| L-allo-threonine aldolase [*Zea mays*] | 0.98 | 870 | 1555 |
| | | NP_001053314 | Os04g0516600 [*Oryza sativa Japonica* Group] > gi|38344656|emb|CAD4182.21| OSJNBb0072M01.18 [*Oryza sativa Japonica* Group] > gi|113564885|dbj|BAF15228.1| Os04g0516600 [*Oryza sativa Japonica* Group] > gi|116310209|emb|CAH67219.1| OSIGBa0145M07.1 [*Oryza sativa Indica* Group] > gi|215708770|dbj|BAG94039.1| unnamed protein product [*Oryza sativa Japonica* Group] > gi|215765369|dbj|BAG87066.1| unnamed protein product [*Oryza sativa Japonica* Group] > gi|218195217|gb|EEC77644.1| hypothetical protein | 0.79 | 871 | 1556 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | OsI_16646 [*Oryza sativa Indica* Group] > gi|222629209|gb|EEE61341.1| hypothetical protein OsJ_15466 [*Oryza sativa Japonica* Group] | | | |
| | | CAE05443 | OSJNBa0073E02.3 [*Oryza sativa Japonica* Group] | 0.75 | 872 | 1557 |
| | | XP_002448187 | hypothetical protein SORBIDRAFT_06g022630 [*Sorghum bicolor*] > gi|241939370|gb|EES12515.1| hypothetical protein SORBIDRAFT_06g022630 [*Sorghum bicolor*] | 0.79 | 873 | 1558 |
| | | ACG36649 | L-allo-threonine aldolase [*Zea mays*] | 0.80 | 874 | 1559 |
| | | BAK03835 | predicted protein [*Hordeum vulgare* subsp. *vulgare*] | 0.79 | 875 | 1560 |
| | | BAJ93201 | predicted protein [*Hordeum vulgare* subsp. *vulgare*] | 0.76 | 876 | 1561 |
| | | NP_001140767 | hypothetical protein LOC100272842 [*Zea mays*] > gi|194700996|gb|ACF84582.1| unknown [*Zea mays*] | 0.72 | 877 | 1562 |
| | 700-723 | AAS47590 | phospholipid-hydroperoxide glutathione peroxidase [*Setaria italica*] | 1.00 | 878 | 1563 |
| | | XP_002446921 | hypothetical protein SORBIDRAFT_06g024920 [*Sorghum bicolor*] > gi|48374968|gb|AAT42166.1| putative glutathione peroxidase [*Sorghum bicolor*] > gi|241938104|gb|EES11249.1| hypothetical protein SORBIDRAFT_06g024920 [*Sorghum bicolor*] | 0.99 | 879 | 1564 |
| | | NP_001141210 | hypothetical protein LOC100273297 [*Zea mays*] > gi|48374955|gb|AAT42154.1| putative glutathione peroxidase [*Zea mays*] > gi|194703274|gb|ACF85721.1| unknown [*Zea mays*] > gi|195622840|gb|ACG33250.1| phospholipid hydroperoxide glutathione peroxidase [*Zea mays*] > gi|223975959|gb|ACN32167.1| unknown [*Zea mays*] | 0.96 | 880 | 1565 |
| | | ACG39625 | phospholipid hydroperoxide glutathione peroxidase [*Zea mays*] | 0.96 | 881 | 1566 |
| | | EEC77777 | hypothetical protein OsI_16938 [*Oryza sativa Indica* Group] | 0.95 | 882 | |
| | | NP_001146472 | hypothetical protein LOC100280060 [*Zea mays*] > gi|219887431|gb|ACL54090.1| unknown [*Zea mays*] | 0.94 | 883 | 1567 |
| | | NP_001147681 | phospholipid hydroperoxide glutathione peroxidase [*Zea mays*] > gi|195613068|gb|ACG28364.1| phospholipid hydroperoxide glutathione peroxidase [*Zea mays*] | 0.94 | 884 | 1568 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | NP_001053524 | Os04g0556300 [*Oryza sativa Japonica* Group] > gi|21360380|gb|AAM47493.1| glutathione peroxidase 1 [*Oryza sativa*] > gi|113565095|dbj|BAF15438.1| Os04g0556300 [*Oryza sativa Japonica* Group] > gi|215693018|dbj|BAG88438.1| unnamed protein product [*Oryza sativa Japonica* Group] > gi|222629338|gb|EEE61470.1| hypothetical protein OsJ_15735 [*Oryza sativa Japonica* Group] | 0.94 | 885 | 1569 |
| | | NP_001105091 | GP protein [*Zea mays*] > gi|22268405|gb|AAM88847.2| AF520911_1 putative glutathione peroxidase [*Zea mays*] | 0.94 | 886 | 1570 |
| | | AAQ64633 | cytosolic glutathione peroxidase [*Triticum monococcum*] | 0.93 | 887 | 1571 |
| | 714-737 | XP_002446921 | hypothetical protein SORBIDRAFT_06g024920 [*Sorghum bicolor*] > gi|48374968|gb|AAT42166.1| putative glutathione peroxidase [*Sorghum bicolor*] > gi|241938104|gb|EES11249.1| hypothetical protein SORBIDRAFT_06g024920 [*Sorghum bicolor*] | 1.00 | 888 | 1572 |
| | | AAS47590 | phospholipid-hydroperoxide glutathione peroxidase [*Setaria italica*] | 0.99 | 889 | 1573 |
| | | NP_001141210 | hypothetical protein LOC100273297 [*Zea mays*] > gi|48374955|gb|AAT42154.1| putative glutathione peroxidase [*Zea mays*] > gi|194703274|gb|ACF85721.1| unknown [*Zea mays*] > gi|195622840|gb|ACG33250.1| phospholipid hydroperoxide glutathione peroxidase [*Zea mays*] > gi|223975959|gb|ACN32167.1| unknown [*Zea mays*] | 0.98 | 890 | 1574 |
| | | ACG39625 | phospholipid hydroperoxide glutathione peroxidase [*Zea mays*] | 0.97 | 891 | 1575 |
| | | EEC77777 | hypothetical protein OsI_16938 [*Oryza sativa Indica* Group] | 0.96 | 892 | |
| | | NP_001146472 | hypothetical protein LOC100280060 [*Zea mays*] > gi|219887431|gb|ACL54090.1| unknown [*Zea mays*] | 0.95 | 893 | 1576 |
| | | NP_001147681 | phospholipid hydroperoxide glutathione peroxidase [*Zea mays*] > gi|195613068|gb|ACG28364.1| phospholipid hydroperoxide glutathione peroxidase [*Zea mays*] | 0.95 | 894 | 1577 |
| | | NP_001053524 | Os04g0556300 [*Oryza sativa Japonica* Group] > gi|21360380|gb|AAM47493.1| glutathione peroxidase 1 | 0.95 | 895 | 1578 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | [*Oryza sativa*] > gi|113565095|dbj|BAF15438.1| Os04g0556300 [*Oryza sativa Japonica* Group] > gi|215693018|dbj|BAG88438.1| unnamed protein product [*Oryza sativa Japonica* Group] > gi|222629338|gb|EEE61470.1| hypothetical protein OsJ_15735 [*Oryza sativa Japonica* Group] | | | |
| | | NP_001105091 | GP protein [*Zea mays*] > gi|22268405|gb|AAM88847.2| AF520911_1 putative glutathione peroxidase [*Zea mays*] | 0.95 | 896 | 1579 |
| | | AAQ64633 | cytosolic glutathione peroxidase [*Triticum monococcum*] | 0.95 | 897 | 1580 |
| | 160-183 | NP_001159179 | hypothetical protein LOC100304264 [*Zea mays*] > gi|223942501|gb|ACN25334.1| unknown [*Zea mays*] | 1.00 | 898 | 1581 |
| | | NP_001105290 | LOC542207 [*Zea mays*] > gi|57791232|gb|AAW56446.1| methyl-binding domain protein MBD113 [*Zea mays*] | 0.74 | 899 | 1582 |
| | 1054-1077 | XP_002450144 | hypothetical protein SORBIDRAFT_05g001160 [*Sorghum bicolor*] > gi|241935987|gb|EES09132.1| hypothetical protein SORBIDRAFT_05g001160 [*Sorghum bicolor*] | 1.00 | 900 | 1583 |
| | | NP_001065992 | Os12g0116000 [*Oryza sativa Japonica* Group] > gi|108862099|gb|ABA96293.2| Vacuolar sorting receptor 1 precursor, putative, expressed [*Oryza sativa Japonica* Group] > gi|113648499|dbj|BAF29011.1| Os12g0116000 [*Oryza sativa Japonica* Group] > gi|215694863|dbj|BAG90054.1| unnamed protein product [*Oryza sativa Japonica* Group] | 0.89 | 901 | 1584 |
| | | EEC68730 | hypothetical protein OsI_37233 [*Oryza sativa Indica* Group] | 0.89 | 902 | |
| | | EEE51529 | hypothetical protein OsJ_32728 [*Oryza sativa Japonica* Group] | 0.89 | 903 | |
| | | EEC67546 | hypothetical protein OsI_34875 [*Oryza sativa Indica* Group] | 0.89 | 904 | |
| | | BAK03786 | predicted protein [*Hordeum vulgare* subsp. *vulgare*] | 0.87 | 905 | 1585 |
| | | BAK00302 | predicted protein [*Hordeum vulgare* subsp. *vulgare*] | 0.87 | 906 | 1586 |
| | | CBI18031 | unnamed protein product [*Vitis vinifera*] | 0.78 | 907 | |
| | | XP_002267833 | PREDICTED: hypothetical protein [*Vitis vinifera*] | 0.78 | 908 | 1587 |
| | | XP_002309184 | predicted protein [*Populus trichocarpa*] > gi|222855160|gb|EEE92707.1| predicted protein [*Populus trichocarpa*] | 0.78 | 909 | 1588 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | 1792-1815 | NP_001140790 | hypothetical protein LOC100272865 [Zea mays] > gi|194701088|gb|ACF84628.1| unknown [Zea mays] | 1.00 | 910 | 1589 |
| | | XP_002464219 | hypothetical protein SORBIDRAFT_01g014350 [Sorghum bicolor] > gi|241918073|gb|EER91217.1| hypothetical protein SORBIDRAFT_01g014350 [Sorghum bicolor] | 0.85 | 911 | 1590 |
| | | XP_002464218 | hypothetical protein SORBIDRAFT_01g014340 [Sorghum bicolor] > gi|241918072|gb|EER91216.1| hypothetical protein SORBIDRAFT_01g014340 [Sorghum bicolor] | 0.84 | 912 | 1591 |
| | | AAL73972 | putative cytochrome P450-like protein [Sorghum bicolor] | 0.73 | 913 | 1592 |
| | 2477-2500 | XP_002454227 | hypothetical protein SORBIDRAFT_04g027100 [Sorghum bicolor] > gi|241934058|gb|EES07203.1| hypothetical protein SORBIDRAFT_04g027100 [Sorghum bicolor] | 1.00 | 914 | 1593 |
| | | NP_001169751 | hypothetical protein LOC100383632 [Zea mays] > gi|224031415|gb|ACN34783.1| unknown [Zea mays] | 0.93 | 915 | 1594 |
| | | BAJ95386 | predicted protein [Hordeum vulgare subsp. vulgare] | 0.78 | 916 | 1595 |
| | | EEC73665 | hypothetical protein OsI_08209 [Oryza sativa Indica Group] | 0.77 | 917 | |
| | | NP_001047529 | Os02g0637800 [Oryza sativa Japonica Group] > gi|49387984|dbj|BAD25092.1| unknown protein [Oryza sativa Japonica Group] > gi|49388709|dbj|BAD25890.1| unknown protein [Oryza sativa Japonica Group] > gi|113537060|dbj|BAF09443.1| Os02g0637800 [Oryza sativa Japonica Group] > gi|215704166|dbj|BAG93006.1| unnamed protein product [Oryza sativa Japonica Group] > gi|222623311|gb|EEE57443.1| hypothetical protein OsJ_07658 [Oryza sativa Japonica Group] | 0.77 | 918 | 1596 |
| | 3108-3131 | NP_001169691 | hypothetical protein LOC100383572 [Zea mays] > gi|224030935|gb|ACN34543.1| unknown [Zea mays] | 1.00 | 919 | 1597 |
| | | ACN33688 | unknown [Zea mays] | 0.96 | 920 | 1598 |
| | | NP_001131248 | hypothetical protein LOC100192560 [Zea mays] > gi|195656461|gb|ACG47698.1| nucleic acid binding protein [Zea mays] | 0.81 | 921 | 1599 |
| | | XP_002441761 | hypothetical protein SORBIDRAFT_08g001980 [Sorghum bicolor] > gi|241942454|gb|EES15599.1| hypothetical protein SORBIDRAFT_08g001980 [Sorghum bicolor] | 0.80 | 922 | 1600 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | 2192-2215 | NP_001150353 | LOC100283983 [Zea mays] > gi\|195638608\|gb\|ACG38772.1\| ubiquilin-1 [Zea mays] > gi\|195644430\|gb\|ACG41683.1\| ubiquilin-1 [Zea mays] > gi\|224029247\|gb\|ACN33699.1\| unknown [Zea mays] | 1.00 | 923 | 1601 |
| | | XP_002465921 | hypothetical protein SORBIDRAFT_01g048260 [Sorghum bicolor] > gi\|241919775\|gb\|EER92919.1\| hypothetical protein SORBIDRAFT_01g048260 [Sorghum bicolor] | 0.92 | 924 | 1602 |
| | | NP_001048862 | Os03g0131300 [Oryza sativa Japonica Group] > gi\|108706017\|gb\|ABF93812.1\| Ubiquitin family protein, expressed [Oryza sativa Japonica Group] > gi\|113547333\|dbj\|BAF10776.1\| Os03g0131300 [Oryza sativa Japonica Group] > gi\|215713564\|dbj\|BAG94701.1\| unnamed protein product [Oryza sativa Japonica Group] > gi\|222624144\|gb\|EEE58276.1\| hypothetical protein OsJ_09294 [Oryza sativa Japonica Group] | 0.78 | 925 | 1603 |
| | | EEC74450 | hypothetical protein OsI_09858 [Oryza sativa Indica Group] | 0.78 | 926 | |
| | | NP_001169509 | hypothetical protein LOC100383383 [Zea mays] > gi\|224029753\|gb\|ACN33952.1\| unknown [Zea mays] | 0.78 | 927 | 1604 |
| | | EAY79386 | hypothetical protein OsI_34513 [Oryza sativa Indica Group] | 0.71 | 928 | |
| | | N_001065193 | Os10g0542200 [Oryza sativa Japonica Group] > gi\|10140758\|gb\|AAG13589.1\| AC051633_5 putative ubiquitin protein [Oryza sativa Japonica Group] > gi\|31433330\|gb\|AAP54859.1\| Ubiquitin family protein, expressed [Oryza sativa Japonica Group] > gi\|113639802\|dbj\|BAF27107.1\| Os10g0542200 [Oryza sativa Japonica Group] | 0.71 | 929 | 1605 |
| | | EEE51337 | hypothetical protein OsJ_32327 [Oryza sativa Japonica Group] | 0.71 | 930 | |
| | | BAJ87273 | predicted protein [Hordeum vulgare subsp. vulgare] | 0.73 | 931 | 1606 |
| | | BAK06552 | predicted protein [Hordeum vulgare subsp. vulgare] | 0.74 | 932 | 1607 |
| | 1289-1312 | NP_001046031 | Os02g0171100 [Oryza sativa Japonica Group] > gi\|49387565\|dbj\|BAD25496.1\| putative glyceraldehyde-3-phosphate dehydrogenase [Oryza sativa Japonica Group] > gi\|49388082\|dbj\|BAD25194.1\| putative glyceraldehyde-3-phosphate dehydrogenase | 1.00 | 933 | 1608 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | [*Oryza sativa Japonica* Group] > gi\|113535562\|dbj\|BAF07945.1\| Os02g0171100 [*Oryza sativa Japonica* Group] > gi\|215697739\|dbj\|BAG91733.1\| unnamed protein product [*Oryza sativa Japonica* Group] > gi\|218190154\|gb\|EEC72581.1\| hypothetical protein OsI_06028 [*Oryza sativa Indica* Group] > gi\|222622270\|gb\|EEE56402.1\| hypothetical protein OsJ_05558 [*Oryza sativa Japonica* Group] | | | |
| | | NP_001149357 | LOC100282981 [*Zea mays*] > gi\|195626622\|gb\|ACG35141.1\| glyceraldehyde-3-phosphate dehydrogenase, cytosolic [*Zea mays*] > gi\|195641440\|gb\|ACG40188.1\| glyceraldehyde-3-phosphate dehydrogenase, cytosolic [*Zea mays*] | 0.92 | 934 | 1609 |
| | | ACL54292 | unknown [*Zea mays*] | 0.92 | 935 | 1610 |
| | | XP_002451619 | hypothetical protein SORBIDRAFT_04g004750 [*Sorghum bicolor*] > gi\|241931450\|gb\|EES04595.1\| hypothetical protein SORBIDRAFT_04g004750 [*Sorghum bicolor*] | 0.90 | 936 | 1611 |
| | | NP_001130796 | hypothetical protein LOC100191900 [*Zea mays*] > gi\|194690136\|gb\|ACF79152.1\| unknown [*Zea mays*] > gi\|195622606\|gb\|ACG33133.1\| glyceraldehyde-3-phosphate dehydrogenase, cytosolic [*Zea mays*] > gi\|195625996\|gb\|ACG34828.1\| glyceraldehyde-3-phosphate dehydrogenase, cytosolic [*Zea mays*] | 0.88 | 937 | 1612 |
| | | NP_001058309 | Os06g0666600 [*Oryza sativa Japonica* Group] > gi\|52076528\|dbj\|BAD45405.1\| putative glyceraldehyde-3-phosphate dehydrogenase [*Oryza sativa Japonica* Group] > gi\|113596349\|dbj\|BAF20223.1\| Os06g0666600 [*Oryza sativa Japonica* Group] > gi\|125556399\|gb\|EAZ02005.1\| hypothetical protein OsI_24036 [*Oryza sativa Indica* Group] > gi\|215741351\|dbj\|BAG97846.1\| unnamed protein product [*Oryza sativa Japonica* Group] | 0.85 | 938 | 1613 |
| | | BAJ86344 | predicted protein [*Hordeum vulgare* subsp. *vulgare*] > gi\|326520716\|dbj\|BAJ92721.1\| predicted protein [*Hordeum vulgare* subsp. *vulgare*] | 0.82 | 939 | 1614 |
| | | ADJ96634 | glyceraldehyde-3-phosphate dehydrogenase [*Guzmania wittmackii* x *Guzmania lingulata*] | 0.82 | 940 | 1615 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | CAC80377 | glyceraldehyde-3-phosphate dehydrogenase [*Capsicum annuum*] > gi|26986729|emb|CAC88118.1| glyceraldehyde-3-phosphate dehydrogenase [*Capsicum annuum*] | 0.77 | 941 | 1616 |
| | | XP_002263263 | PREDICTED: hypothetical protein [*Vitis vinifera*] > gi|297736130|emb|CBI24168.3| unnamed protein product [*Vitis vinifera*] | 0.75 | 942 | 1617 |
| Predicted folded 24-nts-long seq 52801 | 173-196 | AAL76004 | putative gag-pol polyprotein [*Zea mays*] | 1.00 | 943 | |
| | | AAN40035 | putative gag-pol polyprotein [*Zea mays*] | 0.90 | 944 | |
| | | AAN40025 | putative gag-pol polyprotein [*Zea mays*] | 0.85 | 945 | |
| | | AAL66753 | putative copia-type pol polyprotein [*Zea mays*] | 0.81 | 946 | |
| | | AAP94599 | putative copia-type pol polyprotein [*Zea mays*] | 0.81 | 947 | |
| Predicted folded 24-nts-long seq 52452 | 14-37 | XP_002458660 | hypothetical protein SORBIDRAFT_03g037610 [*Sorghum bicolor*] > gi|241930635|gb|EES03780.1| hypothetical protein SORBIDRAFT_03g037610 [*Sorghum bicolor*] | 1.00 | 948 | 1618 |
| | | NP_001106055 | ribonuclease III domain protein1 [*Zea mays*] > gi|149980667|gb|ABR53724.1| chloroplast ribonuclease III domain protein [*Zea mays*] > gi|194704042|gb|ACF86105.1| unknown [*Zea mays*] > gi|195647406|gb|ACG43171.1| RNA binding protein [*Zea mays*] > gi|223950477|gb|ACN29322.1| unknown [*Zea mays*] | 0.98 | 949 | 1619 |
| | | BAJ85766 | predicted protein [*Hordeum vulgare* subsp. *vulgare*] > gi|326503490|dbj|BAJ86251.1| predicted protein [*Hordeum vulgare* subsp. *vulgare*] > gi|326520661|dbj|BAJ92694.1| predicted protein [*Hordeum vulgare* subsp. *vulgare*] | 0.91 | 950 | 1620 |
| | | EEE55556 | hypothetical protein OsJ_03820 [*Oryza sativa Japonica* Group] | 0.89 | 951 | |
| | | NP_001044581 | Os01g0810100 [*Oryza sativa Japonica* Group] > gi|20160696|dbj|BAB89639.1| unknown protein [*Oryza sativa Japonica* Group] > gi|113534112|dbj|BAF06495.1| Os01g0810100 [*Oryza sativa Japonica* Group] > gi|215701330|dbj|BAG92754.1| unnamed protein product [*Oryza sativa Japonica* Group] > gi|215704464|dbj|BAG93898.1| unnamed protein product [*Oryza sativa Japonica* Group] | 0.92 | 952 | 1621 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | EEC71679 | hypothetical protein OsI__04153 [*Oryza sativa Indica* Group] | 0.86 | 953 | |
| | | BAJ91324 | predicted protein [*Hordeum vulgare* subsp. *vulgare*] | 0.85 | 954 | 1622 |
| | | XP__002533159 | RNA binding protein, putative [*Ricinus communis*] > gi|223527031|gb|EEF29218.1| RNA binding protein, putative [*Ricinus communis*] | 0.75 | 955 | 1623 |
| | | NP__195467 | Ribonuclease III family protein [*Arabidopsis thaliana*] > gi|4468817|emb|CAB38218.1| putative protein [*Arabidopsis thaliana*] > gi|7270733|emb|CAB80416.1| putative protein [*Arabidopsis thaliana*] > gi|95147308|gb|ABF57289.1| At4g37510 [*Arabidopsis thaliana*] > gi|332661403|gb|AEE86803.1| Ribonuclease III family protein [*Arabidopsis thaliana*] | 0.74 | 956 | 1624 |
| | | XP__002866942 | ribonuclease III family protein [*Arabidopsis lyrata* subsp. *lyrata*] > gi|297312778|gb|EFH43201.1| ribonuclease III family protein [*Arabidopsis lyrata* subsp. *lyrata*] | 0.74 | 957 | 1625 |
| | 86-109 | NP__001169273 | hypothetical protein LOC100383136 [*Zea mays*] > gi|224028313|gb|ACN33232.1| unknown [*Zea mays*] | 1.00 | 958 | 1626 |
| | | XP__022462951 | hypothetical protein SORBIDRAFT__02g035180 [*Sorghum bicolor*] > gi|241926328|gb|EER99472.1| hypothetical protein SORBIDRAFT__02g035180 [*Sorghum bicolor*] | 0.94 | 959 | 1627 |
| | | BAK06716 | predicted protein [*Hordeum vulgare* subsp. *vulgare*] | 0.82 | 960 | 1628 |
| | | EEC82174 | hypothetical protein OsI__26284 [*Oryza sativa Indica* Group] | 0.81 | 961 | |
| | | NP__001059844 | Os07g0530100 [*Oryza sativa Japonica* Group] > gi|33146648|dbj|BAC79984.1| putative tyrosyl-DNA phosphodiesterase [*Oryza sativa Japonica* Group] > gi|113611380|dbj|BAF21758.1| Os07g0530100 [*Oryza sativa Japonica* Group] > gi|215697362|dbj|BAG91356.1| unnamed protein product [*Oryza sativa Japonica* Group] > gi|222637174|gb|EEE67306.1| hypothetical protein OsJ__24533 [*Oryza sativa Japonica* Group] | 0.81 | 962 | 1629 |
| Predicted zma mir 48588 | 69-89 | NP__001167972 | hypothetical protein LOC100381689 [*Zea mays*] > gi|223945237|gb|ACN26702.1| unknown [*Zea mays*] | 1.00 | | |
| zma-miR166d* | 1395-1415 | NP__001151161 | riboflavin kinase family protein [*Zea mays*] > gi|195644710|gb|ACG41823.1| riboflavin kinase family protein [*Zea mays*] | 1.00 | 963 | 1630 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | EEC76352 | hypothetical protein OsI__13934 [*Oryza sativa Indica* Group] | 0.78 | 964 | |
| | | ABF99395 | riboflavin biosynthesis protein, putative, expressed [*Oryza sativa Japonica* Group] | 0.77 | 965 | 1631 |
| | | NP__001051594 | Os03g0801700 [*Oryza sativa Japonica* Group] > gi|108711599|gb|ABF99394.1| riboflavin biosynthesis protein, putative, expressed [*Oryza sativa Japonica* Group] > gi|113550065|dbj|BAF13508.1| Os03g0801700 [*Oryza sativa Japonica* Group] > gi|222625981|gb|EEE60113.1| hypothetical protein OsJ__12987 [*Oryza sativa Japonica* Group] | 0.77 | 966 | 1632 |
| | | BAK03408 | predicted protein [*Hordeum vulgare* subsp. *vulgare*] | 0.73 | 967 | 1633 |
| | | BAJ90790 | predicted protein [*Hordeum vulgare* subsp. *vulgare*] | 0.72 | 968 | 1634 |
| Predicted folded 24-nts-long seq 52795 | 923-946 | XP__002461133 | hypothetical protein SORBIDRAFT__02g041270 [*Sorghum bicolor*] > gi|241924510|gb|EER97654.1| hypothetical protein SORBIDRAFT__02g041270 [*Sorghum bicolor*] | 1.00 | 969 | 1635 |
| | | ACR36108 | unknown [*Zea mays*] | 0.97 | 970 | 1636 |
| | | NP__001149600 | protein SFT2 [*Zea mays*] > gi|195628366|gb|ACG36013.1| protein SFT2 [*Zea mays*] | 0.96 | 971 | 1637 |
| | | BAJ93024 | predicted protein [*Hordeum vulgare* subsp. *vulgare*] | 0.90 | 972 | 1638 |
| | | BAJ93185 | predicted protein [*Hordeum vulgare* subsp. *vulgare*] | 0.90 | 973 | 1639 |
| | | NP__001057449 | Os06g0300300 [*Oryza sativa Japonica* Group] > gi|53792521|dbj|BAD53485.1| unknown protein [*Oryza sativa Japonica* Group] > gi|113595489|dbj|BAF19363.1| Os06g0300300 [*Oryza sativa Japonica* Group] > gi|215697111|dbj|BAG91105.1| unnamed protein product [*Oryza sativa Japonica* Group] > gi|215766579|dbj|BAG98738.1| unnamed protein product [*Oryza sativa Japonica* Group] > gi|218198021|gb|EEC80448.1| hypothetical protein OsI__22649 [*Oryza sativa Indica* Group] > gi|222635438|gb|EEE65570.1| hypothetical protein OsJ__21068 [*Oryza sativa Japonica* Group] | 0.89 | 974 | 1640 |
| | | XP__002532175 | Protein transport protein SFT2, putative [*Ricinus communis*] > gi|223528143|gb|EEF30212.1| Protein transport protein SFT2, putative [*Ricinus communis*] | 0.73 | 975 | 1641 |
| | | XP__002264182 | PREDICTED: hypothetical protein [*Vitis vinifera*] > gi|296085064|emb|CBI28479.3| unnamed protein product [*Vitis vinifera*] | 0.70 | 976 | 1642 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | 149-172 | XP_002445951 | hypothetical protein SORBIDRAFT_07g028610 [Sorghum bicolor] > gi|241942301|gb|EES15446.1| hypothetical protein SORBIDRAFT_07g028610 [Sorghum bicolor] | 1.00 | 977 | 1643 |
| | | NP_001131191 | hypothetical protein LOC100192499 [Zea mays] > gi|194690830|gb|ACF79499.1| unknown [Zea mays] | 0.92 | 978 | 1644 |
| | | BAK06465 | predicted protein [Hordeum vulgare subsp. vulgare] > gi|326515200|dbj|BAK03513.1| predicted protein [Hordeum vulgare subsp. vulgare] | 0.83 | 979 | 1645 |
| | | EAZ07476 | hypothetical protein OsI_29735 [Oryza sativa Indica Group] > gi|125603873|gb|EAZ43198.1| hypothetical protein OsJ_27795 [Oryza sativa Japonica Group] | 0.83 | 980 | |
| | | NP_001062134 | Os08g0496000 [Oryza sativa Japonica Group] > gi|42408865|dbj|BAD10124.1| putative cytochrome c oxidase subunit 15(COX15) homolog isoform 1 precursor [Oryza sativa Japonica Group] > gi|113624103|dbj|BAF24048.1| Os08g0496000 [Oryza sativa Japonica Group] > gi|215737013|dbj|BAG95942.1| unnamed protein product [Oryza sativa Japonica Group] | 0.83 | 981 | 1646 |
| zma-miR169c* | 107-128 | XP_002451684 | hypothetical protein SORBIDRAFT_04g005850 [Sorghum bicolor] > gi|241931515|gb|EES04660.1| hypothetical protein SORBIDRAFT_04g005850 [Sorghum bicolor] | 1.00 | 992 | 1655 |
| | | NP_001169303 | hypothetical protein LOC100383167 [Zea mays] > gi|195627360|gb|ACG35510.1| cytochrome P450 CYP71K14 [Zea mays] | 0.85 | 993 | 1656 |
| | | ACN33338 | unknown [Zea mays] | 0.76 | 994 | 1657 |
| | 1135-1156 | NP_001169303 | hypothetical protein LOC100383167 [Zea mays] > gi|195627360|gb|ACG35510.1| cytochrome P450 CYP71K14 [Zea mays] | 1.00 | 995 | 1658 |
| | | ACN33338 | unknown [Zea mays] | 0.88 | 996 | 1659 |
| | | XP_002451684 | hypothetical protein SORBIDRAFT_04g005850 [Sorghum bicolor] > gi|241931515|gb|EES04660.1| hypothetical protein SORBIDRAFT_04g005850 [Sorghum bicolor] | 0.85 | 997 | 1660 |
| Predicted zma mir 50517 | 606-625 | XP_002436376 | hypothetical protein SORBIDRAFT_10g001390 [Sorghum bicolor] > gi|241914599|gb|EER87743.1| hypothetical protein SORBIDRAFT_10g001390 [Sorghum bicolor] | 1.00 | 998 | 1661 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | NP_001150208 | DAG protein [Zea mays] > gi|195637572|gb|ACG38254.1| DAG protein [Zea mays] > gi|223947219|gb|ACN27693.1| unknown [Zea mays] | 0.81 | 999 | 1662 |
| | | BAC22214 | putative plastid protein [Oryza sativa Japonica Group] | 0.81 | 1000 | 1663 |
| | | BAK01694 | predicted protein [Hordeum vulgare subsp. vulgare] | 0.80 | 1001 | 1664 |
| | | BAJ87670 | predicted protein [Hordeum vulgare subsp. vulgare] | 0.76 | 1002 | 1665 |
| | 560-579 | NP_001056622 | Os06g0116600 [Oryza sativa Japonica Group] > gi|55296199|dbj|BAD67917.1| putative DAL1 protein [Oryza sativa Japonica Group] > gi|113594662|dbj|BAF18536.1| Os06g0116600 [Oryza sativa Japonica Group] > gi|218197457|gb|EEC79884.1| hypothetical protein OsI_21391 [Oryza sativa Indica Group] > gi|222634859|gb|EEE64991.1| hypothetical protein OsJ_19911 [Oryza sativa Japonica Group] | 1.00 | 1003 | 1666 |
| | 3352-3371 | NP_001170545 | hypothetical protein LOC100384563 [Zea mays] > gi|238005944|gb|ACR34007.1| unknown [Zea mays] | 1.00 | 1004 | 1667 |
| | | XP_002436375 | hypothetical protein SORBIDRAFT_10g001380 [Sorghum bicolor] > gi|241914598|gb|EER87742.1| hypothetical protein SORBIDRAFT_10g001380 [Sorghum bicolor] | 0.85 | 1005 | 1668 |
| | | EEC79883 | hypothetical protein OsI_21390 [Oryza sativa Indica Group] | 0.81 | 1006 | |
| | | EEE64990 | hypothetical protein OsJ_19910 [Oryza sativa Japonica Group] | 0.78 | 1007 | |
| | | NP_001045600 | Os02g0102800 [Oryza sativa Japonica Group] > gi|41052906|dbj|BAD07818.1| unknown protein [Oryza sativa Japonica Group] > gi|41053240|dbj|BAD08201.1| unknown protein [Oryza sativa Japonica Group] > gi|113535131|dbj|BAF07514.1| Os02g0102800 [Oryza sativa Japonica Group] | 0.75 | 1008 | 1669 |
| Predicted zma mir 49435 | 965-985 | NP_001141527 | hypothetical protein LOC100273639 [Zea mays] > gi|194704936|gb|ACF86552.1| unknown [Zea mays] > gi|195642904|gb|ACG40920.1| hypothetical protein [Zea mays] | 1.00 | 1009 | 1670 |
| | | XP_002440488 | hypothetical protein SORBIDRAFT_09g001840 [Sorghum bicolor] > gi|241945773|gb|EES18918.1| hypothetical protein SORBIDRAFT_09g001840 [Sorghum bicolor] | 0.85 | 1010 | 1671 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | 358-378 | ACF85023 | unknown [*Zea mays*] | 1.00 | 1011 | 1672 |
| | | NP_001151177 | transposon protein [*Zea mays*] > gi|195644822|gb|ACG41879.1| transposon protein [*Zea mays*] | 0.99 | 1012 | 1673 |
| | | XP_002452722 | hypothetical protein SORBIDRAFT_04g031370 [*Sorghum bicolor*] > gi|241932553|gb|EES05698.1| hypothetical protein SORBIDRAFT_04g031370 [*Sorghum bicolor*] | 0.86 | 1013 | 1674 |
| | | NP_001047784 | Os02g0689500 [*Oryza sativa Japonica* Group] > gi|41052806|dbj|BAD07674.1| unknown protein [*Oryza sativa Japonica* Group] > gi|113537315|dbj|BAF09698.1| Os02g0689500 [*Oryza sativa Japonica* Group] > gi|125540730|gb|EAY87125.1| hypothetical protein OsI_08527 [*Oryza sativa Indica* Group] > gi|215704259|dbj|BAG93099.1| unnamed protein product [*Oryza sativa Japonica* Group] | 0.77 | 1014 | 1675 |
| mtr-miR169q | 174-194 | XP_002468544 | hypothetical protein SORBIDRAFT_01g047710 [*Sorghum bicolor*] > gi|241922398|gb|EER95542.1| hypothetical protein SORBIDRAFT_01g047710 [*Sorghum bicolor*] | 1.00 | 1015 | 1676 |
| | | NP_001142595 | hypothetical protein LOC100274862 [*Zea mays*] > gi|195607096|gb|ACG25378.1| hypothetical protein [*Zea mays*] | 0.85 | 1016 | 1677 |
| | | ACN31627 | unknown [*Zea mays*] | 0.85 | 1017 | 1678 |
| | | ACR38267 | unknown [*Zea mays*] | 0.85 | 1018 | 1679 |
| | | NP_001144209 | hypothetical protein LOC100277070 [*Zea mays*] > gi|195638456|gb|ACG38696.1| hypothetical protein [*Zea mays*] | 0.85 | 1019 | 1680 |
| | | NP_001048909 | Os03g0138500 [*Oryza sativa Japonica* Group] > gi|108706085|gb|ABF93880.1| expressed protein [*Oryza sativa Japonica* Group] > gi|113547380|dbj|BAF10823.1| Os03g0138500 [*Oryza sativa Japonica* Group] | 0.72 | 1020 | 1681 |
| | | EAZ25513 | hypothetical protein OsJ_09336 [*Oryza sativa Japonica* Group] | 0.71 | 1021 | |
| | | EAY88465 | hypothetical protein OsI_09934 [*Oryza sativa Indica* Group] | 0.71 | 1022 | |
| | 1074-1094 | NP_001150090 | PIT1 [*Zea mays*] > gi|195636634|gb|ACG37785.1| PIT1 [*Zea mays*] | 1.00 | 1023 | 1682 |
| | | NP_001042834 | Os01g0303600 [*Oryza sativa Japonica* Group] > gi|52075677|dbj|BAD44897.1| zinc finger protein-like [*Oryza sativa Japonica* Group] > gi|52077476|dbj|BAD45040.1| zinc finger protein-like [*Oryza sativa Japonica* Group] > gi|218188061|dbj|EEC70488.1| | 0.76 | 1024 | 1683 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | hypothetical protein OsI_01559 [*Oryza sativa Indica* Group] > gi|255673151|dbj|BAF04748.2| Os01g0303600 [*Oryza sativa Japonica* Group] | | | |
| Predicted zma mir 49003 | 71-92 | XP_002437560 | hypothetical protein SORBIDRAFT_10g029400 [*Sorghum bicolor*] > gi|241915783|gb|EER88927.1| hypothetical protein SORBIDRAFT_10g029400 [*Sorghum bicolor*] | 1.00 | 1025 | 1684 |
| | | ACL53917 | unknown [*Zea mays*] | 0.97 | 1026 | 1685 |
| | | NP_001152313 | LOC100285952 [*Zea mays*] > gi|195654989|gb|ACG46962.1| MPK17-1-putative MAPK [*Zea mays*] | 0.97 | 1027 | 1686 |
| | | NP_001146196 | LOC100279766 [*Zea mays*] > gi|219886151|gb|ACL53450.1| unknown [*Zea mays*] > gi|297595201|gb|ADI48121.1| putative mitogen-activated protein kinase 17-3 [*Zea mays*] | 0.95 | 1028 | 1687 |
| | | EEC81289 | hypothetical protein OsI_24409 [*Oryza sativa Indica* Group] | 0.91 | 1029 | |
| | | NP_001058530 | Os06g0708000 [*Oryza sativa Japonica* Group] > gi|108860803|sp|Q5Z9J0.2| MPK12_ORYSJ RecName: Full = Mitogen-activated protein kinase 12; Short = MAP kinase 12; AltName: Full = Blast- and wound-induced MAP kinase 1; AltName: Full = MAP kinase 1; AltName: Full = OsBWMK1; AltName: Full = OsMAPK1 > gi|53792601|dbj|BAD53616.1| putative MAP kinase [*Oryza sativa Japonica* Group] > gi|113596570|dbj|BAF20444.1| Os06g0708000 [*Oryza sativa Japonica* Group] | 0.91 | 1030 | 1688 |
| | | AAX20165 | putative MAPK protein kinase [*Triticum aestivum*] > gi|84795226|gb|ABC65849.1| mitogen-activated protein kinase MAPK1e [*Triticum aestivum*] | 0.86 | 1031 | 1689 |
| | | ABC54587 | mitogen-activated protein kinase [*Triticum aestivum*] | 0.86 | 1032 | 1690 |
| | | AAX20166 | putative MAPK protein kinase [*Triticum aestivum*] | 0.86 | 1033 | 1691 |
| | | ABD97883 | mitogen-activated protein kinase [*Triticum aestivum*] | 0.86 | 1034 | 1692 |
| | 53-74 | EAY76957 | hypothetical protein OsI_04915 [*Oryza sativa Indica* Group] | 1.00 | 1035 | |
| | | NP_001045192 | Os01g0916200 [*Oryza sativa Japonica* Group] > gi|19386749|dbj|BAB86130.1| putative adapter-related protein complex 4 epsilon 1 subunit [*Oryza sativa Japonica* Group] > gi|20805003|dbj|BAB92679.1| putative adapter-related protein complex 4 epsilon 1 subunit [*Oryza sativa Japonica* Group] | 1.00 | 1036 | 1693 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | > gi|113534723|dbj|BAF07106.1| Os01g0916200 [*Oryza sativa Japonica* Group] > gi|215707205|dbj|BAG93665.1| unnamed protein product [*Oryza sativa Japonica* Group] | | | |
| | | EAZ14613 | hypothetical protein OsJ_04538 [*Oryza sativa Japonica* Group] | 0.93 | 1037 | |
| | | XP_002458982 | hypothetical protein SORBIDRAFT_03g043730 [*Sorghum bicolor*] > gi|241930957|gb|EES04102.1| hypothetical protein SORBIDRAFT_03g043730 [*Sorghum bicolor*] | 0.91 | 1038 | 1694 |
| | | NP_001169710 | hypothetical protein LOC100383591 [*Zea mays*] > gi|224031083|gb|ACN34617.1| unknown [*Zea mays*] | 0.90 | 1039 | 1695 |
| | | BAJ89128 | predicted protein [*Hordeum vulgare* subsp. *vulgare*] | 0.88 | 1040 | 1696 |
| | | XP_002328755 | predicted protein [*Populus trichocarpa*] > gi|222839053|gb|EEE77404.1| predicted protein [*Populus trichocarpa*] | 0.70 | 1041 | 1697 |
| | | XP_002519936 | AP-1 complex subunit gamma-2, putative [*Ricinus communis*] > gi|223540982|gb|EEF42540.1| AP-1 complex subunit gamma-2, putative [*Ricinus communis*] | 0.71 | 1042 | 1698 |
| zma-miR399g | 897-917 | NP_001105061 | Hageman factor inhibitor [*Zea mays*] > gi|16305146|gb|AAL16995.1| Hageman factor inhibitor [*Zea mays*] | 1.00 | 1043 | 1699 |
| | | NP_001106233 | trypsin/factor XIIA inhibitor precursor [*Zea mays*] > gi|266398|sp|P01088.2|ITRF_MAIZE RecName: Full = Trypsin/factor XIIA inhibitor; AltName: Full = CHFI; AltName: Full = Hageman factor inhibitor; Flags: Precursor > gi|22327|emb|CAA37998.1| corn Hageman factor inhibitor [*Zea mays*] > gi|75994173|gb|ABA34122.1| hageman factor inhibitor [*Zea mays* subsp. *parviglumis*] > gi|75994177|gb|ABA34124.1| hageman factor inhibitor [*Zea mays* subsp. *parviglumis*] > gi|75994189|gb|ABA34130.1| hageman factor inhibitor [*Zea mays* subsp. *parviglumis*] > gi|75994193|gb|ABA34132.1| hageman factor inhibitor [*Zea mays* subsp. *parviglumis*] > gi|195658559|gb|ACG48747.1| trypsin/factor XIIA inhibitor precursor [*Zea mays*] > gi|195658619|gb|ACG48777.1| trypsin/factor XIIA inhibitor precursor [*Zea mays*] > gi|214014768|gb|ACJ62034.1| | 0.84 | 1044 | 1700 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | Hageman factor inhibitor [*Zea mays* subsp. *parviglumis*] > gi|214014812|gb|ACJ62056.1| Hageman factor inhibitor [*Zea mays* subsp. *parviglumis*] > gi|214014814|gb|ACJ62057.1| Hageman factor inhibitor [*Zea mays* subsp. *parviglumis*] > gi|214014820|gb|ACJ62060.1| Hageman factor inhibitor [*Zea mays* subsp. *parviglumis*] > gi|214014826|gb|ACJ62063.1| Hageman factor inhibitor [*Zea mays* subsp. *parviglumis*] > gi|214014828|gb|ACJ62064.1| Hageman factor inhibitor [*Zea mays* subsp. *parviglumis*] > gi|214014862|gb|ACJ62081.1| Hageman factor inhibitor [*Zea mays* subsp. *parviglumis*] > gi|214014864|gb|ACJ62082.1| Hageman factor inhibitor [*Zea mays* subsp. *parviglumis*] > gi|214014870|gb|ACJ62085.1| Hageman factor inhibitor [*Zea mays* subsp. *parviglumis*] > gi|238014562|gb|ACR38316.1| unknown [*Zea mays*] | | | |
| | | ABA34135 | hageman factor inhibitor [*Zea mays* subsp. *parviglumis*] > gi|214014790|gb|ACJ62045.1| Hageman factor inhibitor [*Zea mays* subsp. *parviglumis*] > gi|214014796|gb|ACJ62048.1| Hageman factor inhibitor [*Zea mays* subsp. *parviglumis*] | 0.83 | 1045 | 1701 |
| | | ACJ62011 | Hageman factor inhibitor [*Zea mays* subsp. *parviglumis*] > gi|214014726|gb|ACJ62013.1| Hageman factor inhibitor [*Zea mays* subsp. *parviglumis*] > gi|214014728|gb|ACJ62014.1| Hageman factor inhibitor [*Zea mays* subsp. *parviglumis*] > gi|214014730|gb|ACJ62015.1| Hageman factor inhibitor [*Zea mays* subsp. *parviglumis*] > gi|214014732|gb|ACJ62016.1| Hageman factor inhibitor [*Zea mays* subsp. *parviglumis*] > gi|214014734|gb|ACJ62017.1| Hageman factor inhibitor [*Zea mays* subsp. *parviglumis*] > gi|214014744|gb|ACJ62022.1| Hageman factor inhibitor [*Zea mays* subsp. *parviglumis*] > gi|214014746|gb|ACJ62023.1| Hageman factor inhibitor [*Zea mays* subsp. *parviglumis*] > gi|214014748|gb|ACJ62024.1| Hageman factor inhibitor [*Zea mays* subsp. *parviglumis*] | 0.83 | 1046 | 1702 |
| | | ABA34133 | hageman factor inhibitor [*Zea mays* subsp. *parviglumis*] | 0.83 | 1047 | 1703 |
| | | ACJ62080 | Hageman factor inhibitor [*Zea mays* subsp. *parviglumis*] | 0.83 | 1048 | 1704 |
| | | ABA34137 | hageman factor inhibitor [*Zea diploperennis*] > gi|75994207|gb|ABA34139.1| hageman factor inhibitor [*Zea diploperennis*] > gi|75994211|gb|ABA34141.1| hageman factor inhibitor | 0.83 | 1049 | 1705 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | [Zea diploperennis] > gi\|75994213\|gb\|ABA34142.1\| hageman factor inhibitor [Zea diploperennis] > gi\|75994215\|gb\|ABA34143.1\| hageman factor inhibitor [Zea diploperennis] > gi\|75994217\|gb\|ABA34144.1\| hageman factor inhibitor [Zea diploperennis] | | | |
| | | ACG48546 | trypsin/factor XIIA inhibitor precursor [Zea mays] | 0.83 | 1050 | 1706 |
| | | ABA34129 | hageman factor inhibitor [Zea mays subsp. parviglumis] | 0.83 | 1051 | 1707 |
| | | ABA34125 | hageman factor inhibitor [Zea mays subsp. parviglumis] > gi\|75994185\|gb\|ABA34128.1\| hageman factor inhibitor [Zea mays subsp. parviglumis] > gi\|214014736\|gb\|ACJ62018.1\| Hageman factor inhibitor [Zea mays subsp. parviglumis] > gi\|214014752\|gb\|ACJ62026.1\| Hageman factor inhibitor [Zea mays subsp. parviglumis] > gi\|214014822\|gb\|ACJ62061.1\| Hageman factor inhibitor [Zea mays subsp. parviglumis] | 0.83 | 1052 | 1708 |
| Predicted zma mir 49985 | 379-399 | XP_002454327 | hypothetical protein SORBIDRAFT_04g028730 [Sorghum bicolor] > gi\|241934158\|gb\|EES07303.1\| hypothetical protein SORBIDRAFT_04g028730 [Sorghum bicolor] | 1.00 | 1053 | 1709 |
| | | ACG36841 | caleosin related protein [Zea mays] | 0.81 | 1054 | 1710 |
| | | ACN31536 | unknown [Zea mays] | 0.78 | 1055 | 1711 |
| | | NP_001142815 | hypothetical protein LOC100275194 [Zea mays] > gi\|195610158\|gb\|ACG26909.1\| hypothetical protein [Zea mays] | 0.79 | 1056 | 1712 |
| | | NP_001148700 | caleosin related protein [Zea mays] > gi\|195621488\|gb\|ACG32574.1\| caleosin related protein [Zea mays] | 0.77 | 1057 | 1713 |
| | 632-652 | XP_002448765 | hypothetical protein SORBIDRAFT_06g032800 [Sorghum bicolor] > gi\|241939948\|gb\|EES13093.1\| hypothetical protein SORBIDRAFT_06g032800 [Sorghum bicolor] | 1.00 | 1058 | 1714 |
| | | NP_001131374 | hypothetical protein LOC100192699 [Zea mays] > gi\|195620734\|gb\|ACG32197.1\| oligosaccharyl transferase STT3 subunit [Zea mays] | 0.99 | 1059 | 1715 |
| | | NP_001168720 | hypothetical protein LOC100382512 [Zea mays] > gi\|223950395\|gb\|ACN29281.1\| unknown [Zea mays] | 0.98 | 1060 | 1716 |
| | | NP_001054248 | Os04g0675500 [Oryza sativa Japonica Group] > gi\|38344929\|emb\|CAE03245.2\| OSJNBa0018M05.20 [Oryza sativa Japonica Group] > gi\|90399055\|emb\|CAJ86104.1\| H0103C06.8 [Oryza sativa Indica Group] | 0.96 | 1061 | 1717 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | > gi|113565819|dbj|BAF16162.1| Os04g0675500 [*Oryza sativa Japonica* Group] > gi|125550210|gb|EAY96032.1| hypothetical protein OsI_17905 [*Oryza sativa Indica* Group] > gi|125592048|gb|EAZ32398.1| hypothetical protein OsJ_16609 [*Oryza sativa Japonica* Group] > gi|215708677|dbj|BAG93946.1| unnamed protein product [*Oryza sativa Japonica* Group] | | | |
| | | BAJ87792 | predicted protein [*Hordeum vulgare* subsp. *vulgare*] | 0.95 | 1062 | 1718 |
| | | CBG76274 | OO__Ba0005L10-OO__Ba0081K17.25 [*Oryza officinalis*] | 0.93 | 1063 | 1719 |
| | | XP_002269119 | PREDICTED: hypothetical protein [*Vitis vinifera*] | 0.86 | 1064 | 1720 |
| | | XP_002318345 | predicted protein [*Populus trichocarpa*] > gi|222859018|gb|EEE96565.1| predicted protein [*Populus trichocarpa*] | 0.86 | 1065 | 1721 |
| | | XP_002891078 | hypothetical protein ARALYDRAFT_891007 [*Arabidopsis lyrata* subsp. *lyrata*] > gi|297336920|gb|EFH67337.1| hypothetical protein ARALYDRAFT_891007 [*Arabidopsis lyrata* subsp. *lyrata*] | 0.85 | 1066 | 1722 |
| | | XP_002329687 | predicted protein [*Populus trichocarpa*] > gi|222870595|gb|EEF07726.1| predicted protein [*Populus trichocarpa*] | 0.85 | 1067 | 1723 |
| | 795-815 | XP_002458747 | hypothetical protein SORBIDRAFT_03g039530 [*Sorghum bicolor*] > gi|241930722|gb|EES03867.1| hypothetical protein SORBIDRAFT_03g039530 [*Sorghum bicolor*] | 1.00 | 1068 | 1724 |
| | | NP_001147942 | L-ascorbate oxidase [*Zea mays*] > gi|195614732|gb|ACG29196.1| L-ascorbate oxidase precursor [*Zea mays*] | 0.96 | 1069 | 1725 |
| | | ACN34362 | unknown [*Zea mays*] | 0.96 | 1070 | 1726 |
| | | EEC71780 | hypothetical protein OsI_04394 [*Oryza sativa Indica* Group] | 0.86 | 1071 | |
| | | NP_001044773 | Os01g0842500 [*Oryza sativa Japonica* Group] > gi|19571025|dbj|BAB86452.1| putative laccase LAC5-6 [*Oryza sativa Japonica* Group] > gi|113534304|dbj|BAF06687.1| Os01g0842500 [*Oryza sativa Japonica* Group] > gi|125572601|gb|EAZ14116.1| hypothetical protein OsJ_04040 [*Oryza sativa Japonica* Group] > gi|215694814|dbj|BAG90005.1| unnamed protein product [*Oryza sativa Japonica* Group] | 0.86 | 1072 | 1727 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | BAJ84890 | predicted protein [*Hordeum vulgare* subsp. *vulgare*] | 0.84 | 1073 | 1728 |
| | | BAJ96691 | predicted protein [*Hordeum vulgare* subsp. *vulgare*] | 0.84 | 1074 | 1729 |
| | | NP_001105875 | putative laccase [*Zea mays*] > gi|84618781|emb|CAJ30500.1| putative laccase [*Zea mays*] | 0.79 | 1075 | 1730 |
| | | ACN28855 | unknown [*Zea mays*] | 0.79 | 1076 | 1731 |
| | | XP_002458746 | hypothetical protein SORBIDRAFT_03g039520 [*Sorghum bicolor*] > gi|241930721|gb|EES03866.1| hypothetical protein SORBIDRAFT_03g039520 [*Sorghum bicolor*] | 0.78 | 1077 | 1732 |
| | 198-218 | XP_002458746 | hypothetical protein SORBIDRAFT_03g039520 [*Sorghum bicolor*] > gi|241930721|gb|EES03866.1| hypothetical protein SORBIDRAFT_03g039520 [*Sorghum bicolor*] | 1.00 | 1078 | 1733 |
| | | NP_001105875 | putative laccase [*Zea mays*] > gi|84618781|emb|CAJ30500.1| putative laccase [*Zea mays*] | 0.94 | 1079 | 1734 |
| | | NP_001146658 | hypothetical protein LOC100280258 [*Zea mays*] > gi|219888209|gb|ACL54479.1| unknown [*Zea mays*] | 0.93 | 1080 | 1735 |
| | | ACN28855 | unknown [*Zea mays*] | 0.94 | 1081 | 1736 |
| | | NP_001044772 | Os01g0842400 [*Oryza sativa Japonica* Group] > gi|75321217|sp|Q5N9X2.1| LAC4_ORYSJ RecName: Full = Laccase-4; AltName: Full = Benzenediol:oxygen oxidoreductase 4; AltName: Full = Diphenol oxidase 4; AltName: Full = Urishiol oxidase 4; Flags: Precursor > gi|56784239|dbj|BAD81734.1| putative laccase LAC5-6 [*Oryza sativa Japonica* Group] > gi|113534303|dbj|BAF06686.1| Os01g0842400 [*Oryza sativa Japonica* Group] > gi|215697155|dbj|BAG91149.1| unnamed protein product [*Oryza sativa Japonica* Group] | 0.80 | 1082 | 1737 |
| | | EAZ14115 | hypothetical protein OsJ_04039 [*Oryza sativa Japonica* Group] | 0.80 | 1083 | |
| | | EEC71777 | hypothetical protein OsI_04389 [*Oryza sativa Indica* Group] | 0.80 | 1084 | |
| | | BAJ99773 | predicted protein [*Hordeum vulgare* subsp. *vulgare*] | 0.78 | 1085 | 1738 |
| | | XP_002458747 | hypothetical protein SORBIDRAFT_03g039530 [*Sorghum bicolor*] > gi|241930722|gb|EES03867.1| hypothetical protein SORBIDRAFT_03g039530 [*Sorghum bicolor*] | 0.78 | 1086 | 1739 |
| | | AAC04576 | putative high-pI laccase [*Oryza sativa Japonica* Group] | 0.79 | 1087 | 1740 |
| | 751-771 | XP_002456566 | hypothetical protein SORBIDRAFT_03g038550 [*Sorghum bicolor*] > gi|241928541|gb|EES01686.1| | 1.00 | 1088 | 1741 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | hypothetical protein SORBIDRAFT_03g038550 [*Sorghum bicolor*] | | | |
| | | NP_001148479 | L-ascorbate oxidase [*Zea mays*] > gi|195619672|gb|ACG31666.1| L-ascorbate oxidase precursor [*Zea mays*] | 0.92 | 1089 | 1742 |
| | | NP_001183899 | hypothetical protein LOC100502492 [*Zea mays*] > gi|223948465|gb|ACN28316.1| unknown [*Zea mays*] > gi|238015342|gb|ACR38706.1| unknown [*Zea mays*] | 0.90 | 1090 | 1743 |
| | | NP_001044679 | Os01g0827300 [*Oryza sativa Japonica* Group] > gi|75331868|sp|Q941X2.1| LAC3_ORYSJ RecName: Full = Benzenediol: oxygen oxidoreductase 3; AltName: Full = Diphenol oxidase 3; AltName: Full = Urishiol oxidase 3; Flags: Precursor > gi|15624045|dbj|BAB68098.1| putative laccase [*Oryza sativa Japonica* Group] > gi|113534210|dbj|BAF06593.1| Os01g0827300 [*Oryza sativa Japonica* Group] > gi|215701334|dbj|BAG92758.1| unnamed protein product [*Oryza sativa Japonica* Group] > gi|222619479|gb|EEE55611.1| hypothetical protein OsJ_03932 [*Oryza sativa Japonica* Group] | 0.84 | 1091 | 1744 |
| | | ACN27868 | unknown [*Zea mays*] | 0.82 | 1092 | 1745 |
| | | XP_002315131 | laccase 90c [*Populus trichocarpa*] > gi|222864171|gb|EEF01302.1| laccase 90c [*Populus trichocarpa*] | 0.71 | 1093 | 1746 |
| | | ABK92474 | unknown [*Populus trichocarpa*] | 0.70 | 1094 | 1747 |
| | | XP_002312186 | laccase 90a [*Populus trichocarpa*] > gi|222852006|gb|EEE89553.1| laccase 90a [*Populus trichocarpa*] | 0.70 | 1095 | 1748 |
| | 868-888 | NP_001141205 | hypothetical protein LOC100273292 [*Zea mays*] > gi|223944003|gb|ACN26085.1| unknown [*Zea mays*] | 1.00 | 1096 | 1749 |
| | | ACF85713 | unknown [*Zea mays*] | 0.91 | 1097 | 1750 |
| | | XP_002446013 | hypothetical protein SORBIDRAFT_06g000500 [*Sorghum bicolor*] > gi|241937196|gb|EES10341.1| hypothetical protein SORBIDRAFT_06g000500 [*Sorghum bicolor*] | 0.84 | 1098 | 1751 |
| | | XP_002446014 | hypothetical protein SORBIDRAFT_06g000510 [*Sorghum bicolor*] > gi|241937197|gb|EES10342.1| hypothetical protein SORBIDRAFT_06g000510 [*Sorghum bicolor*] | 0.81 | 1099 | 1752 |
| | | CAH67827 | B0616E02-H0507E05.3 [*Oryza sativa Indica* Group] > gi|125546940|gb|EAY92762.1| hypothetical protein | 0.80 | 1100 | 1753 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | OsI_14564 [*Oryza sativa Indica* Group] > gi\|125589087\|gb\|EAZ29437.1\| hypothetical protein OsJ_13511 [*Oryza sativa Japonica* Group] | | | |
| | | BAJ88131 | predicted protein [*Hordeum vulgare* subsp. *vulgare*] | 0.83 | 1101 | 1754 |
| | 172-192 | NP_001148700 | caleosin related protein [*Zea mays*] > gi\|195621488\|gb\|ACG32574.1\| caleosin related protein [*Zea mays*] | 1.00 | 1102 | 1755 |
| | | ACN31536 | unknown [*Zea mays*] | 0.99 | 1103 | 1756 |
| | | ACG36841 | caleosin related protein [*Zea mays*] | 0.83 | 1104 | 1757 |
| | | NP_001142815 | hypothetical protein LOC100275194 [*Zea mays*] > gi\|195610158\|gb\|ACG26909.1\| hypothetical protein [*Zea mays*] | 0.82 | 1105 | 1758 |
| | | XP_002454327 | hypothetical protein SORBIDRAFT_04g028730 [*Sorghum bicolor*] > gi\|241934158\|gb\|EES07303.1\| hypothetical protein SORBIDRAFT_04g028730 [*Sorghum bicolor*] | 0.76 | 1106 | 1759 |
| | 782-802 | XP_002465485 | hypothetical protein SORBIDRAFT_01g039690 [*Sorghum bicolor*] > gi\|241919339\|gb\|EER92483.1\| hypothetical protein SORBIDRAFT_01g039690 [*Sorghum bicolor*] | 1.00 | 1107 | 1760 |
| | | NP_001131665 | hypothetical protein LOC100193025 [*Zea mays*] > gi\|194692196\|gb\|ACF80182.1\| unknown [*Zea mays*] | 0.92 | 1108 | 1761 |
| | | NP_001049699 | Os03g0273200 [*Oryza sativa Japonica* Group] > gi\|122247226\|sp\|Q10ND7.1\| LAC10_ORYSJ RecName: Full = Laccase-10; AltName: Full = Benzenediol:oxygen oxidoreductase 10; AltName: Full = Diphenol oxidase 10; AltName: Full = Urishiol oxidase 10; Flags: Precursor > gi\|108707435\|gb\|ABF95230.1\| laccase, putative, expressed [*Oryza sativa Japonica* Group] > gi\|113548170\|dbj\|BAF11613.1\| Os03g0273200 [*Oryza sativa Japonica* Group] > gi\|215704111\|dbj\|BAG92951.1\| unnamed protein product [*Oryza sativa Japonica* Group] > gi\|215765805\|dbj\|BAG87502.1\| unnamed protein product [*Oryza sativa Japonica* Group] > gi\|222624652\|gb\|EEE58784.1\| hypothetical protein OsJ_10313 [*Oryza sativa Japonica* Group] | 0.82 | 1109 | 1762 |
| | | XP_002531824 | laccase, putative [*Ricinus communis*] > gi\|223528520\|gb\|EEF30544.1\| laccase, putative [*Ricinus communis*] | 0.73 | 1110 | 1763 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | XP_002278215 | PREDICTED: hypothetical protein [*Vitis vinifera*] | 0.73 | 1111 | 1764 |
| | | CBI16199 | unnamed protein product [*Vitis vinifera*] | 0.72 | 1112 | |
| | | XP_002278232 | PREDICTED: hypothetical protein [*Vitis vinifera*] | 0.73 | 1113 | 1765 |
| | | XP_002282823 | PREDICTED: hypothetical protein [*Vitis vinifera*] | 0.74 | 1114 | 1766 |
| | 943-963 | NP_001183899 | hypothetical protein LOC100502492 [*Zea mays*] > gi|223948465|gb|ACN28316.1| unknown [*Zea mays*] > gi|238015342|gb|ACR38706.1| unknown [*Zea mays*] | 1.00 | 1115 | 1767 |
| | | NP_001148479 | L-ascorbate oxidase [*Zea mays*] > gi|195619672|gb|ACG31666.1| L-ascorbate oxidase precursor [*Zea mays*] | 0.90 | 1116 | 1768 |
| | | XP_002456566 | hypothetical protein SORBIDRAFT_03g038550 [*Sorghum bicolor*] > gi|241928541|gb|EES01686.1| hypothetical protein SORBIDRAFT_03g038550 [*Sorghum bicolor*] | 0.89 | 1117 | 1769 |
| | | NP_001044679 | Os01g0827300 [*Oryza sativa Japonica* Group] > gi|75331868|sp|Q941X2.1| LAC3_ORYSJ RecName: Full = Laccase-3; AltName: Full = Benzenediol:oxygen oxidoreductase 3; AltName: Full = Diphenol oxidase 3; AltName: Full = Urishiol oxidase 3; Flags: Precursor > gi|15624045|dbj|BAB68098.1| putative laccase [*Oryza sativa Japonica* Group] > gi|113534210|dbj|BAF06593.1| Os01g0827300 [*Oryza sativa Japonica* Group] > gi|215701334|dbj|BAG92758.1| unnamed protein product [*Oryza sativa Japonica* Group] > gi|222619479|gb|EEE55611.1| hypothetical protein OsJ_03932 [*Oryza sativa Japonica* Group] | 0.83 | 1118 | 1770 |
| | | ACN27868 | unknown [*Zea mays*] | 0.80 | 1119 | 1771 |
| | | XP_002315131 | laccase 90c [*Populus trichocarpa*] > gi|222864171|gb|EEF01302.1| laccase 90c [*Populus trichocarpa*] | 0.70 | 1120 | 1772 |
| | | CBI25418 | unnamed protein product [*Vitis vinifera*] | 0.71 | 1121 | 1773 |
| | | XP_002273875 | PREDICTED: hypothetical protein [*Vitis vinifera*] | 0.71 | 1122 | 1774 |
| | 852-872 | NP_001105875 | putative laccase [*Zea mays*] > gi|84618781|emb|CAJ30500.1| putative laccase [*Zea mays*] | 1.00 | 1123 | 1775 |
| | | ACN28855 | unknown [*Zea mays*] | 0.98 | 1124 | 1776 |
| | | NP_001146658 | hypothetical protein LOC100280258 [*Zea mays*] > gi|219888209|gb|ACL54479.1| unknown [*Zea mays*] | 0.94 | 1125 | 1777 |
| | | XP_002458746 | hypothetical protein SORBIDRAFT_03g039520 [*Sorghum bicolor*] > gi|241930721|gb|EES03866.1| | 0.91 | 1126 | 1778 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | NP_001044772 | hypothetical protein SORBIDRAFT_03g039520 [Sorghum bicolor] Os01g0842400 [Oryza sativa Japonica Group] > gi|75321217|sp|Q5N9X2.1| LAC4_ORYSJ RecName: Full = Laccase-4; AltName: Full = Benzenediol:oxygen oxidoreductase 4; AltName: Full = Diphenol oxidase 4; AltName: Full = Urishiol oxidase 4; Flags: Precursor > gi|56784239|dbj|BAD81734.1| putative laccase LAC5-6 [Oryza sativa Japonica Group] > gi|113534303|dbj|BAF06686.1| Os01g0842400 [Oryza sativa Japonica Group] > gi|215697155|dbj|BAG91149.1| unnamed protein product [Oryza sativa Japonica Group] | 0.80 | 1127 | 1779 |
| | | EAZ14115 | hypothetical protein OsJ_04039 [Oryza sativa Japonica Group] | 0.80 | 1128 | |
| | | EEC71777 | hypothetical protein OsI_04389 [Oryza sativa Indica Group] | 0.80 | 1129 | |
| | | AAC04576 | putative high-pI laccase [Oryza sativa Japonica Group] | 0.79 | 1130 | 1780 |
| | | BAJ99773 | predicted protein [Hordeum vulgare subsp. vulgare] | 0.77 | 1131 | 1781 |
| | | XP_002458747 | hypothetical protein SORBIDRAFT_03g039530 [Sorghum bicolor] > gi|241930722|gb|EES03867.1| hypothetical protein SORBIDRAFT_03g039530 [Sorghum bicolor] | 0.78 | 1132 | 1782 |
| | 801-821 | XP_002441216 | hypothetical protein SORBIDRAFT_09g022460 [Sorghum bicolor] > gi|241946501|gb|EES19646.1| hypothetical protein SORBIDRAFT_09g022460 [Sorghum bicolor] | 1.00 | 1133 | 1783 |
| | | NP_001105874 | putative laccase [Zea mays] > gi|84618777|emb|CAJ30498.1| putative laccase [Zea mays] | 0.89 | 1134 | 1784 |
| | | Q0DHL5 | RecName: Full = Putative laccase-11; AltName: Full = Benzenediol:oxygen oxidoreductase 11; AltName: Full = Diphenol ocidase 11; AltName: Full = Urishiol oxidase 11 > gi|222631843|gb|EEE63975.1| hypothetical protein OsJ_18801 [Oryza sativa Japonica Group] | 0.88 | 1135 | |
| | | NP_001055744 | Os05g0458300 [Oryza sativa Japonica Group] > gi|113579295|dbj|BAF17658.1| Os05g0458300 [Oryza sativa Japonica Group] | 0.81 | 1136 | 1785 |
| | | XP_002456622 | hypothetical protein SORBIDRAFT_03g039570 [Sorghum bicolor] > gi|241928597|gb|EES01742.1| hypothetical protein | 0.76 | 1137 | 1786 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | SORBIDRAFT_03g039570 [*Sorghum bicolor*] | | | |
| | | ACG47007 | L-ascorbate oxidase precursor [*Zea mays*] | 0.76 | 1138 | 1787 |
| | | NP_001105921 | putative laccase [*Zea mays*] > gi|84618783|emb|CAJ30497.1| putative laccase [*Zea mays*] | 0.74 | 1139 | 1788 |
| | 673-693 | NP_001168720 | hypothetical protein LOC100382512 [*Zea mays*] > gi|223950395|gb|ACN29281.1| unknown [*Zea mays*] | 1.00 | 1140 | 1789 |
| | | XP_002448765 | hypothetical protein SORBIDRAFT_06g032800 [*Sorghum bicolor*] > gi|241939948|gb|EES13093.1| hypothetical protein SORBIDRAFT_06g032800 [*Sorghum bicolor*] | 0.98 | 1141 | 1790 |
| | | NP_001131374 | hypothetical protein LOC100192699 [*Zea mays*] > gi|195620734|gb|ACG32197.1| oligosaccharyl transferase STT3 subunit [*Zea mays*] | 0.98 | 1142 | 1791 |
| | | NP_001054248 | Os04g0675500 [*Oryza sativa Japonica* Group] > gi|38344929|emb|CAE03245.2| OSJNBa0018M05.20 [*Oryza sativa Japonica* Group] > gi|90399055|emb|CAJ86104.1| H0103C06.8 [*Oryza sativa Indica* Group] > gi|113565819|dbj|BAF16162.1| Os04g0675500 [*Oryza sativa Japonica* Group] > gi|125550210|gb|EAY96032.1| hypothetical protein OsI_17905 [*Oryza sativa Indica* Group] > gi|125592048|gb|EAZ32398.1| hypothetical protein OsJ_16609 [*Oryza sativa Japonica* Group] > gi|215708677|dbj|BAG93946.1| unnamed protein product [*Oryza sativa Japonica* Group] | 0.96 | 1143 | 1792 |
| | | BAJ87792 | predicted protein [*Hordeum vulgare* subsp. *vulgare*] | 0.94 | 1144 | 1793 |
| | | XP_002269119 | PREDICTED: hypothetical protein [*Vitis vinifera*] | 0.86 | 1145 | 1794 |
| | | CBG76274 | OO_Ba0005L10-OO_Ba0081K17.25 [*Oryza officinalis*] | 0.93 | 1146 | 1795 |
| | | XP_002318345 | predicted protein [*Populus trichocarpa*] > gi|222859018|gb|EEE96565.1| predicted protein [*Populus trichocarpa*] | 0.86 | 1147 | 1796 |
| | | XP_002891078 | hypothetical protein ARALYDRAFT_891007 [*Arabidopsis lyrata* subsp. *lyrata*] > gi|297336920|gb|EFH67337.1| hypothetical protein ARALYDRAFT_891007 [*Arabidopsis lyrata* subsp. *lyrata*] | 0.86 | 1148 | 1797 |
| | | XP_002329687 | predicted protein [*Populus trichocarpa*] | 0.85 | 1149 | 1798 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | > gi|222870595|gb|EEF07726.1| predicted protein [*Populus trichocarpa*] | | | |
| | 1539-1559 | XP_002462694 | hypothetical protein SORBIDRAFT_02g030360 [*Sorghum bicolor*] > gi|241926071|gb|EER99215.1| hypothetical protein SORBIDRAFT_02g030360 [*Sorghum bicolor*] | 1.00 | 1150 | 1799 |
| | | NP_001168360 | hypothetical protein LOC100382128 [*Zea mays*] > gi|223947749|gb|ACN27958.1| unknown [*Zea mays*] | 0.92 | 1151 | 1800 |
| | | NP_001063714 | Os09g0524300 [*Oryza sativa Japonica* Group] > gi|52076031|dbj|BAD46484.1| ethionine resistance protein-like [*Oryza sativa Japonica* Group] > gi|255679074|dbj|BAF25628.2| Os09g0524300 [*Oryza sativa Japonica* Group] | 0.80 | 1152 | 1801 |
| | | ABG73448 | MATE efflux family protein [*Oryza brachyantha*] | 0.80 | 1153 | 1802 |
| | | EAZ09807 | hypothetical protein OsI_32095 [*Oryza sativa Indica* Group] | 0.80 | 1154 | |
| | | XP_002444635 | hypothetical protein SORBIDRAFT_07g025190 [*Sorghum bicolor*] > gi|241940985|gb|EES14130.1| hypothetical protein SORBIDRAFT_07g025190 [*Sorghum bicolor*] | 0.73 | 1155 | 1803 |
| | | BAD09230 | putative ripening regulated protein DDTFR18 [*Oryza sativa Japonica* Group] | 0.70 | 1156 | 1804 |
| | 1198-1218 | NP_001146658 | hypothetical protein LOC100280258 [*Zea mays*] > gi|219888209|gb|ACL54479.1| unknown [*Zea mays*] | 1.00 | 1157 | 1805 |
| | | NP_001105875 | putative laccase [*Zea mays*] > gi|84618781|emb|CAJ30500.1| putative laccase [*Zea mays*] | 0.95 | 1158 | 1806 |
| | | ACN28855 | unknown [*Zea mays*] | 0.92 | 1159 | 1807 |
| | | XP_002458746 | hypothetical protein SORBIDRAFT_03g039520 [*Sorghum bicolor*] > gi|241930721|gb|EES03866.1| hypothetical protein SORBIDRAFT_03g039520 [*Sorghum bicolor*] | 0.91 | 1160 | 1808 |
| | | NP_001044772 | Os01g0842400 [*Oryza sativa Japonica* Group] > gi|75321217|sp|Q5N9X2.1| LAC4_ORYSJ RecName: Full = Laccase-4; AltName: Full = Benzenediol:oxygen oxidoreductase 4; AltName: Full = Diphenol oxidase 4; AltName: Full = Urishiol oxidase 4; Flags: Precursor > gi|56784239|dbj|BAD81734.1| putative laccase LAC5-6 [*Oryza sativa Japonica* Group] > gi|113534303|dbj|BAF06686.1| Os01g0842400 [*Oryza sativa Japonica* Group] > gi|215697155|dbj|BAG91149.1| unnamed protein | 0.80 | 1161 | 1809 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | EAZ14115 | product [*Oryza sativa Japonica* Group] hypothetical protein OsJ_04039 [*Oryza sativa Japonica* Group] | 0.80 | 1162 | |
| | | EEC71777 | hypothetical protein OsI_04389 [*Oryza sativa Indica* Group] | 0.80 | 1163 | |
| | | BAJ99773 | predicted protein [*Hordeum vulgare* subsp. *vulgare*] | 0.78 | 1164 | 1810 |
| | | AAC04576 | putative high-pI laccase [*Oryza sativa Japonica* Group] | 0.78 | 1165 | 1811 |
| | | XP_002458747 | hypothetical protein SORBIDRAFT_03g039530 [*Sorghum bicolor*] > gi|241930722|gb|EES03867.1| hypothetical protein SORBIDRAFT_03g039530 [*Sorghum bicolor*] | 0.77 | 1166 | 1812 |
| | 934-954 | ACN27868 | unknown [*Zea mays*] | 1.00 | 1167 | 1813 |
| | | NP_001148479 | L-ascorbate oxidase [*Zea mays*] > gi|195619672|gb|ACG31666.1| L-ascorbate oxidase precursor [*Zea mays*] | 0.94 | 1168 | 1814 |
| | | XP_002456566 | hypothetical protein SORBIDRAFT_03g038550 [*Sorghum bicolor*] > gi|241928541|gb|EES01686.1| hypothetical protein SORBIDRAFT_03g038550 [*Sorghum bicolor*] | 0.90 | 1169 | 1815 |
| | | NP_001183899 | hypothetical protein LOC100502492 [*Zea mays*] > gi|223948465|gb|ACN28316.1| unknown [*Zea mays*] > gi|238015342|gb|ACR38706.1| unknown [*Zea mays*] | 0.88 | 1170 | 1816 |
| | | NP_001044679 | Os01g0827300 [*Oryza sativa Japonica* Group] > gi|75331868|sp|Q941X2.1| LAC3_ORYSJ RecName: Full = Laccase-3; AltName: Full = Benzenediol:oxygen oxidoreductase 3; AltName: Full = Diphenol oxidase 3; AltName: Full = Urishiol oxidase 3; Flags: Precursor > gi|15624045|dbj|BAB68098.1| putative laccase [*Oryza sativa Japonica* Group] > gi|113534210|dbj|BAF06593.1| Os01g0827300 [*Oryza sativa Japonica* Group] > gi|215701334|dbj|BAG92758.1| unnamed protein product [*Oryza sativa Japonica* Group] > gi|222619479|gb|EEE55611.1| hypothetical protein OsJ_03932 [*Oryza sativa Japonica* Group] | 0.81 | 1171 | 1817 |
| Predicted folded 24-nts-long seq 52739 | 1620-1643 | NP_001137083 | hypothetical protein LOC100217256 [*Zea mays*] > gi|194698278|gb|ACF83223.1| unknown [*Zea mays*] | 1.00 | 1172 | 1818 |
| | | XP_002446946 | hypothetical protein SORBIDRAFT_06g025600 [*Sorghum bicolor*] > gi|241938129|gb|EES11274.1| hypothetical protein | 0.75 | 1173 | 1819 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| Predicted zma mir 49816 | 334-354 | XP_002459032 | SORBIDRAFT_06g025600 [*Sorghum bicolor*] hypothetical protein SORBIDRAFT_03g044830 [*Sorghum bicolor*] > gi\|241931007\|gb\|EES04152.1\| hypothetical protein SORBIDRAFT_03g044830 [*Sorghum bicolor*] | 1.00 | 1174 | 1820 |
| | | NP_001131974 | hypothetical protein LOC100193372 [*Zea mays*] > gi\|194693076\|gb\|ACF80622.1\| unknown [*Zea mays*] | 0.90 | 1175 | 1821 |
| | | BAJ85237 | predicted protein [*Hordeum vulgare* subsp. *vulgare*] > gi\|326511587\|dbj\|BAJ91938.1\| predicted protein [*Hordeum vulgare* subsp. *vulgare*] | 0.84 | 1176 | 1822 |
| | | NP_001045294 | Os01g0931100 [*Oryza sativa Japonica* Group] > gi\|57899654\|dbj\|BAD87323.1\| unknown protein [*Oryza sativa Japonica* Group] > gi\|57900117\|dbj\|BAD88179.1\| unknown protein [*Oryza sativa Japonica* Group] > gi\|113534825\|dbj\|BAF07208.1\| Os01g0931100 [*Oryza sativa Japonica* Group] > gi\|215697092\|dbj\|BAG91086.1\| unnamed protein product [*Oryza sativa Japonica* Group] | 0.85 | 1177 | 1823 |
| | 116-136 | CAE04743 | OSJNBb0060E08.6 [*Oryza sativa Japonica* Group] > gi\|116309791\|emb\|CAH66831.1\| OSIGBa0148A10.8 [*Oryza sativa Indica* Group] | 1.00 | 1178 | 1824 |
| | | NP_001053941 | 0s04g0625800 [*Oryza sativa Japonica* Group] > gi\|113565512\|dbj\|BAF15855.1\| Os04g0625800 [*Oryza sativa Japonica* Group] > gi\|215767966\|dbj\|BAH00195.1\| unnamed protein product [*Oryza sativa Japonica* Group] | 1.00 | 1179 | 1825 |
| | | EAY95645 | hypothetical protein OsI_17510 [*Oryza sativa Indica* Group] | 1.00 | 1180 | |
| | | NP_001131852 | hypothetical protein LOC100193230 [*Zea mays*] > gi\|194692726\|gb\|ACF80447.1\| unknown [*Zea mays*] | 0.79 | 1181 | 1826 |
| | | BAK03410 | predicted protein [*Hordeum vulgare* subsp. *vulgare*] > gi\|326525779\|dbj\|BAJ88936.1\| predicted protein [*Hordeum vulgare* subsp. *vulgare*] | 0.81 | 1182 | 1827 |
| | | XP_002447134 | hypothetical protein SORBIDRAFT_06g029180 [*Sorghum bicolor*] > gi\|241938317\|gb\|EES11462.1\| hypothetical protein SORBIDRAFT_06g029180 [*Sorghum bicolor*] | 0.78 | 1183 | 1828 |
| | | NP_001168401 | hypothetical protein LOC100382170 [*Zea mays*] > gi\|223948043\|gb\|ACN28105.1\| unknown [*Zea mays*] | 0.77 | 1184 | 1829 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | ACF85557 | unknown [Zea mays] | 0.74 | 1185 | 1830 |
| | | NP_001141359 | hypothetical protein LOC100273450 [Zea mays] > gi|194704160|gb|ACF86164.1| unknown [Zea mays] | 0.74 | 1186 | 1831 |
| | 81-101 | XP_002463519 | hypothetical protein SORBIDRAFT_01g001270 [Sorghum bicolor] > gi|241917373|gb|EER90517.1| hypothetical protein SORBIDRAFT_01g001270 [Sorghum bicolor] | 1.00 | 1187 | 1832 |
| | | BAK01513 | predicted protein [Hordeum vulgare subsp. vulgare] | 0.86 | 1188 | 1833 |
| | | NP_001051898 | Os03g0849600 [Oryza sativa Japonica Group] > gi|28269403|gb|AAO37946.1| putative conserved oligomeric Golgi complex component [Oryza sativa Japonica Group] > gi|108712114|gb|ABF99909.1| brefeldin A-sensitive Golgi protein, putative, expressed [Oryza sativa Japonica Group] > gi|113550369|dbj|BAF13812.1| Os03g0849600 [Oryza sativa Japonica Group] > gi|125588645|gb|EAZ29309.1| hypothetical protein OsJ_13370 [Oryza sativa Japonica Group] | 0.85 | 1189 | 1834 |
| | | EEC76534 | hypothetical protein OsI_14326 [Oryza sativa Indica Group] | 0.85 | 1190 | |
| | 322-342 | NP_001168448 | hypothetical protein LOC100382221 [Zea mays] > gi|223948365|gb|ACN28266.1| unknown [Zea mays] | 1.00 | 1191 | 1835 |
| | 98-118 | BAD05744 | putative RNA Binding Protein 45 [Oryza sativa Japonica Group] > gi|40253847|dbj|BAD05783.1| putative RNA Binding Protein 45 [Oryza sativa Japonica Group] | 1.00 | 1192 | 1836 |
| | | EEE68172 | hypothetical protein OSJ_26296 [Oryza sativa Japonica Group] | 0.75 | 1193 | |
| | | ACF85557 | unknown [Zea mays] | 0.78 | 1194 | 1837 |
| | | NP_001141359 | hypothetical protein LOC100273450 [Zea mays] > gi|194704160|gb|ACF86164.1| unknown [Zea mays] | 0.78 | 1195 | 1838 |
| aqc-miR529 | 955-975 | AAX83875 | teosinte glume architecture 1 [Zea mays subsp. mays] | 1.00 | 1196 | 1839 |
| | | AAX83872 | teosinte glume architecture 1 [Zea mays subsp. mays] | 0.99 | 1197 | 1840 |
| | | AAX83873 | teosinte glume architecture 1 [Zea mays subsp. mays] > gi|62467440|gb|AAX83874.1| teosinte glume architecture 1 [Zea mays subsp. mays] | 0.99 | 1198 | 1841 |
| | | XP_002445815 | hypothetical protein SORBIDRAFT_07g026220 [Sorghum bicolor] > gi|241942165|gb|EES15310.1| hypothetical protein SORBIDRAFT_07g026220 [Sorghum bicolor] | 0.80 | 1199 | 1842 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | 831-851 | ADX60108 | SBP transcription factor [*Zea mays*] | 1.00 | 1200 | 1843 |
| | | XP_002446904 | hypothetical protein SORBIDRAFT_06g024630 [*Sorghum bicolor*] > gi|241938087|gb|EES11232.1| hypothetical protein SORBIDRAFT_06g024630 [*Sorghum bicolor*] | 0.72 | 1201 | 1844 |
| | 882-902 | ACN30570 | unknown [*Zea mays*] > gi|223973927|gb|ACN31151.1| unknown [*Zea mays*] > gi|323388595|gb|ADX60102.1| SBP transcription factor [*Zea mays*] | 1.00 | 1202 | 1845 |
| | | NP_001145445 | hypothetical protein LOC100278824 [*Zea mays*] > gi|195656399|gb|ACG47667.1| hypothetical protein [*Zea mays*] | 0.98 | 1203 | 1846 |
| | | XP_002450775 | hypothetical protein SORBIDRAFT_05g017510 [*Sorghum bicolor*] > gi|241936618|gb|EES09763.1| hypothetical protein SORBIDRAFT_05g017510 [*Sorghum bicolor*] | 0.87 | 1204 | 1847 |
| | 656-676 | NP_001137049 | hypothetical protein LOC100217221 [*Zea mays*] > gi|194698154|gb|ACF83161.1| unknown [*Zea mays*] | 1.00 | 1205 | 1848 |
| | 1248-1268 | XP_002447211 | hypothetical protein SORBIDRAFT_06g030520 [*Sorghum bicolor*] > gi|241938394|gb|EES11539.1| hypothetical protein SORBIDRAFT_06g030520 [*Sorghum bicolor*] | 1.00 | 1206 | 1849 |
| | | NP_001132831 | hypothetical protein LOC100194321 [*Zea mays*] > gi|194695516|gb|ACF81842.1| unknown [*Zea mays*] | 0.90 | 1207 | 1850 |
| | | NP_001054060 | Os04g0644700 [*Oryza sativa Japonica* Group] > gi|148886836|sp|P0C541.1| COPE2_ORYSJ RecName: Full = Coatomer subunit epsilon-2; AltName: Full = Epsilon-coat protein 2; Short = Epsilon-COP 2 > gi|38344895|emb|CAD41918.2| OSJNBa0033G05.19 [*Oryza sativa Japonica* Group] > gi|113565631|dbj|BAF15974.1| Os04g0644700 [*Oryza sativa Japonica* Group] > gi|125591839|gb|EAZ32189.1| hypothetical protein OsJ_16395 [*Oryza sativa Japonica* Group] | 0.80 | 1208 | 1851 |
| | | A2XY73 | RecName: Full = Coatomer subunit epsilon-2; AltName: Full = Epsilon-coat protein 2; Short = Epsilon-COP 2 > gi|90399097|emb|CAJ86157.1| H0413E07.10 [*Oryza sativa Indica* Group] | 0.80 | 1209 | |
| | | EAY95783 | hypothetical protein OsI_17658 [*Oryza sativa Indica* Group] | 0.80 | 1210 | |
| | 82-102 | ACR34442 | unknown [*Zea mays*] | 1.00 | 1211 | 1852 |
| | 82-102 | NP_00145733 | hypothetical protein LOC100279240 [*Zea mays*] | 1.00 | 1212 | 1853 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | XP_002460490 | > gi|219884215|gb|ACL52482.1| unknown [Zea mays] hypothetical protein SORBIDRAFT_02g029300 [Sorghum bicolor] > gi|241923867|gb|EER97011.1| hypothetical protein SORBIDRAFT_02g029300 [Sorghum bicolor] | 0.87 | 1213 | 1854 |
| | | NP_001063612 | Os09g0507100 [Oryza sativa Japonica Group] > gi|122234416|sp|Q0JOK1.1| SPL18_ORYSJ RecName: Full = Squamosa promoter-binding-like protein 18 > gi|113631845|dbj|BAF25526.1| Os09g0507100 [Oryza sativa Japonica Group] | 0.71 | 1214 | 1855 |
| | 996-1016 | ACF86782 | unknown [Zea mays] > gi|323388573|gb|ADX60091.1| SBP transcription factor [Zea mays] | 1.00 | 1215 | 1856 |
| | | ACG45113 | squamosa promoter-binding-like protein 9 [Zea mays] | 1.00 | 1216 | 1857 |
| | | XP_002462571 | hypothetical protein SORBIDRAFT_02g028420 [Sorghum bicolor] > gi|241925948|gb|EER99092.1| hypothetical protein SORBIDRAFT_02g028420 [Sorghum bicolor] | 0.83 | 1217 | 1858 |
| | | NP_001136945 | hypothetical protein LOC100217104 [Zea mays] > gi|194697718|gb|ACF82943.1| unknown [Zea mays] | 0.76 | 1218 | 1859 |
| | 1120-1140 | ACL52941 | unknown [Zea mays] | 1.00 | 1219 | 1860 |
| | | XP_002444771 | hypothetical protein SORBIDRAFT_07g027740 [Sorghum bicolor] > gi|241941121|gb|EES14266.1| hypothetical protein SORBIDRAFT_07g027740 [Sorghum bicolor] | 0.76 | 1220 | 1861 |
| | 1348-1368 | XP_002438971 | hypothetical protein SORBIDRAFT_10g029190 [Sorghum bicolor] > gi|241917194|gb|EER90338.1| hypothetical protein SORBIDRAFT_10g029190 [Sorghum bicolor] | 1.00 | 1221 | 1862 |
| | | NP_001149534 | squamosa promoter-binding-like protein 11 [Zea mays] > gi|195627850|gb|ACG35755.1| squamosa promoter-binding-like protein 11 [Zea mays] > gi|195644948|gb|ACG41942.1| squamosa promoter-binding-like protein 11 [Zea mays] | 0.88 | 1222 | 1863 |
| | 221-241 | XP_002447219 | hypothetical protein SORBIDRAFT_06g030650 [Sorghum bicolor] > gi|241938402|gb|EES11547.1| hypothetical protein SORBIDRAFT_06g030650 [Sorghum bicolor] | 1.00 | 1223 | 1864 |
| | | NP_001169344 | hypothetical protein LOC100383211 [Zea mays] > gi|224028835|gb|ACN33493.1| unknown [Zea mays] | 0.92 | 1224 | 1865 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | NP_001147890 | LOC100281500 [*Zea mays*] > gi\|195614420\|gb\|ACG29040.1\| zinc finger, C3HC4 type family protein [*Zea mays*] | 0.90 | 1225 | 1866 |
| | | CAD41707 | OSJNBa0010D21.9 [*Oryza sativa Japonica* Group] > gi\|125549990\|gb\|EAY95812.1\| hypothetical protein OsI_17683 [*Oryza sativa Indica* Group] > gi\|125591860\|gb\|EAZ32210.1\| hypothetical protein OsJ_16417 [*Oryza sativa Japonica* Group] > gi\|215701084\|dbj\|BAG92508.1\| unnamed protein product [*Oryza sativa Japonica* Group] | 0.74 | 1226 | 1867 |
| | 973-993 | NP_001136945 | hypothetical protein LOC100217104 [*Zea mays*] > gi\|194697718\|gb\|ACF82943.1\| unknown [*Zea mays*] | 1.00 | 1227 | 1868 |
| | | XP_002462571 | hypothetical protein SORBIDRAFT_02g028420 [*Sorghum bicolor*] > gi\|241925948\|gb\|EER99092.1\| hypothetical protein SORBIDRAFT_02g028420 [*Sorghum bicolor*] | 0.82 | 1228 | 1869 |
| | | ACF86782 | unknown [*Zea mays*] > gi\|323388573\|gb\|ADX60091.1\| SBP transcription factor [*Zea mays*] | 0.76 | 1229 | 1870 |
| | | ACG45113 | squamosa promoter-binding-like protein 9 [*Zea mays*] | 0.76 | 1230 | 1871 |
| | 558-578 | CAB56631 | SBP-domain protein 5 [*Zea mays*] | 1.00 | 1231 | 1872 |
| | | XP_002444771 | hypothetical protein SORBIDRAFT_07g027740 [*Sorghum bicolor*] > gi\|241941121\|gb\|EES14266.1\| hypothetical protein SORBIDRAFT_07g027740 [*Sorghum bicolor*] | 0.85 | 1232 | 1873 |
| | | ACL52941 | unknown [*Zea mays*] | 0.78 | 1233 | 1874 |
| | 1410-1430 | NP_001152658 | MTA/SAH nucleosidase [*Zea mays*] > gi\|195658647\|gb\|ACG48791.1\| MTA/SAH nucleosidase [*Zea mays*] > gi\|223973627\|gb\|ACN31001.1\| unknown [*Zea mays*] | 1.00 | 1234 | 1875 |
| | | ACF83838 | unknown [*Zea mays*] | 0.88 | 1235 | 1876 |
| | | ACG39594 | MTA/SAH nucleosidase [*Zea mays*] | 0.88 | 1236 | 1877 |
| | | XP_002445813 | hypothetical protein SORBIDRAFT_07g026190 [*Sorghum bicolor*] > gi\|241942163\|gb\|EES15308.1\| hypothetical protein SORBIDRAFT_07g026190 [*Sorghum bicolor*] | 0.88 | 1237 | 1878 |
| | | ACN31483 | unknown [*Zea mays*] | 0.90 | 1238 | 1879 |
| | | NP_001056592 | Os06g0112200 [*Oryza sativa Japonica* Group] > gi\|7363290\|dbj\|BAA93034.1\| methylthioadenosine/S-adenosyl homocysteine nucleosidase [*Oryza sativa Japonica* Group] > gi\|32352128\|dbj\|BAC78557.1\| hypothetical protein [*Oryza sativa Japonica* Group] | 0.80 | 1239 | 1880 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | > gi|113594632|dbj|BAF18506.1| Os06g0112200 [*Oryza sativa Japonica* Group] > gi|125595804|gb|EAZ35584.1| hypothetical protein OsJ_19870 [*Oryza sativa Japonica* Group] > gi|215694661|dbj|BAG89852.1| unnamed protein product [*Oryza sativa Japonica* Group] > gi|215740802|dbj|BAG96958.1| unnamed protein product [*Oryza sativa Japonica* Group] | | | |
| | | AAL58883 | methylthioadenosine/S-adenosyl homocysteine nucleosidase [*Oryza sativa*] | 0.79 | 1240 | 1881 |
| | | ABR25495 | mta/sah nucleosidase [*Oryza sativa Indica* Group] | 0.79 | 1241 | 1882 |
| | | BAK03317 | predicted protein [*Hordeum vulgare* subsp. *vulgare*] > gi|326534118|dbj|BAJ89409.1| predicted protein [*Hordeum vulgare* subsp. *vulgare*] | 0.78 | 1242 | 1883 |
| | | EAY99382 | hypothetical protein OsI_21350 [*Oryza sativa Indica* Group] | 0.78 | 1243 | |
| | 1197-1217 | AAX83872 | teosinte glume architecture 1 [*Zea mays* subsp. *mays*] | 1.00 | 1244 | 1884 |
| | | AAX83875 | teosinte glume architecture 1 [*Zea mays* subsp. *mays*] | 0.98 | 1245 | 1885 |
| | | AAX83873 | teosinte glume architecture 1 [*Zea mays* subsp. *mays*] > gi|62467440|gb|AAX83874.1| teosinte glume architecture 1 [*Zea mays* subsp. *mays*] | 0.99 | 1246 | 1886 |
| | | XP_002445815 | hypothetical protein SORBIDRAFT_07g026220 [*Sorghum bicolor*] > gi|241942165|gb|EES15310.1| hypothetical protein SORBIDRAFT_07g026220 [*Sorghum bicolor*] | 0.80 | 1247 | 1887 |
| | | BAK05794 | predicted protein [*Hordeum vulgare* subsp. *vulgare*] | 0.63 | 1248 | 1888 |
| Predicted folded 24-nts-long seq 52792 | 748-771 | NP_001143705 | hypothetical protein LOC100276442 [*Zea mays*] > gi|195625088|gb|ACG34374.1| hypothetical protein [*Zea mays*] | 1.00 | 1281 | 1911 |
| | | ACF83056 | unknown [*Zea mays*] | 0.95 | 1282 | 1912 |
| | 1078-1101 | ACF83056 | unknown [*Zea mays*] | 1.00 | 1283 | 1913 |
| | | NP_001143705 | hypothetical protein LOC100276442 [*Zea mays*] > gi|195625088|gb|ACG34374.1| hypothetical protein [*Zea mays*] | 0.88 | 1284 | 1914 |
| Predicted folded 24-nts-long seq 51757 | 278-301 | XP_002458944 | hypothetical protein SORBIDRAFT_03g043140 [*Sorghum bicolor*] > gi|241930919|gb|EES04064.1| hypothetical protein SORBIDRAFT_03g043140 [*Sorghum bicolor*] | 1.00 | 1285 | 1915 |
| | | ACF79162 | unknown [*Zea mays*] > gi|194703646|gb|ACF85907.1| unknown [*Zea mays*] | 0.98 | 1286 | 1916 |
| | | NP_001105336 | fructose-bisphosphate aldolase, cytoplasmic isozyme [*Zea mays*] | 0.98 | 1287 | 1917 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | > gi|113621|sp|P08440.1|ALF_MAIZE RecName: Full = Fructose-bisphosphate aldolase, cytoplasmic isozyme > gi|168420|gb|AAA33435.1| aldolase [*Zea mays*] > gi|295850|emb|CAA31366.1| fructose bisphosphate aldolase [*Zea mays*] > gi|225624|prf||1307278A cytoplasmic aldolase | | | |
| | | NP_001150049 | fructose-bisphosphate aldolase cytoplasmic isozyme [*Zea mays*] > gi|194704898|gb|ACF86533.1| unknown [*Zea mays*] > gi|195636310|gb|ACG37623.1| fructose-bisphosphate aldolase cytoplasmic isozyme [*Zea mays*] | 0.98 | 1288 | 1918 |
| | | XP_002453822 | hypothetical protein SORBIDRAFT_04g019020 [*Sorghum bicolor*] > gi|241933653|gb|EES06798.1| hypothetical protein SORBIDRAFT_04g019020 [*Sorghum bicolor*] | 0.95 | 1289 | 1919 |
| | | P17784 | RecName: Full = Fructose-bisphosphate aldolase cytoplasmic isozyme; AltName: Full = Gravity-specific protein GSC 233 > gi|41398198|gb|AAS05825.1| fructose 1,6-bisphosphate aldolase [*Oryza sativa Japonica* Group] > gi|50878379|gb|AAT85154.1| putative fructose-bisphosphate aldolase [*Oryza sativa Japonica* Group] > gi|50878433|gb|AAT85207.1| putative fructose-bisphosphate aldolase [*Oryza sativa Japonica* Group] > gi|169244417|gb|ACA50482.1| fructose-bisphosphate aldolase [*Oryza sativa Japonica* Group] > gi|306415953|gb|ADM86851.1| fructose-bisphosphate aldolase [*Oryza sativa Japonica* Group] | 0.94 | 1290 | |
| | | BAI59774 | aldolase C-1 [*Phyllostachys edulis*] | 0.94 | 1291 | 1920 |
| | | EAY94426 | hypothetical protein OsI_16195 [*Oryza sativa Indica* Group] | 0.93 | 1292 | |
| | | CAA37290 | unnamed protein product [*Oryza sativa Japonica* Group] | 0.93 | 1293 | 1921 |
| | | ABG65931 | Fructose-bisphosphate aldolase, cytoplasmic isozyme, putative, expressed [*Oryza sativa Japonica* Group] > gi|125574121|gb|EAZ15405.1| hypothetical protein OsJ_30817 [*Oryza sativa Japonica* Group] > gi|215701125|dbj|BAG92549.1| unnamed protein product [*Oryza sativa Japonica* Group] > gi|215708712|dbj|BAG93981.1| unnamed protein | 0.92 | 1294 | 1922 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | product [*Oryza sativa Japonica* Group] | | | |
| | 686-709 | NP_001145778 | hypothetical protein LOC100279285 [*Zea mays*] > gi|219884395|gb|ACL52572.1| unknown [*Zea mays*] | 1.00 | 1295 | 1923 |
| | | ACF87373 | unknown [*Zea mays*] | 1.00 | 1296 | 1924 |
| | | ACG25535 | ribosomal RNA apurinic site specific lyase [*Zea mays*] | 0.99 | 1297 | 1925 |
| | | XP_002455890 | hypothetical protein SORBIDRAFT_03g026880 [*Sorghum bicolor*] > gi|241927865|gb|EES01010.1| hypothetical protein SORBIDRAFT_03g026880 [*Sorghum bicolor*] | 0.79 | 1298 | 1926 |
| | 365-388 | ACR36335 | unknown [*Zea mays*] | 1.00 | 1299 | 1927 |
| | | ACR35742 | unknown [*Zea mays*] | 0.75 | 1300 | 1928 |
| | 512-535 | XP_002458102 | hypothetical protein SORBIDRAFT_03g026990 [*Sorghum bicolor*] > gi|241930077|gb|EES03222.1| hypothetical protein SORBIDRAFT_03g026990 [*Sorghum bicolor*] | 1.00 | 1301 | 1929 |
| | | NP_001151540 | hydrogen-transporting ATP synthase, rotational mechanism [*Zea mays*] > gi|195605790|gb|ACG24725.1| hydrogen-transporting ATP synthase, rotational mechanism [*Zea mays*] > gi|195608344|gb|ACG26002.1| hydrogen-transporting ATP synthase, rotational mechanism [*Zea mays*] > gi|195647528|gb|ACG43232.1| hydrogen-transporting ATP synthase, rotational mechanism [*Zea mays*] > gi|195658703|gb|ACG48819.1| hydrogen-transporting ATP synthase, rotational mechanism [*Zea mays*] | 0.93 | 1302 | 1930 |
| | | ACF82609 | unknown [*Zea mays*] | 0.93 | 1303 | 1931 |
| | | NP_001149611 | LOC100283237 [*Zea mays*] > gi|194696248|gb|ACF82208.1| unknown [*Zea mays*] > gi|195605550|gb|ACG24605.1| hydrogen-transporting ATP synthase, rotational mechanism [*Zea mays*] > gi|195619622|gb|ACG31641.1| hydrogen-transporting ATP synthase, rotational mechanism [*Zea mays*] > gi|195628500|gb|ACG36080.1| hydrogen-transporting ATP synthase, rotational mechanism [*Zea mays*] > gi|195637444|gb|ACG38190.1| hydrogen-transporting ATP synthase, rotational mechanism [*Zea mays*] > gi|195644406|gb|ACG41671.1| hydrogen-transporting ATP synthase, rotational mechanism [*Zea mays*] | 0.93 | 1304 | 1932 |
| | | BAJ87122 | predicted protein [*Hordeum vulgare* subsp. *vulgare*] | 0.89 | 1305 | 1933 |
| | | NP_001043488 | Os01g0600000 [*Oryza sativa Japonica* Group] > gi|113533019|dbj|BAF05402.1| | 0.88 | 1306 | 1934 |

TABLE 6-continued

Target Genes of down regulated miRNAs Associated with Increased NUE
(Table 2)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | Os01g0600000 [*Oryza sativa Japonica* Group] > gi\|125571065\|gb\|EAZ12580.1\| hypothetical protein OsJ_02485 [*Oryza sativa Japonica* Group] > gi\|215768142\|dbj\|BAH00371.1\| unnamed protein product [*Oryza sativa Japonica* Group] > gi\|218188591\|gb\|EEC71018.1\| hypothetical protein OsI_02711 [*Oryza sativa Indica* Group] | | | |
| | | ABF70110 | mitochondrial ATP synthase g subunit family protein [*Musabalbisiana*] | 0.78 | 1307 | 1935 |
| | | ABA40451 | unknown [*Solanum tuberosum*] | 0.72 | 1308 | 1936 |
| | | NP_001056144 | Os05g0533800 [*Oryza sativa Japonica* Group] > gi\|48843828\|gb\|AAT47087.1\| unknown protein [*Oryza sativa Japonica* Group] > gi\|113579695\|dbj\|BAF18058.1\| Os05g0533800 [*Oryza sativa Japonica* Group] > gi\|222632347\|gb\|EEE64479.1\| hypothetical protein OsJ_19329 [*Oryza sativa Japonica* Group] | 0.73 | 1309 | 1937 |
| | | BAJ90534 | predicted protein [*Hordeum vulgare* subsp. *vulgare*] | 0.74 | 1310 | 1938 |
| ath-miR2936 | 742-763 | ACN26323 | unknown [*Zea mays*] > gi\|223944533\|gb\|ACN26350.1\| unknown [*Zea mays*] | 1.00 | 1389 | 2005 |
| | | BAC01259 | glycosylphosphatidylinositol anchor attachment 1-like [*Oryza sativa Japonica* Group] > gi\|125571593\|gb\|EAZ13108.1\| hypothetical protein OsJ_03027 [*Oryza sativa Japonica* Group] | 0.78 | 1390 | 2006 |
| | | EAY75389 | hypothetical protein OsI_03287 [*Oryza sativa Indica* Group] | 0.78 | 1391 | |

Table 6: Provided are the target Genes of miRNAs Associated with Increased NUE (Table 2) along with their GenBank Accession numbers and sequence identifiers (SEQ ID NO:).
"bind" = binding;
"pos" = position;
"hom" = homologue;
"p.p." = polypeptide;
"p.n." = polynucleotide.

TABLE 7

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| Predicted siRNA 59952 | 1180-1201 | XP_002439783 | hypothetical protein SORBIDRAFT_09g019980 [*Sorghum bicolor*] > gi\|241945068\|gb\|EES18213.1\| hypothetical protein SORBIDRAFT_09g019980 [*Sorghum bicolor*] | 1.00 | 2007 | 2437 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | NP_001140772 | hypothetical protein LOC100272847 [*Zea mays*] > gi\|194701020\|gb\|ACF84594.1\| unknown [*Zea mays*] | 0.87 | 2008 | 2438 |
| | | ACG40649 | hypothetical protein [*Zea mays*] | 0.87 | 2009 | 2439 |
| | | NP_001140587 | hypothetical protein LOC100272657 [*Zea mays*] > gi\|194700088\|gb\|ACF84128.1\| unknown [*Zea mays*] | 0.85 | 2010 | 2440 |
| | | ACG28586 | hypothetical protein [*Zea mays*] | 0.83 | 2011 | 2441 |
| | | EEC79208 | hypothetical protein OsI_19925 [*Oryza sativa Indica* Group] | 0.73 | 2012 | |
| | 2775-2796 | NP_001146628 | hypothetical protein LOC100280226 [*Zea mays*] > gi\|219888087\|gb\|ACL54418.1\| unknown [*Zea mays*] | 1.00 | 2013 | 2442 |
| | | EEE65008 | hypothetical protein OsJ_19956 [*Oryza sativa Japonica* Group] | 0.71 | 2014 | |
| | | BAA90807 | putative SEU1 protein [*Oryza sativa Japonica* Group] > gi\|215704489\|dbj\|BAG93923.1\| unnamed protein product [*Oryza sativa Japonica* Group] | 0.71 | 2015 | 2443 |
| Predicted siRNA 59626 | 220-238 | ACR33998 | unknown [*Zea mays*] | 1.00 | 2016 | 2444 |
| | | NP_001141472 | hypothetical protein LOC100273582 [*Zea mays*] > gi\|194704716\|gb\|ACF86442.1\| unknown [*Zea mays*] | 1.00 | 2017 | 2445 |
| | 1435-1453 | XP_002446603 | hypothetical protein SORBIDRAFT_06g018770 [*Sorghum bicolor*] > gi\|241937786\|gb\|EES10931.1\| hypothetical protein SORBIDRAFT_06g018770 [*Sorghum bicolor*] | 1.00 | 2018 | 2446 |
| | | NP_001159223 | hypothetical protein LOC100304309 [*Zea mays*] > gi\|223942807\|gb\|ACN25487.1\| unknown [*Zea mays*] | 0.92 | 2019 | 2447 |
| | | BAJ94860 | predicted protein [*Hordeum vulgare* subsp. *vulgare*] | 0.79 | 2020 | 2448 |
| | | CAE03375 | OSJNBa0036B21.17 [*Oryza sativa Japonica* Group] | 0.80 | 2021 | |
| | | EEE61116 | hypothetical protein OsJ_15040 [*Oryza sativa Japonica* Group] | 0.80 | 2022 | |
| | | CBW45773 | ORW1943Ba0077G13.1 [*Oryza rufipogon*] | 0.80 | 2023 | |
| | | NP_001052976 | Os04g0458200 [*Oryza sativa Japonica* Group] > gi\|215715295\|dbj\|BAG95046.1\| unnamed protein product [*Oryza sativa Japonica* Group] > gi\|218194967\|gb\|EEC77394.1\| hypothetical protein OsI_16151 [*Oryza sativa Indica* Group] > gi\|255675525\|dbj\|BAF14890.2\| Os04g0458200 [*Oryza sativa Japonica* Group] | 0.80 | 2024 | 2449 |
| | | CAH67071 | OSIGBa0097P08.1 [*Oryza sativa Indica* Group] | 0.79 | 2025 | 2450 |
| | 1613-1631 | NP_001141472 | hypothetical protein LOC100273582 [*Zea mays*] > gi\|194704716\|gb\|ACF86442.1\| unknown [*Zea mays*] | 1.00 | 2026 | 2451 |
| | | ACR33998 | unknown [*Zea mays*] | 0.85 | 2027 | 2452 |
| Predicted siRNA 60850 | 408-428 | NP_001131645 | hypothetical protein LOC100193004 [*Zea mays*] > gi\|194692138\|gb\|ACF80153.1\| unknown [*Zea mays*] | 1.00 | 2028 | 2453 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | 481-501 | ACG31592 | hypothetical protein [*Zea mays*] | 1.00 | 2029 | 2454 |
| | | NP_001132267 | hypothetical protein LOC100193703 [*Zea mays*] > gi\|194693920\|gb\|ACF81044.1\| unknown [*Zea mays*] | 1.00 | 2030 | 2455 |
| Predicted siRNA 59961 | 1611-1630 | XP_002463038 | hypothetical protein SORBIDRAFT_02g036610 [*Sorghum bicolor*] > gi\|241926415\|gb\|EER99559.1\| hypothetical protein SORBIDRAFT_02g036610 [*Sorghum bicolor*] | 1.00 | 2031 | 2456 |
| | | NP_001130320 | hypothetical protein LOC100191414 [*Zea mays*] > gi\|194688838\|gb\|ACF78503.1\| unknown [*Zea mays*] | 0.96 | 2032 | 2457 |
| | | BAJ88611 | predicted protein [*Hordeum vulgare* subsp. *vulgare*] | 0.87 | 2033 | 2458 |
| | | NP_001060016 | Os07g0566200 [*Oryza sativa* Japonica Group] > gi\|75152457\|sp\|Q8H4S6.2\|P2C64_ORYSJ RecName: Full = Probable protein phosphatase 2C 64; Short = OsPP2C64 > gi\|33146759\|dbj\|BAC79670.1\| putative protein phosphatase 2C [*Oryza sativa* Japonica Group] > gi\|113611552\|dbj\|BAF21930.1\| Os07g0566200 [*Oryza sativa* Japonica Group] > gi\|125600752\|gb\|EAZ40328.1\| hypothetical protein OsJ_24776 [*Oryza sativa* Japonica Group] | 0.89 | 2034 | 2459 |
| | | NP_001150759 | LOC100284392 [*Zea mays*] > gi\|195641568\|gb\|ACG40252.1\| catalytic/protein phosphatase type 2C [*Zea mays*] | 0.92 | 2035 | 2460 |
| | | ACR38208 | unknown [*Zea mays*] | 0.92 | 2036 | 2461 |
| | | EAZ04367 | hypothetical protein OsI_26509 [*Oryza sativa* Indica Group] | 0.88 | 2037 | |
| | | ACN30598 | unknown [*Zea mays*] | 0.87 | 2038 | 2462 |
| | | ACF84784 | unknown [*Zea mays*] | 0.80 | 2039 | 2463 |
| | 802-821 | XP_002462759 | hypothetical protein SORBIDRAFT_02g031500 [*Sorghum bicolor*] > gi\|241926136\|gb\|EER99280.1\| hypothetical protein SORBIDRAFT_02g031500 [*Sorghum bicolor*] | 1.00 | 2040 | 2464 |
| | | NP_001151289 | RING-H2 finger protein ATL2B [*Zea mays*] > gi\|195645562\|gb\|ACG42249.1\| RING-H2 finger protein ATL2B [*Zea mays*] > gi\|223946553\|gb\|ACN27360.1\| unknown [*Zea mays*] | 0.80 | 2041 | 2465 |
| | 540-559 | XP_002438439 | hypothetical protein SORBIDRAFT_10g019640 [*Sorghum bicolor*] > gi\|241916662\|gb\|EER89806.1\| hypothetical protein SORBIDRAFT_10g019640 [*Sorghum bicolor*] | 1.00 | 2042 | 2466 |
| | | ACN33733 | unknown [*Zea mays*] | 0.89 | 2043 | 2467 |
| | | NP_001150669 | amino acid permease [*Zea mays*] > gi\|195640964\|gb\|ACG39950.1\| amino acid permease [*Zea mays*] | 0.89 | 2044 | 2468 |
| | | XP_002453115 | hypothetical protein SORBIDRAFT_04g000290 [*Sorghum bicolor*] | 0.82 | 2045 | 2469 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | | > gi|241932946|gb|EES06091.1| hypothetical protein SORBIDRAFT_04g000290 [*Sorghum bicolor*] | | | |
| | | NP_001136459 | hypothetical protein LOC100216569 [*Zea mays*] > gi|194695786|gb|ACF81977.1| unknown [*Zea mays*] | 0.80 | 2046 | 2470 |
| | | NP_001045585 | Os02g0101000 [*Oryza sativa Japonica* Group] > gi|41053220|dbj|BAD08181.1| putative amino acid transport protein [*Oryza sativa Japonica* Group] > gi|113535116|dbj|BAF07499.1| Os02g0101000 [*Oryza sativa Japonica* Group] > gi|215704334|dbj|BAG93768.1| unnamed protein product [*Oryza sativa Japonica* Group] > gi|218189857|gb|EEC72284.1| hypothetical protein OsI_05452 [*Oryza sativa Indica* Group] > gi|222621988|gb|EEE56120.1| hypothetical protein OsJ_04987 [*Oryza sativa Japonica* Group] | 0.78 | 2047 | 2471 |
| | | BAJ96557 | predicted protein [*Hordeum vulgare* subsp. *vulgare*] > gi|326523625|dbj|BAJ92983.1| predicted protein [*Hordeum vulgare* subsp. *vulgare*] | 0.73 | 2048 | 2472 |
| | | XP_002446139 | hypothetical protein SORBIDRAFT_06g002240 [*Sorghum bicolor*] > gi|241937322|gb|EES10467.1| hypothetical protein SORBIDRAFT_06g002240 [*Sorghum bicolor*] | 0.72 | 2049 | 2473 |
| | | NP_001147785 | amino acid permease [*Zea mays*] > gi|195613758|gb|ACG28709.1| amino acid permease [*Zea mays*] | 0.71 | 2050 | 2474 |
| | 987-1006 | NP_001132785 | hypothetical protein LOC100194274 [*Zea mays*] > gi|194695392|gb|ACF81780.1| unknown [*Zea mays*] | 1.00 | 2051 | 2475 |
| | | NP_001150926 | bHLH transcription factor GBOF-1 [*Zea mays*] > gi|195642998|gb|ACG40967.1| bHLH transcription factor GBOF-1 [*Zea mays*] | 0.96 | 2052 | 2476 |
| | | XP_002462650 | hypothetical protein SORBIDRAFT_02g029530 [*Sorghum bicolor*] > gi|241926027|gb|EER99171.1| hypothetical protein SORBIDRAFT_02g029530 [*Sorghum bicolor*] | 0.79 | 2053 | 2477 |
| | | NP_001149110 | LOC100282732 [*Zea mays*] > gi|195624818|gb|ACG34239.1| bHLH transcription factor GBOF-1 [*Zea mays*] | 0.76 | 2054 | 2478 |
| | | ACR35934 | unknown [*Zea mays*] | 0.75 | 2055 | 2479 |
| | 235-254 | NP_001065691 | Os11g0136600 [*Oryza sativa Japonica* Group] > gi|33340240|gb|AAQ14593.1| AF319480_1 calcium-dependent calmodulin-independent protein kinase [*Oryza sativa*] > gi|33340242|gb|AAQ14594.1| AF319481_1 calcium-dependent calmodulin-independent protein | 1.00 | | 2480 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | | kinase [*Oryza sativa*] > gi\|77548548\|gb\|ABA91345.1\| Calcium-dependent protein kinase, isoform 2, putative, expressed [*Oryza sativa Japonica* Group] > gi\|113644395\|dbj\|BAF27536.1\| Os11g0136600 [*Oryza sativa Japonica* Group] | | | |
| Predicted siRNA 56542 | 452-472 | XP_002465086 | hypothetical protein SORBIDRAFT_01g031850 [*Sorghum bicolor*] > gi\|241918940\|gb\|EER92084.1\| hypothetical protein SORBIDRAFT_01g031850 [*Sorghum bicolor*] | 1.00 | 2056 | 2481 |
| | | NP_001145189 | hypothetical protein LOC100278439 [*Zea mays*] > gi\|195652469\|gb\|ACG45702.1\| hypothetical protein [*Zea mays*] | 0.92 | 2057 | 2482 |
| | | NP_001050454 | Os03g0439700 [*Oryza sativa Japonica* Group] > gi\|108709042\|gb\|ABF96837.1\| expressed protein [*Oryza sativa Japonica* Group] > gi\|113548925\|dbj\|BAF12368.1\| Os03g0439700 [*Oryza sativa Japonica* Group] > gi\|222625197\|gb\|EEE59329.1\| hypothetical protein OsJ_11404 [*Oryza sativa Japonica* Group] | 0.78 | 2058 | 2483 |
| | | AAR89010 | expressed protein [*Oryza sativa Japonica* Group] | 0.77 | 2059 | |
| | | BAJ96331 | predicted protein [*Hordeum vulgare* subsp. *vulgare*] | 0.77 | 2060 | 2484 |
| Predicted siRNA 56353 | 585-608 | NP_001183654 | hypothetical protein LOC100502248 [*Zea mays*] > gi\|238013682\|gb\|ACR37876.1\| unknown [*Zea mays*] | 1.00 | 2061 | 2485 |
| | | XP_002464467 | hypothetical protein SORBIDRAFT_01g018940 [*Sorghum bicolor*] > gi\|241918321\|gb\|EER91465.1\| hypothetical protein SORBIDRAFT_01g018940 [*Sorghum bicolor*] | 0.94 | 2062 | 2486 |
| | | AAL59033 | hypothetical protein [*Oryza sativa Japonica* Group] > gi\|31432747\|gb\|AAP54340.1\| expressed protein [*Oryza sativa Japonica* Group] | 0.78 | 2063 | |
| | | BAJ89715 | predicted protein [*Hordeum vulgare* subsp. *vulgare*] > gi\|326505214\|dbj\|BAK02994.1\| predicted protein [*Hordeum vulgare* subsp. *vulgare*] | 0.77 | 2064 | 2487 |
| | | BAK03788 | predicted protein [*Hordeum vulgare* subsp. *vulgare*] | 0.75 | 2065 | 2488 |
| | | NP_001064892 | Os10g0484900 [*Oryza sativa Japonica* Group] > gi\|255679504\|dbj\|BAF26806.2\| Os10g0484900 [*Oryza sativa Japonica* Group] | 0.76 | 2066 | 2489 |
| | 23-46 | XP_002463222 | hypothetical protein SORBIDRAFT_02g040060 [*Sorghum bicolor*] > gi\|241926599\|gb\|EER99743.1\| hypothetical protein SORBIDRAFT_02g040060 [*Sorghum bicolor*] | 1.00 | 2067 | 2490 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | NP_001105697 | thiazole biosynthetic enzyme 1-2, chloroplastic precursor [Zea mays] > gi\|2501190\|sp\|Q41739.1\|THI42_MAIZE RecName: Full = Thiazole biosynthetic enzyme 1-2, chloroplastic; Flags: Precursor > gi\|596080\|gb\|AAA96739.1\| thiamine biosynthetic enzyme [Zea mays] | 0.93 | 2068 | 2491 |
| | | ACF87708 | unknown [Zea mays] > gi\|224033955\|gb\|ACN36053.1\| unknown [Zea mays] | 0.93 | 2069 | 2492 |
| | | NP_001105696 | thiazole biosynthetic enzyme 1-1, chloroplastic precursor [Zea mays] > gi\|2501189\|sp\|Q41738.1\|THI41_MAIZE RecName: Full = Thiazole biosynthetic enzyme 1-1, chloroplastic; Flags: Precursor > gi\|596078\|gb\|AAA96738.1\| thiamine biosynthetic enzyme [Zea mays] > gi\|194704634\|gb\|ACF86401.1\| unknown [Zea mays] | 0.92 | 2070 | 2493 |
| | | NP_001059841 | Os07g0529600 [Oryza sativa Japonica Group] > gi\|32352138\|dbj\|BAC78562.1\| thiamine biosynthetic enzyme [Oryza sativa Japonica Group] > gi\|113611377\|dbj\|BAF21755.1\| Os07g0529600 [Oryza sativa Japonica Group] > gi\|215712225\|dbj\|BAG94352.1\| unnamed protein product [Oryza sativa Japonica Group] | 0.87 | 2071 | 2494 |
| | | BAC45141 | putative thiamine biosynthesis protein [Oryza sativa Japonica Group] > gi\|125600511\|gb\|EAZ40087.1\| hypothetical protein OsJ_24530 [Oryza sativa Japonica Group] | 0.87 | 2072 | 2495 |
| | | EAZ04139 | hypothetical protein OsI_26282 [Oryza sativa Indica Group] | 0.87 | 2073 | |
| | | XP_002458014 | hypothetical protein SORBIDRAFT_03g025520 [Sorghum bicolor] > gi\|241929989\|gb\|EES03134.1\| hypothetical protein SORBIDRAFT_03g025520 [Sorghum bicolor] | 0.91 | 2074 | 2496 |
| | | ACF85034 | unknown [Zea mays] | 0.84 | 2075 | 2497 |
| | | AAZ93636 | pathogen-induced defense-responsive protein 8 [Oryza sativa Indica Group] | 0.84 | 2076 | 2498 |
| | 71-94 | ACG31888 | ubiquitin-conjugating enzyme E2 W [Zea mays] | 1.00 | 2077 | 2499 |
| | | NP_001050906 | Os03g0681400 [Oryza sativa Japonica Group] > gi\|57164486\|gb\|AAK00965.2\| AC079736_5 putative ubiquitin-conjugating enzyme E2 [Oryza sativa Japonica Group] > gi\|108710422\|gb\|ABF98217.1\| Ubiquitin-conjugating enzyme family protein, expressed [Oryza sativa Japonica Group] > gi\|113549377\|dbj\|BAF12820.1\| Os03g0681400 [Oryza sativa Japonica Group] | 0.71 | 2078 | 2500 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | XP_002464080 | > gi\|215737341\|dbj\|BAG96270.1\| unnamed protein product [*Oryza sativa Japonica* Group] > gi\|222625566\|gb\|EEE59698.1\| hypothetical protein OsJ_12122 [*Oryza sativa Japonica* Group] hypothetical protein SORBIDRAFT_01g011940 [*Sorghum bicolor*] > gi\|241917934\|gb\|EER91078.1\| hypothetical protein SORBIDRAFT_01g011940 [*Sorghum bicolor*] | 0.72 | 2079 | 2501 |
| | | XP_002443656 | hypothetical protein SORBIDRAFT_08g022990 [*Sorghum bicolor*] > gi\|241944349\|gb\|EES17494.1\| hypothetical protein SORBIDRAFT_08g022990 [*Sorghum bicolor*] | 0.71 | 2080 | 2502 |
| | | NP_001146940 | ubiquitin-conjugating enzyme E2 W [*Zea mays*] > gi\|195605468\|gb\|ACG24564.1\| ubiquitin-conjugating enzyme E2 W [*Zea mays*] | 0.70 | 2081 | 2503 |
| Predicted siRNA 59965 | 614-634 | NP_001047323 | Os02g0596900 [*Oryza sativa Japonica* Group] > gi\|75291091\|sp\|Q6K908.1\|ARP3_ORYSJ RecName: Full = Actin-related protein 3 > gi\|190356069\|sp\|A2X6S3.2\|ARP3_ORYSI RecName: Full = Actin-related protein 3 > gi\|47847830\|dbj\|BAD21625.1\| putative arp3 [*Oryza sativa Japonica* Group] > gi\|113536854\|dbj\|BAF09237.1\| Os02g0596900 [*Oryza sativa Japonica* Group] > gi\|218191098\|gb\|EEC73525.1\| hypothetical protein OsI_07915 [*Oryza sativa Indica* Group] > gi\|222623169\|gb\|EEE57301.1\| hypothetical protein OsJ_07378 [*Oryza sativa Japonica* Group] | 1.00 | 2082 | 2504 |
| | | ACF87749 | unknown [*Zea mays*] > gi\|223972725\|gb\|ACN30550.1\| unknown [*Zea mays*] | 0.92 | 2083 | 2505 |
| | | XP_002285370 | PREDICTED: hypothetical protein [*Vitis vinifera*] | 0.86 | 2084 | 2506 |
| | | NP_001147580 | LOC100281189 [*Zea mays*] > gi\|195612296\|gb\|ACG27978.1\| actin-like protein 3 [*Zea mays*] | 0.92 | 2085 | 2507 |
| | | NP_001170315 | hypothetical protein LOC100384280 [*Zea mays*] > gi\|224034999\|gb\|ACN36575.1\| unknown [*Zea mays*] | 0.90 | 2086 | 2508 |
| | | XP_002315648 | predicted protein [*Populus trichocarpa*] > gi\|222864688\|gb\|EEF01819.1\| predicted protein [*Populus trichocarpa*] | 0.84 | 2087 | 2509 |
| | | XP_002515041 | protein binding protein, putative [*Ricinus communis*] > gi\|223546092\|gb\|EEF47595.1\| protein binding protein, putative [*Ricinus communis*] | 0.85 | 2088 | 2510 |
| | | XP_002312654 | predicted protein [*Populus trichocarpa*] > gi\|222852474\|gb\|EEE90021.1\| predicted protein [*Populus trichocarpa*] | 0.84 | 2089 | 2511 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | CAM97883 | actin-related protein 3 [*Nicotiana tabacum*] | 0.83 | 2090 | 2512 |
| | | NP_172777 | actin-related protein 3 [*Arabidopsis thaliana*] > gi|75313139|sp|Q9SAF1.1|ARP3_ARATH RecName: Full = Actin-related protein 3; AltName: Full = Protein DISTORTED TRICHOMES 1 > gi|4850401|gb|AAD31071.1| AC007357_20 Strong similarity to gb|U29610 Actin-like protein (Arp3) from *Acanthamoeba castellanii* and is a member of the PF|00022 Actin family [*Arabidopsis thaliana*] > gi|21427461|gb|AAM53243.1| AF507911_1 actin-related protein 3 [*Arabidopsis thaliana*] > gi|20260500|gb|AAM13148.1| similar to actin-like protein [*Arabidopsis thaliana*] > gi|21489929|tpg|DAA00033.1| TPA_exp: actin-related protein 3; AtARP3 [*Arabidopsis thaliana*] > gi|30387525|gb|AAP31928.1| At1g13180 [*Arabidopsis thaliana*] > gi|332190859|gb|AEE28980.1| actin-related protein 3 [*Arabidopsis thaliana*] | 0.81 | 2091 | 2513 |
| Predicted siRNA 58872 | 632-651 | ACR34392 | unknown [*Zea mays*] | 1.00 | 2092 | 2514 |
| | 315-334 | NP_001004443 | beta-hexosaminidase subunit alpha precursor [*Rattus norvegicus*] > gi|85701350|sp|Q641X3.1|HEXA_RAT RecName: Full = Beta-hexosaminidase subunit alpha; AltName: Full = Beta-N-acetylhexosaminidase subunit alpha; Short = Hexosaminidase subunit A; AltName: Full = N-acetyl-beta-glucosaminidase subunit alpha; Flags: Precursor > gi|51980341|gb|AAH82097.1| Hexosaminidase A [*Rattus norvegicus*] > gi|149041858|gb|EDL95699.1| hexosaminidase A, isoform CRA_a [*Rattus norvegicus*] | 1.00 | 2093 | 2515 |
| | | NP_034551 | beta-hexosaminidase subunit alpha precursor [*Mus musculus*] > gi|497174|gb|AAA18775.1| beta-hexosaminidase [*Mus musculus*] > gi|497196|gb|AAA18777.1| beta-hexosaminidase alpha-subunit [*Mus musculus*] > gi|14789650|gb|AAH10755.1| Hexosaminidase A [*Mus musculus*] > gi|26344774|dbj|BAC36036.1| unnamed protein product [*Mus musculus*] > gi|26344800|dbj|BAC36049.1| unnamed protein product [*Mus musculus*] > gi|74184438|dbj|BAE25744.1| unnamed protein product [*Mus musculus*] | 0.94 | 2094 | 2516 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | | > gi\|74204649\|dbj\|BAE35394.1\| unnamed protein product [*Mus musculus*] > gi\|148694024\|gb\|EDL25971.1\| hexosaminidase A [*Mus musculus*] | | | |
| | | BAE35636 | unnamed protein product [*Mus musculus*] | 0.94 | 2095 | 2517 |
| | | BAE29566 | unnamed protein product [*Mus musculus*] | 0.94 | 2096 | 2518 |
| | | BAE30831 | unnamed protein product [*Mus musculus*] | 0.94 | 2097 | 2519 |
| | | BAE35457 | unnamed protein product [*Mus musculus*] | 0.94 | 2098 | 2520 |
| | | P29416 | RecName: Full = Beta-hexosaminidase subunit alpha; AltName: Full = Beta-N-acetylhexosaminidase subunit alpha; Short = Hexosaminidase subunit A; AltName: Full = N-acetyl-beta-glucosaminidase subunit alpha; Flags: Precursor > gi\|51265\|emb\|CAA45615.1\| beta-N-acetylhexosaminidase [*Mus musculus*] > gi\|577688\|gb\|AAC53246.1\| beta-N-acetylhexosaminidase, alpha-subunit [*Mus musculus*] | 0.94 | 2099 | |
| | | BAC38018 | unnamed protein product [*Mus musculus*] | 0.94 | 2100 | 2521 |
| | | BAE39189 | unnamed protein product [*Mus musculus*] | 0.94 | 2101 | 2522 |
| | | BAE40146 | unnamed protein product [*Mus musculus*] | 0.94 | 2102 | 2523 |
| | 535-554 | XP-002526446 | heat shock protein, putative [*Ricinus communis*] > gi\|223534226\|gb\|EEF35941.1\| heat shock protein, putative [*Ricinus communis*] | 1.00 | 2103 | 2524 |
| | | XP_002328713 | predicted protein [*Populus trichocarpa*] > gi\|222839011\|gb\|EEE77362.1\| predicted protein [*Populus trichocarpa*] | 0.92 | 2104 | 2525 |
| | | XP_002331133 | predicted protein [*Populus trichocarpa*] > gi\|222872861\|gb\|EEF09992.1\| predicted protein [*Populus trichocarpa*] | 0.92 | 2105 | 2526 |
| | | XP_002279101 | PREDICTED: hypothetical protein [*Vitis vinifera*] | 0.93 | 2106 | 2527 |
| | | ABZ04081 | chloroplast heat shock protein 70-2 [*Ipomoea nil*] | 0.90 | 2107 | 2528 |
| | | ABM92419 | chloroplast HSP70 [*Cucumis sativus*] | 0.90 | 2108 | 2529 |
| | | ABE79560 | Chaperone DnaK [*Medicago truncatula*] | 0.90 | 2109 | 2530 |
| | | CAA52149 | heat shock protein 70 [*Cucumis sativus*] | 0.89 | 2110 | 2531 |
| | | Q02028 | RecName: Full = Stromal 70 kDa heat shock-related protein, chloroplastic; Flags: Precursor > gi\|169023\|gb\|AAA33637.1\| 70 kDa heat shock protein [*Pisum sativum*] > gi\|871515\|emb\|CAA49147.1\| Psst70 (stress 70 protein) [*Pisum sativum*] | 0.90 | 2111 | |
| | | CAN81065 | hypothetical protein VITISV_000728 [*Vitis vinifera*] | 0.91 | 2112 | 2532 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| Predicted siRNA 54631 | 1842-1866 | YP_024387 | ribulose-1,5-bisphosphate carboxylase/oxygenase large subunit [*Saccharum* hybrid cultivar SP-80-3280] > gi|50812536|ref|YP_054639.1| ribulose-1,5-bisphosphate carboxylase/oxygenase large subunit [*Saccharum officinarum*] > gi|118614500|ref|YP_899415.1| ribulose 1,5-bisphosphate carboxylase/oxygenase large subunit [*Sorghum bicolor*] > gi|75290174|sp|Q6ENV5.1|RBL_SACOF RecName: Full = Ribulose bisphosphate carboxylase large chain; Short = RuBisCO large subunit; Flags: Precursor > gi|75291223|sp|Q6L391.1|RBL_SACHY RecName: Full = Ribulose bisphosphate carboxylase large chain; Short = RuBisCO large subunit; Flags: Precursor > gi|125987520|sp|A1E9T2.1|RBL_SORBI RecName: Full = Ribulose bisphosphate carboxylase large chain; Short = RuBisCO large subunit; Flags: Precursor > gi|48478681|gb|AAT44701.1| RuBisCO large chain [*Saccharum* hybrid cultivar SP80-3280] > gi|49659520|dbj|BAD27301.1| RuBisCO large subunit [*Saccharum* hybrid cultivar NCo 310] > gi|118201134|gb|ABK79504.1| ribulose-1,5-bisphosphate carboxylase/oxygenase large subunit [*Sorghum bicolor*] | 1.00 | 2113 | 2533 |
| | | NP_043033 | ribulose-1,5-bisphosphate carboxylase/oxygenase large subunit [*Zea mays*] > gi|1172861|sp|P00874.2|RBL_MAIZE RecName: Full = Ribulose bisphosphate carboxylase large chain; Short = RuBisCO large subunit; Flags: Precursor > gi|18036|emb|CAA78027.1| Ribulose bisphosphate carboxylase [*Zea mays*] > gi|902230|emb|CAA60294.1| ribulose-1,5-bisphosphate carboxylase/oxygenase large subunit [*Zea mays*] | 0.99 | 2114 | 2534 |
| | | ABP01447 | ribulose-1,5-bisphosphate carboxylase/oxygenase large subunit [*Sorghastrum nutans*] | 0.99 | 2115 | 2535 |
| | | YP_003208195 | ribulose-1,5-bisphosphate carboxylase/oxygenase large subunit [*Coix lacryma-jobi*] > gi|209361365|gb|ACI43280.1| ribulose-1,5-bisphosphate carboxylase/oxygenase large subunit [*Coix lacryma-jobi*] | 0.98 | 2116 | 2536 |
| | | ABP01443 | ribulose-1,5-bisphosphate carboxylase/oxygenase large subunit [*Cymbopogon citratus*] | 0.98 | 2117 | 2537 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | ABP01445 | ribulose-1,5-bisphosphate carboxylase/oxygenase large subunit [*Pogonatherum* sp. Hodkinson 21] | 0.98 | 2118 | 2538 |
| | | ABP01442 | ribulose-1,5-bisphosphate carboxylase/oxygenase large subunit [*Coix lacryma-jobi*] | 0.97 | 2119 | 2539 |
| | | ABP01448 | ribulose-1,5-bisphosphate carboxylase/oxygenase large subunit [*Sorghum halepense*] | 0.96 | 2120 | 2540 |
| | | CAG34130 | ribulose-1,5-bisphosphate carboxylase/oxygenase large subunit [*Arthraxon* sp. Hodkinson 111] | 0.96 | 2121 | 2541 |
| | | AAA31678 | ribulose 1,5-bisphosphate carboxylase/oxygenase [*Cenchrus setiger*] > gi|294104|gb|AAA32020.1| ribulosebiphosphate carboxylase, large subunit [*Pennisetum glaucum*] | 0.97 | 2122 | 2542 |
| | 884-908 | ABP01449 | ribulose-1,5-bisphosphate carboxylase/oxygenase large subunit [*Trachypogon spicatus*] | 1.00 | 2123 | 2543 |
| | | ABP01447 | ribulose-1,5-bisphosphate carboxylase/oxygenase large subunit [*Sorghastrum nutans*] | 1.00 | 2124 | 2544 |
| | | NP_043033 | ribulose-1,5-bisphosphate carboxylase/oxygenase large subunit [*Zea mays*] > gi|1172861|sp|P00874.2|RBL_MAIZE RecName: Full = Ribulose bisphosphate carboxylase large chain; Short = RuBisCO large subunit; Flags: Precursor > gi|18036|emb|CAA78027.1| Ribulose bisphosphate carboxylase [*Zea mays*] > gi|902230|emb|CAA60294.1| ribulose-1,5-bisphosphate carboxylase/oxygenase subunit [*Zea mays*] | 0.99 | 2125 | 2545 |
| | | YP_024387 | ribulose-1,5-bisphosphate carboxylase/oxygenase large subunit [*Saccharum* hybrid cultivar SP-80-3280] > gi|50812536|ref|YP_054639.1| ribulose-1,5-bisphosphate carboxylase/oxygenase large subunit [*Saccharum officinarum*] > gi|118614500|ref|YP_899415.1| ribulose 1,5-bisphosphate carboxylase/oxygenase large subunit [*Sorghum bicolor*] > gi|75290174|sp|Q6ENV5.1|RBL_SACOF RecName: Full = Ribulose bisphosphate carboxylase large chain; Short = RuBisCO large subunit; Flags: Precursor > gi|75291223|sp|Q6L391.1|RBL_SACHY RecName: Full = Ribulose bisphosphate carboxylase large chain; Short = RuBisCO large subunit; Flags: Precursor > gi|125987520|sp|A1E9T2.1|RBL_SORBI RecName: Full = Ribulose bisphosphate carboxylase large chain; | 1.00 | 2126 | 2546 |

TABLE 7-continued

Target genes of up regulated siRNA sequences associated with NUE
(Table 3)

| Mir name | Mir Bind. Pos. | Hom. NCBI Accession | Annotation/organism | p.p. Identity | p.p. SEQ ID NO: | p.n. SEQ ID NO: |
|---|---|---|---|---|---|---|
| | | | Short = RuBisCO large subunit; Flags: Precursor<br>> gi|48478681|gb|AAT44701.1| RuBisCO large chain [*Saccharum* hybrid cultivar SP80-3280]<br>> gi|49659520|dbj|BAD27301.1| RuBisCO large subunit [*Saccharum* hybrid cultivar NCo 310]<br>> gi|118201134|gb|ABK79504.1| ribulose-1,5-bisphosphate carboxylase/oxygenase large subunit [*Sorghum bicolor*] | | | |
| | | ABP01443 | ribulose-1,5-bisphosphate carboxylase/oxygenase large subunit [*Cymbopogon citratus*] | 1.00 | 2127 | 2547 |
| | | ABP01445 | ribulose-1,5-bisphosphate carboxylase/oxygenase large subunit [*Pogonatherum* sp. Hodkinson 21] | 0.99 | 2128 | 2548 |
| | | ABP01442 | ribulose-1,5-bisphosphate carboxylase/oxygenase large subunit [*Coix lacryma-jobi*] | 0.98 | 2129 | 2549 |
| | | YP_003208195 | ribulose-1,5-bisphosphate carboxylase/oxygenase large subunit [*Coix lacryma-jobi*]<br>> gi|209361365|gb|ACI43280.1| ribulose-1,5-bisphosphate carboxylase/oxygenase large subunit [*Coix lacryma-jobi*] | 0.98 | 2130 | 2550 |
| | | ABP01441 | ribulose-1,5-bisphosphate carboxylase/oxygenase large subunit [*Bothriochloa ischaemum*] | 0.98 | 2131 | 2551 |
| | | CAG34130 | ribulose-1,5-bisphosphate carboxylase/oxygenase large subunit [*Arthraxon* sp. Hodkinson 111] | 0.96 | 2132 | 2552 |
| Predicted siRNA 59846 | 69-92 | XP_002458082 | hypothetical protein SORBIDRAFT_03g026670 [*Sorghum bicolor*]<br>> gi|241930057|gb|EES03202.1| hypothetical protein SORBIDRAFT_03g026670 [*Sorghum bicolor*] | 1.00 | 2133 | 2553 |
| | | EEC70994 | hypothetical protein OsI_02661 [*Oryza sativa* Indica Group] | 0.83 | 2134 | |
| | | NP_001152397 | regulator of telomere elongation helicase 1 [*Zea mays*]<br>> gi|195655863|gb|ACG47399.1| regulator of telomere elongation helicase 1 [*Zea mays*] | 0.78 | 2135 | 2554 |
| | | NP_001043456 | Os01g0592900 [*Oryza sativa Japonica* Group]<br>> gi|53791584|dbj|BAD52706.1| DEAH helicase isoform 5-like [*Oryza sativa Japonica* Group]<br>> gi|255673416|dbj|BAF05370.2| Os01g0592900 [*Oryza sativa Japonica* Group] | 0.70 | 2136 | 2555 |
| | 85-108 | ACR34511 | unknown [*Zea mays*] | 1.00 | 2137 | 2556 |
| | | NP_001105187 | histone acetyltransferase1 [*Zea mays*]<br>> gi|20977602|gb|AAM28228.1| histone acetyl transferase [*Zea mays*]<br>> gi|223975399|gb|ACN31887.1| unknown [*Zea mays*] | 0.99 | 2138 | 2557 |
| | | Q8LPU4 | RecName: Full = Histone acetyltransferase type B catalytic subunit; AltName: Full = Histone acetyltransferase HAT B; | 0.99 | 2139 | |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | | AltName: Full = Histone acetyltransferase HAT-B-p50 > gi|6288802|gb|AAF06742.1| AF171927_1 histone acetyltransferase HAT-B-p50 [*Zea mays*] > gi|5579441|gb|AAC03423.2| histone acetyltransferase HAT B [*Zea mays*] | | | |
| | | XP_002460092 | hypothetical protein SORBIDRAFT_02g022640 [*Sorghum bicolor*] > gi|241923469|gb|EER96613.1| hypothetical protein SORBIDRAFT_02g022640 [*Sorghum bicolor*] | 0.89 | 2140 | 2558 |
| | | NP_001062946 | Os09g0347800 [*Oryza sativa Japonica* Group] > gi|75121858|sp|Q6ES10.1|HAT1_ORYSJ RecName: Full = Probable acetyltransferase type B catalytic subunit; AltName: Full = HAT B > gi|50252375|dbj|BAD28482.1| putative histone acetyltransferase HAT B [*Oryza sativa Japonica* Group] > gi|50252405|dbj|BAD28560.1| putative histone acetyltransferase HAT B [*Oryza sativa Japonica* Group] > gi|113631179|dbj|BAF24860.1| Os09g0347800 [*Oryza sativa Japonica* Group] > gi|215678892|dbj|BAG95329.1| unnamed protein product [*Oryza sativa Japonica* Group] | 0.77 | 2141 | 2559 |
| | | EEC84410 | hypothetical protein OsI_30998 [*Oryza sativa Indica* Group] | 0.77 | 2142 | |
| | | EEE69531 | hypothetical protein OsJ_29003 [*Oryza sativa Japonica* Group] | 0.77 | 2143 | |
| | | BAK05443 | predicted protein [*Hordeum vulgare* subsp. *vulgare*] | 0.75 | 2144 | 2560 |
| | 85-108 | XP_002460092 | hypothetical protein SORBIDRAFT_02g022640 [*Sorghum bicolor*] > gi|241923469|gb|EER96613.1| hypothetical protein SORBIDRAFT_02g022640 [*Sorghum bicolor*] | 1.00 | 2145 | 2561 |
| | | NP_001105187 | histone acetyltransferase1 [*Zea mays*] > gi|20977602|gb|AAM28228.1| histone acetyl transferase [*Zea mays*] > gi|223975399|gb|ACN31887.1| unknown [*Zea mays*] | 0.90 | 2146 | 2562 |
| | | Q8LPU4 | RecName: Full = Histone acetyltransferase type B catalytic subunit; AltName: Full = Histone acetyltransferase HAT B; AltName: Full = Histone acetyltransferase HAT-B-p50 > gi|6288802|gb|AAF06742.1| AF171927_1 histone acetyltransferase HAT-B-p50 [*Zea mays*] > gi|5579441|gb|AAC03423.2| histone acetyltransferase HAT B [*Zea mays*] | 0.90 | 2147 | |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | NP_001062946 | Os09g0347800 [*Oryza sativa Japonica* Group] > gi|75121858|sp|Q6ES10.1|HAT1_ORYSJ RecName: Full = Probable acetyltransferase type B catalytic subunit; AltName: Full = HAT B > gi|50252375|dbj|BAD28482.1| putative histone acetyltransferase HAT B [*Oryza sativa Japonica* Group] > gi|50252405|dbj|BAD28560.1| putative histone acetyltransferase HAT B [*Oryza sativa Japonica* Group] > gi|113631179|dbj|BAF24860.1| Os09g0347800 [*Oryza sativa Japonica* Group] > gi|215678892|dbj|BAG95329.1| unnamed protein product [*Oryza sativa Japonica* Group] | 0.81 | 2148 | 2563 |
| | | EEC84410 | hypothetical protein OsI_30998 [*Oryza sativa Indica* Group] | 0.81 | 2149 | |
| | | EEE69531 | hypothetical protein OsJ_29003 [*Oryza sativa Japonica* Group] | 0.81 | 2150 | |
| | | BAK05443 | predicted protein [*Hordeum vulgare* subsp. *vulgare*] | 0.78 | 2151 | 2564 |
| | | ACR34511 | unknown [*Zea mays*] | 0.79 | 2152 | 2565 |
| Predicted siRNA 60081 | 293-311 | XP_002460816 | hypothetical protein SORBIDRAFT_02g035420 [*Sorghum bicolor*] > gi|241924193|gb|EER97337.1| hypothetical protein SORBIDRAFT_02g035420 [*Sorghum bicolor*] | 1.00 | 2153 | 2566 |
| | | NP_001147287 | receptor-like serine-threonine protein kinase [*Zea mays*] > gi|195609532|gb|ACG26596.1| receptor-like serine-threonine protein kinase [*Zea mays*] | 0.87 | 2154 | 2567 |
| | | BAK06110 | predicted protein [*Hordeum vulgare* subsp. *vulgare*] | 0.73 | 2155 | 2568 |
| | 564-582 | ACN27203 | unknown [*Zea mays*] | 1.00 | 2156 | 2569 |
| | | NP_001150572 | RING-H2 finger protein ATL1R [*Zea mays*] > gi|195640284|gb|ACG39610.1| RING-H2 finger protein ATL1R [*Zea mays*] | 1.00 | 2157 | 2570 |
| | | XP_002448400 | hypothetical protein SORBIDRAFT_06g026580 [*Sorghum bicolor*] > gi|241939583|gb|EES12728.1| hypothetical protein SORBIDRAFT_06g026580 [*Sorghum bicolor*] | 0.80 | 2158 | 2571 |
| | 374-392 | NP_001151643 | DNA binding protein [*Zea mays*] > gi|195648318|gb|ACG43627.1| DNA binding protein [*Zea mays*] | 1.00 | 2159 | 2572 |
| | | XP_002468594 | hypothetical protein SORBIDRAFT_01g048710 [*Sorghum bicolor*] > gi|241922448|gb|EER95592.1| hypothetical protein SORBIDRAFT_01g048710 [*Sorghum bicolor*] | 0.83 | 2160 | 2573 |
| | | NP_001048832 | Os03g0127500 [*Oryza sativa Japonica* Group] > gi|20330751|gb|AAM19114.1| | 0.73 | 2161 | 2574 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | | AC104427_12 Putative bZIP transcription factor [*Oryza sativa Japonica* Group] > gi|108705971|gb|ABF93766.1| bZIP family transcription factor, putative, expressed [*Oryza sativa Japonica* Group] > gi|113547303|dbj|BAF10746.1| Os03g0127500 [*Oryza sativa Japonica* Group] | | | |
| | | EAZ25438 | hypothetical protein OsJ_09254 [*Oryza sativa Japonica* Group] | 0.73 | 2162 | |
| | | EAY88362 | hypothetical protein OsI_09817 [*Oryza sativa Indica* Group] | 0.73 | 2163 | |
| | 365-383 | XP_002446810 | hypothetical protein SORBIDRAFT_06g023020 [*Sorghum bicolor*] > gi|241937993|gb|EES11138.1| hypothetical protein SORBIDRAFT_06g023020 [*Sorghum bicolor*] | 1.00 | 2164 | 2575 |
| | | NP_001185810 | yellow stripe-like transporter 11 [*Zea mays*] > gi|308210134|gb|ADO20998.1| yellow stripe-like transporter 11 [*Zea mays*] | 0.90 | 2165 | 2576 |
| | | CAH67887 | OSIGBa0153E02-OSIGBa0093I20.16 [*Oryza sativa Indica* Group] > gi|125549079|gb|EAY94901.1| hypothetical protein OsI_16701 [*Oryza sativa Indica* Group] | 0.79 | 2166 | |
| | | Q7X660 | RecName: Full = Probable metal-nicotianamine transporter YSL11; AltName: Full = Protein YELLOW STRIPE LIKE 11; Short = OsYSL11 > gi|32487645|emb|CAE05635.1| OSJNBa0038O10.1 [*Oryza sativa Japonica* Group] > gi|57834127|emb|CAI44638.1| OSJNBb0065J09.18 [*Oryza sativa Japonica* Group] > gi|125591037|gb|EAZ31387.1| hypothetical protein OsJ_15515 [*Oryza sativa Japonica* Group] | 0.79 | 2167 | |
| | | BAE91891 | hypothetical protein [*Oryza sativa Japonica* Group] | 0.79 | 2168 | 2577 |
| | | Q5JQD7 | RecName: Full = Probable metal-nicotianamine transporter YSL12; AltName: Full = Protein YELLOW STRIPE LIKE 12; Short = OsYSL12 > gi|116310949|emb|CAH67886.1| OSIGBa0153E02-OSIGBa0093I20.15 [*Oryza sativa Indica* Group] | 0.74 | 2169 | |
| | | NP_001185468 | yellow stripe-like transporter 12 [*Zea mays*] > gi|308210136|gb|ADO20999.1| yellow stripe-like transporter 12 [*Zea mays*] | 0.73 | 2170 | 2578 |
| | | XP_002452492 | hypothetical protein SORBIDRAFT_04g026840 [*Sorghum bicolor*] > gi|241932323|gb|EES05468.1| hypothetical protein SORBIDRAFT_04g026840 [*Sorghum bicolor*] | 0.71 | 2171 | 2579 |
| | | BAE91892 | hypothetical protein [*Oryza sativa Japonica* Group] | 0.73 | 2172 | 2580 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | XP_002446809 | hypothetical protein SORBIDRAFT_06g023010 [*Sorghum bicolor*] > gi\|241937992\|gb\|EES11137.1\| hypothetical protein SORBIDRAFT_06g023010 [*Sorghum bicolor*] | 0.72 | 2173 | 2581 |
| | 529-547 | XP_002464238 | hypothetical protein SORBIDRAFT_01g014760 [*Sorghum bicolor*] > gi\|241918092\|gb\|EER91236.1\| hypothetical protein SORBIDRAFT_01g014760 [*Sorghum bicolor*] | 1.00 | 2174 | 2582 |
| | | NP_001146578 | hypothetical protein LOC100280174 [*Zea mays*] > gi\|219887889\|gb\|ACL54319.1\| unknown [*Zea mays*] | 0.92 | 2175 | 2583 |
| | | ACN27618 | unknown [*Zea mays*] | 0.91 | 2176 | 2584 |
| | | EAY90980 | hypothetical protein OsI_12589 [*Oryza sativa Indica* Group] | 0.83 | 2177 | |
| | | NP_001050649 | Os03g0609800 [*Oryza sativa Japonica* Group] > gi\|37700299\|gb\|AAR00589.1\| putative NPH3 family protein [*Oryza sativa Japonica* Group] > gi\|40539093\|gb\|AAR87349.1\| transposon protein, putative, mutator sub-class [*Oryza sativa Japonica* Group] > gi\|62733727\|gb\|AAX95837.1\| transposon protein, putative, mutator sub-class [*Oryza sativa Japonica* Group] > gi\|108709776\|gb\|ABF97571.1\| transposon protein, putative, Mutator sub-class, expressed [*Oryza sativa Japonica* Group] > gi\|108709777\|gb\|ABF97572.1\| transposon protein, putative, Mutator sub-class, expressed [*Oryza sativa Japonica* Group] > gi\|113549120\|dbj\|BAF12563.1\| Os03g0609800 [*Oryza sativa Japonica* Group] > gi\|125587097\|gb\|EAZ27761.1\| hypothetical protein OsJ_11706 [*Oryza sativa Japonica* Group] > gi\|215686957\|dbj\|BAG89762.1\| unnamed protein product [*Oryza sativa Japonica* Group] | 0.83 | 2178 | 2585 |
| | | EAZ21022 | hypothetical protein OsJ_36671 [*Oryza sativa Japonica* Group] | 0.73 | 2179 | |
| | | NP_001067147 | Os12g0583500 [*Oryza sativa Japonica* Group] > gi\|77556906\|gb\|ABA99702.1\| transposon protein, putative, Mutator sub-class, expressed [*Oryza sativa Japonica* Group] > gi\|113649654\|dbj\|BAF30166.1\| Os12g0583500 [*Oryza sativa Japonica* Group] | 0.73 | 2180 | 2586 |
| | | EAY83679 | hypothetical protein OsI_38903 [*Oryza sativa Indica* Group] | 0.73 | 2181 | |
| | | BAJ87350 | predicted protein [*Hordeum vulgare* subsp. *vulgare*] | 0.71 | 2182 | 2587 |
| | 3078-3096 | NP_001185468 | yellow stripe-like transporter 12 [*Zea mays*] > gi\|308210136\|gb\|ADO20999.1\| yellow stripe-like transporter 12 [*Zea mays*] | 1.00 | 2183 | 2588 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | XP_002446809 | hypothetical protein SORBIDRAFT_06g023010 [*Sorghum bicolor*] > gi|241937992|gb|EES11137.1| hypothetical protein SORBIDRAFT_06g023010 [*Sorghum bicolor*] | 0.93 | 2184 | 2589 |
| | | Q5JQD7 | RecName: Full = Probable metal-nicotianamine transporter YSL12; AltName: Full = Protein YELLOW STRIPE LIKE 12; Short = OsYSL12 > gi|116310949|emb|CAH67886.1| OSIGBa0153E02-OSIGBa0093I20.15 [*Oryza sativa Indica* Group] | 0.88 | 2185 | |
| | | BAE91892 | hypothetical protein [*Oryza sativa Japonica* Group] | 0.87 | 2186 | 2590 |
| | | XP_002452492 | hypothetical protein SORBIDRAFT_04g026840 [*Sorghum bicolor*] > gi|241932323|gb|EES05468.1| hypothetical protein SORBIDRAFT_04g026840 [*Sorghum bicolor*] | 0.82 | 2187 | 2591 |
| | | BAE44205 | hypothetical protein [*Oryza sativa Japonica* Group] | 0.81 | 2188 | 2592 |
| | | Q6H7J6 | RecName: Full = Probable metal-nicotianamine transporter YSL14; AltName: Full = Protein YELLOW STRIPE LIKE 14; Short = OsYSL14 > gi|49388177|dbj|BAD25303.1| oligopeptide transporter OPT-like [*Oryza sativa Japonica* Group] | 0.81 | 2189 | |
| | | BAJ89062 | predicted protein [*Hordeum vulgare* subsp. *vulgare*] | 0.80 | 2190 | 2593 |
| | | BAJ92335 | predicted protein [*Hordeum vulgare* subsp. *vulgare*] | 0.80 | 2191 | 2594 |
| | | ACN34648 | unknown [*Zea mays*] > gi|295441975|gb|ADG21035.1| oligopeptide transporter [*Zea mays*] > gi|308210138|gb|ADO21000.1| yellow stripe-like transporter 14A [*Zea mays*] | 0.81 | 2192 | 2595 |
| Predicted siRNA 59380 | 1927-1945 | XP_002450269 | hypothetical protein SORBIDRAFT_05g002900 [*Sorghum bicolor*] > gi|241936112|gb|EES09257.1| hypothetical protein SORBIDRAFT_05g002900 [*Sorghum bicolor*] | 1.00 | 2193 | 2596 |
| | | NP_001130515 | hypothetical protein LOC100191614 [*Zea mays*] > gi|194689354|gb|ACF78761.1| unknown [*Zea mays*] > gi|195635013|gb|ACG36975.1| pyruvate kinase, cytosolic isozyme [*Zea mays*] > gi|223947285|gb|ACN27726.1| unknown [*Zea mays*] > gi|238009496|gb|ACR35783.1| unknown [*Zea mays*] | 0.98 | 2194 | 2597 |
| | | NP_001149198 | LOC100282820 [*Zea mays*] > gi|195625378|gb|ACG34519.1| pyruvate kinase, cytosolic isozyme [*Zea mays*] | 0.97 | 2195 | 2598 |
| | | BAJ87403 | predicted protein [*Hordeum vulgare* subsp. *vulgare*] | 0.95 | 2196 | 2599 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | BAJ94667 | predicted protein [*Hordeum vulgare* subsp. *vulgare*] | 0.95 | 2197 | 2600 |
| | | NP_001065749 | Os11g0148500 [*Oryza sativa Japonica* Group] > gi\|77548686\|gb\|ABA91483.1\| pyruvate kinase family protein, expressed [*Oryza sativa Japonica* Group] > gi\|113644453\|dbj\|BAF27594.1\| Os11g0148500 [*Oryza sativa Japonica* Group] > gi\|215692631\|dbj\|BAG88051.1\| unnamed protein product [*Oryza sativa Japonica* Group] > gi\|218185248\|gb\|EEC67675.1\| hypothetical protein OsI_35105 [*Oryza sativa Indica* Group] > gi\|222615524\|gb\|EEE51656.1\| hypothetical protein OsJ_32969 [*Oryza sativa Japonica* Group] | 0.95 | 2198 | 2601 |
| | | NP_001066148 | Os12g0145700 [*Oryza sativa Japonica* Group] > gi\|77553678\|gb\|ABA96474.1\| pyruvate kinase family protein, expressed [*Oryza sativa Japonica* Group] > gi\|113648655\|dbj\|BAF29167.1\| Os12g0145700 [*Oryza sativa Japonica* Group] > gi\|215701048\|dbj\|BAG92472.1\| unnamed protein product [*Oryza sativa Japonica* Group] > gi\|218186432\|gb\|EEC68859.1\| hypothetical protein OsI_37456 [*Oryza sativa Indica* Group] > gi\|222616632\|gb\|EEE52764.1\| hypothetical protein OsJ_35209 [*Oryza sativa Japonica* Group] | 0.94 | 2199 | 2602 |
| | | XP_002283911 | PREDICTED: hypothetical protein [*Vitis vinifera*] | 0.89 | 2200 | 2603 |
| | | AAM22747 | pyruvate kinase-like [*Deschampsia antarctica*] | 0.88 | 2201 | 2604 |
| | | ABE80121 | Pyruvate kinase [*Medicago truncatula*] | 0.89 | 2202 | |
| Predicted siRNA 55806 | 43-66 | NP_001052992 | Os04g0460600 [*Oryza sativa Japonica* Group] > gi\|38344965\|emb\|CAD40985.2\| OSJNBa0072F16.10 [*Oryza sativa Japonica* Group] > gi\|108947442\|gb\|ABF47345.2\| NAC domain protein [*Oryza sativa Japonica* Group] > gi\|113564563\|dbj\|BAF14906.1\| Os04g0460600 [*Oryza sativa Japonica* Group] > gi\|116310448\|emb\|CAH67453.1\| H0219H12.10 [*Oryza sativa Indica* Group] > gi\|215692665\|dbj\|BAG88085.1\| unnamed protein product [*Oryza sativa Japonica* Group] > gi\|215737715\|dbj\|BAG96845.1\| unnamed protein product [*Oryza sativa Japonica* Group] > gi\|218194979\|gb\|EEC77406.1\| hypothetical protein OsI_16171 [*Oryza sativa Indica* Group] > gi\|222628996\|gb\|EEE61128.1\| hypothetical protein OsJ_15058 [*Oryza sativa Japonica* Group] | 1.00 | 2203 | 2605 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | BAC53811 | OsNAC2 protein [*Oryza sativa*] | 0.97 | 2204 | 2606 |
| | | XP_002446618 | hypothetical protein SORBIDRAFT_06g019010 [*Sorghum bicolor*] > gi|241937801|gb|EES10946.1| hypothetical protein SORBIDRAFT_06g019010 [*Sorghum bicolor*] | 0.71 | 2205 | 2607 |
| Predicted siRNA 57034 | 2555-2578 | NP_001141674 | hypothetical protein LOC100273800 [*Zea mays*] > gi|194705506|gb|ACF86837.1| unknown [*Zea mays*] | 1.00 | 2206 | 2608 |
| | | XP_002451554 | hypothetical protein SORBIDRAFT_04g003650 [*Sorghum bicolor*] > gi|241931385|gb|EES04530.1| hypothetical protein SORBIDRAFT_04g003650 [*Sorghum bicolor*] | 0.74 | 2207 | 2609 |
| | 95-115 | YP_874773 | ribosomal protein L14 [*Agrostis stolonifera*] > gi|118430423|ref|YP_874689.1| ribosomal protein L14 [*Hordeum vulgare* subsp. *vulgare*] > gi|159106900|ref|YP_001531318.1| ribosomal protein L14 [*Lolium perenne*] > gi|125987532|sp|A1EA45.1|RK14_AGRST RecName: Full = 50S ribosomal protein L14, chloroplastic > gi|218546804|sp|A1E9M7.1| RK14_HORVU RecName: Full = 50S ribosomal protein L14, chloroplastic > gi|218546811|sp|A8Y9C3.1|RK14_LOLPR RecName: Full = 50S ribosomal protein L14, chloroplastic > gi|118201077|gb|ABK79448.1| ribosomal protein L14 [*Hordeum vulgare* subsp. *vulgare*] > gi|118201247|gb|ABK79616.1| ribosomal protein L14 [*Agrostis stolonifera*] > gi|158934434|emb|CAO86012.1| ribosomal protein L14 [*Lolium perenne*] | 1.00 | 2208 | 2610 |
| | | YP_002364534 | ribosomal protein L14 [*Festuca arundinacea*] > gi|215882361|gb|ACJ70791.1| ribosomal protein L14 [*Festuca arundinacea*] | 0.99 | 2209 | 2611 |
| | | NP_114294 | ribosomal protein L14 [*Triticum aestivum*] > gi|45477200|sp|Q95H51.1|RK14_WHEAT RecName: Full = 50S ribosomal protein L14, chloroplastic > gi|13928241|dbj|BAB47070.1| ribosomal protein L14 [*Triticum aestivum*] | 0.99 | 2210 | 2612 |
| | | NP_039422 | ribosomal protein L14 [*Oryza sativa Japonica* Group] > gi|50234008|ref|YP_052786.1| ribosomal protein L14 [*Oryza nivara*] > gi|109156621|ref|YP_654240.1| ribosomal protein L14 [*Oryza sativa Indica* Group] > gi|253729591|ref|YP_003029775.1| ribosomal protein L14 | 0.98 | 2211 | 2613 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | | [*Bambusa oldhamii*]<br>> gi\|255961418\|ref\|YP_003097611.1\|<br>ribosomal protein L14<br>[*Dendrocalamus latiflorus*]<br>> gi\|297723921\|ref\|NP_001174324.1\|<br>Os05g0292700 [*Oryza sativa Japonica* Group]<br>> gi\|68565732\|sp\|Q6END7.1\|RK14_ORYNI<br>RecName:<br>Full = 50S ribosomal protein L14, chloroplastic<br>> gi\|148839610\|sp\|P0C438.1\|RK14_ORYSA<br>RecName:<br>Full = 50S ribosomal protein L14, chloroplastic<br>> gi\|148839611\|sp\|P0C439.1\|RK14_ORYSI<br>RecName: Full = 50S ribosomal protein L14, chloroplastic<br>> gi\|148839612\|sp\|P0C440.1\|RK14_ORYSJ<br>RecName: Full = 50S ribosomal protein L14, chloroplastic<br>> gi\|12023\|emb\|CAA33932.1\|<br>ribosomal protein L14 [*Oryza sativa Japonica* Group]<br>> gi\|20160833\|dbj\|BAB89773.1\|<br>Chloroplast ribosomal protein L14 [*Oryza sativa Japonica* Group]<br>> gi\|40253571\|dbj\|BAD05517.1\|<br>ribosomal protein L14 [*Oryza sativa Japonica* Group]<br>> gi\|42795513\|gb\|AAS46080.1\|<br>ribosomal protein L14 [*Oryza sativa Indica* Group]<br>> gi\|49615032\|dbj\|BAD26815.1\|<br>ribosomal protein L14 [*Oryza nivara*]<br>> gi\|246367101\|gb\|ACS94712.1\|<br>ribosomal protein L14 [*Bambusa oldhamii*]<br>> gi\|255040295\|gb\|ACT99955.1\|<br>ribosomal protein L14 [*Dendrocalamus latiflorus*]<br>> gi\|255676212\|dbj\|BAH93052.1\|<br>Os05g0292700 [*Oryza sativa Japonica* Group]<br>> gi\|307133922\|gb\|ADN32927.1\|<br>ribosomal protein L14 [*Phyllostachys nigra* var. *henonis*]<br>> gi\|309321653\|gb\|ADO65178.1\|<br>ribosomal protein L14 [*Acidosasa purpurea*]<br>> gi\|309321737\|gb\|ADO65261.1\|<br>ribosomal protein L14 [*Ferrocalamus rimosivaginus*]<br>> gi\|309321821\|gb\|ADO65344.1\|<br>ribosomal protein L14 [*Indocalamus longiauritus*]<br>> gi\|309321904\|gb\|ADO65426.1\|<br>ribosomal protein L14 [*Phyllostachys edulis*]<br>> gi\|309321989\|gb\|ADO65510.1\|<br>ribosomal protein L14 [*Bambusa emeiensis*]<br>> gi\|226644\|prf\|1603356BU | | | |
| | | YP_00200522 | ribosomal protein L14 [*Brachypodium distachyon*]<br>> gi\|218546902\|sp\|B3TN86.1\|RK14_BRADI<br>RecName: Full = 50S | 0.98 | 2212 | 2614 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | | ribosomal protein L14, chloroplastic > gi\|193075591\|gb\|ACF08674.1\| ribosomal protein L14 [*Brachypodium distachyon*] | | | |
| | | ABJ52167 | ribosomal protein L14 [*Phyllostachys edulis*] | 0.98 | 2213 | 2615 |
| | | BAC10087 | Chloroplast 50S ribosomal protein L14 [*Oryza sativa Japonica* Group] > gi\|50510231\|dbj\|BAD31429.1\| Chloroplast 50S ribosomal protein L14 [*Oryza sativa Japonica* Group] | 0.98 | 2214 | 2616 |
| | | YP_003587704 | ribosomal protein L14 [*Anomochloa marantoidea*] > gi\|251765288\|gb\|ACT15442.1\| ribosomal protein L14 [*Anomochloa marantoidea*] | 0.95 | 2215 | 2617 |
| | | BAD33446 | putative ribosomal protein L14 [*Oryza sativa Japonica* Group] > gi\|50726203\|dbj\|BAD33722.1\| putative ribosomal protein L14 [*Oryza sativa Japonica* Group] | 0.96 | 2216 | 2618 |
| | | AAT85078 | putative 50S ribosomal protein L14 [*Oryza sativa Japonica* Group] > gi\|50878445\|gb\|AAT85219.1\| putative 50S ribosomal protein L14 [*Oryza sativa Japonica* Group] | 0.94 | 2217 | 2619 |
| Predicted siRNA 60387 | 403-422 | XP_002439358 | hypothetical protein SORBIDRAFT_09g005070 [*Sorghum bicolor*] > gi\|241944643\|gb\|EES17788.1\| hypothetical protein SORBIDRAFT_09g005070 [*Sorghum bicolor*] | 1.00 | 2218 | 2620 |
| | | NP_001140641 | hypothetical protein LOC100272716 [*Zea mays*] > gi\|194700306\|gb\|ACF84237.1\| unknown [*Zea mays*] | 0.88 | 2219 | 2621 |
| | | ACG56678 | tryptophan aminotransferase [*Zea mays*] | 0.88 | 2220 | 2622 |
| | | NP_001151869 | alliin lyase 2 [*Zea mays*] > gi\|195650459\|gb\|ACG44697.1\| alliin lyase 2 precursor [*Zea mays*] | 0.79 | 2221 | 2623 |
| | 374-393 | NP_001140641 | hypothetical protein LOC100272716 [*Zea mays*] > gi\|194700306\|gb\|ACF84237.1\| unknown [*Zea mays*] | 1.00 | 2222 | 2624 |
| | | ACG56678 | tryptophan aminotransferase [*Zea mays*] | 1.00 | 2223 | 2625 |
| | | XP_002439358 | hypothetical protein SORBIDRAFT_09g005070 [*Sorghum bicolor*] > gi\|241944643\|gb\|EES17788.1\| hypothetical protein SORBIDRAFT_09g005070 [*Sorghum bicolor*] | 0.89 | 2224 | 2626 |
| | | NP_001151869 | alliin lyase 2 [*Zea mays*] > gi\|195650459\|gb\|ACG44697.1\| alliin lyase 2 precursor [*Zea mays*] | 0.77 | 2225 | 2627 |
| | 155-174 | XP_002446287 | hypothetical protein SORBIDRAFT_06g013470 [*Sorghum bicolor*] > gi\|241937470\|gb\|EES10615.1\| hypothetical protein SORBIDRAFT_06g013470 [*Sorghum bicolor*] | 1.00 | 2226 | 2628 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | NP_001132422 | hypothetical protein LOC100193871 [Zea mays] > gi|194694338|gb|ACF81253.1| unknown [Zea mays] | 0.89 | 2227 | 2629 |
| | | ACN36503 | unknown [Zea mays] | 0.89 | 2228 | 2630 |
| | | NP_001144520 | hypothetical protein LOC100277514 [Zea mays] > gi|195643396|gb|ACG41166.1| hypothetical protein [Zea mays] | 0.89 | 2229 | 2631 |
| | | ACN25444 | unknown [Zea mays] | 0.89 | 2230 | 2632 |
| | | XP_002454376 | hypothetical protein SORBIDRAFT_04g029660 [Sorghum bicolor] > gi|241934207|gb|EES07352.1| hypothetical protein SORBIDRAFT_04g029660 [Sorghum bicolor] | 0.83 | 2231 | 2633 |
| | 302-321 | XP_002445712 | hypothetical protein SORBIDRAFT_07g024570 [Sorghum bicolor] > gi|241942062|gb|EES15207.1| hypothetical protein SORBIDRAFT_07g024570 [Sorghum bicolor] | 1.00 | 2232 | 2634 |
| | | NP_001148095 | auxin-independent growth promoter [Zea mays] > gi|195615748|gb|ACG29704.1| auxin-independent growth promoter [Zea mays] | 0.95 | 2233 | 2635 |
| | | BAD10226 | putative auxin-independent growth promoter [Oryza sativa Japonica Group] > gi|50725540|dbj|BAD33009.1| putative auxin-independent growth promoter [Oryza sativa Japonica Group] | 0.82 | 2234 | 2636 |
| | | XP_002460613 | hypothetical protein SORBIDRAFT_02g031900 [Sorghum bicolor] > gi|241923990|gb|EER97134.1| hypothetical protein SORBIDRAFT_02g031900 [Sorghum bicolor] | 0.71 | 2235 | 2637 |
| | 151-170 | NP_001144386 | hypothetical protein LOC100277314 [Zea mays] > gi|195641382|gb|ACG40159.1| hypothetical protein [Zea mays] | 1.00 | 2236 | 2638 |
| | 781-800 | NP_001151955 | senescence-associated protein 15 [Zea mays] > gi|195651331|gb|ACG45133.1| senescence-associated protein 15 [Zea mays] | 1.00 | 2237 | 2639 |
| | 46-65 | XP_002465563 | hypothetical protein SORBIDRAFT_01g041190 [Sorghum bicolor] > gi|241919417|gb|EER92561.1| hypothetical protein SORBIDRAFT_01g041190 [Sorghum bicolor] | 1.00 | 2238 | 2640 |
| | | NP_001049540 | Os03g0245700 [Oryza sativa Japonica Group] > gi|108707147|gb|ABF94942.1| senescence-associated protein 15, putative, expressed [Oryza sativa Japonica Group] > gi|113548011|dbj|BAF11454.1| Os03g0245700 [Oryza sativa Japonica Group] > gi|125543096|gb|EAY89235.1| hypothetical protein OsI_10732 [Oryza sativa Indica Group] > gi|125585589|gb|EAZ26253.1| | 0.88 | 2239 | 2641 |

TABLE 7-continued

Target genes of up regulated siRNA sequences associated with NUE (Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | BAJ85769 | hypothetical protein OsJ_10120 [*Oryza sativa Japonica* Group] predicted protein [*Hordeum vulgare* subsp. *vulgare*] > gi|326514266|dbj|BAJ92283.1| predicted protein [*Hordeum vulgare* subsp. *vulgare*] | 0.86 | 2240 | 2642 |
| | | XP_002464724 | hypothetical protein SORBIDRAFT_01g025820 [*Sorghum bicolor*] > gi|241918578|gb|EER91722.1| hypothetical protein SORBIDRAFT_01g025820 [*Sorghum bicolor*] | 0.76 | 2241 | 2643 |
| | | AAC34858 | senescence-associated protein 15 [*Hemerocallis* hybrid cultivar] | 0.70 | 2242 | 2644 |
| | | EEC66585 | hypothetical protein OsI_32794 [*Oryza sativa Indica* Group] | 0.74 | 2243 | |
| | | EEE50594 | hypothetical protein OsJ_30776 [*Oryza sativa Japonica* Group] | 0.74 | 2244 | |
| | | NP_001064196 | Os10g0158100 [*Oryza sativa Japonica* Group] > gi|255679225|dbj|BAF26110.2| Os10g0158100 [*Oryza sativa Japonica* Group] | 0.73 | 2245 | 2645 |
| | 400-419 | NP_001149275 | DNA polymerase epsilon subunit 3 [*Zea mays*] > gi|195625970|gb|ACG34815.1| DNA polymerase epsilon subunit 3 [*Zea mays*] > gi|195628668|gb|ACG36164.1| DNA polymerase epsilon subunit 3 [*Zea mays*] > gi|223942345|gb|ACN25256.1| unknown [*Zea mays*] | 1.00 | 2246 | 2646 |
| | | XP_002461994 | hypothetical protein SORBIDRAFT_02g012030 [*Sorghum bicolor*] > gi|241925371|gb|EER98515.1| hypothetical protein SORBIDRAFT_02g012030 [*Sorghum bicolor*] | 0.71 | 2247 | 2647 |
| | 71-90 | NP_001141681 | hypothetical protein LOC100273808 [*Zea mays*] > gi|238908879|gb|ACF86850.2| unknown [*Zea mays*] | 1.00 | 2248 | 2648 |
| | 106-125 | XP_002468642 | hypothetical protein SORBIDRAFT_01g049490 [*Sorghum bicolor*] > gi|241922496|gb|EER95640.1| hypothetical protein SORBIDRAFT_01g049490 [*Sorghum bicolor*] | 1.00 | 2249 | 2649 |
| | | ACG46521 | F-box protein [*Zea mays*] | 0.83 | 2250 | 2650 |
| | 670-689 | XP_002444258 | hypothetical protein SORBIDRAFT_07g019090 [*Sorghum bicolor*] > gi|241940608|gb|EES13753.1| hypothetical protein SORBIDRAFT_07g019090 [*Sorghum bicolor*] | 1.00 | 2251 | 2651 |
| | | NP_001131520 | hypothetical protein LOC100192859 [*Zea mays*] > gi|194691750|gb|ACF79959.1| unknown [*Zea mays*] | 0.95 | 2252 | 2652 |
| | | ACG32608 | peroxisomal coenzyme A diphosphatase NUDT7 [*Zea mays*] | 0.95 | 2253 | 2653 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | EAZ06644 | hypothetical protein OsI_28893 [*Oryza sativa Indica* Group] > gi|125561356|gb|EAZ06804.1| hypothetical protein OsI_29048 [*Oryza sativa Indica* Group] | 0.74 | 2254 | |
| | | EAZ42551 | hypothetical protein OsJ_27117 [*Oryza sativa Japonica* Group] | 0.74 | 2255 | |
| | | EAZ06802 | hypothetical protein OsI_29046 [*Oryza sativa Indica* Group] | 0.72 | 2256 | |
| | | NP_001061674 | Os08g0375900 [*Oryza sativa Japonica* Group] > gi|40253324|dbj|BAD05258.1| putative phosphohydrolase [*Oryza sativa Japonica* Group] > gi|40253358|dbj|BAD05290.1| putative phosphohydrolase [*Oryza sativa Japonica* Group] > gi|113623643|dbj|BAF23588.1| Os08g0375900 [*Oryza sativa Japonica* Group] | 0.72 | 2257 | 2654 |
| | | XP_002444259 | hypothetical protein SORBIDRAFT_07g019110 [*Sorghum bicolor*] > gi|241940609|gb|EES13754.1| hypothetical protein SORBIDRAFT_07g019110 [*Sorghum bicolor*] | 0.71 | 2258 | 2655 |
| | 2195-2214 | XP_002440313 | hypothetical protein SORBIDRAFT_09g029610 [*Sorghum bicolor*] > gi|241945598|gb|EES18743.1| hypothetical protein SORBIDRAFT_09g029610 [*Sorghum bicolor*] | 1.00 | 2259 | 2656 |
| | | ACG34981 | glucose-1-phosphate adenylyltransferase large subunit [*Zea mays*] > gi|223948357|gb|ACN28262.1| unknown [*Zea mays*] | 0.97 | 2260 | 2657 |
| | | NP_001056424 | Os05g0580000 [*Oryza sativa Japonica* Group] > gi|51854319|gb|AAU10700.1| putative glucose-1-phosphate adenylyltransferase [*Oryza sativa Japonica* Group] > gi|125553462|gb|EAY99171.1| hypothetical protein OsI_21129 [*Oryza sativa Indica* Group] > gi|169244411|gb|ACA50479.1| ADP-glucose pyrophosphorylase large subunit [*Oryza sativa Japonica* Group] > gi|215704797|dbj|BAG94825.1| unnamed protein product [*Oryza sativa Japonica* Group] > gi|222632685|gb|EEE64817.1| hypothetical protein OsJ_19673 [*Oryza sativa Japonica* Group] > gi|255676601|dbj|BAF18338.2| Os05g0580000 [*Oryza sativa Japonica* Group] > gi|262344368|gb|ACY56044.1| ADP-glucose pyrophosphorylase large subunit [*Oryza sativa Japonica* Group] > gi|262344370|gb|ACY56045.1| ADP-glucose pyrophosphorylase large subunit [*Oryza sativa Japonica* Group] > gi|262344372|gb|ACY56046.1| ADP-glucose pyrophosphorylase large subunit | 0.93 | 2261 | 2658 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | | [*Oryza sativa Japonica* Group] > gi|262344374|gb|ACY56047.1| ADP-glucose pyrophosphorylase large subunit [*Oryza sativa Japonica* Group] > gi|262344376|gb|ACY56048.1| ADP-glucose pyrophosphorylase large subunit [*Oryza sativa Japonica* Group] > gi|262344378|gb|ACY56049.1| ADP-glucose pyrophosphorylase large subunit [*Oryza sativa Japonica* Group] > gi|262344380|gb|ACY56050.1| ADP-glucose pyrophosphorylase large subunit [*Oryza sativa Indica* Group] > gi|262344382|gb|ACY56051.1| ADP-glucose pyrophosphorylase large subunit [*Oryza sativa Indica* Group] > gi|262344384|gb|ACY56052.1| ADP-glucose pyrophosphorylase large subunit [*Oryza sativa Indica* Group] > gi|262344386|gb|ACY56053.1| ADP-glucose pyrophosphorylase large subunit [*Oryza sativa Indica* Group] > gi|262344388|gb|ACY56054.1| ADP-glucose pyrophosphorylase large subunit [*Oryza sativa Indica* Group] > gi|262344390|gb|ACY56055.1| ADP-glucose pyrophosphorylase large subunit [*Oryza sativa Indica* Group] > gi|262344392|gb|ACY56056.1| ADP-glucose pyrophosphorylase large subunit [*Oryza sativa Indica* Group] > gi|262344394|gb|ACY56057.1| ADP-glucose pyrophosphorylase large subunit [*Oryza sativa Indica* Group] | | | |
| | | BAA23490 | ADP glucose pyrophosphorylase large subunit [*Oryza sativa Japonica* Group] | 0.92 | 2262 | 2659 |
| | | AAD39597 | 10A19I.12 [*Oryza sativa Japonica* Group] | 0.93 | 2263 | 2660 |
| | | P12299 | RecName: Full = Glucose-1-phosphate adenylyltransferase large subunit, chloroplastic/amyloplastic; AltName: Full = ADP-glucose pyrophosphorylase; AltName: Full = ADP-glucose synthase; AltName: Full = AGPase S; AltName: Full = Alpha-D-glucose-1-phosphate adenyl transferase; Flags: Precursor > gi|995746|emb|CAA79980.1| ADP-glucose pyrophosphorylase large subunit [*Triticum aestivum*] > gi|110729318|gb|ABG88200.1| ADP-glucose pyrophosphorylase large subunit [*Triticum aestivum*] | 0.91 | 2264 | |
| | | P30524 | RecName: Full = Glucose-1-phosphate adenylyltransferase large subunit 1, chloroplastic/amyloplastic; | 0.91 | 2265 | |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | | AltName: Full = ADP-glucose pyrophosphorylase; AltName: Full = ADP-glucose synthase; AltName: Full = AGPase S; AltName: Full = Alpha-D-glucose-1-phosphate adenyl transferase; AltName: Full = BEPL; Flags: Precursor > gi|1279513|emb|CAA47626.1| glucose-1-phosphate adenylyltransferase [Hordeum vulgare subsp. vulgare] > gi|229610847|emb|CAX51355.1| large subunit of ADP-glucose pyrophosphorylase [Hordeum vulgare subsp. vulgare] > gi|326527375|dbj|BAK04629.1| predicted protein [Hordeum vulgare subsp. vulgare] > gi|326528409|dbj|BAJ93393.1| predicted protein [Hordeum vulgare subsp. vulgare] > gi|326528511|dbj|BAJ93437.1| predicted protein [Hordeum vulgare subsp. vulgare] | | | |
| | | CAD98749 | ADP-glucose pyrophosphorylase large subunit [Triticum aestivum] | 0.89 | 2266 | 2661 |
| | | NP_001105717 | glucose-1-phosphate adenylyltransferase large subunit 2, chloroplastic/amyloplastic [Zea mays] >gi|707928|sp|p55234.1|GLG L2_MAIZE RecName: Full = Glucose-1-phosphate adenylyltransferase large subunit 2, chloroplastic/amyloplastic; AltName: Full = ADP-glucose pyrophosphorylase; AltName: Full = synthase AltName: Full = AGPase S; AltName: Full = Alpha-D-glucose-1-phosphate adenyl transferase; Flags: Precursor >gi|558365|emb|CAA86227.1| ADP-glucose pyrophosphorylase [Zea mays] | 0.92 | 2267 | 2662 |
| | | 1909370A | ADP glucose | 0.87 | 2268 | |
| Predicted siRNA 60837 | 154-171 | XP_001545081 | hypothetical protie BC1G_16418 [Botryotinia fuckeliana B05.10 ] >gi|150854146|gb|EDN29338.1| hypothetical protein BC1G_16418[Botryotinia fuckeliana B05.10 | 1.00 | 2269 | 2663 |
| | 629-646 | XP_002441128 | hypothetical protein SORBIDRAFT_09g020930 [Sorghum bicolor] >g1|241946413|gb|EES19558.1| hypothetical protein SORBIDRAFT_09g020930 [Sorghum bicolor] | 1.00 | 2270 | 2664 |
| | | ACR35990 | unknown [Zea mays] | 0.91 | 2271 | 2665 |
| | | NP_001152387 | LOC100286027 [Zea mays] >gi|195655783|gb|ACG47359.1| secondary cell wall-related glycosyltransferase family 8 [Zea mays] | 0.92 | 2272 | 2666 |
| | | BAJ85213 | predicted protein [Hordeum vulgare subsp. vulgare] >gi|326515442|dbj|BAK03634.1| predicted protein [Hordeum vulgare subsp. vulgare] | 0.86 | 2273 | 2667 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | AAS90653 | putative glycogenin [*Oryza sativa Japonica* Group] | 0.84 | 2274 | 2668 |
| | | EEC79261 | hypothetical protein OsI_20036 [*Oryza sativa Indica* Group] | 0.84 | 2275 | |
| | | EEE63788 | hypothetical protein OsJ_18611 [*Oryza sativa Japonica* Group] | 0.83 | 2276 | |
| | | NP_00104491 | Os01g0880200 [*Oryza sativa Japonica* Group] >gi\|56784626\|dbj\|BAD81673.1\| glycogenin-like protein [*Oryza sativa Japonica* Group] > gi\|113534522\|dbj\|BAF06905.1\| Os01g0880200 [*Oryza sativa Japonica* Group] | 0.84 | 2277 | 2669 |
| | | EEC71899 | hypothetical protein OsI_04661 [*Oryza sativa Indica* Group] | 0.84 | 2278 | |
| | | BAJ87677 | predicted protein [*Hordeum vulgare* subsp. *vulgare*] | 0.82 | 2279 | 2670 |
| | 687-704 | EEC83357 | hypothetical protein OsI_28763 [*Oryza sativa Indica* Group] > gi\|222623167\|gb\|EEE57299.1\| hypothetical protein OsJ_07374 [*Oryza sativa Japonica* Group] | 1.00 | 2280 | |
| | | NP_001060995 | Os08g0150800 [*Oryza sativa Japonica* Group] > gi\|37573038\|dbj\|BAC98550.1\| putative tyrosyl-tRNA synthetase [*Oryza sativa Japonica* Group] > gi\|113622964\|dbj\|BAF22909.1\| Os08g0150800 [*Oryza sativa Japonica* Group] > gi\|222639916\|gb\|EEE68048.1\| hypothetical protein OsJ_26046 [*Oryza sativa Japonica* Group] | 0.94 | 2281 | 2671 |
| | | ACF82652 | unknown [*Zea mays*] | 0.87 | 2282 | 2672 |
| | | NP_001149217 | LOC100282839 [*Zea mays*] > gi\|195625536\|gb\|ACG34598.1\| tyrosyl-tRNA synthetase [*Zea mays*] | 0.86 | 2283 | 2673 |
| | | NP_001148699 | tyrosyl-tRNA synthetase [*Zea mays*] > gi\|195621482\|gb\|ACG32571.1\| tyrosyl-tRNA synthetase [*Zea mays*] | 0.83 | 2284 | 2674 |
| | | BAK05692 | predicted protein [*Hordeum vulgare* subsp. *vulgare*] > gi\|326527699\|dbj\|BAK08124.1\| predicted protein [*Hordeum vulgare* subsp. *vulgare*] > gi\|326533322\|dbj\|BAJ93633.1\| predicted protein [*Hordeum vulgare* subsp. *vulgare*] | 0.83 | 2285 | 2675 |
| | | CAA71881 | Tyrosyl-tRNA synthetase [*Nicotiana tabacum*] | 0.69 | 2286 | 2676 |
| | | XP_002517485 | tyrosyl-tRNA synthetase, putative [*Ricinus communis*] > gi\|223543496\|gb\|EEF45027.1\| tyrosyl-tRNA synthetase, putative [*Ricinus communis*] | 0.71 | 2287 | 2677 |
| | | XP_002274369 | PREDICTED: hypothetical protein [*Vitis vinifera*] > gi\|297742518\|emb\|CBI34667.3\| unnamed protein product [*Vitis vinifera*] | 0.71 | 2288 | 2678 |
| | | CAN65657 | hypothetical protein VITISV_000951 [*Vitis vinifera*] | 0.71 | 2289 | 2679 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | 796-813 | ACG35054 | THO complex subunit 4 [*Zea mays*] | 1.00 | 2290 | 2680 |
| | | NP_001146734 | hypothetical protein LOC100280336 [*Zea mays*] > gi|194704900|gb|ACF86534.1| unknown [*Zea mays*] > gi|219888533|gb|ACL54641.1| unknown [*Zea mays*] | 0.99 | 2291 | 2681 |
| | | XP_002438180 | hypothetical protein SORBIDRAFT_10g009240 [*Sorghum bicolor*] > gi|241916403|gb|EER89547.1| hypothetical protein SORBIDRAFT_10g009240 [*Sorghum bicolor*] | 0.87 | 2292 | 2682 |
| | 310-327 | NP_001168358 | hypothetical protein LOC100382126 [*Zea mays*] > gi|223947741|gb|ACN27954.1| unknown [*Zea mays*] | 1.00 | 2293 | 2683 |
| | | BAD54151 | putative poly(A) polymerase [*Oryza sativa Japonica* Group] | 0.81 | 2294 | |
| | | BAJ95542 | predicted protein [*Hordeum vulgare* subsp. *vulgare*] | 0.80 | 2295 | 2684 |
| | | NP_001174846 | Os06g0558700 [*Oryza sativa Japonica* Group] > gi|255677141|dbj|BAH93574.1| Os06g0558700 [*Oryza sativa Japonica* Group] | 0.80 | 2296 | 2685 |
| | | AAW68015 | putative polynucleotide adenylyltransferase [*Oryza sativa Indica* Group] | 0.80 | 2297 | 2686 |
| | | EAZ37348 | hypothetical protein OsJ_21686 [*Oryza sativa Japonica* Group] | 0.78 | 2298 | |
| | | EAZ01335 | hypothetical protein OsI_23369 [*Oryza sativa Indica* Group] | 0.78 | 2299 | |
| | 576-593 | XP_002466644 | hypothetical protein SORBIDRAFT_01g011560 [*Sorghum bicolor*] > gi|241920498|gb|EER93642.1| hypothetical protein SORBIDRAFT_01g011560 [*Sorghum bicolor*] | 1.00 | 2300 | 2687 |
| | | NP_001169332 | hypothetical protein LOC100383199 [*Zea mays*] > gi|224028751|gb|ACN33451.1| unknown [*Zea mays*] | 0.96 | 2301 | 2688 |
| | | NP_001130678 | hypothetical protein LOC100191781 [*Zea mays*] > gi|194688930|gb|ACF78549.1| unknown [*Zea mays*] | 0.95 | 2302 | 2689 |
| | | EEC81302 | hypothetical protein OsI_24438 [*Oryza sativa Indica* Group] > gi|222636212|gb|EEE66344.1| hypothetical protein OsJ_22634 [*Oryza sativa Japonica* Group] | 0.87 | 2303 | |
| | | BAJ99110 | predicted protein [*Hordeum vulgare* subsp. *vulgare*] | 0.86 | 2304 | 2690 |
| | | BAJ86220 | predicted protein [*Hordeum vulgare* subsp. *vulgare*] | 0.75 | 2305 | 2691 |
| | | NP_001063757 | Os09g0531900 [*Oryza sativa Japonica* Group] > gi|52075938|dbj|BAD46018.1| glycosyl transferase family 8 protein-like [*Oryza sativa Japonica* Group] > gi|52077221|dbj|BAD46265.1| glycosyl transferase family 8 protein-like [*Oryza sativa Japonica* Group] > gi|113631990|dbj|BAF25671.1| | 0.74 | 2306 | 2692 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | | Os09g0531900 [*Oryza sativa Japonica* Group] > gi\|222641970\|gb\|EEE70102.1\| hypothetical protein OsJ_30110 [*Oryza sativa Japonica* Group] | | | |
| | | EEC84934 | hypothetical protein OsI_32147 [*Oryza sativa Indica* Group] | 0.74 | 2307 | |
| | | XP_002462717 | hypothetical protein SORBIDRAFT_02g030820 [*Sorghum bicolor*] > gi\|241926094\|gb\|EER99238.1\| hypothetical protein SORBIDRAFT_02g030820 [*Sorghum bicolor*] | 0.75 | 2308 | 2693 |
| | | CBI38820 | unnamed protein product [*Vitis vinifera*] | 0.72 | 2309 | |
| Predicted siRNA 61382 | 70-89 | XP_002446795 | hypothetical protein SORBIDRAFT_06g022830 [*Sorghum bicolor*] > gi\|241937978\|gb\|EES11123.1\| hypothetical protein SORBIDRAFT_06g022830 [*Sorghum bicolor*] | 1.00 | 2310 | 2694 |
| | | NP_001143685 | hypothetical protein LOC100276413 [*Zea mays*] > gi\|195624570\|gb\|ACG34115.1\| hypothetical protein [*Zea mays*] | 0.86 | 2311 | 2695 |
| | | ACN29321 | unknown [*Zea mays*] | 0.86 | 2312 | 2696 |
| | | NP_001053334 | Os04g0520900 [*Oryza sativa Japonica* Group] > gi\|21741854\|emb\|CAD41444.1\| OSJNBa0019D11.15 [*Oryza sativa Japonica* Group] > gi\|113564905\|dbj\|BAF15248.1\| Os04g0520900 [*Oryza sativa Japonica* Group] > gi\|116310729\|emb\|CAH67525.1\| OSIGBa0131L05.6 [*Oryza sativa Indica* Group] > gi\|125549050\|gb\|EAY94872.1\| hypothetical protein OsI_16672 [*Oryza sativa Indica* Group] > gi\|125591012\|gb\|EAZ31362.1\| hypothetical protein OsJ_15488 [*Oryza sativa Japonica* Group] > gi\|215697100\|dbj\|BAG91094.1\| unnamed protein product [*Oryza sativa Japonica* Group] | 0.72 | 2313 | 2697 |
| | 682-701 | NP_001143685 | hypothetical protein LOC100276413 [*Zea mays*] > gi\|195624570\|gb\|ACG34115.1\| hypothetical protein [*Zea mays*] | 1.00 | 2314 | 2698 |
| | | ACN29321 | unknown [*Zea mays*] | 0.95 | 2315 | 2699 |
| | | XP_002446795 | hypothetical protein SORBIDRAFT_06g022830 [*Sorghum bicolor*] > gi\|241937978\|gb\|EES11123.1\| hypothetical protein SORBIDRAFT_06g022830 [*Sorghum bicolor*] | 0.90 | 2316 | 2700 |
| | | NP_001053334 | Os04g0520900 [*Oryza sativa Japonica* Group] > gi\|21741854\|emb\|CAD41444.1\| OSJNBa0019D11.15 [*Oryza sativa Japonica* Group] > gi\|113564905\|dbj\|BAF15248.1\| Os04g0520900 [*Oryza sativa Japonica* Group] > gi\|116310729\|emb\|CAH67525.1\| | 0.70 | 2317 | 2701 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| Predicted siRNA 60188 | 237-254 | XP_002459573 | OSIGBa0131L05.6 [*Oryza sativa Indica* Group] > gi\|125549050\|gb\|EAY94872.1\| hypothetical protein OsI_16672 [*Oryza sativa Indica* Group] > gi\|125591012\|gb\|EAZ31362.1\| hypothetical protein OsJ_15488 [*Oryza sativa Japonica* Group] > gi\|215697100\|dbj\|BAG91094.1\| unnamed protein product [*Oryza sativa Japonica* Group] hypothetical protein SORBIDRAFT_02g006770 [*Sorghum bicolor*] > gi\|241922950\|gb\|EER96094.1\| hypothetical protein SORBIDRAFT_02g006770 [*Sorghum bicolor*] | 1.00 | 2318 | 2702 |
| | | NP_001150031 | nucleic acid binding protein [*Zea mays*] > gi\|194699002\|gb\|ACF83585.1\| unknown [*Zea mays*] > gi\|195636208\|gb\|ACG37572.1\| nucleic acid binding protein [*Zea mays*] | 0.98 | 2319 | 2703 |
| | | NP_001140438 | hypothetical protein LOC100272497 [*Zea mays*] > gi\|194699514\|gb\|ACF83841.1\| unknown [*Zea mays*] | 0.96 | 2320 | 2704 |
| | | NP_001059216 | Os07g0227400 [*Oryza sativa Japonica* Group] > gi\|24060154\|dbj\|BAC21599.1\| KH domain-like protein [*Oryza sativa Japonica* Group] > gi\|113610752\|dbj\|BAF21130.1\| Os07g0227400 [*Oryza sativa Japonica* Group] > gi\|215697533\|dbj\|BAG91527.1\| unnamed protein product [*Oryza sativa Japonica* Group] | 0.91 | 2321 | 2705 |
| | | EAZ39172 | hypothetical protein OsJ_23597 [*Oryza sativa Japonica* Group] > gi\|218199326\|gb\|EEC81753.1\| hypothetical protein OsI_25419 [*Oryza sativa Indica* Group] | 0.91 | 2322 | |
| | | NP_001148920 | nucleic acid binding protein [*Zea mays*] > gi\|195623320\|gb\|ACG33490.1\| nucleic acid binding protein [*Zea mays*] | 0.85 | 2323 | 2706 |
| | | XP_002466215 | hypothetical protein SORBIDRAFT_01g003680 [*Sorghum bicolor*] > gi\|241920069\|gb\|EER93213.1\| hypothetical protein SORBIDRAFT_01g003680 [*Sorghum bicolor*] | 0.85 | 2324 | 2707 |
| | | NP_001051685 | Os03g0815700 [*Oryza sativa Japonica* Group] > gi\|75226290\|sp\|Q75GR5.1\|SPIN1_ORYSJ RecName: Full = KH domain-containing protein SPIN1; AltName: Full = SPL11-interacting protein 1 > gi\|37718879\|gb\|AAR01750.1\| expressed protein [*Oryza sativa Japonica* Group] > gi\|108711745\|gb\|ABF99540.1\| KH domain-containing protein, putative, expressed [*Oryza sativa Japonica* Group] > gi\|113550156\|dbj\|BAF13599.1\| | 0.86 | 2325 | 2708 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | | Os03g0815700 [*Oryza sativa Japonica* Group] > gi\|215694514\|dbj\|BAG89507.1\| unnamed protein product [*Oryza sativa Japonica* Group] > gi\|218193980\|gb\|EEC76407.1\| hypothetical protein OsI_14057 [*Oryza sativa Indica* Group] > gi\|222626037\|gb\|EEE60169.1\| hypothetical protein OsJ_13097 [*Oryza sativa Japonica* Group] | | | |
| | | NP_001130116 | hypothetical protein LOC100191210 [*Zea mays*] > gi\|194688334\|gb\|ACF78251.1\| unknown [*Zea mays*] | 0.84 | 2326 | 2709 |
| | | BAJ96236 | predicted protein [*Hordeum vulgare* subsp. *vulgare*] | 0.83 | 2327 | 2710 |
| | 362-379 | XP_002448500 | hypothetical protein SORBIDRAFT_06g028030 [*Sorghum bicolor*] > gi\|241939683\|gb\|EES12828.1\| hypothetical protein SORBIDRAFT_06g028030 [*Sorghum bicolor*] | 1.00 | 2328 | 2711 |
| | | NP_001148728 | protein phosphatase 2C [*Zea mays*] > gi\|195621678\|gb\|ACG32669.1\| protein phosphatase 2C [*Zea mays*] > gi\|238007398\|gb\|ACR34734.1\| unknown [*Zea mays*] | 0.93 | 2329 | 2712 |
| | | NP_001053823 | Os04g0609600 [*Oryza sativa Japonica* Group] > gi\|122240832\|sp\|Q0JAA0.1\|P2C44_ORYSJ RecName: Full = Probable protein phosphatase 2C 44; Short = OsPP2C44 > gi\|113565394\|dbj\|BAF15737.1\| Os04g0609600 [*Oryza sativa Japonica* Group] | 0.91 | 2330 | 2713 |
| | | 5 | [*Oryza sativa Japonica* Group] | | | |
| | | EEC71777 | hypothetical protein OsI_04389 [*Oryza sativa Indica* Group] | 0.80 | 2339 | |
| | | BAJ99773 | predicted protein [*Hordeum vulgare* subsp. *vulgare*] | 0.78 | 2340 | 2721 |
| | | XP_002458747 | hypothetical protein SORBIDRAFT_03g039530 [*Sorghum bicolor*] > gi\|241930722\|gb\|EES03867.1\| hypothetical protein SORBIDRAFT_03g039530 [*Sorghum bicolor*] | 0.78 | 2341 | 2722 |
| | | AAC04576 | putative high-pI laccase [*Oryza sativa Japonica* Group] | 0.79 | 2342 | 2723 |
| | 725-742 | CAE03557 | OSJNBa0085I10.2 [*Oryza sativa Japonica* Group] > gi\|90265077\|emb\|CAH67750.1\| H0702G05.9 [*Oryza sativa Indica* Group] | 1.00 | 2343 | 2724 |
| | | NP_001053823 | Os04g0609600 [*Oryza sativa Japonica* Group] > gi\|122240832\|sp\|Q0JAA0.1\|P2C44_ORYSJ RecName: Full = Probable protein phosphatase 2C 44; Short = OsPP2C44 > gi\|113565394\|dbj\|BAF15737.1\| Os04g0609600 [*Oryza sativa Japonica* Group] > gi\|218195541\|gb\|EEC77968.1\| hypothetical protein OsI_17335 | 1.00 | 2344 | 2725 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | XP_002448500 | [Oryza sativa Indica Group] > gi\|222629521\|gb\|EEE61653.1\| hypothetical protein OsJ_16105 [Oryza sativa Japonica Group] hypothetical protein SORBIDRAFT_06g028030 [Sorghum bicolor] > gi\|241939683\|gb\|EES12828.1\| hypothetical protein SORBIDRAFT_06g028030 [Sorghum bicolor] | 0.91 | 2345 | 2726 |
| | | NP_001148728 | protein phosphatase 2C [Zea mays] > gi\|195621678\|gb\|ACG32669.1\| protein phosphatase 2C [Zea mays] > gi\|238007398\|gb\|ACR34734.1\| unknown [Zea mays] | 0.90 | 2346 | 2727 |
| | | CAE03658 | OSJNBa0060NO3.23 [Oryza sativa Japonica Group] | 0.75 | 2347 | 2728 |
| | | XP_002274944 | PREDICTED: hypothetical protein isoform 1 [Vitis vinifera] > gi\|297745124\|emb\|CB138963.3\| unnamed protein product [Vitis vinifera] | 0.74 | 2348 | 2729 |
| | | XP_002514493 | protein phosphatase 2c, putative [Ricinus communis] > gi\|223546392\|gb\|EEF47893.1\| protein phosphatase 2c, putative [Ricinus communis] | 0.76 | 2349 | 2730 |
| | | XP_002274981 | PREDICTED: hypothetical protein isoform 2 [Vitis vinifera] | 0.71 | 2350 | 2731 |
| | 879-896 | NP_001054756 | Os05g0168700 [Oryza sativa Japonica Group] > gi\|53982148\|gb\|AAV25244.1\| putative phosphate translocator [Oryza sativa Japonica Group] > gi\|113578307\|dbj\|BAF16670.1\| Os05g0168700 [Oryza sativa Japonica Group] > gi\|215686739\|dbj\|BAG89589.1\| unnamed protein product [Oryza sativa Japonica Group] > gi\|218196167\|gb\|EEC78594.1\| hypothetical protein OsI_18612 [Oryza sativa Indica Group] > gi\|222630341\|gb\|EEE62473.1\| hypothetical protein OsJ_17270 [Oryza sativa Japonica Group] | 1.00 | 2351 | 2732 |
| | | BAB41206 | putative glucose-6-phosphate/phosphate-tranlocat or [Oryza sativa (japonica cultivar-group)] | 0.99 | 2352 | 2733 |
| | | ACN32013 | unknown [Zea mays] | 0.96 | 2353 | 2734 |
| | | XP_002440680 | hypothetical protein SORBIDRAFT_09g005010 [Sorghum bicolor] > gi\|241945965\|gb\|EES19110.1\| hypothetical protein SORBIDRAFT_09g005010 [Sorghum bicolor] | 0.96 | 2354 | 2735 |
| | | NP_001142411 | hypothetical protein LOC100274586 [Zea mays] > gi\|194707946\|gb\|ACF88057.1\| unknown [Zea mays] > gi\|194708688\|gb\|ACF88428.1\| unknown [Zea mays] > gi\|195620476\|gb\|ACG32068.1\| integral membrane protein like [Zea mays] | 0.95 | 2355 | 2736 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | BAK03308 | predicted protein [*Hordeum vulgare* subsp. *vulgare*] | 0.95 | 2356 | 2737 |
| | | NP_001148556 | integral membrane protein like [*Zea mays*] > gi|195620390|gb|ACG32025.1| integral membrane protein like [*Zea mays*] | 0.87 | 2357 | 2738 |
| | | NP_001042121 | Os01g0167500 [*Oryza sativa Japonica* Group] > gi|13486667|dbj|BAB39904.1| P0028E10.8 [*Oryza sativa Japonica* Group] > gi|15528768|dbj|BAB64810.1| putative glucose-6-phosphate/phosphate-tranlocator [*Oryza sativa Japonica* Group] > gi|20804811|dbj|BAB92494.1| putative glucose-6-phosphate/phosphate-tranlocator [*Oryza sativa Japonica* Group] > gi|113531652|dbj|BAF04035.1| Os01g0167500 [*Oryza sativa Japonica* Group] > gi|215767361|dbj|BAG99589.1| unnamed protein product [*Oryza sativa Japonica* Group] > gi|218187579|gb|EEC70006.1| hypothetical protein OsI_00550 [*Oryza sativa Indica* Group] > gi|222617800|gb|EEE53932.1| hypothetical protein OsJ_00515 [*Oryza sativa Japonica* Group] | 0.92 | 2358 | 2739 |
| | | NP_001142171 | hypothetical protein LOC100274338 [*Zea mays*] > gi|194707458|gb|ACF87813.1| unknown [*Zea mays*] | 0.93 | 2359 | 2740 |
| | | ACN34739 | unknown [*Zea mays*] | 0.92 | 2360 | 2741 |
| | 130-147 | XP_002448782 | hypothetical protein SORBIDRAFT_06g033075 [*Sorghum bicolor*] > gi|241939965|gb|EES13110.1| hypothetical protein SORBIDRAFT_06g033075 [*Sorghum bicolor*] | 1.00 | 2361 | 2742 |
| | | NP_001151057 | LOC100284690 [*Zea mays*] > gi|195643970|gb|ACG41453.1| ATP binding protein [*Zea mays*] | 0.92 | 2362 | 2743 |
| | | EAZ32429 | hypothetical protein OsJ_16639 [*Oryza sativa Japonica* Group] | 0.82 | 2363 | |
| | | NP_001054279 | Os04g0679200 [*Oryza sativa Japonica* Group] > gi|38344039|emb|CAE05726.2| OSJNBb0017I01.6 [*Oryza sativa Japonica* Group] > gi|113565850|dbj|BAF16193.1| Os04g0679200 [*Oryza sativa Japonica* Group] > gi|215712397|dbj|BAG94524.1| unnamed protein product [*Oryza sativa Japonica* Group] > gi|215740866|dbj|BAG97022.1| unnamed protein product [*Oryza sativa Japonica*Group] | 0.82 | 2364 | 2744 |
| | | CAJ86254 | H0801D08.12 [*Oryza sativa Indica* Group] > gi|125550244|gb|EAY96066.1| hypothetical protein OsI_17939 [*Oryza sativa Indica* Group] | 0.82 | 2365 | 2745 |
| | | BAJ93433 | predicted protein [*Hordeum vulgare* subsp. *vulgare*] | 0.80 | 2366 | 2746 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | 99-116 | XP_002452000 | hypothetical protein SORBIDRAFT_04g014390 [*Sorghum bicolor*] > gi\|241931831\|gb\|EES04976.1\| hypothetical protein SORBIDRAFT_04g014390 [*Sorghum bicolor*] | 1.00 | 2367 | 2747 |
| | | ACR36123 | unknown [*Zea mays*] | 0.93 | 2368 | 2748 |
| | | NP_001145206 | hypothetical protein LOC100278461 [*Zea mays*] > gi\|195652631\|gb\|ACG45783.1\| hypothetical protein [*Zea mays*] | 0.92 | 2369 | 2749 |
| | | NP_001046716 | Os02g0329300 [*Oryza sativa Japonica* Group] > gi\|46389946\|dbj\|BAD15798.1\| unknown protein [*Oryza sativa Japonica* Group] > gi\|113536247\|dbj\|BAF08630.1\| Os02g0329300 [*Oryza sativa Japonica* Group] > gi\|222622747\|gb\|EEE56879.1\| hypothetical protein OsJ_06518 [*Oryza sativa Japonica* Group] | 0.86 | 2370 | 2750 |
| | | EEC73063 | hypothetical protein OsI_07020 [*Oryza sativa Indica* Group] | 0.85 | 2371 | |
| | | BAK07073 | predicted protein [*Hordeum vulgare* subsp. *vulgare*] | 0.81 | 2372 | 2751 |
| | 736-753 | ACN28855 | unknown [*Zea mays*] | 1.00 | 2373 | 2752 |
| | | NP_001105875 | putative laccase [*Zea mays*] > gi\|84618781\|emb\|CAJ30500.1\| putative laccase [*Zea mays*] | 0.99 | 2374 | 2753 |
| | | NP_001146658 | hypothetical protein LOC100280258 [*Zea mays*] > gi\|219888209\|gb\|ACL54479.1\| unknown [*Zea mays*] | 0.93 | 2375 | 2754 |
| | | XP_002458746 | hypothetical protein SORBIDRAFT_03g039520 [*Sorghum bicolor*] > gi\|241930721\|gb\|EES03866.1\| hypothetical protein SORBIDRAFT_03g039520 [*Sorghum bicolor*] | 0.93 | 2376 | 2755 |
| | | NP_001044772 | Os01g0842400 [*Oryza sativa Japonica* Group] > gi\|75321217\|sp\|Q5N9X2.1\|LAC4_ORYSJ RecName: Full = Laccase-4; AltName: Full = Benzenediol:oxygen oxidoreductase 4; AltName: Full = Diphenol oxidase 4; AltName: Full = Urishiol oxidase 4; Flags: Precursor > gi\|56784239\|dbj\|BAD81734.1\| putative laccase LAC5-6 [*Oryza sativa Japonica* Group] > gi\|113534303\|dbj\|BAF06686.1\| Os01g0842400 [*Oryza sativa Japonica* Group] > gi\|215697155\|dbj\|BAG91149.1\| unnamed protein product [*Oryza sativa Japonica* Group] | 0.81 | 2377 | 2756 |
| | | EAZ14115 | hypothetical protein OsJ_04039 [*Oryza sativa Japonica* Group] | 0.81 | 2378 | |
| | | EEC71777 | hypothetical protein OsI_04389 [*Oryza sativa Indica* Group] | 0.80 | 2379 | |
| | | BAJ99773 | predicted protein [*Hordeum vulgare* subsp. *vulgare*] | 0.78 | 2380 | 2757 |
| | | XP_002458747 | hypothetical protein SORBIDRAFT_03g039530 [*Sorghum bicolor*] > gi\|241930722\|gb\|EES03867.1\| hypothetical protein | 0.78 | 2381 | 2758 |

TABLE 7-continued

Target genes of up regulated siRNA sequences associated with NUE (Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | | SORBIDRAFT_03g039530 [*Sorghum bicolor*] | | | |
| | | AAC04576 | putative high-pI laccase [*Oryza sativa Japonica* Group] | 0.79 | 2382 | 2759 |
| | 0-17 | NP_001132686 | hypothetical protein LOC100194164 [*Zea mays*] > gi|194695090|gb|ACF81629.1| unknown [*Zea mays*] | 1.00 | 2383 | 2760 |
| | | XP_002457397 | hypothetical protein SORBIDRAFT_03g006690 [*Sorghum bicolor*] > gi|241929372|gb|EES02517.1| hypothetical protein SORBIDRAFT_03g006690 [*Sorghum bicolor*] | 0.81 | 2384 | 2761 |
| | 1000-1017 | NP_001136742 | hypothetical protein LOC100216883 [*Zea mays*] > gi|194696868|gb|ACF82518.1| unknown [*Zea mays*] > gi|195648274|gb|ACG43605.1| monoglyceride lipase [*Zea mays*] | 1.00 | 2385 | 2762 |
| | | XP_002450081 | hypothetical protein SORBIDRAFT_05g000200 [*Sorghum bicolor*] > gi|241935924|gb|EES09069.1| hypothetical protein SORBIDRAFT_05g000200 [*Sorghum bicolor*] | 0.80 | 2386 | 2763 |
| | | XP_002442631 | hypothetical protein SORBIDRAFT_08g000200 [*Sorghum bicolor*] > gi|241943324|gb|EES16469.1| hypothetical protein SORBIDRAFT_08g000200 [*Sorghum bicolor*] | 0.80 | 2387 | 2764 |
| | 296-313 | XP_002440680 | hypothetical protein SORBIDRAFT_09g005010 [*Sorghum bicolor*] > gi|241945965|gb|EES19110.1| hypothetical protein SORBIDRAFT_09g005010 [*Sorghum bicolor*] | 1.00 | 2388 | 2765 |
| | | ACN32013 | unknown [*Zea mays*] | 0.99 | 2389 | 2766 |
| | | NP_001142411 | hypothetical protein LOC100274586 [*Zea mays*] > gi|194707946|gb|ACF88057.1| unknown [*Zea mays*] > gi|194708688|gb|ACF88428.1| unknown [*Zea mays*] > gi|195620476|gb|ACG32068.1| integral membrane protein like [*Zea mays*] | 0.98 | 2390 | 2767 |
| | | NP_001054756 | Os05g0168700 [*Oryza sativa Japonica* Group] > gi|53982148|gb|AAV25244.1| putative phosphate translocator [*Oryza sativa Japonica* Group] > gi|113578307|dbj|BAF16670.1| Os05g0168700 [*Oryza sativa Japonica* Group] > gi|215686739|dbj|BAG89589.1| unnamed protein product [*Oryza sativa Japonica* Group] > gi|218196167|gb|EEC78594.1| hypothetical protein OsI_18612 [*Oryza sativa Indica* Group] > gi|222630341|gb|EEE62473.1| hypothetical protein OsJ_17270 [*Oryza sativa Japonica* Group] | 0.96 | 2391 | 2768 |

TABLE 7-continued

Target genes of up regulated siRNA sequences associated with NUE (Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | BAB41206 | putative glucose-6-phosphate/phosphate-tranlocat or [*Oryza sativa* (*japonica* cultivar-group)] | 0.95 | 2392 | 2769 |
| | | BAK03308 | predicted protein [*Hordeum vulgare* subsp. *vulgare*] | 0.94 | 2393 | 2770 |
| | | NP_001148556 | integral membrane protein like [*Zea mays*] > gi|195620390|gb|ACG32025.1| integral membrane protein like [*Zea mays*] | 0.90 | 2394 | 2771 |
| | | NP_001042121 | Os01g0167500 [*Oryza sativa Japonica* Group] > gi|13486667|dbj|BAB39904.1| P0028E10.8 [*Oryza sativa Japonica* Group] > gi|15528768|dbj|BAB64810.1| putative glucose-6-phosphate/phosphate-tranlocator [*Oryza sativa Japonica* Group] > gi|20804811|dbj|BAB92494.1| putative glucose-6-phosphate/phosphate-tranlocator [*Oryza sativa Japonica* Group] > gi|113531652|dbj|BAF04035.1| Os01g0167500 [*Oryza sativa Japonica* Group] > gi|215767361|dbj|BAG99589.1| unnamed protein product [*Oryza sativa Japonica* Group] > gi|218187579|gb|EEC70006.1| hypothetical protein OsI_00550 [*Oryza sativa Indica* Group] > gi|222617800|gb|EEE53932.1| hypothetical protein OsJ_00515 [*Oryza sativa Japonica* Group] | 0.92 | 2395 | 2772 |
| | | NP_001142171 | hypothetical protein LOC100274338 [*Zea mays*] > gi|194707458|gb|ACF87813.1| unknown [*Zea mays*] | 0.92 | 2396 | 2773 |
| | | ACN34739 | unknown [*Zea mays*] | 0.91 | 2397 | 2774 |
| | 1638-1655 | NP_001183153 | hypothetical protein LOC100501523 [*Zea mays*] > gi|238009674|gb|ACR35872.1| unknown [*Zea mays*] | 1.00 | 2398 | 2775 |
| | 1133-1150 | NP_001146658 | hypothetical protein LOC100280258 [*Zea mays*] > gi|219888209|gb|ACL54479.1| unknown [*Zea mays*] | 1.00 | 2399 | 2776 |
| | | NP_001105875 | putative laccase [*Zea mays*] > gi|84618781|emb|CAJ30500.1| putative laccase [*Zea mays*] | 0.95 | 2400 | 2777 |
| | | ACN28855 | unknown [*Zea mays*] | 0.92 | 2401 | 2778 |
| | | XP_002458746 | hypothetical protein SORBIDRAFT_03g039520 [*Sorghum bicolor*] > gi|241930721|gb|EES03866.1| hypothetical protein SORBIDRAFT_03g039520 [*Sorghum bicolor*] | 0.91 | 2402 | 2779 |
| | | NP_001044772 | Os01g0842400 [*Oryza sativa Japonica* Group] > gi|75321217|sp|Q5N9X2.1|LAC4_ORYSJ RecName: Full = Laccase-4; AltName: Full = Benzenediol:oxygen oxidoreductase 4; AltName: Full = Diphenol oxidase 4; AltName: Full = Urishiol oxidase 4; Flags: Precursor > gi|56784239|dbj|BAD81734.1| putative laccase LAC5-6 | 0.80 | 2403 | 2780 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | | [Oryza sativa Japonica Group] > gi|113534303|dbj|BAF06686.1| Os01g0842400 [Oryza sativa Japonica Group] > gi|215697155|dbj|BAG91149.1| unnamed protein product [Oryza sativa Japonica Group] | | | |
| | | EAZ14115 | hypothetical protein OsJ_04039 [Oryza sativa Japonica Group] | 0.80 | 2404 | |
| | | EEC71777 | hypothetical protein OsI_04389 [Oryza sativa Indica Group] | 0.80 | 2405 | |
| | | BAJ99773 | predicted protein [Hordeum vulgare subsp. vulgare] | 0.78 | 2406 | 2781 |
| | | AAC04576 | putative high-pI laccase [Oryza sativa Japonica Group] | 0.78 | 2407 | 2782 |
| | | XP_002458747 | hypothetical protein SORBIDRAFT_03g039530 [Sorghum bicolor] > gi|241930722|gb|EES03867.1| hypothetical protein SORBIDRAFT_03g039530 [Sorghum bicolor] | 0.77 | 2408 | 2783 |
| | 574-591 | NP_001053823 | Os04g0609600 [Oryza sativa Japonica Group] > gi|122240832|sp|Q0JAA0.1|P2C44_ORYSJ RecName: Full = Probable protein phosphatase 2C 44; Short = OsPP2C44 > gi|113565394|dbj|BAF15737.1| Os04g0609600 [Oryza sativa Japonica Group] > gi|218195541|gb|EEC77968.1| hypothetical protein OsI_17335 [Oryza sativa Indica Group] > gi|222629521|gb|EEE61653.1| hypothetical protein OsJ_16105 [Oryza sativa Japonica Group] | 1.00 | 2409 | 2784 |
| | | CAE03557 | OSJNBa0085I10.2 [Oryza sativa Japonica Group] > gi|90265077|emb|CAH67750.1| H0702G05.9 [Oryza sativa Indica Group] | 0.99 | 2410 | 2785 |
| | | XP_002448500 | hypothetical protein SORBIDRAFT_06g028030 [Sorghum bicolor] > gi|241939683|gb|EES12828.1| hypothetical protein SORBIDRAFT_06g028030 [Sorghum bicolor] | 0.91 | 2411 | 2786 |
| | | NP_001148728 | protein phosphatase 2C [Zea mays] > gi|195621678|gb|ACG32669.1| protein phosphatase 2C [Zea mays] > gi|238007398|gb|ACR34734.1| unknown [Zea mays] | 0.90 | 2412 | 2787 |
| | | CAE03658 | OSJNBa0060N03.23 [Oryza sativa Japonica Group] | 0.74 | 2413 | 2788 |
| | | XP_002274944 | PREDICTED: hypothetical protein isoform 1 [Vitis vinifera] > gi|297745124|emb|CBI38963.3| unnamed protein product [Vitis vinifera] | 0.73 | 2414 | 2789 |
| | | XP_002514493 | protein phosphatase 2c, putative [Ricinus communis] > gi|223546392|gb|EEF47893.1| protein phosphatase 2c, putative [Ricinus communis] | 0.75 | 2415 | 2790 |
| | | XP_002274981 | PREDICTED: hypothetical protein isoform 2 [Vitis vinifera] | 0.70 | 2416 | 2791 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | 1034-1051 | NP_001170532 | hypothetical protein LOC100384546 [Zea mays] > gi|238005884|gb|ACR33977.1| unknown [Zea mays] | 1.00 | 2417 | 2792 |
| | | XP_002438672 | hypothetical protein SORBIDRAFT_10g024080 [Sorghum bicolor] > gi|241916895|gb|EER90039.1| hypothetical protein SORBIDRAFT_10g024080 [Sorghum bicolor] | 0.88 | 2418 | 2793 |
| | | EAZ01659 | hypothetical protein OsI_23694 [Oryza sativa Indica Group] | 0.72 | 2419 | |
| | | EAZ37629 | hypothetical protein OsJ_21963 [Oryza sativa Japonica Group] | 0.72 | 2420 | |
| | | BAD35523 | unknown protein [Oryza sativa Japonica Group] > gi|51090952|dbj|BAD35555.1| unknown protein [Oryza sativa Japonica Group] | 0.72 | 2421 | |
| | 1728-1745 | AAW66346 | YZ1 [Zea luxurians] | 1.00 | 2422 | 2794 |
| | | AAW66344 | YZ1 [Zea mays subsp. mexicana] | 0.99 | 2423 | 2795 |
| | | AAW66348 | YZ1 [Zea mays subsp. parviglumis] | 0.99 | 2424 | 2796 |
| | | AAM22634 | YZ1 [Zea mays] | 0.99 | 2425 | 2797 |
| | | AAM21160 | YZ1 [Zea mays] | 0.98 | 2426 | 2798 |
| | | ABB29302 | YZ1 [Zea mays] > gi|78172241|gb|ABB29304.1| YZ1 [Zea mays] | 0.91 | 2427 | 2799 |
| | | NP_001043656 | Os01g0633400 [Oryza sativa Japonica Group] > gi|55296003|dbj|BAD68894.1| putative YZ1 [Oryza sativa Japonica Group] > gi|113533187|dbj|BAF05570.1| Os01g0633400 [Oryza sativa Japonica Group] > gi|215766352|dbj|BAG98580.1| unnamed protein product [Oryza sativa Japonica Group] | 0.71 | 2428 | 2800 |
| | | XP_002456014 | hypothetical protein SORBIDRAFT_03g028870 [Sorghum bicolor] > gi|241927989|gb|EES01134.1| hypothetical protein SORBIDRAFT_03g028870 [Sorghum bicolor] | 0.77 | 2429 | 2801 |
| | | EAY75077 | hypothetical protein OsI_02971 [Oryza sativa Indica Group] | 0.71 | 2430 | |
| Predicted siRNA 59659 | 689-710 | XP_002443139 | hypothetical protein SORBIDRAFT_08g011100 [Sorghum bicolor] > gi|241943832|gb|EES16977.1| hypothetical protein SORBIDRAFT_08g011100 [Sorghum bicolor] | 1.00 | 2431 | 2802 |
| | | NP_001169596 | hypothetical protein LOC100383477 [Zea mays] > gi|224030279|gb|ACN34215.1| unknown [Zea mays] | 0.94 | 2432 | 2803 |
| | | NP_001066586 | Os12g0285600 [Oryza sativa Japonica Group] > gi|77554686|gb|ABA97482.1| Oxysterol-binding protein, expressed [Oryza sativa Japonica Group] | 0.83 | 2433 | 2804 |

TABLE 7-continued

Target genes of up regulated siRNA sequences associated with NUE
(Table 3)

| Mir name | Mir Bind. Pos. | Hom. NCBI Accession | Annotation/organism | Identity | p.p. SEQ ID NO: | p.n. SEQ ID NO: |
|---|---|---|---|---|---|---|
| | | | > gi|113649093|dbj|BAF29605.1| Os12g0285600 [*Oryza sativa Japonica* Group] > gi|215697261|dbj|BAG91255.1| unnamed protein product [*Oryza sativa Japonica* Group] > gi|222616918|gb|EEE53050.1| hypothetical protein OsJ_35782 [*Oryza sativa Japonica* Group] | | | |
| | | EEC69105 | hypothetical protein OsI_38013 [*Oryza sativa Indica* Group] | 0.81 | 2434 | |
| | | CBI16832 | unnamed protein product [*Vitis vinifera*] | 0.71 | 2435 | |
| | | XP_002282089 | PREDICTED: similar to oxysterol-binding family protein [*Vitis vinifera*] | 0.72 | 2436 | 2805 |

Table 7: Provided are the target Genes of siRNAs Associated with Increased NUE (Table 3) along with their GenBank Accession numbers and sequence identifiers (SEQ ID NO:).
"bind" = binding;
"pos" = position;
"hom" = homologue;
"p.p." = polypeptide;
"p.n." = polynucleotide.

TABLE 8

Target genes of down regulated siRNA sequences associated with NUE
(Table 4)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| Predicted siRNA 59123 | 61-79 | EEE65047 | hypothetical protein OsJ_20044 [*Oryza sativa Japonica* Group] | 1.00 | 2806 | |
| | | NP_001056727 | Os06g0136600 [*Oryza sativa Japonica* Group] > gi|55296986|dbj|BAD68461.1| putative enolase [*Oryza sativa Japonica* Group] > gi|55297212|dbj|BAD68886.1| putative enolase [*Oryza sativa Japonica* Group] > gi|113594767|dbj|BAF18641.1| Os06g0136600 [*Oryza sativa Japonica* Group] > gi|218197519|gb|EEC79946.1| hypothetical protein OsI_21538 [*Oryza sativa Indica* Group] | 0.97 | 2807 | 3082 |
| | | NP_001105896 | enolase 1 [*Zea mays*] > gi|119355|sp|P26301.1|ENO1_MAIZE RecName: Full = Enolase 1; AltName: Full = 2-phospho-D-glycerate hydro-lyase 1; AltName: Full = 2-phosphoglycerate dehydratase 1 > gi|22273|emb|CAA39454.1|enolase [*Zea mays*] | 0.92 | 2808 | 3083 |
| | | ACL53816 | unknown [*Zea mays*] | 0.92 | 2809 | 3084 |
| | | ACN26258 | unknown [*Zea mays*] | 0.88 | 2810 | 3085 |
| | | ACG31732 | enolase [*Zea mays*] | 0.87 | 2811 | 3086 |
| | | XP_002322420 | predicted protein [*Populus trichocarpa*] > gi|118484871|gb|ABK94302.1| unknown [*Populus trichocarpa*] > gi|222869416|gb|EEF06547.1| predicted protein [*Populus trichocarpa*] | 0.88 | 2812 | 3087 |
| | | NP_001105371 | enolase 2 [*Zea mays*] > gi|1169528|sp|P42895.1|ENO2_MAIZE RecName: Full = Enolase 2; AltName: Full = 2-phospho-D-glycerate hydro-lyase 2; AltName: Full = 2-phosphoglycerate dehydratase 2 | 0.87 | 2813 | 3088 |

TABLE 8-continued

Target genes of down regulated siRNA sequences associated with NUE
(Table 4)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | > gi|602253|gb|AAD04187.1|enolase [*Zea mays*] > gi|37222051|gb|AAQ17040.2|pollen 2-phosphoglycerate dehydrogenase 2 precursor [*Cynodon dactylon*] | | | |
| | | ACF06525 | enolase [*Elaeis guineensis*] | 0.87 | 2814 | 3089 |
| | | BAJ90134 | predicted protein [*Hordeum vulgare* subsp. *vulgare*] | 0.87 | 2815 | 3090 |
| | 45-63 | NP_001143947 | hypothetical protein LOC100276760 [*Zea mays*] > gi|195630673|gb|ACG36643.1| hypothetical protein [*Zea mays*] | 1.00 | 2816 | 3091 |
| | | ACR36446 | unknown [*Zea mays*] | 0.97 | 2817 | 3092 |
| | | NP_001143988 | hypothetical protein LOC100276806 [*Zea mays*] > gi|194707932|gb|ACF88050.1| unknown [*Zea mays*] > gi|195619872|gb|ACG31766.1| hypothetical protein [*Zea mays*] > gi|195634969|gb|ACG36953.1| hypothetical protein [*Zea mays*] | 0.79 | 2818 | 3093 |
| | | XP_002450179 | hypothetical protein SORBIDRAFT_05g001600 [*Sorghum bicolor*] > gi|241936022|gb|EES09167.1| hypothetical protein SORBIDRAFT_05g001600 [*Sorghum bicolor*] | 0.81 | 2819 | 3094 |
| | | NP_001065630 | Os11g0127700 [*Oryza sativa Japonica* Group] > gi|77548485|gb|ABA91282.1| expressed protein [*Oryza sativa Japonica* Group] > gi|113644334|dbj|BAF27475.1| Os11g0127700 [*Oryza sativa Japonica* Group] > gi|125576047|gb|EAZ17269.1| hypothetical protein OsJ_32788 [*Oryza sativa Japonica* Group] | 0.70 | 2820 | 3095 |
| | | EAY79782 | hypothetical protein OsI_34938 [*Oryza sativa Indica* Group] | 0.70 | 2821 | |
| | 2433-2451 | XP_002466271 | hypothetical protein SORBIDRAFT_01g004840 [*Sorghum bicolor*] > gi|241920125|gb|EER93269.1| hypothetical protein SORBIDRAFT_01g004840 [*Sorghum bicolor*] | 1.00 | 2822 | 3096 |
| | | NP_001145769 | hypothetical protein LOC100279276 [*Zea mays*] > gi|219884363|gb|ACL52556.1| unknown [*Zea mays*] | 0.98 | 2823 | 3097 |
| | | NP_001151633 | vacuolar protein sorting 35 [*Zea mays*] > gi|195648240|gb|ACG43588.1| vacuolar protein sorting 35 [*Zea mays*] | 0.98 | 2824 | 3098 |
| | | EAY92214 | hypothetical protein OsI_13933 [*Oryza sativa Indica* Group] | 0.95 | 2825 | |
| | | NP_001051593 | Os03g0801600 [*Oryza sativa Japonica* Group] > gi|29150373|gb|AAO72382.1| putative vacuolar protein sorting-associated protein [*Oryza sativa Japonica* Group] > gi|108711598|gb|ABF99393.1| vacuolar protein sorting-associated protein 35 family protein, putative, expressed [*Oryza sativa Japonica* Group] > gi|113550064|dbj|BAF13507.1| Os03g0801600 [*Oryza sativa Japonica* Group] > gi|125588278|gb|EAZ28942.1| hypothetical protein OsJ_12986 [*Oryza sativa Japonica* Group] > gi|215704706|dbj|BAG94334.1| unnamed protein product [*Oryza sativa Japonica* Group] | 0.95 | 2826 | 3099 |
| | | BAJ89592 | predicted protein [*Hordeum vulgare* subsp. *vulgare*] > gi|326488479|dbj|BAJ93908.1| predicted protein [*Hordeum vulgare* subsp. *vulgare*] | 0.95 | 2827 | 3100 |

TABLE 8-continued

Target genes of down regulated siRNA sequences associated with NUE
(Table 4)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | XP_002272227 | PREDICTED: hypothetical protein isoform 1 [*Vitis vinifera*] | 0.82 | 2828 | 3101 |
| | | XP_002272268 | PREDICTED: hypothetical protein isoform 2 [*Vitis vinifera*] | 0.81 | 2829 | 3102 |
| | | BAJ53108 | JHL20J20.15 [*Jatropha curcas*] | 0.79 | 2830 | |
| | | CBI17331 | unnamed protein product [*Vitis vinifera*] | 0.81 | 2831 | |
| | 20-38 | XP_002442446 | hypothetical protein SORBIDRAFT_08g020140 [*Sorghum bicolor*] > gi|241943139|gb|EES16284.1| hypothetical protein SORBIDRAFT_08g020140 [*Sorghum bicolor*] | 1.00 | 2832 | 3103 |
| | | ACF80272 | unknown [*Zea mays*] | 0.84 | 2833 | 3104 |
| | | NP_001141063 | hypothetical protein LOC100273144 [*Zea mays*] > gi|194702462|gb|ACF85315.1| unknown [*Zea mays*] | 0.84 | 2834 | 3105 |
| | | ACG44331 | hypothetical protein [*Zea mays*] | 0.84 | 2835 | 3106 |
| | | BAJ89075 | predicted protein [*Hordeum vulgare* subsp. *vulgare*] > gi|326533254|dbj|BAJ93599.1| predicted protein [*Hordeum vulgare* subsp. *vulgare*] | 0.70 | 2836 | 3107 |
| Predicted siRNA 57685 | 713-731 | CAI30078 | glycosyltransferase [*Sorghum bicolor*] | 1.00 | 2837 | 3108 |
| | | NP_001105165 | glycosyltransferase [*Zea mays*] > gi|56409864|emb|CAI30080.1| glycosyltransferase [*Zea mays*] | 0.96 | 2838 | 3109 |
| | | CAI30079 | glycosyltransferase [*Saccharum officinarum*] | 0.95 | 2839 | 3110 |
| | | BAJ96053 | predicted protein [*Hordeum vulgare* subsp. *vulgare*] | 0.81 | 2840 | 3111 |
| | | NP_001064930 | Os10g0492200 [*Oryza sativa Japonica* Group] > gi|10140717|gb|AAG13551.1|AC023240_24 unknown protein [*Oryza sativa Japonica* Group] > gi|31432816|gb|AAP54403.1| glycosyltransferase, putative, expressed [*Oryza sativa Japonica* Group] > gi|113639539|dbj|BAF26844.1| Os10g0492200 [*Oryza sativa Japonica* Group] > gi|215766456|dbj|BAG98764.1| unnamed protein product [*Oryza sativa Japonica* Group] > gi|222613059|gb|EEE51191.1| hypothetical protein OsJ_31998 [*Oryza sativa Japonica* Group] | 0.77 | 2841 | 3112 |
| | | EEC67226 | hypothetical protein OsI_34143 [*Oryza sativa Indica* Group] | 0.76 | 2842 | |
| | | CCA61105 | TaGT61_1 [*Triticum aestivum*] | 0.70 | 2843 | 3113 |
| | | BAK04539 | predicted protein [*Hordeum vulgare* subsp. *vulgare*] | 0.71 | 2844 | 3114 |
| | | NP_001046724 | Os02g0331200 [*Oryza sativa Japonica* Group] > gi|46390170|dbj|BAD15603.1| putative HGA1 [*Oryza sativa Japonica* Group] > gi|46390974|dbj|BAD16509.1| putative HGA1 [*Oryza sativa Japonica* Group] > gi|113536255|dbj|BAF08638.1| Os02g0331200 [*Oryza sativa Japonica* Group] > gi|215712340|dbj|BAG94467.1| unnamed protein product [*Oryza sativa Japonica* Group] > gi|215737036|dbj|BAG95965.1| unnamed protein product [*Oryza sativa Japonica* Group] | 0.71 | 2845 | 3115 |

TABLE 8-continued

Target genes of down regulated siRNA sequences associated with NUE
(Table 4)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | 344-362 | YP_588428 | hypothetical protein ZeamMp184 [*Zea mays* subsp. *mays*] > gi|40795041|gb|AAR91085.1| hypothetical protein [*Zea mays*] > gi|93116163|gb|ABE98794.1| hypothetical protein [*Zea mays* subsp. *mays*] > gi|102579667|gb|ABF70947.1| hypothetical protein [*Zea mays* subsp. *mays*] | 1.00 | 2846 | |
| | | ABE98707 | hypothetical protein [*Zea mays* subsp. *mays*] | 0.90 | 2847 | |
| | 1201-1219 | CAI30079 | glycosyltransferase [*Saccharum officinarum*] | 1.00 | 2848 | 3116 |
| | | NP_001105165 | glycosyltransferase [*Zea mays*] > gi|56409864|emb|CAI30080.1| glycosyltransferase [*Zea mays*] | 0.96 | 2849 | 3117 |
| | | CAI30078 | glycosyltransferase [*Sorghum bicolor*] | 0.97 | 2850 | 3118 |
| | | BAJ96053 | predicted protein [*Hordeum vulgare* subsp. *vulgare*] | 0.83 | 2851 | 3119 |
| | | NP_001064930 | Os10g0492200 [*Oryza sativa Japonica* Group] > gi|10140717|gb|AAG13551.1|AC023240_24 unknown protein [*Oryza sativa Japonica* Group] > gi|31432816|gb|AAP54403.1| glycosyltransferase, putative, expressed [*Oryza sativa Japonica* Group] > gi|113639539|dbj|BAF26844.1| Os10g0492200 [*Oryza sativa Japonica* Group] > gi|215766456|dbj|BAG98764.1| unnamed protein product [*Oryza sativa Japonica* Group] > gi|222613059|gb|EEE51191.1| hypothetical protein OsJ_31998 [*Oryza sativa Japonica* Group] | 0.77 | 2852 | 3120 |
| | | EEC67226 | hypothetical protein OsI_34143 [*Oryza sativa Indica* Group] | 0.78 | 2853 | |
| | | BAK04539 | predicted protein [*Hordeum vulgare* subsp. *vulgare*] | 0.71 | 2854 | 3121 |
| | | CCA61105 | TaGT61_1 [*Triticum aestivum*] | 0.70 | 2855 | 3122 |
| | | BAD15602 | putative HGA1 [*Oryza sativa Japonica* Group] > gi|46390975|dbj|BAD16510.1| putative HGA1 [*Oryza sativa Japonica* Group] > gi|215686668|dbj|BAG88921.1| unnamed protein product [*Oryza sativa Japonica* Group] | 0.71 | 2856 | |
| | | NP_001046724 | Os02g0331200 [*Oryza sativa Japonica* Group] > gi|46390170|dbj|BAD15603.1| putative HGA1 [*Oryza sativa Japonica* Group] > gi|46390974|dbj|BAD16509.1| putative HGA1 [*Oryza sativa Japonica* Group] > gi|113536255|dbj|BAF08638.1| Os02g0331200 [*Oryza sativa Japonica* Group] > gi|215712340|dbj|BAG94467.1| unnamed protein product [*Oryza sativa Japonica* Group] > gi|215737036|dbj|BAG95965.1| unnamed protein product [*Oryza sativa Japonica* Group] | 0.71 | 2857 | 3123 |
| Predicted siRNA 59993 | Jan-19 | XP_002440494 | hypothetical protein SORBIDRAFT_09g001910 [*Sorghum bicolor*] > gi|241945779|gb|EES18924.1| hypothetical protein SORBIDRAFT_09g001910 [*Sorghum bicolor*] | 1.00 | 2858 | 3124 |
| | | ACG27529 | splicing factor, arginine/serine-rich 7 [*Zea mays*] > gi|223973611|gb|ACN30993.1| unknown [*Zea mays*] | 0.87 | 2859 | 3125 |

TABLE 8-continued

Target genes of down regulated siRNA sequences associated with NUE
(Table 4)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | NP_001049771 | Os03g0285900 [*Oryza sativa Japonica* Group] > gi|108707560|gb|ABF95355.1| RNA recognition motif family protein, expressed [*Oryza sativa Japonica* Group] > gi|113548242|dbj|BAF11685.1| Os03g0285900 [*Oryza sativa Japonica* Group] > gi|222624706|gb|EEE58838.1| hypothetical protein OsJ_10413 [*Oryza sativa Japonica* Group] | 0.74 | 2860 | 3126 |
| | | EEC75006 | hypothetical protein OsI_11073 [*Oryza sativa Indica* Group] | 0.70 | 2861 | |
| | | NP_001132009 | hypothetical protein LOC100193414 [*Zea mays*] > gi|194693184|gb|ACF80676.1| unknown [*Zea mays*] | 0.72 | 2862 | 3127 |
| | | AAY84873 | alternative splicing regulator [*Triticum aestivum*] | 0.72 | 2863 | 3128 |
| | 14-32 | XP_002458875 | hypothetical protein SORBIDRAFT_03g041990 [*Sorghum bicolor*] > gi|241930850|gb|EES03995.1| hypothetical protein SORBIDRAFT_03g041990 [*Sorghum bicolor*] | 1.00 | 2864 | 3129 |
| | | NP_001142991 | hypothetical protein LOC100275452 [*Zea mays*] > gi|195612624|gb|ACG28142.1| hypothetical protein [*Zea mays*] | 0.92 | 2865 | 3130 |
| | | NP_001145171 | hypothetical protein LOC100278407 [*Zea mays*] > gi|195652179|gb|ACG45557.1| hypothetical protein [*Zea mays*] | 0.91 | 2866 | 3131 |
| | | ACF83626 | unknown [*Zea mays*] | 0.92 | 2867 | 3132 |
| | | EAZ14403 | hypothetical protein OsJ_04323 [*Oryza sativa Japonica* Group] | 0.89 | 2868 | |
| | | EAY76740 | hypothetical protein OsI_04696 [*Oryza sativa Indica* Group] | 0.90 | 2869 | |
| | | BAK00430 | predicted protein [*Hordeum vulgare* subsp. *vulgare*] | 0.84 | 2870 | 3133 |
| | 2352-2370 | NP_001067313 | Os12g0623900 [*Oryza sativa Japonica* Group] > gi|77556631|gb|ABA99427.1| 5-methyltetrahydropteroyltriglutamate-homocysteine methyltransferase, putative, expressed [*Oryza sativa Japonica* Group] > gi|108862991|gb|ABG22094.1|5-methyltetrahydropteroyltriglutamate-homocysteine methyltransferase, putative, expressed [*Oryza sativa Japonica* Group] > gi|113649820|dbj|BAF30332.1| Os12g0623900 [*Oryza sativa Japonica* Group] > gi|125537469|gb|EAY83957.1| hypothetical protein OsI_39179 [*Oryza sativa Indica* Group] > gi|125580128|gb|EAZ21274.1| hypothetical protein OsJ_36926 [*Oryza sativa Japonica* Group] | 1.00 | 2871 | 3134 |
| | | ABG22095 | 5-methyltetrahydropteroyltriglutamate-homocysteine methyltransferase, putative, expressed [*Oryza sativa Japonica* Group] > gi|108862993|gb|ABG22096.1|5-methyltetrahydropteroyltriglutamate-homocysteine methyltransferase, putative, expressed [*Oryza sativa Japonica* Group] | 0.99 | 2872 | |
| | | NP_001067314 | Os12g0624000 [*Oryza sativa Japonica* Group] > gi|77556632|gb|ABA99428.1| 5-methyltetrahydropteroyltriglutamate-homocysteine methyltransferase, putative, expressed [*Oryza sativa Japonica* Group] > gi|77556633|gb|ABA99429.1|5-methyltetrahydropteroyltriglutamate-homocysteine methyltransferase, putative, expressed [*Oryza sativa Japonica* Group] | 0.98 | 2873 | 3135 |

TABLE 8-continued

Target genes of down regulated siRNA sequences associated with NUE
(Table 4)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | > gi|113649821|dbj|BAF30333.1| Os12g0624000 [*Oryza sativa Japonica* Group] > gi|215695374|dbj|BAG90565.1| unnamed protein product [*Oryza sativa Japonica* Group] > gi|218187282|gb|EEC69709.1| hypothetical protein OsI_39180 [*Oryza sativa Indica* Group] > gi|222617511|gb|EEE53643.1| hypothetical protein OsJ_36927 [*Oryza sativa Japonica* Group] | | | |
| | | ACN28399 | unknown [*Zea mays*] | 0.95 | 2874 | 3136 |
| | | AAL33589 | methionine synthase [*Zea mays*] | 0.94 | 2875 | 3137 |
| | | ACL54117 | unknown [*Zea mays*] | 0.94 | 2876 | 3138 |
| | | NP_001152513 | LOC100286153 [*Zea mays*] > gi|195657041|gb|ACG47988.1|5-methyltetrahydropteroyltriglutamate--homocysteine methyltransferase [*Zea mays*] | 0.94 | 2877 | 3139 |
| | | CAJ01714 | methionine synthase 2 enzyme [*Hordeum vulgare* subsp. *vulgare*] > gi|326512178|dbj|BAJ96070.1| predicted protein [*Hordeum vulgare* subsp. *vulgare*] | 0.94 | 2878 | 3140 |
| | | BAJ89541 | predicted protein [*Hordeum vulgare* subsp. *vulgare*] | 0.94 | 2879 | 3141 |
| | | BAJ88127 | predicted protein [*Hordeum vulgare* subsp. *vulgare*] | 0.94 | 2880 | 3142 |
| | 121-139 | ACL52492 | unknown [*Zea mays*] | 1.00 | 2881 | 3143 |
| | | XP_002465926 | hypothetical protein SORBIDRAFT_01g048350 [*Sorghum bicolor*] > gi|241919780|gb|EER92924.1| hypothetical protein SORBIDRAFT_01g048350 [*Sorghum bicolor*] | 0.94 | 2882 | 3144 |
| | | NP_001048855 | Os03g0130500 [*Oryza sativa Japonica* Group] > gi|108706005|gb|ABF93800.1| EF hand family protein, expressed [*Oryza sativa Japonica* Group] > gi|113547326|dbj|BAF10769.1| Os03g0130500 [*Oryza sativa Japonica* Group] | 0.80 | 2883 | 3145 |
| | | EAZ25463 | hypothetical protein OsJ_09285 [*Oryza sativa Japonica* Group] | 0.79 | 2884 | |
| | | BAJ91192 | predicted protein [*Hordeum vulgare* subsp. *vulgare*] | 0.80 | 2885 | 3146 |
| | 49-67 | ACV84253 | LOX5 [*Sorghum bicolor*] | 1.00 | 2886 | 3147 |
| | | XP_002446554 | hypothetical protein SORBIDRAFT_06g018040 [*Sorghum bicolor*] > gi|241937737|gb|EES10882.1| hypothetical protein SORBIDRAFT_06g018040 [*Sorghum bicolor*] | 1.00 | 2887 | 3148 |
| | | ACL81190 | tasselseed 1 [*Zea mays*] | 0.95 | 2888 | 3149 |
| | | NP_001105979 | tassel seed1 [*Zea mays*] > gi|84626293|gb|ABC59691.1| lipoxygenase [*Zea mays*] | 0.95 | 2889 | |
| | | ACL81191 | tasselseed 1b [*Zea mays*] | 0.91 | 2890 | 3150 |
| | | NP_001105978 | lipoxygenase7 [*Zea mays*] > gi|84626291|gb|ABC59690.1| lipoxygenase [*Zea mays*] | 0.90 | 2891 | 3151 |
| | | Q7XV13 | RecName: Full = Putative lipoxygenase 5 > gi|38344820|emb|CAD40882.2| OSJNBa0064H22.1 [*Oryza sativa Japonica* Group] > gi|116310177|emb|CAH67189.1| OSIGBa0152K17.1 [*Oryza sativa Indica* Group] | 0.86 | 2892 | |

TABLE 8-continued

Target genes of down regulated siRNA sequences associated with NUE
(Table 4)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | BAJ94611 | predicted protein [*Hordeum vulgare* subsp. *vulgare*] > gi\|326511025\|dbj\|BAJ91860.1\| predicted protein [*Hordeum vulgare* subsp. *vulgare*] | 0.85 | 2893 | 3152 |
| | | CAI84707 | lipoxygenase-like protein [*Hordeum vulgare* subsp. *vulgare*] | 0.85 | 2894 | 3153 |
| | | BAK03423 | predicted protein [*Hordeum vulgare* subsp. *vulgare*] | 0.85 | 2895 | 3154 |
| | 117-135 | NP_001169757 | hypothetical protein LOC100383639 [*Zea mays*] > gi\|224031489\|gb\|ACN34820.1\| unknown [*Zea mays*] > gi\|238006168\|gb\|ACR34119.1\| unknown [*Zea mays*] | 1.00 | 2896 | 3155 |
| | | ACG49031 | ubiquinone biosynthesis methyltransferase COQ5 [*Zea mays*] | 0.99 | 2897 | 3156 |
| | | NP_001151844 | ubiquinone biosynthesis methyltransferase COQ5 [*Zea mays*] > gi\|195650199\|gb\|ACG44567.1\| ubiquinone biosynthesis methyltransferase COQ5 [*Zea mays*] | 0.93 | 2898 | 3157 |
| | | NP_001045568 | Os01g0976600 [*Oryza sativa Japonica* Group] > gi\|75320942\|sp\|Q5JNC0.1\|COQ5_ORYSJ RecName: Full = 2-methoxy-6-polyprenyl-1,4-benzoquinol methylase, mitochondrial; AltName: Full = Ubiquinone biosynthesis methyltransferase COQ5; Flags: Precursor > gi\|57899522\|dbj\|BAD87036.1\| putative ubiquinone [*Oryza sativa Japonica* Group] > gi\|113535099\|dbj\|BAF07482.1\| Os01g0976600 [*Oryza sativa Japonica* Group] > gi\|215706368\|dbj\|BAG93224.1\| unnamed protein product [*Oryza sativa Japonica* Group] > gi\|222619975\|gb\|EEE56107.1\| hypothetical protein OsJ_04965 [*Oryza sativa Japonica* Group] | 0.87 | 2899 | 3158 |
| | | EAY77437 | hypothetical protein OsI_05431 [*Oryza sativa Indica* Group] | 0.87 | 2900 | |
| | | BAJ89795 | predicted protein [*Hordeum vulgare* subsp. *vulgare*] | 0.78 | 2901 | 3159 |
| | | XP_002457083 | hypothetical protein SORBIDRAFT_03g000990 [*Sorghum bicolor*] > gi\|241929058\|gb\|EES02203.1\| hypothetical protein SORBIDRAFT_03g000990 [*Sorghum bicolor*] | 0.72 | 2902 | 3160 |
| | | XP_002324457 | predicted protein [*Populus trichocarpa*] > gi\|222865891\|gb\|EEF03022.1\| predicted protein [*Populus trichocarpa*] | 0.70 | 2903 | 3161 |
| | 656-674 | XP_002444158 | hypothetical protein SORBIDRAFT_07g010240 [*Sorghum bicolor*] > gi\|241940508\|gb\|EES13653.1\| hypothetical protein SORBIDRAFT_07g010240 [*Sorghum bicolor*] | 1.00 | 2904 | 3162 |
| | | NP_001168336 | hypothetical protein LOC100382104 [*Zea mays*] > gi\|223947549\|gb\|ACN27858.1\| unknown [*Zea mays*] | 0.85 | 2905 | 3163 |
| | | EAY97519 | hypothetical protein OsI_19447 [*Oryza sativa Indica* Group] > gi\|222631101\|gb\|EEE63233.1\| hypothetical protein OsJ_18043 [*Oryza sativa Japonica* Group] | 0.80 | 2906 | |
| | | BAJ96779 | predicted protein [*Hordeum vulgare* subsp. *vulgare*] | 0.78 | 2907 | 3164 |
| | | BAK02037 | predicted protein [*Hordeum vulgare* subsp. *vulgare*] | 0.78 | 2908 | 3165 |

TABLE 8-continued

Target genes of down regulated siRNA sequences associated with NUE
(Table 4)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | BAJ97459 | predicted protein [*Hordeum vulgare* subsp. *vulgare*] | 0.78 | 2909 | 3166 |
| | | AAV44115 | unknown protein [*Oryza sativa Japonica* Group] | 0.78 | 2910 | |
| | 668-686 | NP_001150708 | zinc finger, C2H2 type family protein [*Zea mays*] > gi\|195641252\|gb\|ACG40094.1\| zinc finger, C2H2 type family protein [*Zea mays*] | 1.00 | 2911 | 3167 |
| | | XP_002460014 | hypothetical protein SORBIDRAFT_02g020840 [*Sorghum bicolor*] > gi\|241923391\|gb\|EER96535.1\| hypothetical protein SORBIDRAFT_02g020840 [*Sorghum bicolor*] | 0.87 | 2912 | 3168 |
| | | NP_001150040 | zinc finger, C2H2 type family protein [*Zea mays*] > gi\|195636264\|gb\|ACG37600.1\| zinc finger, C2H2 type family protein [*Zea mays*] | 0.78 | 2913 | 3169 |
| | | BAK04496 | predicted protein [*Hordeum vulgare* subsp. *vulgare*] | 0.70 | 2914 | 3170 |
| | 524-542 | NP_001183648 | hypothetical protein LOC100502242 [*Zea mays*] > gi\|238013654\|gb\|ACR37862.1\| unknown [*Zea mays*] | 1.00 | 2915 | 3171 |
| | 660-678 | NP_001150040 | zinc finger, C2H2 type family protein [*Zea mays*] > gi\|195636264\|gb\|ACG37600.1\| zinc finger, C2H2 type family protein [*Zea mays*] | 1.00 | 2916 | 3172 |
| | | XP_002460014 | hypothetical protein SORBIDRAFT_02g020840 [*Sorghum bicolor*] > gi\|241923391\|gb\|EER96535.1\| hypothetical protein SORBIDRAFT_02g020840 [*Sorghum bicolor*] | 0.78 | 2917 | 3173 |
| | | NP_001150708 | zinc finger, C2H2 type family protein [*Zea mays*] > gi\|195641252\|gb\|ACG40094.1\| zinc finger, C2H2 type family protein [*Zea mays*] | 0.76 | 2918 | 3174 |
| | 433-451 | NP_001140599 | hypothetical protein LOC100272670 [*Zea mays*] > gi\|194700138\|gb\|ACF84153.1\| unknown [*Zea mays*] | 1.00 | 2919 | 3175 |
| | 277-295 | XP_002468199 | hypothetical protein SORBIDRAFT_01g041550 [*Sorghum bicolor*] > gi\|241922053\|gb\|EER95197.1\| hypothetical protein SORBIDRAFT_01g041550 [*Sorghum bicolor*] | 1.00 | 2920 | 3176 |
| | | NP_001140579 | hypothetical protein LOC100272649 [*Zea mays*] > gi\|194700056\|gb\|ACF84112.1\| unknown [*Zea mays*] | 0.88 | 2921 | 3177 |
| | | ACG35337 | purple acid phosphatase 1 [*Zea mays*] | 0.84 | 2922 | 3178 |
| | | NP_001049500 | Os03g0238600 [*Oryza sativa Japonica* Group] > gi\|108707073\|gb\|ABF94868.1\| purple acid phosphatase 1, putative, expressed [*Oryza sativa Japonica* Group] > gi\|113547971\|dbj\|BAF11414.1\| Os03g0238600 [*Oryza sativa Japonica* Group] > gi\|125543049\|gb\|EAY89188.1\| hypothetical protein OsI_10684 [*Oryza sativa Indica* Group] > gi\|125585546\|gb\|EAZ26210.1\| hypothetical protein OsJ_10077 [*Oryza sativa Japonica* Group] > gi\|215697901\|dbj\|BAG92094.1\| unnamed protein product [*Oryza sativa* | 0.78 | 2923 | 3179 |

TABLE 8-continued

Target genes of down regulated siRNA sequences associated with NUE
(Table 4)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | *Japonica* Group]<br>> gi|215737711|dbj|BAG96841.1| unnamed protein product [*Oryza sativa Japonica* Group]<br>> gi|215740770|dbj|BAG96926.1| unnamed protein product [*Oryza sativa Japonica* Group]<br>> gi|215767489|dbj|BAG99717.1| unnamed protein product [*Oryza sativa Japonica* Group] | | | |
| | | NP_001151094 | LOC100284727 [*Zea mays*]<br>> gi|195644254|gb|ACG41595.1|purple acid phosphatase 1 [*Zea mays*] | 0.75 | 2924 | 3180 |
| | | ACF83217 | unknown [*Zea mays*] | 0.74 | 2925 | 3181 |
| | | ACN25848 | unknown [*Zea mays*] | 0.74 | 2926 | 3182 |
| | | ACL54336 | unknown [*Zea mays*] | 0.74 | 2927 | 3183 |
| | | BAI78301 | purple acid phosphatase [*Triticum aestivum*] | 0.72 | 2928 | 3184 |
| | | BAK06221 | predicted protein [*Hordeum vulgare* subsp. *vulgare*]<br>> gi|326500986|dbj|BAJ98724.1| predicted protein [*Hordeum vulgare* subsp. *vulgare*]<br>> gi|326530618|dbj|BAK01107.1| predicted protein [*Hordeum vulgare* subsp. *vulgare*] | 0.73 | 2929 | 3185 |
| | 121-139 | XP_002465926 | hypothetical protein SORBIDRAFT_01g048350 [*Sorghum bicolor*]<br>> gi|241919780|gb|EER92924.1| hypothetical protein SORBIDRAFT_01g048350 [*Sorghum bicolor*] | 1.00 | 2930 | 3186 |
| | | ACL52492 | unknown [*Zea mays*] | 0.94 | 2931 | 3187 |
| | | NP_001048855 | Os03g0130500 [*Oryza sativa Japonica* Group] > gi|108706005|gb|ABF93800.1| EF hand family protein, expressed [*Oryza sativa Japonica* Group]<br>> gi|113547326|dbj|BAF10769.1| Os03g0130500 [*Oryza sativa Japonica* Group] | 0.82 | 2932 | 3188 |
| | | EAZ25463 | hypothetical protein OsJ_09285 [*Oryza sativa Japonica* Group] | 0.80 | 2933 | |
| | | BAJ91192 | predicted protein [*Hordeum vulgare* subsp. *vulgare*] | 0.81 | 2934 | 3189 |
| | 2507-2525 | XP_002454851 | hypothetical protein SORBIDRAFT_04g038540 [*Sorghum bicolor*] > gi|241934682|gb|EES07827.1| hypothetical protein SORBIDRAFT_04g038540 [*Sorghum bicolor*] | 1.00 | 2935 | 3190 |
| | | NP_001183894 | hypothetical protein LOC100502487 [*Zea mays*] > gi|238015298|gb|ACR38684.1| unknown [*Zea mays*] | 0.90 | 2936 | 3191 |
| | | BAJ86117 | predicted protein [*Hordeum vulgare* subsp. *vulgare*]<br>> gi|326521078|dbj|BAJ96742.1| predicted protein [*Hordeum vulgare* subsp. *vulgare*] | 0.76 | 2937 | 3192 |
| | | NP_001050813 | Os03g0657100 [*Oryza sativa Japonica* Group] > gi|108710182|gb|ABF97977.1| U-box domain containing protein, expressed [*Oryza sativa Japonica* Group] > gi|113549284|dbj|BAF12727.1| Os03g0657100 [*Oryza sativa Japonica* Group] > gi|218193430|gb|EEC75857.1| hypothetical protein OsI_12864 [*Oryza sativa Indica* Group] | 0.70 | 2938 | 3193 |
| | | AAP50990 | unknown protein [*Oryza sativa Japonica* Group] | 0.70 | 2939 | 3194 |

TABLE 8-continued

Target genes of down regulated siRNA sequences associated with NUE
(Table 4)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | 746-764 | NP_001140297 | hypothetical protein LOC100272342 [*Zea mays*] > gi\|194698890\|gb\|ACF83529.1\| unknown [*Zea mays*] | 1.00 | 2940 | 3195 |
| | 49-67 | NP_001105978 | lipoxygenase7 [*Zea mays*] > gi\|84626291\|gb\|ABC59690.1\| lipoxygenase [*Zea mays*] | 1.00 | 2941 | 3196 |
| | | ACL81191 | tasselseed 1b [*Zea mays*] | 0.98 | 2942 | 3197 |
| | | XP_002446554 | hypothetical protein SORBIDRAFT_06g018040 [*Sorghum bicolor*] > gi\|241937737\|gb\|EES10882.1\| hypothetical protein SORBIDRAFT_06g018040 [*Sorghum bicolor*] | 0.91 | 2943 | 3198 |
| | | ACV84253 | LOX5 [Sorghum *bicolor*] | 0.90 | 2944 | 3199 |
| | | NP_001105979 | tassel seed1 [*Zea mays*] > gi\|84626293\|gb\|ABC59691.1\| lipoxygenase [*Zea mays*] | 0.91 | 2945 | 3200 |
| | | ACL81190 | tasselseed 1 [*Zea mays*] | 0.90 | 2946 | 3201 |
| | | Q7XV13 | RecName: Full = Putative lipoxygenase 5 > gi\|38344820\|emb\|CAD40882.2\| OSJNBa0064H22.1 [*Oryza sativa Japonica* Group] > gi\|116310177\|emb\|CAH67189.1\| OSIGBa0152K17.1 [*Oryza sativa Indica* Group] | 0.83 | 2947 | |
| | | CAI84707 | lipoxygenase-like protein [*Hordeum vulgare* subsp. *vulgare*] | 0.82 | 2948 | 3202 |
| | | BAJ94611 | predicted protein [*Hordeum vulgare* subsp. *vulgare*] > gi\|326511025\|dbj\|BAJ91860.1\| predicted protein [*Hordeum vulgare* subsp. *vulgare*] | 0.82 | 2949 | 3203 |
| | | BAK03423 | predicted protein [*Hordeum vulgare* subsp. *vulgare*] | 0.82 | 2950 | 3204 |
| Predicted siRNA 60012 | 256-274 | XP_002461947 | hypothetical protein SORBIDRAFT_02g011010 [*Sorghum bicolor*] > gi\|241925324\|gb\|EER98468.1\| hypothetical protein SORBIDRAFT_02g011010 [*Sorghum bicolor*] | 1.00 | 2951 | 3205 |
| | 948-966 | XP_002457764 | hypothetical protein SORBIDRAFT_03g013140 [*Sorghum bicolor*] > gi\|241929739\|gb\|EES02884.1\| hypothetical protein SORBIDRAFT_03g013140 [*Sorghum bicolor*] | 1.00 | 2952 | 3206 |
| | | ACF87582 | unknown [*Zea mays*] | 0.93 | 2953 | 3207 |
| | | NP_001105753 | Pti1 protein [*Zea mays*] > gi\|49188602\|gb\|AAT57904.1\|putative PTI1-like kinase [*Zea mays*] | 0.92 | 2954 | 3208 |
| | | AAT57905 | putative PTI1-like kinase [*Zea mays*] | 0.92 | 2955 | 3209 |
| | | AAT57906 | putative PTI1-like kinase [*Zea mays*] | 0.93 | 2956 | 3210 |
| | | EAY73772 | hypothetical protein OsI_01646 [*Oryza sativa Indica* Group] | 0.81 | 2957 | |
| | | NP_001042895 | Os01g0323100 [*Oryza sativa Japonica* Group] > gi\|12328582\|dbj\|BAB21241.1\| putative Pto kinase interactor 1 [*Oryza sativa Japonica* Group] > gi\|29027802\|dbj\|BAC65877.1\| putative Pto kinase interactor 1 [*Oryza sativa Japonica* Group] > gi\|113532426\|dbj\|BAF04809.1\| Os01g0323100 [*Oryza sativa Japonica* Group] > gi\|125570160\|gb\|EAZ11675.1\| hypothetical protein OsJ_01536 [*Oryza sativa Japonica* Group] > gi\|215694472\|dbj\|BAG89427.1\| unnamed protein product [*Oryza sativa Japonica* Group] | 0.81 | 2958 | 3211 |

TABLE 8-continued

Target genes of down regulated siRNA sequences associated with NUE
(Table 4)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | 1207-1225 | XP_002451738 | hypothetical protein SORBIDRAFT_04g006950 [*Sorghum bicolor*] > gi|241931569|gb|EES04714.1| hypothetical protein SORBIDRAFT_04g006950 [*Sorghum bicolor*] | 1.00 | 2959 | 3212 |
| | | ACG38564 | cerebral protein 1 [*Zea mays*] > gi|238015424|gb|ACR38747.1| unknown [*Zea mays*] | 0.96 | 2960 | 3213 |
| | | NP_001047303 | Os02g0593900 [*Oryza sativa Japonica* Group] > gi|113536834|dbj|BAF09217.1| Os02g0593900 [*Oryza sativa Japonica* Group] > gi|125540112|gb|EAY86507.1| hypothetical protein OsI_07887 [*Oryza sativa Indica* Group] > gi|125582717|gb|EAZ23648.1| hypothetical protein OsJ_07349 [*Oryza sativa Japonica* Group] | 0.70 | 2961 | 3214 |
| | 67-85 | XP_002449762 | hypothetical protein SORBIDRAFT_05g022780 [*Sorghum bicolor*] > gi|241935605|gb|EES08750.1| hypothetical protein SORBIDRAFT_05g022780 [*Sorghum bicolor*] | 1.00 | 2962 | 3215 |
| | | ABA94447 | ETO1-like protein 1, putative, expressed [*Oryza sativa Japonica* Group] > gi|125577639|gb|EAZ18861.1| hypothetical protein OsJ_34400 [*Oryza sativa Japonica* Group] | 0.93 | 2963 | 3216 |
| | | EAY81449 | hypothetical protein OsI_36620 [*Oryza sativa Indica* Group] | 0.93 | 2964 | |
| | | NP_001068166 | Os11g0585900 [*Oryza sativa Japonica* Group] > gi|113645388|dbj|BAF28529.1| Os11g0585900 [*Oryza sativa Japonica* Group] | 0.90 | 2965 | 3217 |
| | | NP_001146335 | hypothetical protein LOC100279911 [*Zea mays*] > gi|219886675|gb|ACL53712.1| unknown [*Zea mays*] | 0.91 | 2966 | 3218 |
| | | CBI25039 | unnamed protein product [*Vitis vinifera*] | 0.73 | 2967 | |
| | | XP_002280519 | PREDICTED: hypothetical protein [*Vitis vinifera*] | 0.72 | 2968 | 3219 |
| | | AAZ08351 | ethylene overproducer-like 1 [*Solanum lycopersicum*] | 0.71 | 2969 | 3220 |
| | | ABB46489 | ethylene-overproducer1-like protein [*Solanum lycopersicum*] | 0.71 | 2970 | 3221 |
| Predicted siRNA 55081 | 358-381 | XP_002466013 | hypothetical protein SORBIDRAFT_01g050070 [*Sorghum bicolor*] > gi|241919867|gb|EER93011.1| hypothetical protein SORBIDRAFT_01g050070 [*Sorghum bicolor*] | 1.00 | 2971 | 3222 |
| | | NP_001132709 | hypothetical protein LOC100194192 [*Zea mays*] > gi|194695168|gb|ACF81668.1| unknown [*Zea mays*] | 0.77 | 2972 | 3223 |
| | | NP_001148998 | xyloglucan endotransglucosylase/hydrolase protein 32 [*Zea mays*] > gi|195623856|gb|ACG33758.1| xyloglucan endotransglucosylase/hydrolase protein 32 precursor [*Zea mays*] | 0.76 | 2973 | 3224 |
| Predicted siRNA 59032 | 364-382 | XP_002439498 | hypothetical protein SORBIDRAFT_09g008130 [*Sorghum bicolor*] > gi|241944783|gb|EES17928.1| hypothetical protein SORBIDRAFT_09g008130 [*Sorghum bicolor*] | 1.00 | 2974 | 3225 |
| | | NP_001141460 | hypothetical protein LOC100273570 [*Zea mays*] > gi|194704658|gb|ACF86413.1| unknown [*Zea mays*] > gi|195620084|gb|ACG31872.1|triose | 0.88 | 2975 | 3226 |

TABLE 8-continued

Target genes of down regulated siRNA sequences associated with NUE
(Table 4)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | phosphate/phosphate translocator [*Zea mays*] > gi|195625418|gb|ACG34539.1| triose phosphate/phosphate translocator [*Zea mays*] | | | |
| | | ACG32515 | triose phosphate/phosphate translocator [*Zea mays*] | 0.88 | 2976 | 3227 |
| | | NP_001055001 | Os05g0241200 [*Oryza sativa Japonica* Group] > gi|53980843|gb|AAV24764.1| putative phosphate translocator [*Oryza sativa Japonica* Group] > gi|113578552|dbj|BAF16915.1| Os05g0241200 [*Oryza sativa Japonica* Group] > gi|125551487|gb|EAY97196.1| hypothetical protein OsI_19118 [*Oryza sativa Indica* Group] > gi|215765430|dbj|BAG87127.1| unnamed protein product [*Oryza sativa Japonica* Group] | 0.75 | 2977 | 3228 |
| | | BAJ94007 | predicted protein [*Hordeum vulgare* subsp. *vulgare*] | 0.73 | 2978 | 3229 |
| | 225-243 | NP_001168807 | hypothetical protein LOC100382608 [*Zea mays*] > gi|223973113|gb|ACN30744.1| unknown [*Zea mays*] | 1.00 | 2979 | 3230 |
| Predicted siRNA 58721 | 227-245 | XP_002447337 | hypothetical protein SORBIDRAFT_06g033160 [*Sorghum bicolor*] > gi|241938520|gb|EES11665.1| hypothetical protein SORBIDRAFT_06g033160 [*Sorghum bicolor*] | 1.00 | 2980 | 3231 |
| | | NP_001142056 | hypothetical protein LOC100274212 [*Zea mays*] > gi|194706940|gb|ACF87554.1| unknown [*Zea mays*] > gi|223947485|gb|ACN27826.1| unknown [*Zea mays*] | 0.96 | 2981 | 3232 |
| | | ACG45259 | hypothetical protein [*Zea mays*] | 0.96 | 2982 | 3233 |
| | | EEC78262 | hypothetical protein OsI_17948 [*Oryza sativa Indica* Group] | 0.86 | 2983 | |
| | | EEE61915 | hypothetical protein OsJ_16648 [*Oryza sativa Japonica* Group] | 0.86 | 2984 | |
| | | BAJ96591 | predicted protein [*Hordeum vulgare* subsp. *vulgare*] | 0.86 | 2985 | 3234 |
| | | CAJ86266 | H0901F07.3 [*Oryza sativa Indica* Group] | 0.76 | 2986 | 3235 |
| | 614-632 | NP_001183362 | hypothetical protein LOC100501771 [*Zea mays*] > gi|238011008|gb|ACR36539.1| unknown [*Zea mays*] | 1.00 | 2987 | 3236 |
| | | XP_002453714 | hypothetical protein SORBIDRAFT_04g011130 [*Sorghum bicolor*] > gi|241933545|gb|EES06690.1| hypothetical protein SORBIDRAFT_04g011130 [*Sorghum bicolor*] | 0.92 | 2988 | 3237 |
| | | BAJ91736 | predicted protein [*Hordeum vulgare* subsp. *vulgare*] | 0.80 | 2989 | 3238 |
| | | NP_001043916 | Os01g0687800 [*Oryza sativa Japonica* Group] > gi|18844891|dbj|BAB85360.1| FAD binding domain containing protein-like [*Oryza sativa Japonica* Group] > gi|113533447|dbj|BAF05830.1| Os01g0687800 [*Oryza sativa Japonica* Group] | 0.76 | 2990 | 3239 |
| | | EAY75418 | hypothetical protein OsI_03321 [*Oryza sativa Indica* Group] | 0.75 | 2991 | |
| | 361-379 | XP_002441149 | hypothetical protein SORBIDRAFT_09g021260 [*Sorghum bicolor*] > gi|241946434|gb|EES19579.1| hypothetical protein SORBIDRAFT_09g021260 [*Sorghum bicolor*] | 1.00 | 2992 | 3240 |

TABLE 8-continued

Target genes of down regulated siRNA sequences associated with NUE
(Table 4)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | NP_001152458 | phosphoribosylanthranilate transferase [*Zea mays*] > gi|195656517|gb|ACG47726.1| phosphoribosylanthranilate transferase [*Zea mays*] | 0.97 | 2993 | 3241 |
| | | BAK04138 | predicted protein [*Hordeum vulgare* subsp. *vulgare*] | 0.89 | 2994 | 3242 |
| | | EEC79273 | hypothetical protein OsI_20060 [*Oryza sativa Indica* Group] | 0.90 | 2995 | |
| | | NP_001055620 | Os05g0429700 [*Oryza sativa Japonica* Group] > gi|55733914|gb|AAV59421.1| putative anthranilate phosphoribosyltransferase [*Oryza sativa Japonica* Group] > gi|113579171|dbj|BAF17534.1| Os05g0429700 [*Oryza sativa Japonica* Group] > gi|215737213|dbj|BAG96142.1| unnamed protein product [*Oryza sativa Japonica* Group] > gi|222631675|gb|EEE63807.1| hypothetical protein OsJ_18631 [*Oryza sativa Japonica* Group] | 0.90 | 2996 | 3243 |
| | 149-167 | XP_002454239 | hypothetical protein SORBIDRAFT_04g027330 [*Sorghum bicolor*] > gi|241934070|gb|EES07215.1| hypothetical protein SORBIDRAFT_04g027330 [*Sorghum bicolor*] | 1.00 | 2997 | 3244 |
| | | ACG32582 | heat shock 22 kDa protein [*Zea mays*] | 0.88 | 2998 | 3245 |
| | | NP_001105607 | low molecular weight heat shock protein precursor [*Zea mays*] > gi|3015621|gb|AAC12279.1|low molecular weight heat shock protein precursor [*Zea mays*] > gi|54299342|gb|AAV32521.1| mitochondrial small heat shock protein 22 [*Zea mays*] > gi|195622718|gb|ACG33189.1|heat shock 22 kDa protein [*Zea mays*] | 0.88 | 2999 | 3246 |
| | | ACF84470 | unknown [*Zea mays*] | 0.87 | 3000 | 3247 |
| | | NP_01048175 | Os02g0758000 [*Oryza sativa Japonica* Group] > gi|75294195|sp|Q6Z7V2.1|HS24M_ORYSJ RecName: Full = 24.1 kDa heat shock protein, mitochondrial; Short = OsHsp24.1; Flags: Precursor > gi|46805691|dbj|BAD17092.1| putative low molecular weight heat shock protein [*Oryza sativa Japonica* Group] > gi|113537706|dbj|BAF10089.1| Os02g0758000 [*Oryza sativa Japonica* Group] > gi|125541201|gb|EAY87596.1| hypothetical protein OsI_09007 [*Oryza sativa Indica* Group] > gi|125583753|gb|EAZ24684.1| hypothetical protein OsJ_08454 [*Oryza sativa Japonica* Group] > gi|215693891|dbj|BAG89090.1| unnamed protein product [*Oryza sativa Japonica* Group] > gi|215704321|dbj|BAG93755.1| unnamed protein product [*Oryza sativa Japonica* Group] > gi|215740605|dbj|BAG97261.1| unnamed protein product [*Oryza sativa Japonica* Group] > gi|313575793|gb|ADR66976.1|22 kDa heat shock protein [*Oryza sativa* | 0.80 | 3001 | 3248 |

TABLE 8-continued

Target genes of down regulated siRNA sequences associated with NUE
(Table 4)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | 270-288 | XP_02444207 | *Japonica* Group]<br>> gi\|332691639\|gb\|AEE90022.1\|<br>mitochondrial small heat shock protein<br>[*Oryza sativa Japonica* Group]<br>hypothetical protein<br>SORBIDRAFT_07g014990 [*Sorghum bicolor*] > gi\|241940557\|gb\|EES13702.1\|<br>hypothetical protein<br>SORBIDRAFT_07g014990 [*Sorghum bicolor*] | 1.00 | 3002 | 3249 |
| | | NP_001145845 | hypothetical protein LOC100279356 [*Zea mays*] > gi\|219884681\|gb\|ACL52715.1\|<br>unknown [*Zea mays*] | 0.91 | 3003 | 3250 |
| | | NP_001061645 | Os08g0365900 [*Oryza sativa Japonica* Group] > gi\|38636850\|dbj\|BAD03090.1\|<br>putative nucleolar protein [*Oryza sativa Japonica* Group]<br>> gi\|113623614\|dbj\|BAF23559.1\|<br>Os08g0365900 [*Oryza sativa Japonica* Group]<br>> gi\|215717005\|dbj\|BAG95368.1\|<br>unnamed protein product [*Oryza sativa Japonica* Group]<br>> gi\|222640447\|gb\|EEE68579.1\|<br>hypothetical protein OsJ_27075 [*Oryza sativa Japonica* Group] | 0.77 | 3004 | 3251 |
| 40959 | 436-454 | NP_001147431 | Redundant master homologue-skipping aconitase2 [*Zea mays*]<br>> gi\|195611330\|gb\|ACG27495.1\|<br>aconitate hydratase, cytoplasmic [*Zea mays*] > gi\|223948253\|gb\|ACN28210.1\|<br>unknown [*Zea mays*] | 1.00 | 3005 | 3252 |
| | | XP_002445174 | hypothetical protein<br>SORBIDRAFT_07g005390 [*Sorghum bicolor*] > gi\|241941524\|gb\|EES14669.1\|<br>hypothetical protein<br>SORBIDRAFT_07g005390 [*Sorghum bicolor*] | 0.78 | 3006 | 3253 |
| | | Q6YZX6 | RecName: Full = Putative aconitate hydratase, cytoplasmic; Short = Aconitase; AltName: Full = Citrate hydro-lyase<br>> gi\|40253814\|dbj\|BAD05751.1\|<br>putative Aconitate hydratase [*Oryza sativa Japonica* Group] | 0.77 | 3007 | |
| | | BAJ85661 | predicted protein [*Hordeum vulgare* subsp. *vulgare*] | 0.76 | 3008 | 3254 |
| | | CBE71057 | aconitate hydratase 3 [*Citrus clementina*] | 0.75 | 3009 | 3255 |
| | | ADZ57218 | aconitase protein [*Litchi chinensis*] | 0.74 | 3010 | 3256 |
| | | XP_002524184 | aconitase, putative [*Ricinus communis*]<br>> gi\|223536553\|gb\|EEF38199.1\|<br>aconitase, putative [*Ricinus communis*] | 0.74 | 3011 | 3257 |
| | | XP_002278138 | PREDICTED: hypothetical protein [*Vitis vinifera*]<br>> gi\|297737441\|emb\|CBI26642.3\|<br>unnamed protein product [*Vitis vinifera*] | 0.74 | 3012 | 3258 |
| | | P49608 | RecName: Full = Aconitate hydratase, cytoplasmic; Short = Aconitase; AltName: Full = Citrate hydro-lyase<br>> gi\|7437043\|pir\|\|T10101 aconitate hydratase (EC 4.2.1.3) - cucurbit<br>> gi\|868003\|dbj\|BAA06108.1\|aconitase [*Cucurbita* cv. Kurokawa Amakuri] | 0.75 | 3013 | |
| | | CBE71058 | aconitate hydratase 2 [*Citrus clementina*] | 0.74 | 3014 | 3259 |
| | 529-547 | XP_002453714 | hypothetical protein<br>SORBIDRAFT_04g011130 [*Sorghum bicolor*] > gi\|241933545\|gb\|EES06690.1\|<br>hypothetical protein<br>SORBIDRAFT_04g011130 [*Sorghum bicolor*] | 1.00 | 3015 | 3260 |
| | | NP_001183362 | hypothetical protein LOC100501771 [*Zea mays*] > gi\|238011008\|gb\|ACR36539.1\|<br>unknown [*Zea mays*] | 0.85 | 3016 | 3261 |

TABLE 8-continued

Target genes of down regulated siRNA sequences associated with NUE
(Table 4)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | BAJ91736 | predicted protein [*Hordeum vulgare* subsp. *vulgare*] | 0.80 | 3017 | 3262 |
| | | NP_001043916 | Os01g0687800 [*Oryza sativa Japonica* Group] > gi\|18844891\|dbj\|BAB85360.1\| FAD binding domain containing protein-like [*Oryza sativa Japonica* Group] > gi\|113533447\|dbj\|BAF05830.1\| Os01g0687800 [*Oryza sativa Japonica* Group] | 0.76 | 3018 | 3263 |
| | | EAY75418 | hypothetical protein OsI_03321 [*Oryza sativa Indica* Group] | 0.75 | 3019 | |
| Predicted siRNA 58877 | 254-273 | XP_002489117 | hypothetical protein SORBIDRAFT_0057s002150 [*Sorghum bicolor*] > gi\|241947368\|gb\|EES20513.1\| hypothetical protein SORBIDRAFT_0057s002150 [*Sorghum bicolor*] | 1.00 | 3020 | 3264 |
| | | XP_002488963 | hypothetical protein SORBIDRAFT_1150s002010 [*Sorghum bicolor*] > gi\|241946997\|gb\|EES20142.1\| hypothetical protein SORBIDRAFT_1150s002010 [*Sorghum bicolor*] | 0.94 | 3021 | 3265 |
| | | XP_002464695 | hypothetical protein SORBIDRAFT_01g023641 [*Sorghum bicolor*] > gi\|241918549\|gb\|EER91693.1\| hypothetical protein SORBIDRAFT_01g023641 [*Sorghum bicolor*] | 0.84 | 3022 | 3266 |
| | | XP_002450731 | hypothetical protein SORBIDRAFT_05g016471 [*Sorghum bicolor*] > gi\|241936574\|gb\|EES09719.1\| hypothetical protein SORBIDRAFT_05g016471 [*Sorghum bicolor*] | 0.80 | 3023 | 3267 |
| | | XP_002450732 | hypothetical protein SORBIDRAFT_05g016475 [*Sorghum bicolor*] > gi\|241936575\|gb\|EES09720.1\| hypothetical protein SORBIDRAFT_05g016475 [*Sorghum bicolor*] | 0.79 | 3024 | 3268 |
| Predicted siRNA 57179 | 632-655 | XP_002447941 | hypothetical protein SORBIDRAFT_06g018520 [*Sorghum bicolor*] > gi\|241939124\|gb\|EES12269.1\| hypothetical protein SORBIDRAFT_06g018520 [*Sorghum bicolor*] | 1.00 | 3025 | 3269 |
| | | NP_001159183 | hypothetical protein LOC100304268 [*Zea mays*] > gi\|195627604\|gb\|ACG35632.1\| ubiquitin carboxyl-terminal hydrolase 4 [*Zea mays*] > gi\|223942511\|gb\|ACN25339.1\| unknown [*Zea mays*] | 0.99 | 3026 | 3270 |
| | | NP_001146737 | hypothetical protein LOC100280339 [*Zea mays*] > gi\|219888545\|gb\|ACL54647.1\| unknown [*Zea mays*] > gi\|223974199\|gb\|ACN31287.1\| unknown [*Zea mays*] | 0.99 | 3027 | 3271 |
| | | ACG34260 | ubiquitin carboxyl-terminal hydrolase 4 [*Zea mays*] | 0.99 | 3028 | 3272 |
| | | NP_001052951 | Os04g0452400 [*Oryza sativa Japonica* Group] > gi\|113564522\|dbj\|BAF14865.1\| Os04g0452400 [*Oryza sativa Japonica* Group] > gi\|215695550\|dbj\|BAG90741.1\| unnamed protein product [*Oryza sativa Japonica* Group] | 0.97 | 3029 | 3273 |
| | | BAK02826 | predicted protein [*Hordeum vulgare* subsp. *vulgare*] | 0.96 | 3030 | 3274 |

TABLE 8-continued

Target genes of down regulated siRNA sequences associated with NUE
(Table 4)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | CAD40853 | OSJNBa0086B14.26 [Oryza sativa Japonica Group] > gi|116310175|emb|CAH67188.1| H0815C01.9 [Oryza sativa Indica Group] > gi|125548525|gb|EAY94347.1| hypothetical protein OsI_16114 [Oryza sativa Indica Group] > gi|125590577|gb|EAZ30927.1| hypothetical protein OsJ_15007 [Oryza sativa Japonica Group] | 0.97 | 3031 | |
| | | XP_002270407 | PREDICTED: hypothetical protein [Vitis vinifera] | 0.87 | 3032 | 3275 |
| | | XP_002531269 | Ubiquitin carboxyl-terminal hydrolase, putative [Ricinus communis] > gi|223529154|gb|EEF31133.1| Ubiquitin carboxyl-terminal hydrolase, putative [Ricinus communis] | 0.88 | 3033 | 3276 |
| | | CAN67091 | hypothetical protein VITISV_006756 [Vitis vinifera] | 0.86 | 3034 | |
| Predicted siRNA 55393 | 490-510 | XP_002446760 | hypothetical protein SORBIDRAFT_06g021990 [Sorghum bicolor] > gi|241937943|gb|EES11088.1| hypothetical protein SORBIDRAFT_06g021990 [Sorghum bicolor] | 1.00 | 3035 | 3277 |
| | | ACG37655 | anther-specific proline-rich protein APG [Zea mays] | 0.86 | 3036 | 3278 |
| | | ACG35356 | anther-specific proline-rich protein APG [Zea mays] | 0.86 | 3037 | 3279 |
| | | NP_001132075 | hypothetical protein LOC100193489 [Zea mays] > gi|194693356|gb|ACF80762.1| unknown [Zea mays] | 0.86 | 3038 | 3280 |
| | | NP_001141295 | hypothetical protein LOC100273386 [Zea mays] > gi|194703842|gb|ACF86005.1| unknown [Zea mays] | 0.87 | 3039 | 3281 |
| | | NP_001053264 | Os04g0507700 [Oryza sativa Japonica Group] > gi|32489520|emb|CAE04723.1| OSJNBa0043L24.11 [Oryza sativa Japonica Group] > gi|38567850|emb|CAE05693.2| OSJNBb0002J11.20 [Oryza sativa Japonica Group] > gi|113564835|dbj|BAF15178.1| Os04g0507700 [Oryza sativa Japonica Group] > gi|116310323|emb|CAH67339.1| OSIGBa0157A06.8 [Oryza sativa Indica Group] > gi|116310765|emb|CAH67558.1| OSIGBa0101P20.1 [Oryza sativa Indica Group] > gi|125548968|gb|EAY94790.1| hypothetical protein OsI_16569 [Oryza sativa Indica Group] > gi|125590941|gb|EAZ31291.1| hypothetical protein OsJ_15397 [Oryza sativa Japonica Group] | 0.75 | 3040 | 3282 |
| | | BAJ85303 | predicted protein [Hordeum vulgare subsp. vulgare] | 0.73 | 3041 | 3283 |
| | 66-86 | NP_001104926 | MADS2 [Zea mays] > gi|296611976|gb|AAO85643.1|MADS-box transcription factor MADS2 [Zea mays] | 1.00 | 3042 | 3284 |
| | | AAG09919 | MADS box protein 2 [Zea mays] | 1.00 | 3043 | 3285 |
| | | NP_001047230 | Os02g0579600 [Oryza sativa Japonica Group] > gi|91207149|sp|Q6EP49.2|MAD27_ORYSJ RecName: Full = MADS-box transcription factor 27; AltName: Full = OsMADS27; AltName: Full = RMADS218 > gi|30313677|gb|AAO47706.1| | 0.86 | 3044 | 3286 |

TABLE 8-continued

Target genes of down regulated siRNA sequences associated with NUE
(Table 4)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | transcription factor MADS27 [*Oryza sativa Japonica* Group] > gi|113536761|dbj|BAF09144.1| Os02g0579600 [*Oryza sativa Japonica* Group] | | | |
| | | EEC73475 | hypothetical protein OsI_07801 [*Oryza sativa Indica* Group] > gi|222623119|gb|EEE57251.1| hypothetical protein OsJ_07263 [*Oryza sativa Japonica* Group] | 0.84 | 3045 | |
| | | BAK01931 | predicted protein [*Hordeum vulgare* subsp. *vulgare*] | 0.79 | 3046 | 3287 |
| | | CAM59078 | MIKC-type MADS-box transcription factor WM30 [*Triticum aestivum*] | 0.79 | 3047 | 3288 |
| | | CAD40988 | OSJNBa0072F16.13 [*Oryza sativa Japonica* Group] | 0.77 | 3048 | |
| | | BAD29571 | putative transcription factor MADS27 [*Oryza sativa Japonica* Group] | 0.76 | 3049 | |
| | 571-591 | NP_001047230 | Os02g0579600 [*Oryza sativa Japonica* Group] > gi|91207149|sp|Q6EP49.2|MAD27_ORYSJ RecName: Full = MADS-box transcription factor 27; AltName: Full = OsMADS27; AltName: Full = RMADS218 > gi|30313677|gb|AAO47706.1| transcription factor MADS27 [*Oryza sativa Japonica* Group] > gi|113536761|dbj|BAF09144.1| Os02g0579600 [*Oryza sativa Japonica* Group] | 1.00 | 3050 | 3289 |
| | | EEC73475 | hypothetical protein OsI_07801 [*Oryza sativa Indica* Group] > gi|222623119|gb|EEE57251.1| hypothetical protein OsJ_07263 [*Oryza sativa Japonica* Group] | 0.98 | 3051 | |
| | | BAD29571 | putative transcription factor MADS27 [*Oryza sativa Japonica* Group] | 0.90 | 3052 | |
| | | AAG09919 | MADS box protein 2 [*Zea mays*] | 0.86 | 3053 | 3290 |
| | | NP_001104926 | MADS2 [*Zea mays*] > gi|29611976|gb|AAO85643.1|MADS-box transcription factor MADS2 [*Zea mays*] | 0.86 | 3054 | 3291 |
| | | BAK01931 | predicted protein [*Hordeum vulgare* subsp. *vulgare*] | 0.82 | 3055 | 3292 |
| | | CAD40988 | OSJNBa0072F16.13 [*Oryza sativa Japonica* Group] | 0.80 | 3056 | |
| | | CAM59078 | MIKC-type MADS-box transcription factor WM30 [*Triticum aestivum*] | 0.81 | 3057 | 3293 |
| | 481-501 | NP_001132075 | hypothetical protein LOC100193489 [*Zea mays*] > gi|194693356|gb|ACF80762.1| unknown [*Zea mays*] | 1.00 | 3058 | 3294 |
| | | ACG35356 | anther-specific proline-rich protein APG [*Zea mays*] | 1.00 | 3059 | 3295 |
| | | ACG37655 | anther-specific proline-rich protein APG [*Zea mays*] | 0.92 | 3060 | 3296 |
| | | NP_001141295 | hypothetical protein LOC100273386 [*Zea mays*] > gi|194703842|gb|ACF86005.1| unknown [*Zea mays*] | 0.92 | 3061 | 3297 |
| | | XP_002446760 | hypothetical protein SORBIDRAFT_06g021990 [*Sorghum bicolor*] > gi|241937943|gb|EES11088.1| hypothetical protein SORBIDRAFT_06g021990 [*Sorghum bicolor*] | 0.91 | 3062 | 3298 |
| | | NP_001053264 | Os04g0507700 [*Oryza sativa Japonica* Group] > gi|32489520|emb|CAE04723.1| OSJNBa0043L24.11 [*Oryza sativa Japonica* Group] > gi|38567850|emb|CAE05693.2| | 0.81 | 3063 | 3299 |

TABLE 8-continued

Target genes of down regulated siRNA sequences associated with NUE
(Table 4)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | OSJNBb0002J11.20 [*Oryza sativa Japonica* Group] > gi|113564835|dbj|BAF15178.1| Os04g0507700 [*Oryza sativa Japonica* Group] > gi|116310323|emb|CAH67339.1| OSIGBa0157A06.8 [*Oryza sativa Indica* Group] > gi|116310765|emb|CAH67558.1| OSIGBa0101P20.1 [*Oryza sativa Indica* Group] > gi|125548968|gb|EAY94790.1| hypothetical protein OsI_16569 [*Oryza sativa Indica* Group] > gi|125590941|gb|EAZ31291.1| hypothetical protein OsJ_15397 [*Oryza sativa Japonica* Group] | | | |
| | | BAJ85303 | predicted protein [*Hordeum vulgare* subsp. *vulgare*] | 0.78 | 3064 | 3300 |
| Predicted siRNA 59235 | 55-75 | NP_001167787 | hypothetical protein LOC100381480 [*Zea mays*] > gi|223943955|gb|ACN26061.1| unknown [*Zea mays*] | 1.00 | 3065 | 3301 |
| | | NP_001143285 | hypothetical protein LOC100275819 [*Zea mays*] > gi|195617040|gb|ACG30350.1| hypothetical protein [*Zea mays*] | 0.97 | 3066 | 3302 |
| Predicted siRNA 60123 | 512-531 | NP_001149853 | LOC100283481 [*Zea mays*] > gi|195635075|gb|ACG37006.1|pollen-specific protein like [*Zea mays*] | 1.00 | 3067 | 3303 |
| | | NP_001152271 | pollen-specific protein like [*Zea mays*] > gi|195638358|gb|ACG38647.1|pollen-specific protein like [*Zea mays*] > gi|195642016|gb|ACG40476.1|pollen-specific protein like [*Zea mays*] > gi|195654521|gb|ACG46728.1|pollen-specific protein like [*Zea mays*] | 0.83 | 3068 | 3304 |
| | | XP_002457577 | hypothetical protein SORBIDRAFT_03g009730 [*Sorghum bicolor*] > gi|241929552|gb|EES02697.1| hypothetical protein SORBIDRAFT_03g009730 [*Sorghum bicolor*] | 0.71 | 3069 | 3305 |
| Predicted siRNA 56837 | 1216-1237 | XP_002455312 | hypothetical protein SORBIDRAFT_03g008220 [*Sorghum bicolor*] > gi|241927287|gb|EES00432.1| hypothetical protein SORBIDRAFT_03g008220 [*Sorghum bicolor*] | 1.00 | 3070 | 3306 |
| | | NP_001145952 | hypothetical protein LOC100279478 [*Zea mays*] > gi|219885097|gb|ACL52923.1| unknown [*Zea mays*] | 0.88 | 3071 | 3307 |
| | | NP_001143749 | hypothetical protein LOC100276506 [*Zea mays*] > gi|195626214|gb|ACG34937.1| hypothetical protein [*Zea mays*] > gi|195645208|gb|ACG42072.1| hypothetical protein [*Zea mays*] | 0.89 | 3072 | 3308 |
| | | NP_001131959 | hypothetical protein LOC100193355 [*Zea mays*] > gi|194693040|gb|ACF80604.1| unknown [*Zea mays*] | 0.84 | 3073 | 3309 |
| | | NP_001041811 | Os01g0112100 [*Oryza sativa Japonica* Group] > gi|113531342|dbj|BAF03725.1| Os01g0112100 [*Oryza sativa Japonica* Group] > gi|125568749|gb|EAZ10264.1| hypothetical protein OsJ_00099 [*Oryza sativa Japonica* Group] > gi|215697848|dbj|BAG92041.1| unnamed protein product [*Oryza sativa Japonica* Group] > gi|215704817|dbj|BAG94845.1| unnamed protein product [*Oryza sativa Japonica* Group] | 0.72 | 3074 | 3310 |

TABLE 8-continued

Target genes of down regulated siRNA sequences associated with NUE
(Table 4)

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | EAY72253 | hypothetical protein OsI_00107 [*Oryza sativa Indica* Group] | 0.72 | 3075 | |
| Predicted siRNA 55404 | 231-252 | NP_001149348 | serine carboxypeptidase 1 [*Zea mays*] > gi|195626594|gb|ACG35127.1|serine carboxypeptidase 1 precursor [*Zea mays*] | 1.00 | 3076 | 3311 |
| | | NP_001137115 | hypothetical protein LOC100217293 [*Zea mays*] > gi|194698414|gb|ACF83291.1| unknown [*Zea mays*] | 0.98 | 3077 | 3312 |
| | | XP_002459781 | hypothetical protein SORBIDRAFT_02g010510 [*Sorghum bicolor*] > gi|241923158|gb|EER96302.1| hypothetical protein SORBIDRAFT_02g010510 [*Sorghum bicolor*] | 0.72 | 3078 | 3313 |
| | 1046-1067 | NP_001137115 | hypothetical protein LOC100217293 [*Zea mays*] > gi|194698414|gb|ACF83291.1| unknown [*Zea mays*] | 1.00 | 3079 | 3314 |
| | | NP_001149348 | serine carboxypeptidase 1 [*Zea mays*] > gi|195626594|gb|ACG35127.1|serine carboxypeptidase 1 precursor [*Zea mays*] | 0.99 | 3080 | 3315 |
| | | XP_002459781 | hypothetical protein SORBIDRAFT_02g010510 [*Sorghum bicolor*] > gi|241923158|gb|EER96302.1| hypothetical protein SORBIDRAFT_02g010510 [*Sorghum bicolor*] | 0.72 | 3081 | 3316 |

Table 8:
Provided are the target Genes of siRNAs Associated with Increased NUE (Table 4) along with their GenBank Accession numbers and sequence identifiers (SEQ ID NO:).
"bind" = binding;
"pos" = position;
"hom" = homologue;
"p.p." = polypeptide;
"p.n." = polynucleotide.

TABLE 9

Target genes of mir395, 397 and 398 to be downregulated

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| zma-miR398b* | 322-342 | YP_003208225 | ribosomal protein S3 [*Coix lacryma-jobi*] & gt;gi|209361951|gb|ACI43310.1| ribosomal protein S3 [*Coix lacryma-jobi*] | 1.00 | 982 | 1647 |
| | | NP_043062 | ribosomal protein S3 [*Zea mays*] & gt;gi|48478711|ref|YP_024318.1| ribosomal protein S3 [*Saccharum hybrid cultivar* SP-80-3280] & gt;gi|50812566 |ref|YP_054668.1| ribosomal protein S3 [*Saccharum officinarum*] & gt;gi|118614530|ref|YP_899446.1 ribosomal protein S3 [*Sorghum bicolor*] & gt;gi|33933|sp|P06586.1|RR3_MAIZE RecName: Full = 30S ribosomal protein S3, chloroplastic & gt;gi|68052946|sp|Q6ENS5.1|RR3_SACOF RecName: Full = 30S ribosomal protein S3, chloroplastic & gt;gi|75126330|sp|Q6L3G0.1|RR3_SACHY RecName: Full = 30S ribosomal protein S3, chloroplastic & gt;gi|125987748|sp|A1E9W3.1|RR3_SORBI RecName: Full = 30S ribosomal protein S3, chloroplastic & gt;gi|12469|emb|CAA68427.1|ribosomal protein S3 [*Zea mays*] & gt;gi|902260|emb|CAA60324.1|ribosomal protein S3 [*Zea mays*] & gt;gi|48478613& gt;gi|AAT44633.1 ribosomal protein S3 [*Saccharum hybrid cultivar* | 0.99 | 983 | 1648 |

TABLE 9-continued

Target genes of mir395, 397 and 398 to be downregulated

| Mir name | Mir Bind. Pos. | Hom. NCBI Access ion | Annotation/Organism | Identity | p.p. SEQ ID NO: | p.n. SEQ ID NO: |
|---|---|---|---|---|---|---|
| | | | SP80-3280] & gt;gi|49659550|dbj|BAD27331.1 ribosomal protein S3 [*Saccharum hybrid* & gt;gi|11820164|gb|ABK79534.1 ribosomal protein S3 [*Sorghum bicolor*] | | | |
| | | ADN86110 | ribosomal protein S3 [*Chasmanthium latifolium*] | 0.96 | 984 | 1649 |
| | | ADN32929 | ribosomal protein S3 [*Phyllostachys nigra* var. *henonis*] & gt;gi|309321655|gb|ADO65180.1 ribosomal protein S3 [*Acidosasa purpurea*] & gt;gi|309321739|gb|ADO65263.1 ribosomal protein S3 [*Ferrocalamus rimosivaginus*] & gt;gi|309321823|gb|ADO65346.1 ribosomal protein S3 [*Indocalamus longiauritus*] & gt;gi|309321906|gb|ADO65428.14 ribosomal protein S3 [*Phllostachys edulis*] | 0.96 | 985 | |
| | | YP_003097613 | ribosomal protein S3 [*Dendrocalamus latiflorus*] & gt;gi|255040297|gb|ACT99957.1 ribosomal protein S3 [*Dendrocalamus latisflorus*] | 0.96 | 986 | 1650 |
| | | ADD63064 | ribosomal protein S3 [*Potamophila parviflora*] | 0.96 | 987 | 1651 |
| | | ADD62997 | ribosomal protein S3 [*Ortza australiensis*] | 0.96 | 988 | 1652 |
| | | NP_039424 | ribosomal protein S3 [*Ortza sativa Japonica* Group] & gt;gi|50234010|ref|YP_052788.1 ribosomal protein S3 [*Ortza nivara*] & gt;gi|09156623|ref|YP_654242.1 ribosomal protein S3 [*Oryza sativa Indica* Group] & gt;gi|68052945|sp|Q6END5.1|RR3_ORYNI RecName: Full = 30S ribosomal protein S3, chloroplastic & gt;gi|48840859|sp|P0C483.1| RR3_ORYSA RecName: Full = 30S ribosomal protein S3, chloroplastic & gt;gi| 148840860|sp|P0C484.1|RR3_ORYSI RecName: Full = 30S ribosomal protein S3, chloroplastic & gt;gi|148840861|sp|P0C485.1|RR3_ORYSA RecName: Full = 30S ribosomal protein S3, chloroplastic & gt;gi|12025|emb|CAA33934.1 ribosomal protein S3 [*Ortza sativa Japonica* Group] & gt;gi|42795515|gb|AAS46082.1 ribosomal protein S3 [*Ortza sativa Indica* Group] & gt;gi|42795581|gb|AAS46147.1 ribosomal protein S3 [*Ortza sativa Japonica* Group] & gt;gi|4279564|gb|AAS46210.1 ribosomal protein S3 [*Ortza sativa Japonica* Group] & gt;gi|49615034|dbj|BAD26817.1 ribosomal protein S3 [*Ortza nivara*] & gt;gi|50725165|dbj|BAD33782.1 ribosomal protein S3 [*Ortza sativa Japonica* Group] & gt;gi|51091521|dbj|BAD36259.1 ribosomal protein S3 [*Ortza sativa Japonica* Group] & gt;gi|8200203|gb|EEC82630.1 hypothetical protein OsI_27221 [*Oryza sativa Indica* Group] & gt;gi|218202023|gb|EEC84450.1 hypothetical protein OsI_31072 [Oryza sativa Indica Group] & gt;gi|290790601|gb|ADD62861.1 ribosomal protein S3 [*Ortza sativa Japonica* Group] & gt;gi|290790670|gb|ADD62929.1 ribosomal protein S3 [*Oryza meridionalis*] & gt;gi|226646|prf| 1603356BW ribosomal protein S3 | 0.96 | 989 | 1653 |
| | | ADO65512 | ribosomal protein S3 [*Bambusa emeiensis*] | 0.95 | 990 | |
| | | BAD05516 | ribosomal protein S3 [*Ortza sativa Japonica* Group] | 0.95 | 991 | 1654 |
| osa-miR395m | 426-446 | XP_002463896 | hypothetical protein SORBIDRAFT_01g008450 [*Sorghum bicolor*] & gt;gi|241917750|gb|EER90894.1 SORBIDRAFT_01g008450 [*Sorghum bicolor*] | 1.00 | 1249 | 1889 |
| | | ACN28609 | unknown [*Zea mays*] | 0.95 | 1250 | 1890 |
| | | ACN34023 | unknown [*Zea mays*] | 0.95 | 1251 | 1891 |
| | | ACG45192 | bifunctional 3-phosphoadenosine 5-phosphosulfate synthtase [*Zea mays*] | 0.94 | 1252 | 1892 |
| | | NP_001104877 | ATP sulfurylase [*Zea mays*] & gt;gi|2738750|gb|AAB94542.1 ATP sulfurylase [*Zea mays*] | 0.95 | 1253 | 1893 |
| | | EAY91825 | hypothetical protein OsI_13470 [*Oryza sativa Indica* Group] | 0.80 | 1254 | |
| | | NP_001051234 | Os03g0743900 [*Oryza sativa Japonica* Group] & gt;gi|30017582|gb|AAP13004.1 putative ATP sulfurylase [*Oryza sativa Japonica* Group] & gt;gi|108711024|gb|ABF98819.1 | 0.80 | 1255 | 1894 |

TABLE 9-continued

Target genes of mir395, 397 and 398 to be downregulated

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | | Bifunctional 3 '-phosphoadenosine 5 '-phosphosulfate synthethase, putative, expressed [Oryza sativa Japonica Group] & gt;gi|113549705|dbj|BAF13148.1 Os03g0743900 [Oryza sativa Japonica Group] & gt;gi|215704581|dbj|BAG94214.1 unnamed protein product [Oryza sativa Japonica Group] | | | |
| | | BAK05662 | predicted protein [Hordeum vulgare subsp. vulgare] & gt;gi|326502564|dbj|BAJ95345.1 predicted protein [Hordeum vulgare subsp. vulgare] | 0.79 | 1256 | 1895 |
| | | BAA36274 | plastidic ATP sulfurylase [Oryza sativa Indica Group] | 0.80 | 1257 | 1896 |
| | | EAZ28548 | hypothetical protein OsJ_12530 [Oryza sativa Japonica Group] | 0.77 | 1258 | |
| | 352-372 | XP_002441904 | hypothetical protein SORBIDRAFT_08g004650 [Sorghum bicolor] & gt;gi|241942597|gb|EES15742.1 hypothetical protein SORBIDRAFT_08g004650 [Sorghum bicolor] | 1.00 | 1259 | 1897 |
| | | EEE52851 | hypothetical protein OsJ_35390 [Oryza sativa Japonica Group] | 0.71 | 1260 | |
| | | NP_001066285 | Os12g0174100 [Oryza sativa Japonica Group] & gt;gi|77553790|gb|ABA96586.1 Growth regulator protein, putative, expressed [Oryza sativa Japonica Group] & gt;gi| 255670095|dbj|BAF29304.2 Os12g0174100 [Oryza sativa Japonica Group] | 0.71 | 1261 | 1898 |
| | | EEC68940 | hypothetical protein OsI_37646 [Oryza sativa Indica Group] | 0.70 | 1262 | |
| | 528-548 | ACN34023 | unknown [Zea mays] | 1.00 | 1263 | 1899 |
| | | NP_001104877 | ATP sulfurylase [Zea mays] & gt;gi|2738750|gb|AAB94542.1 ATP sulfurylase [Zea mays] | 0.98 | 1264 | 1900 |
| | | ACN28609 | unknown [Zea mays] | 0.94 | 1265 | 1901 |
| | | ACG41592 | bifunctional 3-phosphoadenosine 5-phosphosulfate synthetase [Zea mays] | 0.94 | 1266 | 1902 |
| | | XP_002463896 | hypothetical protein SORBIDRAFT_01g008450 [Sorghum bicolor] & gt;gi|241917750|gb|EER90894.1 hypothetical protein SORBIDRAFT_01g008450 [Sorghum bicolor] | 0.94 | 1267 | 1903 |
| | | BAK05662 | predicted protein [Hordeum vulgare subsp. vulgare] & gt;gi|326502564|dbj|BAJ95345.1 predicted protein [Hordeum vulgare subsp. vulfare] | 0.84 | 1268 | 1904 |
| | | EAY91825 | hypothetical protein OsI_13470 [Oryza sativa Indica Group] | 0.80 | 1269 | |
| | | NP_001051234 | Os03g0743900 [Oryza sativa Japonica Group] & gt;gi|30017582|gb|AAP13004.1 putative ATP sulfurylase [Oryza sativa Japonica Group] & gt;gi|108711024|gb|ABF98819.1 Bifunctional 3 & apos;-phosphoadenosine 5 & aps;-phosphosulfate synthethase, putative, expressed [Oryza sativa Japonica Group] & gt;gi|13549705|dbj| BAF13148.1Os03g0743900 [Oryza sativa Japonica Group] & gt;gi|215704581|dbj|BAG94214.1 unnamed protein product [Oryza sativa Japonica Group] | 0.79 | 1270 | 1905 |
| | | BAA36274 | plastidic ATP sulfurylase [Oryza sativa Indica Group] | 0.79 | 1271 | 1906 |
| | | EAZ28548 | hypothetical protein OsJ_12530 [Oryza sativa Japonica Group] | 0.76 | 1272 | |
| | 305-325 | ACL53345 | unknown [Zea mays] | 1.00 | 1273 | 1907 |
| | | XP_002465703 | hypothetical protein SORBIDRAFT_01g044100 [Sorghum bicolor] & gt;gi|241919557|gb|EER92701.1 hypothetical protein SORBIDRAFT_01g044100 [Sorghum bicolor] | 0.95 | 1274 | 1908 |
| | | BAJ85215 | predicted protein [Hordeum vulgare subsp. vulgare] & gt;gi|326511599|dbj|BAJ91944.1 predicted protein [Hordeum vulgare subsp. vulfare] & gt;gi|25585257|gb|EAZ25921.1 hypothetical protein OsJ_09764 [Oryza sativa Japonica Group] | 0.85 | 1275 | 1909 |
| | | AAN59769 | Putative sulfate transporter [Oryza sativa Japonica Group] & gt;gi|125585257|gb|EAZ25921.1| hypothetical protein OsJ_09764 [Oryza sativa Japonica Group] | 0.85 | 1276 | |
| | | EEC74682 | hypothetical protein OsI_10373 [Oryza sativa Japonica Group] | 0.85 | 1277 | |
| | | EEC74681 | hypothetical protein OsI_10372 [Oryza sativa Japonica Group] | 0.72 | 1278 | |
| | | EEE58498 | hypothetical protein OsJ_09763 [Oryza sativa Japonica Group] | 0.72 | 1279 | |
| | | NP_001049257 | Os03g0195300 [Oryza sativa Japonica Group] & gt;gi|108706649|gb|ABF94444.1 Sulfate transporter 2.1, putative, expressed [Oryza sativa Japonica Group] & gt;gi|13547728|dbj|BAF11171.1 Os03g0195300 [Oryza sativa Japonica Group] | 0.72 | 1280 | 1910 |
| zma-miR397a | 798-818 | XP_002458747 | hypothetical protein SORBIDRAFT_03g039530 [Sorghum bicolor] & gt;gi|241930722|gb|EES03867.1 hypothetical protein SORBIDRAFT_03g039530 [Sorghum bicolor] | 1.00 | 1321 | 1949 |

TABLE 9-continued

Target genes of mir395, 397 and 398 to be downregulated

| Mir name | Mir Bind. Pos. | Hom. NCBI Access ion | Annotation/Organism | Identity | p.p. SEQ ID NO: | p.n. SEQ ID NO: |
|---|---|---|---|---|---|---|
| | | NP_001147942 | L-ascorbate oxidase [Zea mays] & gt;gi|195614732|gb|ACG29196.1 L-ascorbate oxidase precursor [Zea mays] | 0.96 | 1322 | 1950 |
| | | ACN34362 | unknown [Zea mays] | 0.96 | 1323 | 1951 |
| | | EEC71780 | hypothetical protein OsI_04394 [Oryza sativa Indica Group] | 0.86 | 1324 | |
| | | NP_001044773 | Os03g0842500 [Oryza sativa Japonica Group] & gt;gi|19571025|gb|BAB86452.1 putative laccase LAC5-6 [Oryza sativa Japonica Group] & gt;gi|13534304|dbj|BAF06687.1 Os01g0842500 [Oryza sativa Japonica Group] & gt;gi|125572601|gb|EAZ14116.1 hypothetical protein OsJ_04040 [Oryza sativa Japonica Group] & gt;gi|215694811|dbj|NAG90005.1 unnamed protein product [Oryza sativa Japonica Group] | 0.86 | 1325 | 1952 |
| | | BAJ84890 | predicted protein [Hordeum vulgare subsp. vulgare] | 0.84 | 1326 | 1953 |
| | | BAJ96691 | predicted protein [Hordeum vulgare subsp. vulgare] | 0.84 | 1327 | 1954 |
| | | NP_001105875 | putative laccase [Zea mays] & gt;gi|8461878|emb|CAJ30500.1 putative laccase [Zea mays] | 0.79 | 1328 | 1955 |
| | | ACN28855 | unknown [Zea mays] | 0.79 | 1329 | 1956 |
| | | XP_002458746 | hypothetical protein SORBIDRAFT_03g039520 [Sorghum bicolor] & gt;gi|241930721|gb|EES03866.1 hypothetical protein SORBIDRAFT_03g039520 [Sorghum bicolor] | 0.78 | 1330 | 1957 |
| | 458-478 | ACF87912 | unknown [Zea mays] | 1.00 | 1331 | 1958 |
| | | NP_001105951 | LOC100037774 [Zea mays] & gt;gi|1184776|gb|AAA87580.1 cytosolic glyceraldehyde-3-phosphate dehydrogenase GAPC4 [Zea mays] | 0.99 | 1332 | 1959 |
| | | NP_001105385 | glyceraldehyde-3-phosphate dehydrogenase, cytosolic 3 [Zea mays] & gt;gi|6166167|sp|Q43247.1|G3PE_MAIZE RecName: Full = Glyceraldehyde-3-phosphate dehydrogense, cytosolic 3 & gt;gi|184774|gb|AAA87579.1 cytosolic glyceraldehyde-3-phosphate dehydrogenase GAPC3 [Zea mays] | 0.99 | 1333 | 1960 |
| | | ACG36109 | glyceraldehyde-3-phosphate dehydrogenase, cytosolic 3 [Zea mays] | 0.99 | 1334 | 1961 |
| | | ADZ55283 | glyceraldehyde-3-phosphate dehydrogenase [Zea mays] | 0.98 | 1335 | 1962 |
| | | XP_002452401 | hypothetical protein SORBIDRAFT_04g025120 [Sorghum bicolor] & gt;gi|241932232|gb|EES05377.1 hypothetical protein SORBIDRAFT_04g025120 [Sorghum bicolor] | 0.98 | 1336 | 1963 |
| | | NP_001053139 | Os04g0486600 [Oryza sativa Japonica Group] & gt;gi|3834606|emb|CAE02009.2 OJ0002233_09.15 [Oryza sativa Japonica Group] & gt;gi|90265255|emb|CAD79700.2H0302E05.3 [Oryza sativa Japonica Group] & gt;gi|13564710|dbj|BAF15053.1 Os05g0486600 [Oryza sativa Japonica Group] & gt;gi|69244439|gb|ACA50493.1 glyceraldehyde-3-phosphate dehydrogenase [Oryza sativa Japonica Group] & gt;gi|215694303|dbj|BAG89296.1 unnamed protein product [Oryza sativa Japonica Group] & gt;gi|306415975|gb|ADM86862.1 glyceraldehyde-3-phosphate dehydrogenase [Oryza sativa Japonica Group] | 0.92 | 1337 | 1964 |
| | | NP_001047348 | Os02g0601300 [Oryza sativa Japonica Group] & gt;gi|47848293|dbj|BAD22157.1 putative glyceraldehyde-3-phosphate dehydrogenase (phosporylating) [Oryza sativa Japonica Group] & gt;gi|13536879|dbj|BAF09262.1 Os02g0601300 [Oryza sativa Japonica Group] & gt;gi|119434402|gb|ABL75274.1 glyceralde-3-phosphate dehydrogenase [Oryza sativa] & gt;gi|215704481|dbj|BAG93915.1| unnamed protein product [Oryza sativa Japonica Group] & gt;gi|306415941|gb|ADM86845.1 glyceraldehyde-3-phosphate dehydrogenase [Oryza sativa Japonica Group] | 0.92 | 1338 | 1965 |
| | | EEC73541 | hypothetical protein OsI_07948 [Oryza sativa Indica Group] | 0.91 | 1339 | |
| | | ABQ81648 | glyceraldehyde-3-phosphate dehydrogenase [Triticum aestivum] | 0.91 | 1340 | 1966 |
| | 201-221 | XP_002458746 | hypothetical protein SORBIDRAFT_03g039520 [Sorghum bicolor] & gt;gi|241930721|gb|EES03866.1 hypothetical protein SORBIDRAFT_03g039520 [Sorghum bicolor] | 1.00 | 1341 | 1967 |
| | | NP_001105875 | putative laccase [Zea mays] & gt;gi|84618781|emb|CAJ30500.1 putative laccase [Zea mays] | 0.94 | 1342 | 1968 |

TABLE 9-continued

Target genes of mir395, 397 and 398 to be downregulated

| Mir name | Mir Bind. Pos. | Hom. NCBI Access ion | Annotation/Organism | Identity | p.p. SEQ ID NO: | p.n. SEQ ID NO: |
|---|---|---|---|---|---|---|
| | | NP_001146658 | hypothetical protein LOC100280258 [*Zea mays*] & gt;gi|219888209|gb|ACL54479.1 unknown [*Zea mays*] | 0.93 | 1343 | 1969 |
| | | ACN28855 | unknown [*Zea mays*] | 0.94 | 1344 | 1970 |
| | | NP_001044772 | Os01g0842400 [*Oriza satuva Japonica* Group] & gt;gi|75321217|sp|Q5N9X2.1|LAC4_ORYSJ RecName: Full = Laccase-4; AltName: Full = Benzenediol: oxygen oxidoreductase 4; AltName: Full = Diphenol oxidase 4; AltName: Full = Urishiol oxidase 4; flags: precursor & gt;gi|56784239|dbj|BAD81734.1| putative laccase LAC5-6 [*Oryza sativa Japonica* Group] & gt;gi|13534303|dbj|BAF06686.1|Os01g0842400 [*Oryza sativa Japonica* Group] & gt;gi|215697155 |dbj|BAG91149.1| unnamed protein product [*Oryza sativa Japonica* Group] | 0.80 | 1345 | 1971 |
| | | EAZ14115 | hypothetical protein OsJ_04039 [*Oryza sativa Japonica* Group] | 0.80 | 1346 | |
| | | EEC71777 | hypothetical protein OsJ_04389 [*Oryza sativa Indica* Group] | 0.80 | 1347 | |
| | | BAJ99773 | predicted protein [*Hordeum vulgare* subsp. *vulgare*) | 0.78 | 1348 | 1972 |
| | | XP_002458747 | hypothetical protein SORBIDRAFT_03g039530 [*Sorghum bicolor*] & gt;gi|241930722|gb|EES03867.1 hypothetical protein SORBIDRAFT_03g039530 [*Sorghum bicolor*] | 0.78 | 1349 | 1973 |
| | | AAC04576 | putative high-pI laccase [*Oryza sativa Japonica* Group] | 0.79 | 1350 | 1974 |
| mtr-miR395c | 426-446 | XP_002463896 | hypothetical protein SORBIDRAFT_01g008450 [*Sorghum bicolor*] & gt;gi|241917750|gb|EER90894.1 hypothetical protein SORBIDRAFT_01g008450 [*Sorghum bicolor*] | 1.00 | 1351 | 1975 |
| | | ACN28609 | unknown [*Zea mays*] | 0.95 | 1352 | 1976 |
| | | ACN34023 | unknown [*Zea mays*] | 0.95 | 1353 | 1977 |
| | | ACG45192 | bifunctional 3-phosphoadenosine 5-phosphosulfate synthtase [*Zea mays*] | 0.94 | 1354 | 1978 |
| | | NP_001104877 | ATP sulfurylase [*Zea mays*] & gt;gi|2738750|gb|AAB94542.1 ATP sulfurylase [*Zea mays*] | 0.95 | 1355 | 1979 |
| | | EAY91825 | hypothetical protein OsI_13470 [*Oryza sativa Indica* Group] | 0.80 | 1356 | |
| | | NP_001051234 | Os03g0743900 [*Oryza sativa Japonica* Group] & gt;gi|30017582|gb|AAP13004.1 putative ATP sulfurylase [*Oryza sativa Japonica* Group] & gt;gi|108711024|gb|ABF98819.1 Bifunctional 3 & apos;-phosphoadenenosine 5 & apos;-phosphosulfate synthethase, putative, expressed [*Oryza sativa Japonica* Group] & gt;gi|13549705|dbj|BAF13148.1 Os03g0743900 [*Oryza sativa Japonica* Group] & gt;gi|215704581|dbj| BAG94214.1 unnamed protein product [*Oryza sativa Japonica* Group] | 0.80 | 1357 | 1980 |
| | | BAK05662 | predicted protein [*Hordeum vulfare* subsp. *vulgare*] & gt;gi|326502564|dbj|BAJ95345.1 predicted protein product [*Hordeum vulgare* subsp. *vulgare*] | 0.79 | 1358 | 1981 |
| | | BAA36274 | plastidic ATP sulfurylase [*Oryza sativa Indica* Group] | 0.80 | 1359 | 1982 |
| | | EAZ28548 | hypothetical protein OsJ_12530 [*Oryza sativa Japonica* Group] | 0.77 | 1360 | |
| | 528-548 | ACN34023 | unknown [*Zea mays*] | 1.00 | 1361 | 1983 |
| | | NP_001104877 | ATP sulfurylase [*Zea mays*] & gt;gi|2738750|gb|AAB94542.1 ATP sulfurylase [*Zea mays*] | 0.98 | 1362 | 1984 |
| | | ACN28609 | unknown [*Zea mays*] | 0.94 | 1363 | 1985 |
| | | ACG45192 | bifunctional 3-phosphoadenosine 5-phosphosulfate synthetase [*Zea mays*] | 0.94 | 1364 | 1986 |
| | | XP_002463896 | hypothetical protein SORBIDRAFT_01g008450 [*Sorghum bicolor*] & gt;gi|241917750|gb|EER90894.1 hypothetical protein SORBIDRAFT_01g008450 [*Sorghum bicolor*] | 0.94 | 1365 | 1987 |
| | | BAK05662 | predicted protein [*Hordeum vulgare* subsp. *vulgare*] & gt;gi|326502564|dbj|BAJ95345.1 predicted protein [*Hordeum vulgare* subsp. *vulgare*] | 0.84 | 1366 | 1988 |
| | | EAY91825 | hypothetical protein OsI_13470 [*Oryza sativa Indica* Group] | 0.80 | 1367 | |
| | | NP_001051234 | Os03g0743900 [*Oryza sativa Japonica* Group] & gt;gi|30017582|gb|AAP13004.1 putative ATP sulfurylase [*Oryza sativa Japonica* Group] & gt;gi|10871102|gb|ABF98819.1 Bifunctional 3 & apos;-phosphoadenosine 5 & apos;-phosphosulfate synthethase, putative, expressed [*Oryza sativa Japonica* Group] & gt;gi|113549705|dbj|BAF13148.1Os03g0743900 [*Oryza sativa Japonica Group*] & gt;gi|215704581|dbj|BAG94214.1 unnamed protein product [*Oryza sativa Japonica* Group] | 0.79 | 1368 | 1989 |

TABLE 9-continued

Target genes of mir395, 397 and 398 to be downregulated

| Mir name | Mir Bind. Pos. | Hom. NCBI Accession | Annotation/Organism | Identity | p.p. SEQ ID NO: | p.n. SEQ ID NO: |
|---|---|---|---|---|---|---|
| | | BAA36274 | plastidic ATP sulfurylase [*Oryza sativa Indica* Group] | 0.79 | 1369 | 1990 |
| | | EAZ28548 | hypothetical protein OsJ_12530 [*Oryza sativa Japonica* Group] | 0.76 | 1370 | |
| | 359-379 | XP_002452295 | hypothetical protein SORBIDRAFT_04g023180 [*Sorghum bicolor*] & gt;gi|241932126|gb|EES05271.1 hypothetical protein SORBIDRAFT_04g023180 [*Sorghum bicolor*] | 1.00 | 1371 | 1991 |
| | | NP_001148591 | 2-hydrozy-3-oxopropionate reductase [*Zea mays*] & gt;gi|95620656|gb|ACG32158.1 2-hydrozy-3-oxopropionate reductase [*Zea mays*] | 0.98 | 1372 | 1992 |
| | | NP_001047154 | Os02g0562700 [*Oryza sativa Japonica* Group] & gt;gi|29368238|gb|AAAO72678.1 gamma hydroxybutyrate dehydrogenase-like protein [*Oryza sativa Japonica* Group] & gt;gi|32352132|dbj|BAC78559.1 hypothetical protein [*Oryza sativa Japonica* Group] & gt;gi|46390142|dbj|BAD15576.1 putative gamma hydroxybutyrate dehydrogenase [*Oryza sativa Japonica* Group] & gt;gi|13536685|dbj|BAF09068.1|Os02g562700 [*Oryza sativa Japonica* Group] & gt;gi|215679041|dbj|BAG96471.1 unnamed protein product [*Oryza sativa Japonica* Group] & gt;gi|21501279|dbj|BAG92703.1 unnamed protein product [*Oryza sativa Japonica* Group] & gt;gi|215766587|dbj|BAG98746.1 unnamed protein product [*Oryza sativa Japonica* Group] & gt;gi|218190991|gb|EEC73418.1 hypothetical protein OsI_07685 [*Oryza sativa Indica* Group] & gt;gi|222623072|gb|EEE57204.1 hypothetical protein OsJ_07161 [*Oryza sativa Japonica* Group] | 0.92 | 1373 | 1993 |
| | | BAJ91168 | predicted protein [*Hordeum vulgare* subsp. *vulgare*] & gt;gi|326518654|dbj|BAJ88356.1 predicted protein [*Hordeum vulgare* subsp. *vulgare*] | 0.90 | 1374 | 1994 |
| | | XP_002266252 | PREDICTED: hypothetical protein isoform 1 [*Vitis vinifera*] & gt;gi|47861759|emb|CAN78910.1 hypothetical protein VITISV_032948 [*Vitis vinifera*] & gt;gi|297736660|emb|CBI25677.3 unnamed protein product [*Vitis vinifera*] | 0.80 | 1375 | 1995 |
| | | ACU2717 | unknown [*Glycine max*] | 0.80 | 1376 | 1996 |
| | | XP_002266296 | PREDICTED: hypothetical protein isoform 2 [*Vitis vinifera*] | 0.78 | 1377 | 1997 |
| | | XP_002320548 | predicted protein [*Populus trichocarpa*] & gt;gi|222861321|gb|EEE98863.1 predicted protein [*Populus trichocarpa*] | 0.76 | 1378 | 1998 |
| | | BAG16485 | succinic semialdehyde reductase isofom1 [*Solanum lycopersicum*] | 0.79 | 1379 | 1999 |
| | | ABK22179 | unknown [*Picea sitchensis*] | 0.77 | 1380 | 2000 |
| | 305-325 | ACL53345 | unknown [*Zea mays*] | 1.00 | 1381 | 2001 |
| | | XP_002465703 | hypothetical protein SORBIDRAFT_01g044100 [*Sorghum bicolor*] & gt;gi|241919557|gb|EER92701.1 hypothetical protein SORBIDRAFT_01g044100 [*Sorghum bicolor*] | 0.95 | 1382 | 2002 |
| | | BAJ85215 | predicted protein [*Hordeum vulgare* subsp. *vulgare*] & gt;gi|326511599|dbj|BAJ91944.1 predicted protein [*Hordeum vulgare* subsp. *vulgare*] | 0.85 | 1383 | 2003 |
| | | AAN59769 | Putative sulfate transporter [*Oryza sativa Japonica* Group] & gt;gi|25585257|gb|EAZ25921.1 hypothetical protein OsJ_09764 [*Oryza sativa Japonica* Group] | 0.85 | 1384 | |
| | | EEC74682 | hypothetical protein OsJ_10373 [*Oryza sativa Indica* Group] | 0.85 | 1385 | |
| | | EEC74681 | hypothetical protein OsJ_10372 [*Oryza sativa Indica* Group] | 0.72 | 1386 | |
| | | EEE58498 | hypothetical protein OsJ_09763[*Oryza sativa Japonica* Group] | 0.72 | 1387 | |
| | | NP_001049257 | Os03g0195300 [*Oryza sativa Japonica* Group] & gt;gi|108706649|gb|ABF94444.1 Sulfate transporter 2.1, putative, expressed [*Oryza sativa Japonica* Group] & gt;gi|13547728|dbj|BAF11171.1Os03g0195300 [*Oryza sativa Japonica* Group] | 0.72 | 1388 | 2004 |
| Predicted zmamir 50266 | 201-221 | XP_002456833 | hypothetical protein SORBIDRAFT_03g043750 [*Sorghum bicolor*] & gt;gi|241928808|gb|EES01953.1 hypothetical protein SORBIDRAFT_03g043750 [*Sorghum bicolor*] | 1.00 | 1311 | 1939 |
| | | NP_001131338 | hypothetical protein LOC100192654 [*Zea mays*] & gt;gi|94690154|gb|ACF79161.1 unknown [*Zea mays*] & gt;gi|219884631|gb|ACL52690.1 unknown [*Zea mays*] & gt;gi|238908563|gb|ACF79698.2unknown [*Zea mays*] | 0.96 | 1312 | 1940 |

TABLE 9-continued

Target genes of mir395, 397 and 398 to be downregulated

| Mir name | Mir Bind. Pos. | Hom. NCBI Access ion | Annotation/Organism | Identity | p.p. SEQ ID NO: | p.n. SEQ ID NO: |
|---|---|---|---|---|---|---|
| | | ACL52654 | unknown [Zea mays] | 0.92 | 1313 | 1941 |
| | | ACG35805 | selenium-binding protein [Zea mays] | 0.92 | 1314 | 1942 |
| | | NP_001045194 | Os01g0916400 [Oryza sativa Japonica Group] & gt;gi\|19386752\|dbj\|BAB86133.1 putative selenium binding protein [Oryza sativa Japonica Group] & gt;gi\|20805006\|dbj\|BAB92682.1 putative selenium binding protein [Oryza sativa Japonica Group] & gt;gi\|31322241\|gb\|AAO91777.1 putative selenium binding protein [Oryza sativa Japonica Group] & gt;gi\|113534725\|dbj\| BAF07108.1\|Os01g0916400 [Oryza sativa Japonica Group] & gt;gi\|125528845\|gb\|EAY76959.1\| hypothetical protein OsI_04917 [Oryza sativa Indica Group] & gt;gi\|25573100\|gb\|EAZ14615.1\| hypothetical protein OsJ_04540 [Oryza sativa Japonica Group] & gt;gi\|13534725\|dbj\|BAF07108.1OS01g0916400 [Oryza sativa Japonica Group] | 0.90 | 1315 | 1943 |
| | | BAJ94729 | predicted protein [Hordeum vulgare subsp. vulgare] | 0.88 | 1316 | 1944 |
| | | BAB40923 | putative selenium binding protein [Oryza sativa (japonica cultivar-group)] | 0.88 | 1317 | 1945 |
| | | XP_002328915 | predicted protein [Populus trichocarpa] & gt;gi\|222839345\|gb\|EEE77682.1 predicted protein [Populus trichocarpa] | 0.80 | 1318 | 1946 |
| | | XP_002298672 | predicted protein [Populus trichocarpa] & gt;gi\|222845930\|gb\|EEE3477.1 predicted protein [Populus trichocarpa] | 0.80 | 1319 | 1947 |
| | | XP_002520613 | selenium-binding protein, putative [Ricinus communis] & gt;gi\|223540174\|gb\|EEF41749.1 selenium-binding protein, putative [Ricinus communis] | 0.80 | 1320 | 1948 |

Table 9, provided are target genes to be downregulated, of mirs 395, 397 and 398.

TABLE 10

Abbreviations of plant species
Provided are the abbreviations and full names of plant species.

| Abbreviation | Organism Name | Common Name |
|---|---|---|
| ahy | Arachis hypogaea | Peanut |
| aly | Arabidopsis lyrata | Arabidopsis lyrata |
| aqc | Aquilegia coerulea | Rocky Mountain Columbine |
| ata | Aegilops taushii | Tausch's goatgrass |
| ath | Arabidopsis thaliana | Arabidopsis thaliana |
| bdi | Brachypodium distachyon | Grass |
| bna | Brassica napus | Brassica napus canola ("liftit") |
| bol | Brassica oleracea | Brassica oleracea wild cabbage |
| bra | Brassica rapa | Brassica rapa yellow mustard |
| ccl | Citrus clementine | Clementine |
| csi | Citrus sinensis | Orange |
| ctr | Citrus trifoliata | Trifoliate orange |
| gma | Glycine max | Glycine max |
| gso | Glycine soja | Wild soybean |
| hvu | Hordeum vulgare | Barley |
| lja | Lotus japonicus | Lotus japonicus |
| mtr | Medicago truncatula | Medicago truncatula—Barrel Clover ("tiltan") |
| osa | Oryza sativa | Oryza sativa |
| pab | Picea abies | European spruce |
| ppt | Physcomitrella patens | Physcomitrella patens (moss) |
| pta | Pinus taeda | Pinus taeda—Loblolly Pine |
| ptc | Populus trichocarpa | Populus trichocarpa—black cotton wood |
| rco | Ricinus communis | Castor bean ("kikayon") |
| sbi | Sorghum bicolor | Sorghum bicolor Dura |
| sly | Solanum lycopersicum | tomato microtom |
| smo | Selaginella moellendorffii | Selaginella moellendorffii |
| sof | Saccharum officinarum | Sugarcane |
| ssp | Saccharum spp | Sugarcane |
| tae | Triticum aestivum | Triticum aestivum |
| tcc | Theobroma cacao | cacao tree and cocoa tree |
| vvi | Vitis vinifera | Vitis vinifera Grapes |
| zma | Zea mays | corn |

Example 3

Gene Cloning and Creation of Binary Vectors for Plant Expression

The predicted target sequences were cloned into binary vectors for the generation of transgenic plants. The full-length open reading frame (ORF) was synthesized by Genscript (Israel). The resultant clone was digested with appropriate restriction enzymes and inserted into the Multi Cloning Site (MCS) of a similarly digested binary vector through ligation using T4 DNA ligase enzyme (Promega, Madison, Wis., USA). FIG. 1 is a plasmid map of the binary vector pORE-E1, used for plant transformation.

Example 4

Generation of Transgenic Model Plants Expressing the Target Genes/Silencing Agents of Some Embodiments of the Invention

*Arabidoposis thaliana* transformation was performed using the floral dip procedure following a slightly modified version of the published protocol (Clough and Bent, 1998, *Plant J* 16(6): 735-43; Desfeux et al, 2000, *Plant Physiol.* 123(3): 895-904). Briefly, $T_0$ Plants were planted in small pots filled with soil. The pots were covered with aluminum foil and a plastic dome, kept at 4° C. for 3-4 days, then uncovered and incubated in a growth chamber at 24° C. under 16 hr light:8 hr dark cycles. A week prior to transformation all individual flowering stems were removed to allow for growth of multiple flowering stems instead. A single colony of *Agrobacterium* (GV3101) carrying the binary vectors (pORE-E1), harboring the target gene or silencing sequence was cultured in LB medium supplemented with kanamycin (50 mg/L) and gentamycin (25 mg/L). Three days prior to transformation, each culture was incubated at 28° C. for 48 hrs, shaking at 180 rpm. The starter culture was split the day before transformation into two cultures, which were allowed to grow further at 28° C. for 24 hours at 180 rpm. Pellets containing the *agrobacterium* cells were obtained by centrifugation of the cultures at 5000 rpm for 15 minutes. The pellets were resuspended in an infiltration medium (10 mM $MgCl_2$, 5% sucrose, 0.044 µM BAP (Sigma) and 0.03% Tween 20) in double-distilled water.

Transformation of $T_0$ plants was performed by inverting each plant into the *Agrobacterium* suspension, keeping the flowering stem submerged for 5 minutes. Following inoculation, each plant was blotted dry for 5 minutes on both sides, and placed sideways on a fresh covered tray for 24 hours at 22° C. Transformed (transgenic) plants were then uncovered and transferred to a greenhouse for recovery and maturation. The transgenic $T_0$ plants were grown in the greenhouse for 3-5 weeks until the seeds are ready. The seeds were then harvested from plants and kept at room temperature until sowing.

Example 5

Selection of Transgenic *Arabidopsis* Plants Expressing the Nucleic Acid Molecules of Some Embodiments of the Invention According to Expression Level

*Arabidopsis* seeds were sown. One to 2 weeks old seedlings were sprayed with a non-volatile herbicide, Basta (Bayer) at least twice every few days. Only resistant plants, which are heterozygous for the transgene, survive. PCR on the genomic gene sequence was performed on the surviving seedlings using primers pORE-F2 (fwd, 5'-TTTAGCGAT-GAACTTCACTC-3'/SEQ ID NO:310) and a custom designed reverse primer based on each target sequence.

Example 6

Evaluating Changes in Root Architecture in Transgenic Plants

Root architecture of the plant governs multiple key agricultural traits. Root size and depth have been shown to logically correlate with drought tolerance and enhanced NUE, since deeper and more branched root systems provide better soil coverage and can access water and nutrients stored in deeper soil layers.

To test whether the transgenic plants produce a modified root structure, plants were grown in agar plates placed vertically. A digital picture of the plates was taken every few days and the maximal length and total area covered by the plant roots were assessed. From every construct created, several independent transformation events were checked in replicates. To assess significant differences between root features, statistical test, such as a Student's t-test, was employed in order to identify enhanced root features and to provide a statistical value to the findings.

Example 7

Testing for Increased Nitrogen Use Efficiency (NUE)

To analyze whether the transgenic *Arabidopsis* plants are more responsive to nitrogen, plants were grown in two different nitrogen concentrations: (1) optimal nitrogen concentration (100% $NH_4NO_3$, which corresponds to 20.61 mM) or (2) nitrogen deficient conditions (1% or 10% $NH_4NO_3$, which corresponds to 0.2 and 2.06 mM, respectively). Plants were allowed to grow until seed production followed by an analysis of their overall size, time to flowering, yield, protein content of shoot and/or grain, and seed production. The parameters checked are each of the overall size of the plant, wet and dry weight, the weight of the seeds yielded, the average seed size and the number of seeds produced per plant. Other parameters that are tested include: the chlorophyll content of leaves (as nitrogen plant status and the degree of leaf greenness are highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (3316 sequences)

SEQ ID NO: 1 - DNA, 21 bp, Oryza sativa
tggtgagccttcctggctaag

SEQ ID NO: 2 - DNA, 24 bp, Oryza sativa
tcacggaaaacgagggagcagcca

SEQ ID NO: 3 - DNA, 21 bp, Oryza sativa
cctgaggggaaatcggcggga

SEQ ID NO: 4 - DNA, 22 bp, Zea mays
gggcaacttctcctttggcaga

SEQ ID NO: 5 - DNA, 24 bp, Artificial sequence
  Predicted folded 24-nts-long sequence
aactaaaacgaaacggaaggagta

SEQ ID NO: 6 - DNA, 24 bp, Artificial sequence
  Predicted folded 24-nts-long sequence
aaggtgcttttaggagtaggacgg

SEQ ID NO: 7 - DNA, 24 bp, Artificial sequence
  Predicted folded 24-nts-long sequence
acaaaggaattagaacggaatggc

SEQ ID NO: 8 - DNA, 24 bp, Artificial sequence
  Predicted folded 24-nts-long sequence
agaatcaggaatggaacggctccg

SEQ ID NO: 9 - DNA, 24 bp, Artificial sequence
  Predicted folded 24-nts-long sequence
agaatcagggatggaacggctcta

SEQ ID NO: 10 - DNA, 24 bp, Artificial sequence
  Predicted folded 24-nts-long sequence
agagtcacgggcgagaagaggacg

SEQ ID NO: 11 - DNA, 24 bp, Artificial sequence
  Predicted folded 24-nts-long sequence
aggacctagatgagcgggcggttt

SEQ ID NO: 12 - DNA, 24 bp, Artificial sequence
  Predicted folded 24-nts-long sequence
aggacgctgctggagacggagaat

SEQ ID NO: 13 - DNA, 24 bp, Artificial sequence
  Predicted folded 24-nts-long sequence
agggcttgttcggtttgaaggggt

SEQ ID NO: 14 - DNA, 24 bp, Artificial sequence
  Predicted folded 24-nts-long sequence
atctttcaacggctgcgaagaagg

SEQ ID NO: 15 - DNA, 24 bp, Artificial sequence
  Predicted folded 24-nts-long sequence
ctagaattagggatggaacggctc

SEQ ID NO: 16 - DNA, 24 bp, Artificial sequence
  Predicted folded 24-nts-long sequence
gagggataactggggacaacacgg

SEQ ID NO: 17 - DNA, 24 bp, Artificial sequence
  Predicted folded 24-nts-long sequence
gcggagtgggatggggagtgttgc

SEQ ID NO: 18 - DNA, 24 bp, Artificial sequence
  Predicted folded 24-nts-long sequence
ggagacggatgcggagactgctgg

SEQ ID NO: 19 - DNA, 24 bp, Artificial sequence
  Predicted folded 24-nts-long sequence
ggttaggagtggattgagggggat

SEQ ID NO: 20 - DNA, 24 bp, Artificial sequence
  Predicted folded 24-nts-long sequence
gtcaagtgactaagagcatgtggt

SEQ ID NO: 21 - DNA, 24 bp, Artificial sequence
  Predicted folded 24-nts-long sequence
gtggaatggaggagattgagggga

SEQ ID NO: 22 - DNA, 24 bp, Artificial sequence
  Predicted folded 24-nts-long sequence
tggctgaaggcagaaccaggggag

SEQ ID NO: 23 - DNA, 24 bp, Artificial sequence
  Predicted folded 24-nts-long sequence
tgtggtagagaggaagaacaggac

SEQ ID NO: 24 - DNA, 24 bp, Artificial sequence
  Predicted folded 24-nts-long sequence
agggactctctttatttccgacgg

SEQ ID NO: 25 - DNA, 24 bp, Artificial sequence
  Predicted folded 24-nts-long sequence
agggttcgtttcctgggagcgcgg

SEQ ID NO: 26 - DNA, 24 bp, Artificial sequence
  Predicted folded 24-nts-long sequence
tcctagaatcagggatggaacggc

SEQ ID NO: 27 - DNA, 24 bp, Artificial sequence
  Predicted folded 24-nts-long sequence
tgggagctctctgttcgatggcgc

SEQ ID NO: 28 - DNA, 22 bp, Artificial sequence
  Predicted Zea mays mir
aacgtcgtgtcgtgcttgggct

SEQ ID NO: 29 - DNA, 22 bp, Artificial sequence
  Predicted Zea mays mir
acctggaccaatacatgagatt

SEQ ID NO: 30 - DNA, 22 bp, Artificial sequence
  Predicted Zea mays mir
agaagcgacaatgggacggagt

SEQ ID NO: 31 - DNA, 23 bp, Artificial sequence
  Predicted Zea mays mir
aggaaggaacaaacgaggataag

SEQ ID NO: 32 - DNA, 22 bp, Artificial sequence
  Predicted Zea mays mir
ccaagagatggaagggcagagc

SEQ ID NO: 33 - DNA, 21 bp, Artificial sequence
  Predicted Zea mays mir
cgacaacgggacggagttcaa

SEQ ID NO: 34 - DNA, 22 bp, Artificial sequence
  Predicted Zea mays mir
gaggatggagaggtacgtcaga

SEQ ID NO: 35 - DNA, 23 bp, Artificial sequence
  Predicted Zea mays mir
gatgggtaggagagcgtcgtgtg

SEQ ID NO: 36 - DNA, 22 bp, Artificial sequence
  Predicted Zea mays mir
gatggttcataggtgacggtag

SEQ ID NO: 37 - DNA, 22 bp, Artificial sequence
  Predicted Zea mays mir
gggagccgagacatagagatgt

SEQ ID NO: 38 - DNA, 22 bp, Artificial sequence
  Predicted Zea mays mir
gtgaggagtgataatgagacgg

SEQ ID NO: 39 - DNA, 23 bp, Artificial sequence
  Predicted Zea mays mir
gtttggggctttagcaggtttat

SEQ ID NO: 40 - DNA, 22 bp, Artificial sequence
  Predicted Zea mays mir
tccatagctgggcggaagagat

SEQ ID NO: 41 - DNA, 21 bp, Artificial sequence
  Predicted Zea mays mir
tcggcatgtgtaggataggtg

SEQ ID NO: 42 - DNA, 22 bp, Artificial sequence
  Predicted Zea mays mir
tgataggctgggtgtggaagcg

SEQ ID NO: 43 - DNA, 22 bp, Artificial sequence
  Predicted Zea mays mir
tgcaaacagactggggaggcga

SEQ ID NO: 44 - DNA, 22 bp, Artificial sequence
  Predicted Zea mays mir
tttggctgacaggataagggag

SEQ ID NO: 45 - DNA, 22 bp, Artificial sequence
  Predicted Zea mays mir
ttttcatagctgggcggaagag

SEQ ID NO: 46 - DNA, 24 bp, Artificial sequence
  Predicted Zea mays mir
aactttaaataggtaggacggcgc

SEQ ID NO: 47 - DNA, 21 bp, Artificial sequence
  Predicted Zea mays mir
ggaatgttgtctggttcaagg

SEQ ID NO: 48 - DNA, 22 bp, Artificial sequence
  Predicted Zea mays mir
tgtaatgttcgcggaaggccac

SEQ ID NO: 49 - DNA, 21 bp, Artificial sequence
  Predicted Zea mays mir
tgttggcatggctcaatcaac

SEQ ID NO: 50 - DNA, 22 bp, Artificial sequence
  Predicted Zea mays mir
cgctgacgccgtgccacctcat

SEQ ID NO: 51 - DNA, 20 bp, Artificial sequence
  Predicted Zea mays mir
gcctgggcctctttagacct

SEQ ID NO: 52 - DNA, 22 bp, Artificial sequence
  Predicted Zea mays mir
gtaggatggatggagagggttc

SEQ ID NO: 53 - DNA, 20 bp, Artificial sequence
  Predicted Zea mays mir
tcaacgggctggcggatgtg

SEQ ID NO: 54 - DNA, 21 bp, Aquilegia caerulea
agaagagagagagcacaaccc

SEQ ID NO: 55 - DNA, 22 bp, Arabidopsis thaliana
cttgagagagagaacacagacg

SEQ ID NO: 56 - DNA, 21 bp, Medicago truncatula
tgagccaggatgacttgccgg

SEQ ID NO: 57 - DNA, 21 bp, Medicago truncatula
atgaagtgtttgggggaactc

SEQ ID NO: 58 - DNA, 21 bp, Oryza sativa
gtgaagtgtttgggggaactc

SEQ ID NO: 59 - DNA, 20 bp, Populus euphratica
ggccgggggacgggctggga

SEQ ID NO: 60 - DNA, 24 bp, Artificial sequence
  Predicted folded 24-nts-long sequence
aaaaaagactgagccgaattgaaa

SEQ ID NO: 61 - DNA, 24 bp, Artificial sequence
  Predicted folded 24-nts-long sequence
aaggagtttaatgaagaaagagag

SEQ ID NO: 62 - DNA, 24 bp, Artificial sequence
  Predicted folded 24-nts-long sequence
actgatgacgacactgaggaggct

SEQ ID NO: 63 - DNA, 24 bp, Artificial sequence
  Predicted folded 24-nts-long sequence
agaggaaccagagccgaagccgtt

SEQ ID NO: 64 - DNA, 24 bp, Artificial sequence
  Predicted folded 24-nts-long sequence
aggcaaggtggaggacgttgatga

SEQ ID NO: 65 - DNA, 24 bp, Artificial sequence
  Predicted folded 24-nts-long sequence
agggctgatttggtgacaagggga

SEQ ID NO: 66 - DNA, 24 bp, Artificial sequence
  Predicted folded 24-nts-long sequence
atataaagggaggaggtatggacc

SEQ ID NO: 67 - DNA, 24 bp, Artificial sequence
  Predicted folded 24-nts-long sequence
atcggtcagctggaggagacaggt

SEQ ID NO: 68 - DNA, 24 bp, Artificial sequence
  Predicted folded 24-nts-long sequence
atggtaagagactatgatccaact

SEQ ID NO: 69 - DNA, 24 bp, Artificial sequence
  Predicted folded 24-nts-long sequence
caattttgtactggatcggggcat

SEQ ID NO: 70 - DNA, 24 bp, Artificial sequence
  Predicted folded 24-nts-long sequence
cagaggaaccagagccgaagccgt

SEQ ID NO: 71 - DNA, 24 bp, Artificial sequence
  Predicted folded 24-nts-long sequence
cggctggacagggaagaagagcac

SEQ ID NO: 72 - DNA, 24 bp, Artificial sequence
  Predicted folded 24-nts-long sequence
gaaacttggagagatggaggcttt

SEQ ID NO: 73 - DNA, 24 bp, Artificial sequence
  Predicted folded 24-nts-long sequence
gagagagaagggagcggatctggt

SEQ ID NO: 74 - DNA, 24 bp, Artificial sequence
  Predicted folded 24-nts-long sequence
gctgcacgggattggtggagaggt

SEQ ID NO: 75 - DNA, 24 bp, Artificial sequence
  Predicted folded 24-nts-long sequence
ggctgctggagagcgtagaggacc

SEQ ID NO: 76 - DNA, 24 bp, Artificial sequence
  Predicted folded 24-nts-long sequence
gggttttgagagcgagtgaagggg

SEQ ID NO: 77 - DNA, 24 bp, Artificial sequence
  Predicted folded 24-nts-long sequence
ggtattggggtggattgaggtgga

SEQ ID NO: 78 - DNA, 24 bp, Artificial sequence
  Predicted folded 24-nts-long sequence
ggtggcgatgcaagaggagctcaa

SEQ ID NO: 79 - DNA, 24 bp, Artificial sequence
  Predicted folded 24-nts-long sequence
gttgctggagagagtagaggacgt

SEQ ID NO: 80 - DNA, 22 bp, Artificial sequence
  Predicted Zea Mays mir sequence
aaaagagaaaccgaagacacat

SEQ ID NO: 81 - DNA, 22 bp, Artificial sequence
  Predicted Zea Mays mir sequence
aaagaggatgaggagtagcatg

SEQ ID NO: 82 - DNA, 21 bp, Artificial sequence
  Predicted Zea Mays mir sequence
aatacacatgggttgaggagg

SEQ ID NO: 83 - DNA, 22 bp, Artificial sequence
  Predicted Zea Mays mir sequence
agaagcggactgccaaggaggc

SEQ ID NO: 84 - DNA, 23 bp, Artificial sequence
  Predicted Zea Mays mir sequence
agagggtttggggatagagggac

SEQ ID NO: 85 - DNA, 21 bp, Artificial sequence
  Predicted Zea Mays mir sequence
atagggatgaggcagagcatg

SEQ ID NO: 86 - DNA, 22 bp, Artificial sequence
  Predicted Zea Mays mir sequence
atgctatttgtacccgtcaccg

SEQ ID NO: 87 - DNA, 22 bp, Artificial sequence
  Predicted Zea Mays mir sequence
atgtggataaaaggagggatga

SEQ ID NO: 88 - DNA, 22 bp, Artificial sequence
  Predicted Zea Mays mir sequence
caacaggaacaaggaggaccat

SEQ ID NO: 89 - DNA, 21 bp, Artificial sequence
  Predicted Zea Mays mir sequence
ctgagttgagaaagagatgct

SEQ ID NO: 90 - DNA, 22 bp, Artificial sequence
  Predicted Zea Mays mir sequence
ctgatgggaggtggagttgcat

SEQ ID NO: 91 - DNA, 23 bp, Artificial sequence
  Predicted Zea Mays mir sequence
ctgggaagatggaacattttggt

SEQ ID NO: 92 - DNA, 22 bp, Artificial sequence
  Predicted Zea Mays mir sequence
gaagatatacgatgatgaggag

SEQ ID NO: 93 - DNA, 21 bp, Artificial sequence
  Predicted Zea Mays mir sequence
gaatctatcgtttgggctcat

SEQ ID NO: 94 - DNA, 21 bp, Artificial sequence
  Predicted Zea Mays mir sequence
gacgagctacaaaaggattcg

SEQ ID NO: 95 - DNA, 22 bp, Artificial sequence
  Predicted Zea Mays mir sequence
gatgacgaggagtgagagtagg

SEQ ID NO: 96 - DNA, 23 bp, Artificial sequence
  Predicted Zea Mays mir sequence
gggcatcttctggcaggaggaca

SEQ ID NO: 97 - DNA, 21 bp, Artificial sequence
  Predicted Zea Mays mir sequence
tacggaagaagagcaagtttt

SEQ ID NO: 98 - DNA, 22 bp, Artificial sequence
  Predicted Zea Mays mir sequence
tagaaagagcgagagaacaaag

SEQ ID NO: 99 - DNA, 21 bp, Artificial sequence
  Predicted Zea Mays mir sequence
tgatattatggacgactggtt

SEQ ID NO: 100 - DNA, 21 bp, Artificial sequence
  Predicted Zea Mays mir sequence
tggaagggccatgccgaggag

SEQ ID NO: 101 - DNA, 21 bp, Artificial sequence
  Predicted Zea Mays mir sequence
ttgagcgcagcgttgatgagc

SEQ ID NO: 102 - DNA, 23 bp, Artificial sequence
  Predicted Zea Mays mir sequence
ttggataacgggtagtttggagt

SEQ ID NO: 103 - DNA, 21 bp, Artificial sequence
  Predicted Zea Mays mir sequence
agctgccgactcattcaccca

SEQ ID NO: 104 - DNA, 22 bp, Artificial sequence
  Predicted Zea Mays mir sequence
tgtacgatgatcaggaggaggt

SEQ ID NO: 105 - DNA, 21 bp, Artificial sequence
  Predicted Zea Mays mir sequence
tgtgttctcaggtcgcccccg

SEQ ID NO: 106 - DNA, 21 bp, Artificial sequence
  Predicted Zea Mays mir sequence
actaaaaagaaacagagggag

SEQ ID NO: 107 - DNA, 20 bp, Artificial sequence
  Predicted Zea Mays mir sequence
gaccggctcgacccttctgc

SEQ ID NO: 108 - DNA, 22 bp, Artificial sequence
  Predicted Zea Mays mir sequence
tggtaggatggatggagagggt

SEQ ID NO: 109 - DNA, 21 bp, Zea mays
ggaatgttgtctggttcaagg

SEQ ID NO: 110 - DNA, 22 bp, Zea mays
ggcaagtctgtccttggctaca

SEQ ID NO: 111 - DNA, 21 bp, Zea mays
tcattgagcgcagcgttgatg

SEQ ID NO: 112 - DNA, 21 bp, Zea mays
ggggcggactgggaacacatg

SEQ ID NO: 113 - DNA, 21 bp, Zea mays
tgccaaaggggatttgcccgg

SEQ ID NO: 114 - DNA, 24 bp, Artificial sequence
  Predicted siRNA sequence
aagaaacggggcagtgagatggac

SEQ ID NO: 115 - DNA, 25 bp, Artificial sequence
  Predicted siRNA sequence
agaaaagattgagccgaattgaatt

SEQ ID NO: 116 - DNA, 22 bp, Artificial sequence
  Predicted siRNA sequence
agagcctgtagctaatggtggg

SEQ ID NO: 117 - DNA, 24 bp, Artificial sequence
  Predicted siRNA sequence
aggtagcggcctaagaacgacaca

SEQ ID NO: 118 - DNA, 24 bp, Artificial sequence
  Predicted siRNA sequence
cctatatactggaacggaacggct

SEQ ID NO: 119 - DNA, 24 bp, Artificial sequence
  Predicted siRNA sequence
ctatatactggaacggaacggctt

SEQ ID NO: 120 - DNA, 24 bp, Artificial sequence
  Predicted siRNA sequence
gacgagatcgagtctggagcgagc

SEQ ID NO: 121 - DNA, 22 bp, Artificial sequence
  Predicted siRNA sequence
gagtatggggagggactaggga

SEQ ID NO: 122 - DNA, 24 bp, Artificial sequence
  Predicted siRNA sequence
gacgaaatagaggctcaggagagg

SEQ ID NO: 123 - DNA, 22 bp, Artificial sequence
  Predicted siRNA sequence
ggattcgtgattggcgatgggg

SEQ ID NO: 124 - DNA, 24 bp, Artificial sequence
  Predicted siRNA sequence
ggtgagaaacggaaaggcaggaca

SEQ ID NO: 125 - DNA, 24 bp, Artificial sequence
  Predicted siRNA sequence
gtgtctgagcagggtgagaaggct

SEQ ID NO: 126 - DNA, 24 bp, Artificial sequence
  Predicted siRNA sequence
gttttggaggcgtaggcgagggat

SEQ ID NO: 127 - DNA, 21 bp, Artificial sequence
  Predicted siRNA sequence
tgggacgctgcatctgttgat

SEQ ID NO: 128 - DNA, 24 bp, Artificial sequence
  Predicted siRNA sequence
tctatatactggaacggaacggct

SEQ ID NO: 129 - DNA, 24 bp, Artificial sequence
  Predicted siRNA sequence
gttgttggaggggtagaggacgtc

SEQ ID NO: 130 - DNA, 24 bp, Artificial sequence
  Predicted siRNA sequence
aatgacaggacgggatgggacggg

SEQ ID NO: 131 - DNA, 24 bp, Artificial sequence
  Predicted siRNA sequence
acggaacggcttcataccacaata

SEQ ID NO: 132 - DNA, 24 bp, Artificial sequence
  Predicted siRNA sequence
gacgggccgacatttagagcacgg

SEQ ID NO: 133 - DNA, 18 bp, Artificial sequence
  Predicted siRNA sequence
acggataaaaggtactct

SEQ ID NO: 134 - DNA, 22 bp, Artificial sequence
  Predicted siRNA sequence
agtatgtcgaaaactggagggc

SEQ ID NO: 135 - DNA, 19 bp, Artificial sequence
  Predicted siRNA sequence
ataagcaccggctaactct

SEQ ID NO: 136 - DNA, 24 bp, Artificial sequence
  Predicted siRNA sequence
attcagcgggcgtggttattggca

SEQ ID NO: 137 - DNA, 20 bp, Artificial sequence
  Predicted siRNA sequence
cagcgggtgccatagtcgat

SEQ ID NO: 138 - DNA, 18 bp, Artificial sequence
  Predicted siRNA sequence
cattgcgacggtcctcaa

SEQ ID NO: 139 - DNA, 19 bp, Artificial sequence
  Predicted siRNA sequence
ctcaacggataaaaggtac

SEQ ID NO: 140 - DNA, 19 bp, Artificial sequence
  Predicted siRNA sequence
gacagtcaggatgttggct

SEQ ID NO: 141 - DNA, 22 bp, Artificial sequence
  Predicted siRNA sequence
gactgatccttcggtgtcggcg

SEQ ID NO: 142 - DNA, 24 bp, Artificial sequence
  Predicted siRNA sequence
gccgaagattaaaagacgagacga

SEQ ID NO: 143 - DNA, 20 bp, Artificial sequence
  Predicted siRNA sequence
gcctttgccgaccatcctga

SEQ ID NO: 144 - DNA, 22 bp, Artificial sequence
  Predicted siRNA sequence
ggaatcgctagtaatcgtggat

SEQ ID NO: 145 - DNA, 20 bp, Artificial sequence
  Predicted siRNA sequence
ggagcagctctggtcgtggg

SEQ ID NO: 146 - DNA, 21 bp, Artificial sequence
  Predicted siRNA sequence
ggaggctcgactatgttcaaa

SEQ ID NO: 147 - DNA, 22 bp, Artificial sequence
  Predicted siRNA sequence
ggagggatgtgagaacatgggc

SEQ ID NO: 148 - DNA, 19 bp, Artificial sequence
  Predicted siRNA sequence
gtccccttcgtctagaggc

SEQ ID NO: 149 - DNA, 20 bp, Artificial sequence
  Predicted siRNA sequence
gtctgagtggtgtagttggt

SEQ ID NO: 150 - DNA, 18 bp, Artificial sequence
  Predicted siRNA sequence
gttggtagagcagttggc

SEQ ID NO: 151 - DNA, 21 bp, Artificial sequence
  Predicted siRNA sequence
tacgttcccgggtcttgtaca

SEQ ID NO: 152 - DNA, 20 bp, Artificial sequence
  Predicted siRNA sequence
tatggatgaagatgggggtg

SEQ ID NO: 153 - DNA, 22 bp, Artificial sequence
  Predicted siRNA sequence
tcaacggataaaaggtactccg

SEQ ID NO: 154 - DNA, 18 bp, Artificial sequence
  Predicted siRNA sequence
tgcccagtgctttgaatg

SEQ ID NO: 155 - DNA, 21 bp, Artificial sequence
  Predicted siRNA sequence
tgcgagaccgacaagtcgagc

SEQ ID NO: 156 - DNA, 20 bp, Artificial sequence
  Predicted siRNA sequence
tttgcgacacgggctgctct

SEQ ID NO: 157 - DNA, 22 bp, Artificial sequence
  Predicted siRNA sequence
catcgctcaacggacaaaaggt

SEQ ID NO: 158 - DNA, 24 bp, Artificial sequence
  Predicted siRNA sequence
aagacgaaggtagcagcgcgatat

SEQ ID NO: 159 - DNA, 24 bp, Artificial sequence
  Predicted siRNA sequence
agccagactgatgagagaaggagg

SEQ ID NO: 160 - DNA, 24 bp, Artificial sequence
  Predicted siRNA sequence
acgttgttggaagggtagaggacg

SEQ ID NO: 161 - DNA, 21 bp, Artificial sequence
  Predicted siRNA sequence
caagttatgcagttgctgcct

SEQ ID NO: 162 - DNA, 22 bp, Artificial sequence
  Predicted siRNA sequence
cagaatggaggaagagatggtg

SEQ ID NO: 163 - DNA, 24 bp, Artificial sequence
  Predicted siRNA sequence
atctgtggagagagaaggttgccc

SEQ ID NO: 164 - DNA, 22 bp, Artificial sequence
  Predicted siRNA sequence
atgtcagggggccatgcagtat

SEQ ID NO: 165 - DNA, 24 bp, Artificial sequence
  Predicted siRNA sequence
atcctgactgtgccgggccggccc

SEQ ID NO: 166 - DNA, 22 bp, Artificial sequence
  Predicted siRNA sequence
cgagttcgccgtagagaaagct

SEQ ID NO: 167 - DNA, 24 bp, Artificial sequence
  Predicted siRNA sequence
gactgattcggacgaaggagggtt

SEQ ID NO: 168 - DNA, 23 bp, Artificial sequence
  Predicted siRNA sequence
gtctgaacactaaacgaagcaca

SEQ ID NO: 169 - DNA, 24 bp, Artificial sequence
  Predicted siRNA sequence
gacgttgttggaagggtagaggac

SEQ ID NO: 170 - DNA, 24 bp, Artificial sequence
  Predicted siRNA sequence
gctactgtagttcacgggccggcc

SEQ ID NO: 171 - DNA, 25 bp, Artificial sequence
  Predicted siRNA sequence
ggtattcgtgagcctgtttctggtt

SEQ ID NO: 172 - DNA, 22 bp, Artificial sequence
  Predicted siRNA sequence
tggaaggagcatgcatcttgag

SEQ ID NO: 173 - DNA, 21 bp, Artificial sequence
  Predicted siRNA sequence
ttcttgaccttgtaagaccca

SEQ ID NO: 174 - DNA, 22 bp, Artificial sequence
  Predicted siRNA sequence
agcagaatggaggaagagatgg

SEQ ID NO: 175 - DNA, 24 bp, Artificial sequence
  Predicted siRNA sequence
ctggacactgttgcagaaggagga

SEQ ID NO: 176 - DNA, 24 bp, Artificial sequence
  Predicted siRNA sequence
gaaataggataggaggagggatga

SEQ ID NO: 177 - DNA, 24 bp, Artificial sequence
  Predicted siRNA sequence
ggcacgactaacagactcacgggc

SEQ ID NO: 178 - DNA, 19 bp, Artificial sequence
  Predicted siRNA sequence
aatcccggtggaacctcca

SEQ ID NO: 179 - DNA, 24 bp, Artificial sequence
  Predicted siRNA sequence
acacgacaagacgaatgagagaga

SEQ ID NO: 180 - DNA, 20 bp, Artificial sequence
  Predicted siRNA sequence
acgacgaggacttcgagacg

SEQ ID NO: 181 - DNA, 19 bp, Artificial sequence
  Predicted siRNA sequence
caaagtggtcgtgccggag

SEQ ID NO: 182 - DNA, 20 bp, Artificial sequence
  Predicted siRNA sequence
cagcttgagaatcgggccgc

SEQ ID NO: 183 - DNA, 19 bp, Artificial sequence
  Predicted siRNA sequence
ccctgtgacaagaggagga

SEQ ID NO: 184 - DNA, 23 bp, Artificial sequence
  Predicted siRNA sequence
cctgctaactagttatgcggagc

SEQ ID NO: 185 - DNA, 19 bp, Artificial sequence
  Predicted siRNA sequence
cgaactcagaagtgaaacc

SEQ ID NO: 186 - DNA, 21 bp, Artificial sequence
  Predicted siRNA sequence
cgcttcgtcaaggagaagggc

SEQ ID NO: 187 - DNA, 26 bp, Artificial sequence
  Predicted siRNA sequence
cttaactgggcgttaagttgcagggt

SEQ ID NO: 188 - DNA, 20 bp, Artificial sequence
  Predicted siRNA sequence
ggacgaacctctggtgtacc

SEQ ID NO: 189 - DNA, 19 bp, Artificial sequence
  Predicted siRNA sequence
ggcgctggagaactgaggg

SEQ ID NO: 190 - DNA, 19 bp, Artificial sequence
  Predicted siRNA sequence
gggggcctaaataaagact

SEQ ID NO: 191 - DNA, 20 bp, Artificial sequence
  Predicted siRNA sequence
gtgctaacgtccgtcgtgaa

SEQ ID NO: 192 - DNA, 20 bp, Artificial sequence
  Predicted siRNA sequence
tagcttaaccttcgggaggg

SEQ ID NO: 193 - DNA, 22 bp, Artificial sequence
  Predicted siRNA sequence
tgagaaagaaagagaaggctca

SEQ ID NO: 194 - DNA, 23 bp, Artificial sequence
  Predicted siRNA sequence
tgatgtccttagatgttctgggc

SEQ ID NO: 195 - DNA, 21 bp, Artificial sequence
  Predicted siRNA sequence
catgtgttctcaggtcgcccc

SEQ ID NO: 196 - DNA, 142 bp, Oryza sativa
atgaggagattgcctctgttagccaagaatggcttgcctatctccactatttggttcatcactggaacacacttggggttctcagatggtggatgaaatatggaagatggtgagccttcctggctaagagagtgattctcat

SEQ ID NO: 197 - DNA, 169 bp, Oryza sativa
ggaaaggctttgtaaaacacactatttgacagtttggaaagcgtgctcacggaaaacgagggagcagccaaggcattgttcttaccggtttatgaattggctacttcctcgttttccgtaaacacgcttcccgagcttctaaacggtgtgtttcttgcaaaaactttat

SEQ ID NO: 198 - DNA, 237 bp, Oryza sativa
gacgccgcactgccgatttccccctcgggcgagccatcggagcgggggccgttggctcccaaagcagacgcgagaattcactgaaattaccgcgccatcttatctccgcaagttgaagaatataattcgggcgcagtaatttttagtgaattcatgtgtctactactacatatgtctgcttgggagccaaccgcgtttcgatggctcgcctgaggggaaatcggcgggaggcgtttg

SEQ ID NO: 199 - DNA, 105 bp, Zea mays
caggatgtgcacctgcatttctgggcaacttctcctttggcagatgcgcgagaatgtgccactgctgccaaaggaaatttgccccggaattcatctgcacaagca

SEQ ID NO: 200 - DNA, 89 bp, Artificial sequence
  Predicted folded 24-nts-long seq pre-mir
gtactccctccgtttctttttagttgtcgctggatagttcaattttgcactatccagcgatcgacaactaaaacgaaacggaaggagta

SEQ ID NO: 201 - DNA, 43 bp, Artificial sequence
  Predicted folded 24-nts-long seq pre-mir
gcacccggggttacccctcaaggtgcttttaggagtaggacgg

SEQ ID NO: 202 - DNA, 100 bp, Artificial sequence
  Predicted folded 24-nts-long seq pre-mir
acaaaggaactagaacggaatggctccaattagggaatattctcctcagatccggaatcattccgctccaaaaaatcaaccggacggagccgctccgttc

SEQ ID NO: 203 - DNA, 271 bp, Artificial sequence
  Predicted folded 24-nts-long seq pre-mir
acggaaccgttctgtcccagttttgttgttgtttggttacaaagtaactagaacgaaatggctccaattaggaaatattctcctcaaatccggaaccattccgctccaaaaaatcaatgggacggagccgctctgttccaatcccgctctcacagtcacgctctgttccgttcactatgcaaccaaacaaaaaacagaaccgctccgttccagattaccaaacacagaacagagcggctccgttcctagaatcaggaatggaacggctccg

SEQ ID NO: 204 - DNA, 271 bp, Artificial sequence
  Predicted folded 24-nts-long seq pre-mir
acggaaccgttccgtcccagttttattgttgtttggttacaaagtaactagaacggaatggctccaattagggaatattctcctcagatccggaaccattccgctccaaaaaatcaatgggacggagccgctctgttccaatcccgctctcacagtcacgctccgttccgttcactatgcaaccaaacaaaaaacagaaccgctccgttccagattaccaaacacagaacagagcggctccgttcctagaatcagggatggaacggctctg

SEQ ID NO: 205 - DNA, 119 bp, Artificial sequence
  Predicted folded 24-nts-long seq pre-mir
tcctcctctcgcgaccggcgagtctagcccctcatccgctcctcaatgtcggtcaccgaacggtgaggaggaaactggagcggggcgcgaggcgcagagtcacgggcgagaagaggacg

SEQ ID NO: 206 - DNA, 280 bp, Artificial sequence
  Predicted folded 24-nts-long seq pre-mir
aggacctaggtgagcgggcggttttcgcagggctacgaggcgcggtaatagaaaagggatacgatcacaacacttgaaatgacgaacgtcgattttacggttgaagagcagctgatgaagcaaaaaaggacaaagaccatcacatgaacaagtttctgcaacaggggttggcctgtttgcccatcatgatccattttcctccgggccctgccaacaagtgagaaacttagccgcctccgatactactaatcttttgttatgcacaataactctcatctag

SEQ ID NO: 207 - DNA, 225 bp, Artificial sequence
  Predicted folded 24-nts-long seq pre-mir
aggacgctgctggagacggagaatatatagaggacagaatcttttagagtgttctgtaaaggacagagaatattcctttacgggacgaaatttaggggacgctgctggagacagtttaagactgtctccagcaacgtcctctatattcatcatctatatctgtcctttacagtctcctctaaaagatttcatcatttatatctcctttttctccaacaacgtcct

SEQ ID NO: 208 - DNA, 129 bp, Artificial sequence
  Predicted folded 24-nts-long seq pre-mir
agggcatgttcggtttgaaggggtttgagggggattggaggggattaaatcccctcctatttaaatttgtatagaaggggatttaatcccctccaatccctctcgtccacccctaaccgaacaagccct

SEQ ID NO: 209 - DNA, 341 bp, Artificial sequence
  Predicted folded 24-nts-long seq pre-mir
atctttcaacggctgcgaagaaggaacaataatattatatgcctgaaaataatgccgaagcttcctggatgccattagaacggcatacaacaccttctccagttctgtataatttttctttgagacactaaggacctcagatacaaaatatactgggacctgcttcttgatttgtccatcaaacttctcctgcacaagtgccgcacttactgctgagtgcgaagctgccacatacaacaacagaggagcccctggcattggtggagttaatgttgttagatctatcaggtattgcttgagttcttcgaaagctttttgttgagctgggccccattgaaaga

SEQ ID NO: 210 - DNA, 328 bp, Artificial sequence
  Predicted folded 24-nts-long seq pre-mir
ggagtgttatgtcccagttttgttgttgttggttacaaagtagctagaacggagtggctccaattagagaatattctcctcaaatccggaaccataccactccaaaaaatcaaccggacggagccgctccgttcccagcccgctcgcacagtcacgcgactcaggtacctgctaatttctacttcagtgactcttcaaccaaacaaaggatggagccgctctgttccagttcactctgcaaccaaacaaaaaacagagccgctccgttccagcttaccaaacacagaacagagcggctccgttcctagaattagggatggaacggctc

SEQ ID NO: 211 - DNA, 55 bp, Artificial sequence
  Predicted folded 24-nts-long seq pre-mir
ccctgtcgtcctccctcgtccctccaattttgagggataactggggacaacactg

SEQ ID NO: 212 - DNA, 224 bp, Artificial sequence
  Predicted folded 24-nts-long seq pre-mir
ctgtacctgcactccccatttccacactgtctctctcctctccgcagctctctgcgggcgcgcgcggctgctggcgggccccaggtgtcatagactgcatgcggagtgggatggggagtgttgctggaaacggagacggatacggagaggagagagaatgtgtcggccgcgcgttttagggatacggagagggagtctgctggagttggtctaacaataaagac

SEQ ID NO: 213 - DNA, 242 bp, Artificial sequence
  Predicted folded 24-nts-long seq pre-mir
tccagcagactccctctccgtatccctaaaacgcacggccaacagtttttctctcctctccgtatctgtctccgtttccagcagactccgtatttgcactccgcatgcagtctatgacacctggggcccgcgagcagccgcgcgcgcatgcagtgagctgcggagaggagagagaaagcgtggaaaaagggaatgcaggtacaggccgtgcgttttagggagacggatgcggagactgctgg

SEQ ID NO: 214 - DNA, 108 bp, Artificial sequence
  Predicted folded 24-nts-long seq pre-mir
ggttaggggtggattgagggggattggaggggattaaatccccttctatacaaatttgaataggagatgatttaatcccctccaatccccctcaatgcacctcaaacc

SEQ ID NO: 215 - DNA, 27 bp, Artificial sequence
  Predicted folded 24-nts-long seq pre-mir
agagacatgtgactaagaacatgtagt

SEQ ID NO: 216 - DNA, 92 bp, Artificial sequence
  Predicted folded 24-nts-long seq pre-mir
gtggaatggaggagattgaggggactagaatccctcactatttaaaattgaatagtaggggattctagccccctcaatcccctctattaccc

SEQ ID NO: 217 - DNA, 85 bp, Artificial sequence
  Predicted folded 24-nts-long seq pre-mir
tggctgaaggcagaaccaggggaggcagcctaccccttagagccttaataggtagtatagattcctgttggttgtctttagacca

SEQ ID NO: 218 - DNA, 57 bp, Artificial sequence
  Predicted folded 24-nts-long seq pre-mir
gttctccgctccctacacaccacagcaaaatggtgtggtagagaggaagaacaggac

SEQ ID NO: 219 - DNA, 89 bp, Artificial sequence
  Predicted folded 24-nts-long seq pre-mir
agggactctctttatttccgacggccaaggtggtgggccgtcggaaatagacgtatttccgacggctggccgtaggccgtcggaaataa

SEQ ID NO: 220 - DNA, 43 bp, Artificial sequence
  Predicted folded 24-nts-long seq pre-mir
gctcccaggaaacgcggctagggttcgttttctgggagcgcgg

SEQ ID NO: 221 - DNA, 334 bp, Artificial sequence
  Predicted folded 24-nts-long seq pre-mir
agtcgctccgttcccagcccgctcgcacagctcgccctcccatctgtgtgcagcagctcgcgcgcctccctctgcaaccaaacaaaaaacagagccgctctgttccagttcactctgcaaccaaacaaaaaacatagtcgctccgttccaacttaggccatgttcgtttgcgtcggattgcacccggaatcaagtcagctaatcaaagtttatataaattagagaagcaatccggttagtaatcgttctgacccaccaatccggcacaaacgaacaaggtcttaccaaacacagaacagagcggctccgttcctagaatcagggatggaacggc

SEQ ID NO: 222 - DNA, 31 bp, Artificial sequence
  Predicted folded 24-nts-long seq pre-mir
ccgttgttgggagctctctgttcgatggcgc

SEQ ID NO: 223 - DNA, 58 bp, Zea mays
aacgtcgtgtcgtgcttgggctgtagcctcggtccatagtgctagcccggcccgacac

SEQ ID NO: 224 - DNA, 417 bp, Zea mays
acctggaccaatacatgagattcttgtgctatttgggggatttggtcttctactaggaggtctaggagtagtattacttaccaacccaatttattctgccttttcgctaggattagttcttgtttgtatatccttattctattttttattaaattcctactttgtagctgtcgcacaacttcttatttatgtgggagccataaatgtcttgatcatatttgctgtaatgtttgtaaacggctcagagtggtctaaagataagaattattggactattggagatgggtttactttactcctttgtataactattcctttttcactaatgactactatcccagatacgtcgtggtatggaattctttggactacaagatcaaaccaaatagtagaacagggtctcataaataacgttca

SEQ ID NO: 225 - DNA, 271 bp, Zea mays
agaagcgacaatgggacggagttcaagaactctcaaattgaaagcttccttgaggaggagggcatcaagcatgagttctcttctccctacactccacaacaaaatggtgtagtggagaggaagaatcgaactctattggacatggcaagaaccatgcttgatgagtacaagacaccggaccggttttgggccgaagcgatcaacaccgcctgctacgccatcaaccggttatatcttcaccgaatcctcaagaagacatcatatgaactcc

SEQ ID NO: 226 - DNA, 223 bp, Zea mays
tttatcctcgtcgtatcctttatatggaaatccggggccagagggtcattcccttgactcgtactgatgagaagttttttactccatcaaaaattgaacaaaaagctgccgaattggtctatttcttgcgtgtaccaattgaagtattttgagtaccagttgcaattgtaaggggattttcgagtatttatctaaagtaaaggaaggaacaaacgaggataag

SEQ ID NO: 227 - DNA, 43 bp, Zea mays
ccaagagatggaagggcatagctttttttgttttttcatcttt

SEQ ID NO: 228 - DNA, 415 bp, Zea mays
ttggctctggcaccgccgactagctcatgttgggatgaagaatcttcataagcttctaaagggagaacacattttaggattaacaaatgttcattttgagaaagacatgatttgtagcgcatgcccaagcagggaagcaagttggcacccatcatccacacaagaacatcatgacgaccgacaggccgcttgagctactccacatggatctattcggcccgatcgcttacataagcatcggcgggagtaagtattgtcttgtgattgttgatgattattctcgcttcacttgggtattctttttacaggaaaaatctcaaacccaagagaccttaaagggattcttgagacgggctcaaaatgagtttggcttaaggatcaagaaaataagaagcgacaacgggacggagttcaa

SEQ ID NO: 229 - DNA, 58 bp, Zea mays
atgcctgctggtaccactcgttgatttccggaggaggaggatggagaggtacgtcagg

SEQ ID NO: 230 - DNA, 44 bp, Zea mays
gatgggtaggagagcgttgatggcggcagcgcacctcctaccca

SEQ ID NO: 231 - DNA, 239 bp, Zea mays
gatggttcataggtgacggtagtaaaatttgctgatttgtactgaaggttgataaaaatataaaaaattattgacagtgaaagtattttctgtatttctgtgatttctatagaaaccaatataatggtggaaatgcccgctggggatatcgttttagttttagtttttgacaagtggatgtgtaattaatatgtgatcacgcgatctgttgtttcgtgcttcttcgctttggtactatc

SEQ ID NO: 232 - DNA, 234 bp, Zea mays
gggagccgagacatagagatgtcacccaacaacaggagtcatatatatgatatgattagcaaggagttgcttaccgatctaccttgtcttctagcggtgatgctaaagctcactagtagacttgttagttgtgggttctgaatcactaagtatcaatcgagggatattgattttagtgggagtagactattaaatgtttaatatgatttactctgtcatggatatttttgtctt

SEQ ID NO: 233 - DNA, 238 bp, Zea mays
gtgaggagtgataatgggacggaattcaagaacacaggtgttgaagaattcttaggtgaagaaggaatcaaacatgagttctcggttccttacactctacaacaaaatggtgtcgtggaaagaaagaaccgaactctaattgaagcagctagaactatgttagatgagtacaagacacctgacaacttttgggcagaggcggtcaacaccacctgtcatgcaatcaaccgtctctatc

SEQ ID NO: 234 - DNA, 51 bp, Zea mays
ctgtagcacccgtgctaagtactctatggtttggggctttagcaggtttat

SEQ ID NO: 235 - DNA, 63 bp, Zea mays
cccctctccaccccatgcatatggtagttcgtgatgaagtttccatagctgggcggaagagat

SEQ ID NO: 236 - DNA, 70 bp, Zea mays
tcggcatgtgtagcataggtgtttttcaagttttgaagttttcttctttccttgcttgttgcctgctaca

SEQ ID NO: 237 - DNA, 80 bp, Zea mays
tgataggccgggtgtgtaagcgcagcgatgcgttgagctaaccggtactaatgaaccgtgaggcttaaccttacaacgcc

SEQ ID NO: 238 - DNA, 405 bp, Zea mays
gtcctctccatctctatggcacaaccgtttgggtcatccatcattacaaaacattcaaaaattagccaataataatcagattatatgttctagcgagtcaagtagtatgtctgtgtgtgacgcttgtcaacaaggcaagagtcaccaattaccttatctagtgtcaacaagtgtctctaccaagccttaacaactcgttttctcggatgtatggggcccagccctcgagtccattgatcgaaagaaattctatgtcagttttatagatgattttaacaaattcagctggatttatttgctgaaacataattctgaagtgttccaaagttttactgagtttcaaaccatggttgagcgcctatttgacaccaaaattattgctatgcaaacagactggggaggcga

SEQ ID NO: 239 - DNA, 339 bp, Zea mays
tttggctgaaaggataagggaggaaattatagagatgtttcacaggaggaggaggattgcacagaagttgcaaggaaggattttaccgtcggttctgcgtatcctacacggcagaacaagaggtttaagtcatttatcagtacgtaaagctgacaactacattgctgaggtaaggaacaacaatgatgtgcattccaagcatattgtcaatgctcatttgcgggaatgttcttgcaaagagtggcagtacacgggcaaaccatgtatccatgctttgtgcttgataacagcaaacgggcaaaccatgtatccatgctttttattcttttttcagctaga

SEQ ID NO: 240 - DNA, 58 bp, Zea mays
ctctccgccccatgcatatggtagttcgtgatgaagttttcatagctgggcggaagag

SEQ ID NO: 241 - DNA, 224 bp, Zea mays
tccgaagtttccctcaggatagctggagcccacacgagttctatcgggtaaagccaatgattagaggcatcgggggcgcaacgccctcgacctattctcaaactttaaataggtaggacggcgcggctgcttcggtgagccgtgccacggaatcgggagctccaagtgggccatttttggtaagcagaactggcgatgcgggatgaaccggaagccgggttacg

SEQ ID NO: 242 - DNA, 112 bp, Zea mays
ggaatgttgtctggttcaaggtcttgctttccgatttgaggatgatccatgcttgcatgtgtagttttttttgttcctcagatctacaagatctcggaccaggcttcattcc

SEQ ID NO: 243 - DNA, 403 bp, Zea mays
tataatgttcgcggaaggccaccttgaattcttcccatgttatctgatgattggccagttgaacgaccacggaatttccccaccaggtgctggcagggccgcgcagttgctgggctgcgaataaaggcttctaggttttagaacagcgcagaagtccgaatttttgctcgataacccgaatccattcgtcggcttctaacgggtcttcagctttaacaaacaggggtggacgtgtctctgagaagtccaagtaagaagtttcgcgggggccctgttgataaccccgcctgccttattgctgaaactgttgacccgccatctctctcagaaaacgggtattatccgcggtcgcgttcactaaggcggcaatcgcctcagcaagtgtgggagggacaggaggtgg

SEQ ID NO: 244 - DNA, 108 bp, Zea mays
tgttggcatggctcaatcaactcgccggccgcgggtggcttatagcttaattctgcgcattcgatcgaggtgcgggcgcagtgtttaattgattgagccgtgccaata

SEQ ID NO: 245 - DNA, 222 bp, Zea mays
gatctccgggggaggaggatggagaggcacatcaggcgaacgagggacaaaaggcatgcccatggaggaagcttgacgacgaagattgtcgtcagtctcccgctgacgccgtgccacctcatggacatcagcagaaatgttgcggcacatggagaaaaatgtcgcaagcccattgaccaagcgagcacccatcccgcggccacgacctcgaccacgaccacg

SEQ ID NO: 246 - DNA, 42 bp, Zea mays
ggctggtggggctcgggcgaaggcctgggcctctttagacct

SEQ ID NO: 247 - DNA, 238 bp, Zea mays
tccatccactctcgccttagtctcttcacaacatttagagccttctctctcactcacctcaatcggttcacagtttcaaaacctcttcaatcatggtgcgtcgtcgtaacccttctgtgattgagtttagcagcgactcggacgagattcaggaggaatctcccgtcccctctcctccgcctcgtcgctccctctctaagagaggacgtggctctggtaggatggatggagagggttc

SEQ ID NO: 248 - DNA, 281 bp, Zea mays
tcaacgggctggcggatgtggttctcggcggactccgactctgacctctcgcgtgggtactgcgcctgcctcgtcgccgcgctggacggggccaaacctgaggacgtcctcgccgtcgaccccgccgatcccgacctcgcgccgctcggggcggggacaacggcggcctggtcgcgggccagcacgtggcataatgtgcttgtcggcatgcagaagcgggcgcgcacggccatcgcggcgcgcgagggtaggcaccccgggaagccgtttccgtcgctcgt

SEQ ID NO: 249 - DNA, 125 bp, Aquilegia caerulea
agagatgagagatatgttgacagaagagagagagcacaacccatcatcagctaaagagagtcttttcttttgttgggagtgtgctctttgctcttctgtcatcatcaccaaatctctctctctct

SEQ ID NO: 250 - DNA, 180 bp, Arabidopsis thaliana
ccattttcgaaagccttgagagagagaacacagacgataccaactttcttcaatctcgttgccgcagtataattatctcattcctcggatatatctctccttctgcggcggcgacaagaagctacaagaataaaaagtctgttttctctcttttcaagaaaccacttacttcgaaaatgg

SEQ ID NO: 251 - DNA, 130 bp, Medicago truncatula
agaggtagagagagtatatttgagccaggatgacttgccggcatttgctgtaaatgtagaagaatcccttctcacaattaaggtgttgttggcgaggaatctaggctcatatttgctctctttccactca

SEQ ID NO: 252 - DNA, 97 bp, Medicago truncatula
gagttcctttgaacgcttcatgcatgagaatatctatttggtctaatatccattagaaaagatagtcttttcttctatgaagtgtttgggggaactc

SEQ ID NO: 253 - DNA, 120 bp, Oryza sativa
gagttctcctcaaatcacttcagtagatagctagctaggcttcattgcattacactgttacaaaactgtgagcatggggccaaaagctagttgtatatagtgaagtgtttgggggaactc

SEQ ID NO: 254 - DNA, 95 bp, Populus euphratica
tcccagtcccgaacccgtcggctgtcggtggactgctcgagctgctcccgcggcaagagcgggtcgtcgcgtgccggccgggggacgggctggga

SEQ ID NO: 255 - DNA, 53 bp, Artificial sequence
  Predicted folded 24-nts-long seq pre-mir
ttcaattcggctcaatcttttctaaaaaaaaaaaagactgagccgaattgaaa

SEQ ID NO: 256 - DNA, 385 bp, Artificial sequence
  Predicted folded 24-nts-long seq pre-mir
tttttcttgcgtaaagctctatatttaaatttgaggcaccaatttggggcaatgttggaaatgctctaaagacatacaactctgagacactaattcggtttttcaagtataagatacgactaaaaaattacatggtacttcttctgtctcagaatataaggtgtaaccactttttattcttgtcttataatataagacgtgctctctttatggacacatacatcgatatagtgatatatagagaattaaatgtattttttggtctttgaaccagtggtaattagagcagtcccaacgcaccaggtcatccagtttctagagaattaattatactgccatgtcaccaatttgatgatgtggcaaggagtttaatgaagaaagagag

SEQ ID NO: 257 - DNA, 49 bp, Artificial sequence
  Predicted folded 24-nts-long seq pre-mir
actgatgacggcactgaggaggctacggaggcttacttgaggttgcatc

SEQ ID NO: 258 - DNA, 253 bp, Artificial sequence
  Predicted folded 24-nts-long seq pre-mir
agaggagccagagccgaagccgttttaagaatagtaggagcgggcctaataaaagctctggcttctctttagaaaaagctaaagtcctgtcaaatacttttttatacgacttattgcaaaaagtacctaaaagctatagctatttttgtactacatagaagaagccacaaatagtagcttcaccggctctggctctaacactttggctccatttggtagttcctcttaaaacagttccggctctggctcctct

SEQ ID NO: 259 - DNA, 420 bp, Artificial sequence
  Predicted folded 24-nts-long seq pre-mir
atgcttgtatttttagcttctttctggcattctaatcatttgtcaatgctaactcaattgccttttctattatgtttgtgcattgtacaagtgctgatttttttctcactgatcgtaatgagggcctgatagtaatgtcatgacccacaacttaatcacttatagaactagaggatttagttgcgaatccggacaaggtcggttaagtagatgttggccgctgccgaacttctcgagcacggggatgcagtcaagcaggtggtcgatgtccctagcgtggatgatggtagcgtagagtccaatctccctaaaggcaggggaacatggcagcgtagccccgcgggagcgtggcggtgtctgggaagcgccagaagccgaggtagagggtgcagagggaggcaaggtggaggacgttgatga

SEQ ID NO: 260 - DNA, 42 bp, Artificial sequence
  Predicted folded 24-nts-long seq pre-mir
gtcaccaaattagccctaagggctgatttggtgacaagggga

SEQ ID NO: 261 - DNA, 52 bp, Artificial sequence
  Predicted folded 24-nts-long seq pre-mir
aggttcaatcggtcgtaacccttcatttatataaagggaggaggtctggacc

SEQ ID NO: 262 - DNA, 355 bp, Artificial sequence
  Predicted folded 24-nts-long seq pre-mir
atcggtcagctggaggagaaaggtaacgtgtgccctagaagcacccgcccctagacgagccccgaggcaccgagcccggggttgggcatggtggaactagatacaagggttgggtgagccgaagggaatccacttgagtggatcccttgcccaacccgagatcggcctgtcataagtgaacgaccacattaacgacgcctagcgctaagccatagtagaggcatgtaacaccctgaatattggggtataaattttctttgctccattttcaaaattcaggtgttactctttcctttcttcgcttttattttctctttattgaaaccatagagagttatttgttctatgttggcat

SEQ ID NO: 263 - DNA, 161 bp, Artificial sequence
  Predicted folded 24-nts-long seq pre-mir
tagcacatcatatgtactctatgccccctaatccatacctagctactgactatggtacacaacttcccctattcacacaccacatgtggattggcggatttctaatagttggtgctgctgcacatgcagccatttttatggtaagagactatgatccaact

SEQ ID NO: 264 - DNA, 41 bp, Artificial sequence
  Predicted folded 24-nts-long seq pre-mir
gatccttatcaaaagctcaattttgtactggatcggggcat

SEQ ID NO: 265 - DNA, 255 bp, Artificial sequence
  Predicted folded 24-nts-long seq pre-mir
cagaggagccagagccgaagccgttttaagaatagtaggagcgggcctaataaaagctctggcttctctttagaaaaagctaaagtcctgtcaaatacttttttatacgacttattgcaaaaagtacctaaaagctatagctatttttgtactacatagaagaagccacaaatagtagcttcaccggctctggctctaacactttggctccatttggtagttcctcttaaaacagttccggctctggctcctctg

SEQ ID NO: 266 - DNA, 245 bp, Artificial sequence
  Predicted folded 24-nts-long seq pre-mir
tgcattttctaccgaagtttagcttcgtacgctagtgaggacatttcttaaatacacttgttaatcgaatgagctagatgttagacaaatgatctttgacattcaaatgatcttcgaatttttttccttacacccttaagacaatcactaggtgagtgtccgtgcattgcaacgggaacatataataccgttgaaggaagggagcagaggggagagtgtatcggctggacagggaagaagagcac

SEQ ID NO: 267 - DNA, 79 bp, Artificial sequence
  Predicted folded 24-nts-long seq pre-mir
cggaccactttctctctcaagtcactaatcactaatgatctcttttctcaattgtgaaacttggagagatggaggcttt

SEQ ID NO: 268 - DNA, 418 bp, Artificial sequence
  Predicted folded 24-nts-long seq pre-mir
caccagatccgctcccttccctcccgtcagcagtagaggcgcaagaagctgtagagaacccgtctcccttcccataagcacgacagaggaaacacacgagacacatgatatagggttggaactatggcctctttctgatctctgtattatgaggggttgtacatgttccttatatagagatgtgagacccatcagtggcaaaacaggtatttgcccacataaccctaactggggttacttaacatatataaggaacttgtacaccccctcataatagagagaagagaaaaaagccagaggcccaaccctatatcatgtgtctcgtgtgttcctctgtcgagattctgggaagggagacggatcctctacaacttctcgtgcctctactgccgacgagagagaagggagcggatctggt

SEQ ID NO: 269 - DNA, 52 bp, Artificial sequence
  Predicted folded 24-nts-long seq pre-mir
tcaatctccacgtgcttcgtgcgctgatgctgcacgggattggtggagaggt

SEQ ID NO: 270 - DNA, 235 bp, Artificial sequence
  Predicted folded 24-nts-long seq pre-mir
gtcctctatactcaaatacctatattagagacattttttatttttattttttatacatacatatttgtcataatctcaaatgtattatttatattttagttttgctaaaccggttatttaaagtatttaaatggatagatggcggtttagagaaactctatatatagataatccagcagcgtcctctaaatttagagaaccatttagaagacgctgctggagagcgtagaggacc

SEQ ID NO: 271 - DNA, 305 bp, Artificial sequence
  Predicted folded 24-nts-long seq pre-mir
gattttccctcctctcacagcccgggttttgagagcgagtgaaggggctcgcttgtgttagcccacgagcgccgggaaacgcccaaaggtgtagcgttgagtgggctaggccgggaaggtcgctgacaattggtatcagaggcagacagtcgccataccgcccgaaaagggggatgggatgtcaggagcctagccgttagcgcccggctttagtaccacctcgctagccggagggggccgtggtgagcttataagtgagatttcccctcctctcacagcccgggttttgagagcgagtgaagggg

SEQ ID NO: 272 - DNA, 136 bp, Artificial sequence
  Predicted folded 24-nts-long seq pre-mir
ggtattggggtggattgaggtggattttgactagttgtggatttattccccctcaatccacatatccactggatatgtggattgagggggaataaatccacaactagtcaaaatccacctcaatccacccagtaac

SEQ ID NO: 273 - DNA, 341 bp, Artificial sequence
  Predicted folded 24-nts-long seq pre-mir
ggtggcgatgcaagaggagctcaacaacttcactaggaatgaggtatggcatttagttccacgtcctaatcaaaatgttgtaggaaccaaatgggtcttccgcaacaagcaagatgagcatggtgtggtgacaaggaacaaagctcgacttgtggccaaaggatactcccaagtcgaaggtttggatttcggtgaaacctatgcacccgtagctaggcttgagtcaattcgtatattattggcctatgatacttaccatggctttaagctttatcaaatggacgtgaaaagtgccttcctcaatggaccaatcaaggaagaggtctatgttgagcaacctc

SEQ ID NO: 274 - DNA, 269 bp, Artificial sequence
  Predicted folded 24-nts-long seq pre-mir
tactttctatccaacaacgtcctctaaatcacgtcctctatatgtaaatacctatattaaagacatttttaattttttaatttttgtacatacatatttgtcatactcttaaatgtattttacatattttagttttattaaaccggttgtttgaagtattcaaatagatagagaaccgtttagagaaactctacatatagaggatccaacaacgttctctaaatttagaggaccgtttagaggacgttgctggagagagtagaggacgt

SEQ ID NO: 275 - DNA, 415 bp, Zea mays
aaaagagaaaccgaagacacatgtacaaaaacttcctataggaatacacaaggaaataatacaattggccaaaatagataatgaggatcatctccatatcattttgcatttctcaacaaatataatctgtttggctattctaagtggttctttttttctgggtaaagaagaacttgtcattttgaattcttgggttcaggaatttttctataacttaaatgattcaataaaagctttttttattcttttagttactgatttttttgttggatttcactctacccgcggttgggaactactaattcgttgggtctacaacaatcttggatgggctcctaacgagctaattttcactatttttgtttgtagttttcctgtgattctagacacgtgtttgaaattttgggtctttttt

SEQ ID NO: 276 - DNA, 284 bp, Zea mays
aaagaggatgaggagtagcatgggaagattgtggaggtgatgatggatgtaaagaaactaaagtttgaggagacgaagatggttggtgatgagatgacgacggcgttggtggatcaaccaattcgacatctcttcaaggccaaaggatgaaatttttgatggcttgtccaagtgtctcgattccttcgggcccagggatgtctagcatgtcgtcctcagatccttggacgaccatcgtcacttctaccctgcaataatcatctggtatgtcgcttccatgaaac

SEQ ID NO: 277 - DNA, 76 bp, Zea mays
aatacacatgggttgaggaggattgggtgtaaattaaactaatttacatctcaatccacctcaactcatgtgtatt

SEQ ID NO: 278 - DNA, 420 bp, Zea mays
agaagcggactgccaaggaggcctgggacgccatcgctgcgacccgcatcggcagcgaccgtgcccgcaagaccacactgcagacacttcgcaaggagtgggagaacctggccttcaagccaggtgaggatgttgatgactttgctctccgcctcaacactctgttgcagaagatggtgcagttcggcgacgacacctacgatgaggagagagctgttgagaagctcttccgttgcatccccgagaagtacaagcagattgcttgctcgatcgagtctctgctagacctctccacgatgacgatcgaagaggcgataggtcgtctcaaggtggtcgacggcgacgaaccacaggctccctctgggcctatcactatcggcgggaagctacatctcactcgggagcagtgggaggcctgcc

SEQ ID NO: 279 - DNA, 167 bp, Zea mays
agagggtttggggatagagggacttgaaccctcatgacttataaagtcgacggatttttcttttactagaaatttcattgttctcagtattgacatgtagaatgggcctccctccttatcctcgtccgatcaagtccgtagcgtctaccgattttgctatatcccca

SEQ ID NO: 280 - DNA, 142 bp, Zea mays
acagggacgaggcagagcatgggtagggggccatcaacagaattccaaatttgatttctgtttgctcgctcacaaaatggagggactcaccacaaacacactcaggcgttgttgctccctcccctgcactgcctcttccctg

SEQ ID NO: 281 - DNA, 158 bp, Zea mays
tggcgatggtgcaaataccttccgtgcttttaacccaactcaagctgaagaaacttattcaatggtcactgctaaccgcttttggtcccaaatctttggtgttgctttttccaataaacgttggttacatttctttatgctatttgtacccgtcacca

SEQ ID NO: 282 - DNA, 76 bp, Zea mays
tttttttctctacaaaagaaacctgattctaggctgtgaagcaaaactaaagggatgtggataaaaggagagatga

SEQ ID NO: 283 - DNA, 110 bp, Zea mays
ggtccaccttctccaggcttaccaaaacagtgctcgaagggcaagttggcagaaatatattcacatatgtggacgacattgtcgtcgccaacaggagcaaggaggaccat

SEQ ID NO: 284 - DNA, 415 bp, Zea mays
ctgagttgagaaagagatgcttgaatcaaaagaattccttttttgaagttcaatttttataagaggacaatatgaatattacaccatgttccattaaaacactcaaggggttatatgatatatcgggtgtagaagtagggcaacacttctattggcaaataggaggtttccaaattcatgcccaagtactcatcacttcttaggtcgtaattactattttgctaggttcagttatcatagctgttcggaatccacaaaccatcccgaccgatggtcagaatttcttcgaatatgtccttgagtttattcgagacttgagcaaaactcagattggagaagaatatggtccctgggttccctttattggaactatgttcctttttatttttgtttcgaattggtcaggtactctttt

SEQ ID NO: 285 - DNA, 108 bp, Zea mays
ctgatgggaggtggagttgcatcgtcccgacggtcaacgcagcaactcttgcattattgcctacccggaaatcaacttctcctcttttcacgcttctacttcttatca

SEQ ID NO: 286 - DNA, 261 bp, Zea mays
caagatgttccctctttgcatttattgcgattctttctccactattattcgaattggaatagttttattacttcaatgaaatccatttttcttttgaaaaaagaaaataaaagactatttcgattcctatataactcttatgtatcagaatatgaatttttcttgttgtttcttcataaacaatcttcttgcttacgattaacatcttctggaacctttctggaacgaatcatcttttctgggaagatggaacattttggt

SEQ ID NO: 287 - DNA, 76 bp, Zea mays
tccttaagtgaggagtccctagggggctcatcacccacagaaaaaccagatgctgaagatgtacgatgatgaggag

SEQ ID NO: 288 - DNA, 243 bp, Zea mays
tatgatcccaaacgatagattcgttgagttcttgccaataaccatggccgctggataaaaacattaaactgaaagcccagacaaaatgagcgcctaagaaaaaaagaccatatgcagataatgaagaaccataaaactggattacttgggatgcctgtgtccacaagaaatctcgaagccaaccattaatcgtaatggaactctacgtggcaagaactcattgaatctatcgtttgggctcat

SEQ ID NO: 289 - DNA, 355 bp, Zea mays
gacgagctacaaaaggattcgtttttttcgtgtcacacctgattactccttttttcattttaaagagtggcatcctatgtgcactatctcgatcgaggtatggaggtcagaataaatagaataataatgaatggaaaaaagagaaaatcctttagctggataaggggcggatgtagccaagtggatcaaggcagtggattgtgaatccaccatgcgcgagttcaatttccagtcgttcgcccatcgcattattggaaattccgaaaatgcaattttccatattcctagttacgtatttacttacggcgacaaagaaaaaaactatcactatattttttccttttcctagttcttc

SEQ ID NO: 290 - DNA, 144 bp, Zea mays
attctcacaaccctcccagtctataaacctatgtctgacgactgggtgtttcttagaaagaatgacagaattgtagaagtcagcctggaaaagattccagaaccgagggtcctggacaccaggatgacgaggagtgagagtagg

SEQ ID NO: 291 - DNA, 42 bp, Zea mays
gggcatcttctggtaggaggacatcatccccttcttccagaa

SEQ ID NO: 292 - DNA, 201 bp, Zea mays
tacggaagaagagcaagttttttctttgatgttcaccaaaacaattcacttttctttccatggatcacacagtgagcgtatttggtatttggatattatccgtatcaatgacctggtgaatcctcttactcttaattaatcattagacaaaattaataaactagaaaagatcgatatcaagataaaacttgcacattttcc

SEQ ID NO: 293 - DNA, 82 bp, Zea mays
gctttgtgcatctctacgctcgcctaagccaagaagataaggcggtcatgctcaaacttctagaaagagcgagagaacaaag

SEQ ID NO: 294 - DNA, 243 bp, Zea mays
tgatattatggacgagtggttacaaagggacaatttcgtttttgaaggatggtccggcttattgctttttccttgtgcttatttcgctttagggggttggtttacccatggattggctagttcctatttggaaggttgcaatttcttaaccgtggcagtttccacacctgccaatagtttagcacactctttgttgctactatggggaccagaagcacagggatattttactcgttggtgtca

SEQ ID NO: 295 - DNA, 75 bp, Zea mays
tggaaggggcatgcagaggagcacgaacgaggtgtggttggcccctcgttagctctcctgtgcctgcctcttcca

SEQ ID NO: 296 - DNA, 74 bp, Zea mays
ttgagcgcagcgttgatgagccagccgccgtgcctcccctgtcggctgcggcggctcaccagcgctgcactcaa

SEQ ID NO: 297 - DNA, 164 bp, Zea mays
ctaaacaacctagattatcctccattaaagtgtatctatttcagatagaatcctttaagttgaaaaaatctatcttatcctaataggttcatcttgtgttaaaaaaattatcttatcctaataggttcattttaggtttttttggataacgggtagtttggagt

SEQ ID NO: 298 - DNA, 80 bp, Zea mays
agctgccgactcattcacccacatgccaagcaaacggccatggaaaccagctttgcagatgagtgaatgaagcgggaggt

SEQ ID NO: 299 - DNA, 222 bp, Zea mays
atgaagtgtaatcagggaaaaaacagatgccgaaggtggagtcctcaaaggtggagtcccgaggtggctcatcagccgccgaaaaaacagatgccgaagatgtacgatgatcaggaggaggtggagggtggtggtggtaaccagagccggatggcctagggtcaccaggaatgggtcccggacctgggtaaggaggcggagggtgggaggatgattgacccg

SEQ ID NO: 300 - DNA, 141 bp, Zea mays
gcgggggcgaactgagaacacatgagaataatgagatgagattgctcgcctcgcggtacggttcgtgctggcctggaccaccgtcgtcgccgttcatcttgtacgcataataatgctgcatgtgttctcaggtcgcccccg

SEQ ID NO: 301 - DNA, 81 bp, Zea mays
actccctctgtttctttttagttgtcgctggatagtgcaaaattgaactatccagtgacaactaaaaagaaacagagggag

SEQ ID NO: 302 - DNA, 56 bp, Zea mays
gggccgggccggccggtccgcctcacggcgagaaccgaccggctcgacccttctgc

SEQ ID NO: 303 - DNA, 243 bp, Zea mays
tccctcactccaaccattctcgccttagcctctccacggtgtttagagcctcctctctcactcacctcaaccggttcatagttccaaaacctctccaatcatggtgcgtcgtcgcaacccttccgtgattgagtttagcagcgactcggatgagattcaggaggaatctcccgtcccctctctccgcctcgtcgctccctctctaagagaggacgcggctctggtaggatggatggagagggt

SEQ ID NO: 304 - DNA, 104 bp, Zea mays
gtggaatgttgtctggttcaaggtcttttgctttgtgatccatctgtgtagagcttctaagtattccttggatctgcaagatctcggaccaggcttcattcccc

SEQ ID NO: 305 - DNA, 134 bp, Zea mays
atgaggtagagaacgggatgcagccaaggatgacttgccggctcctggaacctggaggcgtctcagcttgctgtgctgtggcttagaacttagtcggcaagtctgtccttggctacacctagttctcttcctct

SEQ ID NO: 306 - DNA, 143 bp, Zea mays
gtcattgagcgcagcgttgatgatgcggagcatgtacgtcttcccgggcttcactttcagcttgaacgtgtctgcgtgcatgcatatcataagtatggatatgagttagtataaagaatcatagccgttagcgctcattaact

SEQ ID NO: 307 - DNA, 141 bp, Zea mays
gtcattgagcgcagcgttgatgatgcggagcatgtacgtcttcccgggcttcactttcagcttgaacgtgtctggtgcatgcatatcataagtatggatatgagttagtataaagaatcatagccgttagcgctcattaac

SEQ ID NO: 308 - DNA, 108 bp, Zea mays
gggggcggactgggaacacatgggaatgagatgagatcattgctcggtcgtgctggcctgggccgtcggcgcgcgttgatcttgcatgtgttctcaggtcgcccccgg

SEQ ID NO: 309 - DNA, 68 bp, Zea mays
agggcaaccccccgttggcaggtgcgacggcgacgtacccctaccctgccaaaggggatttgcccggc

SEQ ID NO: 310 - DNA, 20 bp, Artificial sequence
  Single strand DNA oligonucleotide
tttagcgatgaacttcactc

SEQ ID NO: 311 - protein, 337 aa, Sorghum bicolor
MAFFSHHHLQQPHPQQAPPPHQQQPVLPSFRNALPVPVDGQIPAPLTFFNPPPAFPEQPAQAPLVDAMGLTAAAGLGWRQPREQELLGENSQMSSIDFLQTGSAVSTGLALSLEDRRHGGGGAGNSSGDSPLLLLPMLDDDISREVQRLDADMDRFIKAQSERLRQSILEKVQAKQFEALASVEDKILRKIRDKEAEVETINKRNSELEDQIKHLGVEVGAWQQRAKYNESMINALKYNLEQVCAHQSKDFKEGCGDSEVDDTASCRNGGAVNLQLTPKENRQQKDLTACRVCKSSEACMLLLPCRHLCLCKECESKLSFCPLCQSSKILGMEIYYA

SEQ ID NO: 312 - protein, 329 aa, Zea mays
MAFFSHHHLQQPHAQQPVLPSFRNALPVPVDGQIPAPLTFFNPPPAFPEQPAQAPLVDAVGLTAAAGLGWRQPREQELLGENSQMSSIDFLQTGSAVSTGLALSLEDRRHVGGGAGNSSGDSPLLLLPMLDDDISREVQRLDADMDRFIKAQSERLRQSILEKVQAKQFEALASVEDKILRKIRDKEAEVETINKRNSELEDQIKHLGVEVGAWQHRAKYNESMINALKYNLEQVCAHQSKDFKEGCGDSEVDDTASCRDGGAINFQLTPKENRQPKDLTACRVCKSSEASMLLLPCRHLCLCKECESKLSFCPLCQSSKILGMEIYYA

SEQ ID NO: 313 - protein, 329 aa, Zea mays
MAFFSHHHLQQPHAQQPVLPSFRNALPVPVDGQIPAPLTFFNPPPAFPEQPAQAPLVDAVGLTAAAGLGWRQPREQELLGENSQMSSIDFLQTGSAVSTGLALSLEDRRHGGGGAGNSSGDSPLLLLPMLDDDISREVQRLDADMDRFIKAQSERLRQSILEKVQAKQFEALASVEDKILRKIRDKEAEVETINKRNSELEDQIKHLGVEVGAWQHRAKYNESMINALKYNLEQVCAHQSKDFKEGCGDSEVDDTASCRDGGAINFQLTPKENRQPKDLTACRVCKSSEASMLLLPCRHLCLCKECESKLSFCPLCQSSKILGMEIYYA

SEQ ID NO: 314 - protein, 337 aa, Zea mays
MAFFSHHHLQQPHPQQAPPPNQQQPVLPSFRNALPVPVDGQIPAPLTFFNPPPAFPEQPAQTTLVDAVGLTAAAGLGWRQPREQELLGENSQMSSIDFLQTGSAVSTGLALSLEDRRHGGGGAGNSSGDSPLLLLPMLDDDISREVQRLDADMDRFIKAQSERLRQSILEKVQAKQFEALASVEDKIFRKIRDKEAEVETINKRNSELEDQIKHLGVEVGAWQQRAKYNESLINALKYNLEQVCAHQSKDFKEGCGDSEVDDTASCPYGGAVNLQLMPKENRQPKNLTACRVCKSSEACMLLLPCRHLCLCKECESKLSICPLCQSSKILGMEIYYA

SEQ ID NO: 315 - protein, 337 aa, Zea mays
MAFFSHHHLQQPHPQQAPPPNQQQPVLPSFRNALPVPVDGQIPAPLTFFNPPPAFPEQPAQTTLVDAVGLTAAAGLGWRQPREQELLGENSQMSSIDFLQTGSAVSTGLALSLEDRRHGGGGAGNSSGDSPLLLLPMLDDDISREVQRLDADMDRFIKAQSERLRQSILEKVQAKQFEALASVEDKIFRKIRDKEAEVETINKRNSELEDQIKHLGVEVGAWQQRAKYNESLINALKYNLEQVCAHQSKDFKEGCGDSEVYDTASCPYGGAVNLQLMPKENRQPKNLTACRVCKSSEACMLLLPCRHLCLCKECESKLSICPLCQSSKILGMEIYYA

SEQ ID NO: 316 - protein, 342 aa, Oryza sativa Japonica Group
MAFFSHHHLQQPHPQAPPPPPPQQQQQPVPPSFRNALPVPVDGQIPAPLPFFNPPPAFQDQPAQPPLVDAMGLTAAAGLGWRQPREQELLGENSQMSSIDFLQTGSAVSTGLALSLEDRRHGGGSGAGAGNSSGDSPLLLLPMLDDDISREVQRLDADMDRFIKAQSERLRQSILEKVQAKQFEALASVEDKILRKIRDKEAEVENINKRNSELEDQIKQLAVEVGAWQQRAKYNESMINALKYNLEQVCAHQSKDFKEGCGDSEVDDTASCCNGGAANLQLMPKENRHSKDLTACRVCKSSEACMLLLPCRHLCLCKECESKLSFCPLCQSSKILGMEIYM

SEQ ID NO: 317 - protein, 342 aa, Oryza sativa Indica Group
MAFFSHHHLQQPHPQAPPPPPPQQQQQPVPPSFRNALPVPVDGQIPAPLPFFNPPPAFQDQPAQPPLVDAMGLTAAAGLGWRQPREQELLGENSQMSSIDFLQTGSAVSTGLALSLEDRRHGGGSGAGAGNSSGDSPLLLLPMLDDDISREVQRLDADMDRFIKAQSERLRQSILEKVQAKQFEALASVEDKILRKIRDKEAEVENINKRNSELEDQIKQLAVEVGAWQQRAKYNESMINALKYNLEQVCAHQSKDFKEGCGDSEVDDTASCCNGGAANLQLMPKENRHSKDLTACSFCKSSEACMLLLPCRHLCLCKECESKLSFCPLCQSSKILGMEIYM

SEQ ID NO: 318 - protein, 337 aa, Hordeum vulgare subsp. vulgare
MAFFSHHHLQQPHPAAPPPPQQQQPAPLSFRNALPVPVDGQIPAPLAFFNAPPAFPDQAGQPQLDAAGLTAAAGMGWRQPREQELLGENSQMSSIDFLQTGSAVSTGLALSLEDRRHGGGGAGAGNSSGDSPLLLLPMLDDDISREVQRLDADMDRFIRAQSERLRQSILEKVQAKQFEALASVEDKILRKIRDKESEVQNINKRNLELEDQIKQMSGEVGAWQQRAKYNESMISALKYNLEQVCAHQSKDFKEGCGDSEVDDTASCCNGGAVNLQLMPKANNHPKDLMACRVCKSSEACMLLLPCRHLCLCKECESKLSFCPLCQSSKILGMEIYM

SEQ ID NO: 319 - protein, 249 aa, Zea mays
MRPTPALVAGGRMVTSFLSATEWMLPSPATQVHTISVLPSRRDFAFSNLTMLLRNSGGNEGESGSTKFHVVRDDLLHPLANGNKARKLDALLPILRRCGVTDIVTCGGCQSAHAAAIAVHCAEWGIRPHILLRGEQLDVPTGYNLISLMFGNVTYVSRSLYAQRDEMLYEHAIKVAGYSGTVMWADEVIGKGLGVDEDTTDGNGSRRVMIVKEGAGSVQALLGKERFFLASFHLSFMITHDVCTANKTK

SEQ ID NO: 320 - protein, 249 aa, Sorghum bicolor
MRPTPALAAGGRTVASFLSATEWMLPSPATQVHTISVLPSRLEFAFSNLTTSLRNGGGNGSETGNPKFQIVRDDLLHPLANGNKARKLDALLPVLRHCGATDIVTCGGCQSAHAAAVAVHCAEWGIRPHILLRGEQLDVPTGYNLISLMFGNVTYASRSLYAQRDEMLYEHAIKVAGCSGTVMWADEIIGKDLGLDEDTTDGNGSRKVMIVKEGAGSVQALLGKKGFVLASFHFSFMITHDVSTANKIK

SEQ ID NO: 321 - protein, 400 aa, Zea mays
MRPTPALVAGGRMVTSFLSATEWMLPSPATQVHTISVLPSRRDFAFSNLTMLLRNSGGNEGESGSTKFHVVRDDLLHPLANGNKARKLDALLPILRRCGVTDIVTCGGCQSAHAAAIAVHCAEWGIRPHILLRGEQLDVPTGYNLISLMFGNVTYVSRSLYAQRDEMLYEHAIKVAGYSGTVMWADEVIGKGLGVDEDTTDGNGSRRVMIVKEGAGSVQALLGVMRLLKYLSGLTLFRKDEKVHIVVDSGTGTTAVGLALGAVCLGLQWRVTAVMLADTLEGYKQRERSLLSDFEKVFPEIYHGMVEDATHDNLVQWVERFSPRRFGKVLDGEIAMCRQVAQQTGILLDPMYTLAAWEQAVDICCGDSEAKVLMIHTGGTLGLFGLAQRYSSQFNTGEQP

SEQ ID NO: 322 - protein, 407 aa, Oryza sativa Indica Group
MRPSPALAGGGRTVANLLSATEWMLPSPATQVHTISVLPSHSPPSPPHHFAFSNLTTAPKRNGGKGEEEGRPRFEVVRDDLLHPLANGNKARKLDALLPLLRRRGATDVVTCGGCQSAHAAATAVHCAEWGMRPHILLRGEQPDIPTGYNLISLMFGNVAYASRSVYAHRDEMLYNHARKVAGTGGTVLWADDISKEDFVLDEDNGCEIGSRRVVIIKEGAGDVQALLGVIRLVEYLYNLSSFHKHENVHVVVDAGTGTTAVGLALGAVCLGLHWRVTAVMLADTLERYKEREKSLISDFKKLCHNNYHEMVGENDIGDSLVEWVERFSPRRFGKVLNGEIALCRQIAQQTGILLDPMYTLAGWEQAVDLCVGDSRTKVVMIHTGGTLGFCGLAQRYSSHFTSDEQT

SEQ ID NO: 323 - protein, 429 aa, Oryza sativa Japonica Group
MRPSPALAGGGRTVANLLSATEWMLPSPATQVHTISVLPSHSPPSPPHHFAFSNLTTAPKRNGGKGEEEGRPRFEVVRDDLLHPLANGNKARKLDALLPLLRRRGATDVVRAHRCIPLHPALITSCFSNLMVTCGGCQSAHAAATAVHCAEWGMRPHILLRGEQPDIPTGYNLISLMFGNVAYASRSVYAHRDEMLYNHARKVAGTGGTVLWADDISKEDFVLDEDNGCEIGSRRVVIIKEGAGDVQALLGVIRLVEYLYNLSSFHKHENVHVVVDAGTGTTAVGLALGAVCLGLHWRVTAVMLADTLERYKEREKSLISDFKKLCHNNYHEMVGENDIGDSLVEWVERFSPRRFGKVLNGEIALCRQIAQQTGILLDPMYTLAGWEQAVDLCVGDSRTKVVMIHTGGTLGFCGLAQRYSSHFTSDEQT

SEQ ID NO: 324 - protein, 405 aa, Hordeum vulgare subsp. vulgare
MRPAPVLAAGGRTLGNILSATEWMLPSPATQVHTISVLPSHAPSPAPQFAFSNLTTALRSSGGKGDEQGTPRFDVLRDDLLHPLANGNKARKLDALLPLLRRLGATDVITCGGCQSAHAAAVAVHCAEWGIRPHLLLRGEQLDVPTGYNLISLMFGNVTYASRSVYAHRDEMLYEHARKVAGNSGTVLWANDIVRDNLAVDEETVLENDSRRVVIIKEGAGTVQALLGVMRLVEYLSNLSSFHNDEEVRIVVDAGTGTTAVGLALGAVCLGLNWRVTAVMLADTLERYQEQEKSLISDFKGLCHEDFHDLVGTDGLVHWVDRFSPRRFGKVLSGEITSCRQVAQQTGILLDPVYTLAAWEQAVDLCCGDGRGAKVAMIHTGGTLGLFGLAQRYPLHFGATANEQA

SEQ ID NO: 325 - protein, 249 aa, Sorghum bicolor; identical to SEQ ID NO: 320

SEQ ID NO: 326 - protein, 249 aa, Zea mays; identical to SEQ ID NO: 319

SEQ ID NO: 327 - protein, 406 aa, Sorghum bicolor
MAKLKAARATDVPSALPPEPDIAADLDGLAAAASSCSCIRAGAAEATTTAAEGRPLVVIGHRGKGMNTLVSPDPRLRGDVRENTLRAFNDAAASHPAVAYVEFDVQVTKDGCPVIFHDNFIYTQQDGEISGKRVTDLDLDEFLSYGPQREQGKAGKPLFRKLKDGRILKWDVRSEDALCTLREVFHGVHRRVGFNVELKFDDDLVYTEDSLTCILQAVLKVVLEHAGDRPIIFSSFQPDAAQLIRKLQDKYPVFFLTNGGTQVYADQRRNSLEEAVKLCVAGGLQGIVSEVRAILRQPSAVAEIKDANKLSLMTYGQLNNVPEVVYVQHLMGVDGVIVDLVGEIAEAVSAFTVTAVQASGSQDGGGGVVGERMETAAALAVAAGTTPSFSPREMSFLLRLIPELVQ

SEQ ID NO: 328 - protein, 417 aa, Zea mays
MAQLKAARATDVPPAMPDPDPDVVAADLGACVRHGRVDGLAAGSGRAEATATATTTAAAADQGRRRPPLVVVGHRGKGMNALASPDPRLRGDIRENTLRAFNAAAASHPAVAYVEFDVQVTRDGCPVIFHDNFIYTQQDGQVSAKRVTELNLDEFLSYGPQRDQGKAGKPLLRKLKDGRILKWDVQSEDALCTLREVFEGVHRRVGFNVELKFDDDLFYTEERLTCILKSVLKVVFEHANDRPIIFSSFQPDAAQLIRKLQDKYPVLFLTNGGTQVYADPRRNSLEEAVKLCVAGGLQGIVSEVRAILRQPSAVAKIKEANKLSLMTYGQLNNVAEVVYVQHLMGVDGVIVDLVQEIAEAVSAFTVVTAVQASGSQDGGGIVVGERMETAAVAVAGTPSFSPREVSFLLRLIPELVQ

SEQ ID NO: 329 - protein, 370 aa, Zea mays
MAQLKAARATDVPPAMPDPDPDVVAADLGACVRHGRVDGLAAGSGRAEATATATTTAAAADQGRRRPPLVVVGHRGKGMNALASPDPRLRGDIRENTLRAFNAAAASHPAVAYVEFDVQAGKPLLRKLKDGRILKWDVQSEDALCTLREVFEGVHRRVGFNVELKFDDDLFYTEERLTCILKSVLKVVFEHANDRPIIFSSFQPDAAQLIRKLQDKYPVLFLTNGGTQVYADPRRNSLEEAVKLCVAGGLQGIVSEVRAILRQPSAVAKIKEANKLSLMTYGQLNNVAEVVYVQHLMGVDGVIVDLVQEIAEAVSAFTVVTAVQASGSQDGGGIVVGERMETAAVAVAGTPSFSPREVSFLLRLIPELVQ

SEQ ID NO: 330 - protein, 469 aa, Zea mays
MAHDGFLGGFHELSWPLVHAAAAGAAPFDPLLVHVPHALMGAGAGWQHEAAVGAIVPSQSQSQSPPPPPSSLAAAAVGGADAVEAAMMEQLASRLGVSVPSPPSSRYVSCHSTPVAPCVLAGDAERAERLSCFPASGRKLSRVASSQSLLREQAPAPAPAPSPGAAAKQHAGDGACDGPCRKRKASGTSSKQSKAKEAVTTAPPESRETAETRAKKCKLSTDEERKPAAGEGWRGSGKGKELVAADAEPPKDYIHVRARRGQATDSHSLAERVRREKIGERMKLLQDLVPGCSKVTGKAVMLDEIINYVQSLQRQVEFLSMKLSTVNPRLELGADDSFVPRDDANKMCAAATSSISMAQQPLPLPAAYHALEGSSPAFCYTTTPPAPGTAARLGVAASDAKAFEMAPPSSAATVNHAGTAERRPLEGPADENASPQMGGRSLWEEGDDDLQSLVLMGFRGRHVIIGGPI

SEQ ID NO: 331 - protein, 418 aa, Zea mays
MAEAAASSSSSGSCAPRRLHGAGIVRDALTYNGLAALPPPLPPAQVQVTAYGSGGGGGGGGGGGGKISPAVLFIIVILAVVFFISGLLHLLVRVLMKKQRRRGGTASAAARGSGGEGGGADAALQRQLQQLFHLHDSGLDQAFIDALPVFAYREIVVGGGGDGDKEPFDCAVCLCEFDAEDRLRLLPLCGHAFHLNCIDTWLLSNSTCPLCRGVLFVPGLMGEDSPMFDFEEGLEEGRLSEDCDDGFGLPGRKASGLAQTPVAEKKVFPVRLGKFKNVGTHGAVEGGNANANANPRVLTRDEGESSSSRLDGRRCFSMGTYQYVLGTSELRVALQPGCIRNDTGGAMRGMPPGLSSINADIMEGKKICARNKGESFSVSKIWQWSNLKGKLPAGSDECSDAGSLPWMKKGGAVDTSNL

SEQ ID NO: 332 - protein, 411 aa, Zea mays
MAEAATSSSSSGSFAPRRLHDAGVVRESLPYSVLAAPPPPPLPPVQVQVAGSGGGGGGKINPAVLFIIVILALVFFISGLLHLLVRVLSKKQHRRGGPRDTASAAAPRTGVEAGGVDVALQRQLQQLFHLHDSGLDQAFIDALPVFAYRDIVVGGGGDGDKEPFDCAVCLCEFDAEDRLRLLPLCGHAFHLNCIDTWLLSNSTCPLCRGVLFIPGLMGEGNPMFDFEERLEEGRLSEDCDDGFGLPGLKASGLAQTPVAEKKVFPVRLGKFKNVGTQGAVEGGNANASVLSRDQVESSSSSSLDGRRCFSMGTYQYVLGTSELRVALQPGRIRNGTGGAMMGRPPGLSSINADIMEGKKICTRNKGESFSVSKIWQWSHIKGKLPAGSDECSDAGSLPWMKRGGAADTSNL

SEQ ID NO: 333 - protein, 327 aa, Zea mays
MKKQRRRGGTASAAARGSGGEGGGADAALQRQLQQLFHLHDSGLDQAFIDALPVFAYREIVVGGGGDGDKEPFDCAVCLCEFDAEDRLRLLPLCGHAFHLNCIDTWLLSNSTCPLCRGVLFVPGLMGEDSPMFDFEEGLEEGRLSEDCDDGFGLPGLKASGLAQTPVAEKKVFPVRLGKFKNVGTHGAVEGGHANANANANANPRVLTRDEGESSSSRLDGRRCFSMGTYQYVLGTSELRVALQPGCIRNGTGGAMRGMPPGLSSINADIMEGKKICARNKGESFSVSKIWQWSNLKGKLPAGSDECSDAGSLPWMKKGGAVDTSNL

SEQ ID NO: 334 - protein, 422 aa, Hordeum vulgare subsp. vulgare
DAGVPVPLGDMAEEAVSSSPGSSAVTAVAAYPYPYRVARSLHGALVVRDELPYSYPAAAAAAPPPPAQVQQGSSGGGGGKISPAVLFIIVILAVVFFISGLLHLLVRLLMKKQHRRRGGSAAAAAQGPGEADAALQRQLQQLFHLHDSGLDQAFIDALPVFSYREIVVGGGGGDKEPFDCAVCLCEFDAEDRLRLLPLCGHAFHLNCIDTWLLSNSTCPLCRGVLFAPGLTAENNPMFDFDEGLEEGRLSECCEDGFGLPTQKSSEGLQEPAAEKRVFPVRLGKFKNVGTQGAVEGGNADSAVLRREEGESSSSSLDARKCFSMGTYQYVLGTSELQVALQPGRARNGGAMRLRPPGISCVNADIMEGKKICARNKGESFSMSKIWQWSNLKGKLPAGSDDCSEAGSLPWLKRGGTGDKLNM

SEQ ID NO: 335 - protein, 436 aa, Oryza sativa Japonica Group
MEALSRTERVGGGGGAMVEVAFASSAGSSAAAPRRLRGELVVRDAIPYAGVAPPPPALPLPQPQLQPQVQATTSGGGGGGKISPAVLFIIVILAVVFFISGLLHLLVRLLMKKQHRRGGGGGAAAGVSRSAAGDDAGGGGDAALQRQLQQLFHLHDSGLDQAFIDALPVFAYREIVVGGGGDGDKEPFDCAVCLCEFDAEDRLRLLPLCGHAFHLHCIDTWLLSNSTCPLCRGVLFVPGLTENNPMFDFDEGLEEGRLSEDCDNGFGYPGHKATEGMQTPGTEKRVFPVRLGKFKNVGTQGAVEGGGIGNANGAVLRREEGESSSSSLDARRCFSMGTYQYVLGTSELRVSLQPDRIRNGGGGVTRARPTGLSSVNAEIMEGKKICARNKGESFSVSKIWQWSNLKGKLPTGSDECSEAGSLPWMKRGGIGDTSNM

SEQ ID NO: 336 - protein, 151 aa, Zea mays
MRRHGASEASPSIIHTSSIALLQERFRNLQKVKEMREGRELQRVHAADTTTTTTNRTASSPSSSSSLSSALSLGLQQAANANDHPRWFLHPDLIRPSRPLRGHACHGLGATGGGVVVQTTSPPPLPPSSSWGGAQNSGYRTDIDVDTSLHL

SEQ ID NO: 337 - protein, 134 aa, Sorghum bicolor
MRRHGGSEASPSIIHTSSIALLQERFRNLQKVKEMREGRALQRVHTTDTDRTGSSSSLSSALSLGLQAANSNEQPRWFLHPDLIRPSRPLRGPAYYHGLGANGVQTSPPPASSWGGMQNSGYRADVDVDTSLHL

SEQ ID NO: 338 - protein, 428 aa, Zea mays
MAHDGFLGDLACPLPLAHAATAAPFDPLRVHVAHALTGAGAGWEHDAATGALVPSRPRPLSPSSLAAATAVVVGGGGDAVEAALMEQLASRLGVSVPSPPPSRYASCHGTPAGSPSKSAAPWVLAGDAAPAERATGLPCFPASCGELSRVPSCQSSLLGEHAPTPAPAPLPGAAKQHASDGSCSDGPCRKRKASGGKAKDVVTTATPKSREPETMAKRRKLSTDAARDEAGSHGNGKGKEVAPAAEPEPQPPKDYIHVRARRGQATDSHSLAERVRREKISERMKLLQDLVPGCSKVTGKAVMLDEIINYVQSLQCQVEFLSMKLSTVDPRRELDVGCFVVPKDDVTMQANRLCAPATSSSSSAFCYAARSVVTNAKGFETPLPLANHGVAADDRPLERRTRDAGPQAGSLWEEDDLQSLVLMGFRGR

SEQ ID NO: 339 - protein, 370 aa, Zea mays; identical to SEQ ID NO: 329

SEQ ID NO: 340 - protein, 417 aa, Zea mays; identical to SEQ ID NO: 328

SEQ ID NO: 341 - protein, 406 aa, Sorghum bicolor; identical to SEQ ID NO: 327

SEQ ID NO: 342 - protein, 508 aa, Sorghum bicolor
MALKFLNKKGWHTGSLRNIERVWKAEQAEEAERRKTEELKKQVAAEKEKAEFRAMQERAGLRPAQERLDFLYESGLAVGKSSEGFQALQQSAPGAAAASTSAQGSAADSSKAATPGALFEDKPQSANDTWRKLHSDPLLLIRQREQDAIARIKNNPIKMAEIKKSVEAEKKQKEEKKEKKRHKKHRHHKSKSKRHHSDENLDSDEVSDGKDERRKRAHSSLGHKKEENRSRHKKQHREDSSDSDNDEPQRRKQDASEDDEPRRRQQDDNEPRRRQRDDNEPRRRRQDNGEPRRRRQDDDEPRRRRQDDDEPRRRRQDDDEPRGRRQDDEKPRERGYVDRPRYDRFDVDDRKRRHHSPPDSRPKRVDDSHKTGNSTSEHHSRSEQGSGEQTRRESEHGRNKGPSFNRRRGGVHHMSEEERLARLRQMEADAEVHEEQRWKRLKKAADDDAKEAATVNVNQFKGKNFLEDEKKSIFGTDKGGSATIEESIRRRAFYSQGGRDAEGNAFRR

SEQ ID NO: 343 - protein, 504 aa, Zea mays
MALKFLNKKGWHTGSLRNIERVWKAEQAEEAERRKTEELKKQVAAEREKAEFRAMQERAGLRPAQERLDFLYESGLAVGKSSEGFQALQQSAPGAAAASTSAQASAADSSKAATPGALFEDKPQSANDTWRKLHSDPLLLIRQREQDAISRIKNNPIKMAEIKKSVEAEKKQKEEKKAKKKHKKHHHHKSKSKRHHSDENSDSDEISDGKDERRKRSHSSLHKKEENMSRHKKQHREDSSDSDDEPQRRKQDVSENDEPRRRLHDDNEPRRRWQDDVEPRRRLHDDDEPRRWQDDVEPRRRRQDDGESRRRWQDDDELRGRRQVDEKPRERSYVNRPRYDRSDADDRRRHHSPRDTKPKRVDDGHKTGNSTSEHHSRSEQGSGEQTRQESEHDRNSGPSLNRRRGGVHHMSEEERLARLHQMQADAEVHEEQRWKRLKKAADDDAKEATTVNANQFKGKNFLEDEKKSIFGTDKGGSATIEESIRRRAFYSQGGRDAEGNAFRR

SEQ ID NO: 344 - protein, 260 aa, Zea mays
MWSPIPGTLMRTSSLPAVIEASGNDDWKKRKEAQSLKRLEVKKKRIERRNSLACNTSKEAAGQSPKEMNANTDKLVSSDETIVSANESHSSGKHLVKGLPPKYQATITSEDSSSAMRKKPNSAFKAITEEQNSSSSVPSSGEAISSVTAPSLPLLSLVPITATLGSREDQSILGRAGARANGMGDVERRMMQEMPGVFTKGLSNGSRVEGFLYKYSKGEVRIVCICHGSFLTPSEFVEHAGAGKVDNPLRHIVVSATPNL

SEQ ID NO: 345 - protein, 262 aa, Zea mays
MWSPIPGTLMRTSSLPAVIEASGNDDWKKRKEAQSLKRLEVKKKRIERRNSLACNTSKEAAGQSPKEMNANTDKLVSSDETIVSANESHSSGKHLVKGLPPKYQATITSEDSSSAMRKKPNSAFKGTAITEEQNSSSSVPSSGEAISSVTAPSLPLLSLVPITATLGSREDQSILGRAGARANGMGDVERRMMQEMPGVFTKGLSNGSRVEGFLYKYSKGEVRIVCICHGSFLTPSEFVEHAGAGKVDNPLRHIVVSATPNL

SEQ ID NO: 346 - protein, 262 aa, Zea mays
MWSQIPGTLMRTSSLPAVIEASGNDDWKKRKEAQSLKRLEVKKKRIERRNSLTCNTSKEAAGQSPEEMNANTDKLVSSDETIASANESHSSGKHLVKGLPPKYQATITSQDSSSAMRKKPNSAFKGTAITEEQNSSSSVPSSGEAISSVTAPSLPALSLVPITATLGSREDQSILGRAGARANGMGDVERRMMQEMPGVFTKGLSNGSRVEGFLYKYSKGEVRIVCICHGSFLTPSEFVEHAGAGKVDNPLRHIVVSATPNL

SEQ ID NO: 347 - protein, 253 aa, Zea mays
MRTSSLPAVIEASGNDDWKKRKEAQSLKRLEVKKKRIERRNSLACNTSKEAAGQSPKEMNANTDKLVSSDETIVSANESHSSGKHLVKGLPPKYQATITSEDSSSAMRKKPNSAFKGTAITEEQNSSSSVPSSGEAISSVTAPSLPLLSLVPITATLGSREDQSILGRAGARANGMGDVERRMMQEMPGVFTKGLSNGSRVEGFLYKYSKGEVRIVCICHGSFLTPSEFVEHAGAGKVDNPLRHIVVSATPNL

SEQ ID NO: 348 - protein, 262 aa, Zea mays; identical to SEQ ID NO: 346

SEQ ID NO: 349 - protein, 262 aa, Zea mays; identical to SEQ ID NO: 345

SEQ ID NO: 350 - protein, 253 aa, Zea mays; identical to SEQ ID NO: 347

SEQ ID NO: 351 - protein, 260 aa, Zea mays; identical to SEQ ID NO: 344

SEQ ID NO: 352 - protein, 262 aa, Zea mays; identical to SEQ ID NO: 345

SEQ ID NO: 353 - protein, 253 aa, Zea mays; identical to SEQ ID NO: 347

SEQ ID NO: 354 - protein, 260 aa, Zea mays; identical to SEQ ID NO: 344

SEQ ID NO: 355 - protein, 262 aa, Zea mays; identical to SEQ ID NO: 346

SEQ ID NO: 356 - protein, 393 aa, Zea mays
MEGFSRDLLCGIGKGDAPPPEKRPGQLREEMEEVELSLGLSLGGRFGLDRKGSKLPRSSSVAAMLTTPVEVPAPPSLSRASSLPVQAEASEVERKQGLDGWGSCREGGGLGVQHAARLPASGNPSSASSVGEGQILQGTLMRTSSLPAVIEASGNDDWKKRKEAQSLKRLEVKKKRIERRNSLACNTSKEAAGQSPKEMNANTDKLVSSDETIVSANESHSSGKHLVKGLPPKYQATITSEDSSSAMRKKPNSAFKGTAITEEQNSSSSVPSSGEAISSVTAPSLPLLSLVPITATLGSREDQSILGRAGARANGMGDVERRMMQEMPGVFTKGLSNGSRVEGFLYKYSKGEVRIVCICHGSFLTPSEFVEHAGAGKVDNPLRHIVVSATPNL

SEQ ID NO: 357 - protein, 394 aa, Sorghum bicolor
MEGFSRDLLCGIGKGDAPPPEQRPGQLREEMEAVELSLGLSLGGRFGLDRKGDKLPRSSSVAAMLTPPVEVPTPRALPRTSSLPVLAEASEVAKQQGLAGWGSCRDGGGLGVEHAARLPASGSPSSASSGGDGQRLQGTLMRTSSLPAAIEAAGNDEWKKRKEAQSLKRLEVKKKRIERRNSHTCNTSKEAAGQIPEEMNAHTDKLVASDEAVVMNNENHSSGKHLVKGLPPKYQATIASQDSLSTVGKKPNSAFKAIVEEHSPSSSIPSSGEAISSVTAASPPSSSLAHRTATLGPAGDQSILGRAASRANSMGDVERKMMQEMPGVFTKGLPNGNRVEGFLYKYRKGEDVRIVCICHGSFLTPSEFVEHAGAGKVDNPLRHIVVNPTPTPNL

SEQ ID NO: 358 - protein, 261 aa, Zea mays
MNDADVGKQVQQMVRFILQEADEKASEISVAAEEVGTDSRLHQIPTYILRSVRMHACRSSASRSCSWWSRKNGRCGRSTSARRSRWTSAGRCEQTIHPFVRFQHLIILHLPMQIPHAHACMQRVLDGAERGAHQAAAGAGRRGDRDEGERRRRAAPRHQGRQRLQEGPQGPHRAEPASPEGAGAGAAVPRGGPEPGGGGAGGGQEGVRREGQGQPPQDHHRRQGLPAAAEDQPRRARAVLVLTYLLTSHHETLVSDERAMN

SEQ ID NO: 359 - protein, 506 aa, Sorghum bicolor
MVASAKGRLVSVLAVAAALAAVLLYRAPFSKSLGGEGCSLLPHDHFWVASDRVVTLGRVGPAAVEVKGGLINAIAVGDYRSFVLRRPLLDYGDAVIMPGLIDVHAHLDEPGRAEWEGFSTGTRAAAAGGITTLVDMPLNSFPSTVSEETLKLKLEAAQDKLYVDVGFWGGLVPENAFNPSALEGLLNAGVLGLKSFMCPSGINDFPMTNSTHIEEGLVTLAKYKRPLLIHAERIPEAEDDDMREDELDPRSYMTYLKSRPPSWEESAIRDLHRAMKDTESGGRSEGAHIHIVHLSDAKTSLELMKDAKRSGASLSIETCPHYLAFSSEEVPDGDTRFKCSPPIRDDTNRENLWKALLDGHIDMLSSDHSPSTPDLKLMEEGNFLRAWGGISSLQFVLPVTWSYGRKYGITLNQLSSWWSENPAKLAGQKNKGAILPGYHADIVVWKPETEFQLDDSHVIYHKHQNISAYLGKQLSGKVLSTFVRGNLVFAEDKHANVACGVPILAK

SEQ ID NO: 360 - protein, 506 aa, Zea mays
MAASAKGRLVPVLAVAAALAAVLLYRAPFSKSLGGEGCSLLPHDHFWIASDRVVTLGRVGPAAVEVKGGLINAIAVGDYRSFVLRRPLLDYGDAVIMPGLIDVHAHLDEPGRAEWEGFSNGTRAAAAGGITTLVDMPLNSFPSTVSEETLKLKLEAARDKLYVDVGFWGGLVPENAFNPSALEGLLKAGVLGLKSFMCPSGINDFPMTNSTHIEEGLVTLAKYKRSLLIHAERIPEAEDHDLQEDELDPRSYMTYLKSRPPSWEEAAIRDLQRAMKDTELGGRSEGAHIHIVHLSDAKTSLELMKDAKRSGASLSIETCPHYLAFSSEEVPDGDTRFKCSPPIRDDTNRENLWKALLDGHIDMLSSDHSPSTPDLKLMEEGDFLRAWGGISSLQFVLPVTWSYGRKYGVTLNQLASWWSERPAKLAGQKNKGAILPGYHADIVVWKPETEFQLDNNHAIYHKHQNISAYLGKQLSGKVLSTFVRGNLVFAEDKHANAACGVPILAK

SEQ ID NO: 361 - protein, 506 aa, Zea mays
MAASAKGRLVPVLAVAAALAAVLLYRAPFSKSLGGEGCSLLPHDHFWIASDRVVTLGRVGPSAVEVKGGLINAIAVGDYRSFVLRRPLLDYGDAVIMPGLIDVHAHLDEPGRAEWEGFSNGTRAAAAGGITTLVDMPLNSFPSTVSEETLKLKLEAARDKLYVDVGFWGGLVPENAFNPSALEGLLKAGVLGLKSFMCPSGINDFPMTNSTHIEEGLVTLAKYKRSLLIHAERIPEAEDHDLQEDELDPRSYMTYLKSRPPSWEEAAIRDLQRAMKDTELGGRSEGAHIHIVHLSDAKTSLELMKDAKRSGASLSIETCPHYLAFSSEEVPDGDTRFKCSPPIRDDTNRENLWKALLDGHIDMLSSDHSPSTPDLKLMEEGDFLRAWGGISSLQFVLPVTWSYGRKYGVTLNQLASWWSERPAKLAGQKNKGAILPGYHADIVVWKPETEFQLDNNHAIYHKHQNISAYLGKQLSGKVLSTFVRGNLVFAEDKHANAACGVPILAK

SEQ ID NO: 362 - protein, 507 aa, Oryza sativa Indica Group
MAMAAAKGRVLPLLAVAAALAAALLYRAPFSKSLGGEGCSLLPHDHFWIASERVVTLGRVGPAAVEVKGGLINAIAVGDYRSFLLRRPVVDYGDAVIMPGLIDVHAHLDEPGRAEWEGFSTGTRAAAAGGITTLVDMPLNSYPSTVSEETLKLKLDAAKDKLHVDVGFWGGLVPENALNPSALESLLNSGVLGLKSFMCPSGINDFPMTNSTHIEEGLVTLAKYKRPLLIHAERIPDVQNEDGIDGELDPKAYTTYLKSRPPAWEEAAIKDLQRAMKDTEIGGRSEGAHIHIVHLSDAKTSLGLLKDAKQNGARVSVETCPHYLAFSAEEVPDGDTRFKCAPPIRDSTNRDNLWEALLDGHIDMLSSDHSPSAPDLKLMEEGNFLRAWGGISSLQFVLPVTWSHGKKYGISLNQLASWWSERPAMLAGLKKKGAVLPGYRADIVVWKPEAQFHLDDSHPVYHKHRNISAYLGKQLSGKILSTFVGGNLVFAEDKHAKVACGAPILAK

SEQ ID NO: 363 - protein, 507 aa, Oryza sativa Japonica Group
MAMAAAKGRVLPLLAVAAALAAALLYRAPFSKSLGGEGCSLLPHDHFWIASERVVTLGRVGPAAVEVKGGLINAIAVGDYRSFLLRRPVVDYGDAVIMPGLIDVHAHLDEPGRAEWEGFSTGTRAAAAGGITTLVDMPLNSYPSTVSEETLKLKLDAAKDKLHVDVGFWGGLVPENALNPSALESLLNAGVLGLKSFMCPSGINDFPMTNSTHIEEGLVTLAKYKRPLLIHAERIPDVQNEDGIDGELDPKAYTTYLKSRPPAWEEAAIKDLQRAMKDTEIGGRSEGAHIHIVHLSDAKTSLGLLKDAKQNGARVSVETCPHYLAFSAEEVPDGDTRFKCAPPIRDSTNRDNLWEALLDGHIDMLSSDHSPSAPDLKLMEEGNFLRAWGGISSLQFVLPVTWSHGKKYGISLNQLASWWSERPAMLAGLKKKGAVLPGYRADIVVWKPEAQFHLDDSHPVYHKHRNISAYLGKQLSGKILSTFVGGNLVFAEDKHAKAACGAPILAK

SEQ ID NO: 364 - protein, 505 aa, Hordeum vulgare subsp. vulgare
MAAGKGRVLPLLAVAAALAAALLYTAPFSKSLGGEGCSLLPHGHFWIASQRVVALGRVGPAAVEVKEGLINAIAVGDYRSFVLRRPLVDYGDAVIMPGLIDVHAHLDEPGRAEWEGFSTGTRAAAAGGITTLVDMPLNSFPSTVSEETLKLKVDAARDKLYVDVGFWGGLVPENALNPSKLESLLNAGVLGLKSFMCPSGINDFPMTNSTHIEEGLVTLAKYKRPLLIHAERIPDVASDEELDGELDPRSYATYLKSRTPAWEESAVRDLKRAMKDTEVGGRSEGAHLHIVHLSDSKTSLRLLKDAKHSGAKVTIETCPHYLAFSAEEVPDGDTRFKCSPPIRDAANKENLWEALLDGHIDMLSSDHSPSTPDLKLMEEGNFMKAWGGISSLQFVLPVTWSHGKKYGITLNQLASWWSEKPAELAGQKNKGSILPGYHADIVVWNPEAQFHLDDSHAVYHKHRNISAYLGNELSGKVLSTFVRGNLVFAEGKHAGAACGATILAK

SEQ ID NO: 365 - protein, 497 aa, Oryza sativa Indica Group
MAMAAAKGRVLPLLAVAAALAAALLYRAPFSKVSGRFPFPRYSNPRSLLSYEKAEENPFVFAEPGRGGEGRADQRDRRRGLPELPAPATGGGLRHAHLDEPGRAEWEGFSTGTRAAAAGGITTLVDMPLNSYPSTVSEETLKLKLDAAKDKLHVDVGFWGGLVPENALNPSALESLLNSGVLGLKSFMCPSGINDFPMTNSTHIEEGLVTLAKYKRPLLIHAERIPDVQNEDGIDGELDPKAYTTYLKSRPPAWEEAAIKDLQRAMKDTEIGGRSEGAHIHIVHLSDAKTSLGLLKDAKQNGARVSVETCPHYLAFSAEEVPDGDTRFKCAPPIRDSTNRDNLWEALLDGHIDMLSSDHSPSAPDLKLMEEGNFLRAWGGISSLQFVLPVTWSHGKKYGISLNQLASWWSERPAMLAGLKKKGAVLPGYRADIVVWKPEAQFHLDDSHPVYHKHRNISAYLGKQLSGKILSTFVGGNLVFAEDKHAKVACGAPILAK

SEQ ID NO: 366 - protein, 134 aa, Zea mays subsp. parviglumis
MRKHRIVSLVSALLILLALAVSSTRNAQEDSMANNTGTLVGGIQDVPGSENDLHLQELARFAVDEHNKKANALLGFEKLVKAKTQVVAGTMYYLTIEVKDGEVKKLYEAKVWEKPWENLKGLQEFKPVEEGASA

SEQ ID NO: 367 - protein, 134 aa, Zea mays subsp. parviglumis
MRKHRIVSLVSALLILLALAVSSTRNAQEDSMANNTGTLVGGIQDVPGSENDLHLQELARFAVDEHNKKANALLGFEKLVKVKTQVVAGTMYYLTIEVKDGEVKKLYEAKVWEKPWENLKGLQEFKPVEEGASA

SEQ ID NO: 368 - protein, 134 aa, Zea mays
MRKHRIVSLVSALLILLALAVSSTRNAQEDSMANNTGTLVGGIQDVPGSENDLHLQELARFAVDERNKKANALLGFEKLVKAKTQVVAGTMYYLTIEVKDGEVKKLYEAKVWEKPWENLKGLQEFKPVEEGASA

SEQ ID NO: 369 - protein, 134 aa, Zea mays subsp. parviglumis
MRKHRIVSLVFALLILLALAVSSTRNAQEDSMADNTGTLAGGIKDVPGNENDLHLQELARFAVDEHNKKANALLGFEKLVKAKTQVVAGTMYYLTIEVKDGEVKKLYEAKVWEKPWENLKGLQEFKPVEEGASA

SEQ ID NO: 370 - protein, 134 aa, Zea mays subsp. parviglumis
MRKHRIVSLVSALLILLALAVSSTRNAQEDSMANNTGTLVGGIQDVPGSENDLHLQELARFAVDEHNKKANALLGFEKLVKAKTQVVAGTMYYLTIEVKDGEVKKLYEAKVWEKPWENFKELQEFKPVEECASA

SEQ ID NO: 371 - protein, 134 aa, Zea mays
MRKHRIVSLVAALLILLALAVSSTRNAQEDSMADNTGTLAGGIKDVPGNENDLHLQELARFAVDEHNKKANALLGFEKLVKAKTQVVAGTMYYLTIEVKDGEVKKLYEAKVWEKPWENFKELQEFKPVEEGASA

SEQ ID NO: 372 - protein, 134 aa, Zea mays
MRKHRIVSLVAALLILLALAVSSTRNAQEDSMADNTGTLAGGIKDVPGNENDLHLQELARFAVDEHNKKANALLGFEKLVKAKTQVVAGTMYYLTIEVKDGEVKKLYEAKVWEKPWENFKELQEFKPVDEGASA

SEQ ID NO: 373 - protein, 134 aa, Zea mays
MRKHRIVSLVAALLILLALAVSSNRNAQEDSMADNTGTLVGGIQDVPENENDLHLQELARFAVDEHNKKANALLGFEKLVKAKTQVVAGTMYYLTIEVKDGEVKKLYEAKVWEKPWEKFKELQEFKPVEEGASA

SEQ ID NO: 374 - protein, 135 aa, Coix lacryma-jobi
MRKQRIVPLVAALLVLLALAVSSTRNAREEESMADDAGMLAGGIKDVPANENDLHLQELARFAVDEHNKKANALLGYEKLVKAKTQVVAGTMYYLTIEVKDGEVKKLYEAKVWEKPWENFKELLEFKPVEEDASA

SEQ ID NO: 375 - protein, 135 aa, Zea mays
MRKHRIVSLVAALLVLLALAAVSSTRSTQKESVADNAGMLAGGIKDVPANENDLQLQELARFAVNEHNQKANALLGFEKLVKAKTQVVAGTMYYLTIEVKDGEVKKLYEAKVWEKPWENFKQLQEFKPVEEGASA

SEQ ID NO: 376 - protein, 701 aa, Hordeum vulgare subsp. vulgare
MKALLSAHASDLLRGPHLVRAAVLFFACAASFLVGYRWSDASASPLFFSSVFSPAPPSSRISSRSPSVAISPNSNISFDPSLIPAPAAAPPASSTPNASPPPPPPVASPPPPMPTPSPPPPPPLPPSPPPPPARLGIVGEDGAMRDDFDIGAGVNETDLATDEGAPQEPGNAGAGRGNRVRVGKFPACPASMREYIPCLDNDEEIRRLPSTERGERFERHCPAKEKALSCLVPAPKGYKAPIPWPRSRDEVWFTNVPHTRLVDDKGGQNWITKAKDKFTFPGGGTQFIHGANQYLDQISQMVPDIAFGSRTRVVLDVGCGVASFGAYLLSRDVLTLSIAPKDVHENQIQFALERGVPAMVAAFATHRLLYPSQAFEIIHCSRCRINWTRDDGILLLEVNRMLRAGGYFAWAAQPVYKHEEAQQEAWKEMEDLTTRLCWELVKKEGYVAMWRKPLNNSCYMSREPGVKPPLCDTDDNPDDVWYVGLKACISRLPVNGDGSAPFPWPARLMEPPRRLQGVEMDAYSSKNELFKAETKFWDDIVGGYIRVFKWKKFKLRNVMDMRARFGGFGAALIGRKLDCWVMNVVPVTEPNTLPVIYDRGLLGVAHDWCEPFDTYPRTYDLLHAFGLFSKEQKRCNVSSILLEMDRILRPGGRAYIRDNRETIEDIKEITDAMGWRSTIRETGEGAHASRKVLTCDKPMVR

SEQ ID NO: 377 - protein, 687 aa, Oryza sativa Japonica Group
MKPLGAHGADLLCGPRVLRAAALAFACAAAFLVGYHWSDSSPRLLFFSSTASSSSSPLLSTGSPSVAVSPNANLSFDPSLIPTPAASTPPASPTANASPPPSLPPPPPPLRPPPPPARLGIVGEDGAMRDDFDVVVGGANDTDLAATDEALPQEPTDAGPAVGSRVRIGRFPVCPESMREYIPCLDNEEEIRRLPSTERGERFERHCPAKDKGLSCLVPAPKGYKAPIPWPRSRDEVWFSNVPHTRLVDDKGGQNWISKAKDKFRFPGGGTQFIHGANQYLDQISQMVPDIAFGSHTRVALDVGCGVASFGAYLLSRDVLTLSIAPKDVHENQIQFALERGVPAMAAAFATHRLLYPSQAFDLIHCSRCRINWTHDDGILLLEVNRMLRAGGYFAWAAQPVYKHEEAQQEAWKEMEDFTARLCWELVKKEGYIAMWRKPLNNSCYMNRDPGVKPALCDPDDNPDDVWYVNLKACISRLPENGDGLTPFPWPARLMEPPKRLEGVEMDAHSSKKELFKAETKFWDDIVEGYIRVFKWRKFKLRNVLDMRAGFGGFAAALINRKLDCWVMNVVPVSEPNTLPVIYDRGLLGVAHDWCEPFDTYPRTYDLLHAFSLFSKEQKRCNISSILLEMDRILRPGGRAYIRDLKQVVQDVKEITTAMGWRSIMRDTAEGPYASRKVLMCDKPMVR

SEQ ID NO: 378 - protein, 688 aa, Sorghum bicolor
MKALGAHGADLLRGPHLLRAAVLAFAVALAFLVGYHWPNASPRLVFFSSAASSSAPRSSSRSPAVALSPNSNISFDQSLIPTPATPPASPAPNAWPPPSLPPPTPAPPPPLLPPPPPARLGIVGEDGAMQDEFDIGSIGANDTDLATDDTAPQEPSNGGASGGPPRVRIGRFPVCPESMREYIPCLDNEEEIKRLPSTERGERFERHCPAKDKGLSCLVPAPNGYKAPIPWPRSRDEVWFSNVPHTRLVDDKGGQNWITKVKDKFRFPGGGTQFIHGANQYLDQISQMVPNVAFGSHTRVVLDVGCGVASFGAYLLSRDVLTLSIAPKDVHENQIQFALERGVPAMVAAFATRRLLYPSQAFDIIHCSRCRINWTRDDGILLLEVNRLLRAGGYFAWAAQPVYKHEEAQQEAWKEMEDLTTRLCWELVKKEGYIAMWRKPLNNSCYMNRGPAVKPPLCDADDNPDDVWYVSLKACISRLPENAEAPTPVQWPARLMEPPKRLQGVEMDAYSSKNELFKAETKFWEDIIDGYIRVFKWRKFKLRNVMDMRAGFGGFAAALISRKLDWWVMNVVPISEPNTLPVIFDRGLLGVAHDWCEPFDTYPRTYDLLHASGLFSKEQKRCNISSILLEMDRILRPGGKAYIRDRKEVIQEIKEITNAMGWRGTIRDTAEGAYASRKVLMCDKPMGR

SEQ ID NO: 379 - protein, 688 aa, Zea mays
MKALGAHAADLLRGPHLLRAAVFAFAVALAFLVGYHWPNASPRLVFFSSDASSSSPRSSSRSPSVVLSPNSNVSFDPSLIPTPSTPPASSTPNAWSPPALPPPTSAPPPPLPPPPPPARLGIVGEDGAMQDDFDIGNVGANDTDLATDETAPQEPSDVGASGGPPRVRIERFPVCPESMREYIPCLDNEDDIKRLPSTERGERFERHCPAKDKGLSCLVPAPNGYKAPIPWPRSRDEVWFSNVPHTRLIDDKGGQNWITKVKDKFRFPGGGTQFIHGANQYLDQISQMVPNVAFGSHTRVVLDVGCGVASFGAYLLSRDVLTLSIAPKDVHENQIQFALERGVPAMAAAFATRRLLYTSQAFDIIHCSRCRINWTRDDGILLLEVNRLLRAGGYFAWAAQPVYKHEEAQQEAWKEMENLTARLCWEFVKKEGYIAMWRKPLNNSCYINRGPEGKPPLCDADDNPDDVWYVGLKACISRLPENGEAPTPVQWPARLMEPPKRLQGVEMDAYSSKNELFKAETKFWDDIIDGYIRIFKWRKFKVRNVMDMRAGFGGFAAALIRQKLDWWVMNVVPISEPNTLPVIFDRGLLGVAHDWCEPFDTYPRTYDLLHASGLFSKEQNRCNISSILLEMDRILRPGGKAYIRDRKEVIQEIKEITNAMGWRGTIRDTAEGAYASRKVLMCDKPMAR

SEQ ID NO: 380 - protein, 679 aa, Zea mays
MKALGAHAADLLRGPHLLRAAVFAFAVALAFLVGYHWPNASPRLVFFSSDASSSSPRSSSRSPSVVLSPNSNVSFDPSLIPTPSTPPASSTPNAWSPPSLPPPTSAPPPPLPPPPPPARLGIVGEDGAMQDDFDIGNVGANDTDLATDETAPQEPSDVGASGGPPRVRIERFPVCPESMREYIPCLDNEDDIKRLPSTERGERFERHCPAKDKGLSCLVPAPNGYKAPIPWPRSRDEVWFSNVPHTRLIDDKGGQNWITKVKDKFRFPGGGTQFIHGANQYLDQISQMVPNVAFGSHTRVVLDVGCGVASFGAYLLSRDVLTLSIAPKDVHENQIQFALERGVPAMAAAFATRRLLYPSQAFDIIHCSRCRINWTRDDGILLLEVNRLLRAGGYFAWAAQPVYKHEEAQQEAWKEMENLTARLCWEFVKKEGYIAMWRKPLNNSCYINRGPEGKPPLCDADDNPDDVWYVGLKACISRLPENGEAPTPVQWPARLMEPPKRLQGVEMDAYSSKNELFKAETKFWDDIIDGYIRIFKWRRFKVRNVMDMRAGFGGFAAALIRQKLDWWVMNVVPISEPNTLPVIFDRGLLGVAHDWCEPFDTYPRTYDLLHASGLFSKEQNRCNISSILLEMDRILRPGGKAYIRDRKEVIQEIKEITNAMGWRGTIRDTAEGRTPVGRF

SEQ ID NO: 381 - protein, 324 aa, Sorghum bicolor
MAHAKAGASLPVPNVQALAQTWHGSGEPGPVRYVRTEETSAGEVVAGCAIPVVDLSRLLDPRSSEEELANLGSACQHWGFFQLINHGVVDEVIQDVKRDMIEFFKLPLEAKKVHAQVPGGLEGYGQAFVFSETQKLDWADMIYLMISPKESRDLRFWPTRPPSFRDSVDRYSAEVAKVTVCLLRFMAADLGVEPKRLLEAFRGQPQSMRTTYYPPCRQAADVLGLSPHTDATGLALLLHVNDVQGLQIWRDGKWHAVDPLDGTFVVSIGDILEILSNGRYRSIEHKAVVHPDKERISAAMFHQPRQRCSISRAPTRRSALCRSS

SEQ ID NO: 382 - protein, 356 aa, Zea mays
MAHAKAGASLPVPNVQALAQTWHGSGEPVPFRYVRTEEIVAGEVVAGCAIPVVDLSRLLDPRSSEEELANLGSACQHWGFFQLINHGVPDEVIQDTKKDMVEFFKLPVEAKKVHAQVPGGIEGYGQAFVFSETQKLDWADMIYLMISPKESRDLRFWPTRPPSFRDSIERYSAETAKVTACLLRFMAKDLGVEPERLLEEFRGLPQSMRTTYYPPCRLAADVLGLSPHTDATGLTLLLHVNDVQGLQIRRDGKWLAVDPLDGALVVSIGDILEILSNGRYRSIEHRAIVHPDKERISAAMFHQTCPNTTVGPLQELVERDSGGARYRSMDYMDFMKGFFAAKLDGRRSHMDALRIY

SEQ ID NO: 383 - protein, 304 aa, Sorghum bicolor
MAHAKAGASLPVPNVQALAQTWHGSGEPMPVRYVRTEETSAGEVVAGCAIPVMDLSRLLNPRLSEEELANLGFACQHWGFFQLINHGVPDEVIQDVKRDMIEFFKLPLEAKKVHAQVPGGLEGYGQAFVYSETQKLDWSDMIYLRISPMESRDLRFWPTRPPSFRDSVDRYSAETAKVTASLLRFMAVDLGVESERLLEAFRGQPQSMRTSYYPACKQVADVLGLSPHTDATLALLLHVNDVQGLQIRRDGKWHAIDPIDGAFVVSIGDILEVYIIREMLMPDRHRQLTQILTLFESLKLNSFS

SEQ ID NO: 384 - protein, 385 aa, Sorghum bicolor
MCVCERDYSNLYRTETSLQQEEEEPTLLSMAHAKSAGGNLQVPNVQALSQTWNQSGELVPARYVRTEETSDAVVVAGCALPVVDLGRLLDPRSSQEELAVLGSACQQGFFQLVNHGVPDDVVLDVRRDIAEFFRLPLEAKKVYAQLPDGLEGYGQAFVFSEAQKLDWSDMMYLMLRPVESRDMSFWPVHPPSFRTSVDRYSAEAAKVVWCLLRFMAADMGVEPELLQEMFAGQPQTMKMTYYPPCRQADKVIGLSPHTDACAVTLLLHVNDVQGLQIRMDDGKWHPVEPLDGALIVSVGDIIEILSNGKYRSIEHRAVVHPDKERISAAMFHQPRGSITVEPLPELVKKDGGVARYKSVGYAEFMKRFFSAKLDGRKGHLDHFRV

SEQ ID NO: 385 - protein, 574 aa, Zea mays
MTLASTDKVVLGCIAFSIFWVLAVFPSVPFMPVGRTAGSLLGAMLMVLFRVMTPEEAYKAIDLPILGLLFGTMVVSIFLERADMFKYLGSALAWRSRGSKDLLFRVCLVSAVASALFTNDTCCVVLTEFILKLARQNNLPPQPFLLALASSSNIGSSATPIGNPQNLVIAVQSGITFGQFLVGVFPAMIVGVAANTCILLCYFWRCLSAPEKDQEGGAAAAGPDVAVVADEEVTSHRFTPARMSRASSVNGGGADADCVGELIRRSDSLSRADTTLGMSMRSRSYNSEGGDIQVAIRSMRASSMSQEMVEVSTVCDRRDDGGAGPRKVTRTTSHQRSVIIEDAPEADAADDDDDGHKGKDGDSVTNKEKRWKVLVWKTAVYLTTLGMLAALLMGLNMSWSAITAALVLLALDFTDAQACLEKVSYSLLIFFCGMFITVDGFNRTGIPNALWELVEPHSRIDSAKGTALLAVVILVLSNVASNVPTVLLLGTRVAASAGTISPESEKKAWLILAWVSTVAGNLTLLGSAANLIVCEQARRAQFFGYNLTFWSHLRFGLPSTIIITAIGLLIVASY

SEQ ID NO: 386 - protein, 531 aa, Zea mays
MLMVLFRVMTPEEAYKAIDLPILGLLFGTMVVSIFLERADMFKYLGSALAWRSRGSKDLLFRVCLVSAVASALFTNDTCCVVLTEFILKLARQNNLPPQPFLLALASSSNIGSSATPIGNPQNLVIAVQSGITFGQFLVGVFPAMIVGVAANTCILLCYFWRCLSAPEKDQEGGAAAAGPDVAVVADEEVTSHRFTPARMSRASSVNGGGADADCVGELIRRSDSLSRADTTLGMSMRSRSYNSEGGDIQVAIRSMRASSMSQEMVEVSTVCDRRDDGGAGPRKVTRTTSHQRSVIIEDAPEADAADDDDDGHKGKDGDSVTNKEKRWKVLVWKTAVYLTTLGMLAALLMGLNMSWSAITAALVLLALDFTDAQACLEKVSYSLLIFFCGMFITVDGFNRTGIPNALWELVEPHSRIDSAKGTALLAVVILVLSNVASNVPTVLLLGTRVAASAGTISPESEKKAWLILAWVSTVAGNLTLLGSAANLIVCEQARRAQFFGYNLTFWSHLRFGLPSTIIITAIGLLIVASY

SEQ ID NO: 387 - protein, 575 aa, Zea mays
MTLASTDKVVLGCIAFSIFWVLAVFPSVPFMPVGRTAGSLLGAMLMVLFRVMTPEEAYKAIDLPILGLLFGTMVVSIFLERADMFKYLGSALAWRSRGSKDLLFRVCLVSAVASALFTNDTCCVVLTEFILKLARQNNLPPQPFLLALASSSNIGSSATPIGNPQNLVIAVQSGITFGQFLVGVFPAMIVGVAANTCILLCYFWRCLSAPEKDQEGGGAAAAGPDVAVVADEEVTSHRFTPARMSRASSVNGGGADADCVGELIRRSDSLSRADTTLGMSMRSRSYNSEGGDIQVAIRSMRASSMSQEMVEVSTVCDRRDDGGAGPRKVTRTTSHQRSVIIEDAPEADAADDDDDGHKGKDGDSVTNKEKRWKVLVWKTAVYLTTLGMLAALLMGLNMSWSAITAALVLLALDFTDAQACLEKVSYSLLIFFCGMFITVDGFNRTGIPNALWELVEPHSRIDSAKGTALLAVVILVLSNVASNVPTVLLLGTRVAASAVAISPESEKKAWLILAWVSTVAGNLTLLGSAANLIVCEQARRAQFFGYNLTFWSHLRFGLPSTIIITAIGLLIVASY

SEQ ID NO: 388 - protein, 557 aa, Oryza sativa Japonica Group
MALAGTSKVVLGCVAFGIFWVLAVFPTVPFMPVGRTAGSLLGAMLMVLFRVISPEDAYAAIDLPIIGLLFGTMVVSIFLERADMFKYLGNLLSWKSRGSKDLLFRVCIVSAIASALFTNDTCCVVLTEFILKVARQNNLPPQPFLLALATSSNIGSAATPIGNPQNLVIAVESGISFGQFLLGVFPAMIVGVLTNAAILLCYFWKYLSVEKDQEGGQPAGPEVVADDEVTSHRFTPARMSHVSSLNPDDMDCISEPIIRSNSVRSTSANENLRSRSVNSEADIQLAIKSLRASSMSHEMVEVSTVTDRRDEGASSRKFTRTASQQRSVIIEDSPPSPASNGDKEKEDEVAEKRWRVFVWKTAVYLITLGMLIALLMGLNMSWTAITAALVLLALDFTDAQACLEKVSYSLLIFFCGMFITVDGFNKTGIPNTLWELVEPYSRIDSAKGVALLAVVILILSNVASNVPTVLLLGTRVAASAAAISHDSERKAWLILAWVSTVAGNLTLLGSAANLIVCEQARRAQFFGYNLSFWSHLRFGVPSTIVVTAIGLLIVTSY

SEQ ID NO: 389 - protein, 567 aa, Oryza sativa Indica Group
MVLASTPKVVLGCVAFTIFWVLAVFPSVPFMPVGRTAGSLLGAMLMVLFRVMTPEEAYAAIDLPILGLLFGTMVVSIFLERADMFKYLGNMLSWKSRGSKDLLFRVCVVSAVASALFTNDTTCVVLTEFILKVARQNNLPPQPFLLALASSSNIGSAATPIGNPQNLVIAVESGITFGQFLLGVFPAMVVGILANTCILLCYFWRYLSADRDQLEGGGGAHGPEVVADEEVTSHRFTPARMSHASSVNDSDCISEPIRRSESMNRADALRSRSYNSEGDIQVAIRSLRASSLSREMVEVSTVCDRRDVVVDGGGGGGPRKITRSTSHQRSVIIEDAPEQHQHPAGLFDGEKDKDDEAIGKRRRWKVIVWKYAVYLTTLGMLAALLLGLNMSWTAITAALILLALDFTDAQACLEKVSYSLLIFFCGMFITVDGFNKTGIPNTLWELVEPYARIDSPKGVVLLAIVILVLSNVASNVPTVLLLGTRVAASAAAISPASEKKAWLILAWVSTVAGNLTLLGSAANLIVCEQARRAQFFGYNLTFWSHLRFGVPSTIIVTAIGLLIVMSY

SEQ ID NO: 390 - protein, 556 aa, Zea mays
MALAGTSKVVLGCIAFGIFWVMAVFPTVPFMPVGRTAGSLLGAMLMVLFRVISPEDAYAAIDLPIIGLLFGTMVVSIFLERADMFKYLGNLLSWKSRGSKDLLFRVCIVSAFASALFTNDTCCVVLTEFILKVARQNNLPPQPFLLALATSSNIGSAATPIGNPQNLVIAVESGISFGQFLLGVFPAMIVGVLTNAAILLLYFWKYLSVEKDQEGGQPTGPEVVADDEVTSHRFTPARMSHVSSLNPDDMDCVSEPIIRSNSVSTTGNENLRSRSINSEADIQLAIKSLRASSMSHEMVEVSTVPDRRDEGASSRKFTRTASQQRSVIIEDLAPSPEINGEKEKETEVAEKRWKVLVWKTAVYLITLGMLIALLMGLNMSWTAITAALVLLALDFTDAQACLEKVSYSLLIFFCGMFITVDGFNKTGIPNTLWELVEPYSRIDSAKGVALLAVVILILSNVASNVPTVLLLGTRVAASAASISHGSERKAWLILAWVSTVAGNLTLLGSAANLIVCEQARRAQFFGYNLTFWSHLRFGVPSTIIVTAIGLLIVISY

SEQ ID NO: 391 - protein, 556 aa, Zea mays
  misc_feature (272)..(272): Xaa can be any naturally occurring amino acid
MALAGTSKVVLGCIAFGIFWVMAVFPTVPFMPFGRTAGSLLGAMLMVLFRVISPEDAYAAIDLPIIGLLFGTMVVSIFLERADMFKYLGNLLSWKSRGSKDLLFRVCIVSAFASALFTNDTCCVVLTEFILKVARQNNLPPQPFLLALATSSNIGSAATPIGNPQNLVIAVESGISFGQFLLGVFPAMIVGVLTNAAILLLYFWKYLSVEKDQEGGQPTGPEVVADDEVTSHRFTPARMSHVSSLNPDDMDCVSEPIIRSNSVSTTGNENLXSRSINSEADIQLAIKSLRASSMSHEMVEVSTVPDRRDEGASSRKFTRTASQQRSVIIEDLAPSPEINGEKEKETEVAEKRWKVLVWKTAVYLITLGMLIALLMGLNMSWTAITAALVLLALDFTDAQACLEKVSYSLLIFFCGMFITVDGFNKTGIPNTLWELVEPYSRIDSAKGVALLAVVILILSNVASNVPTVLLLGTRVAASAASISHGSERKAWLILAWVSTVAGNLTLLGSAANLIVCEQARRAQFFGYNLTFWSHLRFGVPSTIIVTAIGLLIVISY

SEQ ID NO: 392 - protein, 535 aa, Zea mays
MAVFPTVPFMPVGRTAGSLLGAMLMVLFRVISPEDAYAAIDLPIIGLLFGTMVVSIFLERADMFKYLGNLLSWKSRGSKDLLFRVCIVSAFASALFTNDTCCVVLTEFILKVARQNNLPPQPFLLALATSSNIGSAATPIGNPQNLVIAVESGISFGQFLLGVFPAMIVGVLTNAAILLLYFWKYLSVEKDQEGGQPTGPEVVADDEVTSHRFTPARMSHVSSLNPDDMDCVSEPIIRSNSVSTTGNENLRSRSINSEADIQLAIKSLRASSMSHEMVEVSTVPDRRDEGASSRKFTRTASQQRSVIIEDLAPSPEINGEKEKETEVAEKRWKVLVWKTAVYLITLGMLIALLMGLNMSWTAITAALVLLALDFTDAQACLEKVSYSLLIFFCGMFITVDGFNKTGIPNTLWELVEPYSRIDSAKGVALLAVVILILSNVASNVPTVLLLGTRVAASAASISHGSERKAWLILAWVSTVAGNLTLLGSAANLIVCEQARRAQFFGYNLTFWSHLRFGVPSTIIVTAIGLLIVISY

SEQ ID NO: 393 - protein, 572 aa, Hordeum vulgare subsp. vulgare
MVLAHTSKVVLGCVAFGIFWVLAVFPSVPFMPVGRTAGSLLGAMLMVLFRVISPEDAYAAIDLPIIGLLFGTMVVSIFLERADMFKYLGNLLQWKSRGPKDLLFRVCIVSAIASALFTNDTCCVVLTEFILKVARQNNLPPQPFLLALATSSNIGSAATPIGNPQNLVIAVESGISFGQFLLGVFPAMIVGVLTNAAILLCYFWRYLAVEPTDQLERGGGGVSTRGAELQVGDDEVQSHRFTPARMSHVSSLNPDDFDCVSEPIIRSASVNGGDNLRSRSVNSNAADADMQFSIRSLRSSSMSHEMVEVSTVPVLLDGSASSRKFTRTASQQRSVIIEDAPPSSPTDDDDAANGDKDKGELPEVAEKRWKVLVWKTAVYLITLGMLIALLMGLNMSWTAITAALVLLTLDFTDAQACLEKVSYSLLIFFCGMFITVDGFNKTGIPNTMWELVEPYSRIDSARGVALLGLVILILSNVASNVPTVLLLGTRVAASAAAISPASERKAWLILAYVSTVAGNLTLLGSAANLIVCEQARRAQFFGYNLSFWSHLRFGVPSTIVVTAIGLLIVSSY

SEQ ID NO: 394 - protein, 572 aa, Hordeum vulgare subsp. vulgare
MVLAHTSKVVLGCVAFGIFWVLAVFPSVPFMPVGRTAGSLLGAMLMVLFRVISPEDAYATIDLPIIGLLFGTMVVSIFLERADMFKYLGNLLQWKSRGPKDLLFRVCIVSAIASALFTNDTCCVVLTEFILKVARQNNLPPQPFLLALATSSNIGSAATPIGNPQNLVIAVESGISFGQFLLGVFPAMIVGVLTNAAILLCYFWRYLAVEPTDQLERGGGGVSTRGAELQVGDDEVQSHRFTPARMSHVSSLNPDDFDCVSEPIIRSASVNGGDNLRSRSVNSNAADADMQFSIRSLRSSSMSHEMVEVSTVPVLLDGSASSRKFTRTASQQRSVIIEDAPPSSPTDDDDAANGDKDKGELPEVAEKRWKVLVWKTAVYLITLGMLIALLMGLNMSWTAITAALVLLALDFTDAQACLEKVSYSLLIFFCGMFITVDGFNKTGIPNTMWELVEPYSRIDSARGVALLGLVILILSNVASNVPTVLLLGTRVAASAAAISPASERKAWLILAYVSTVAGNLTLLGSAANLIVCEQARRAQFFGYNLSFWSHLRFGVPSTIVVTAIGLLIVSSY

SEQ ID NO: 395 - protein, 453 aa, Sorghum bicolor
MAPPEPEVFDVVIFGASGFTGKYVIREALKFLNSSSNSPLRSLAVAGRSRDRVAAALRWAAAPAPPPEDVPILVADTSDPASLAALAARARVVLSCAGPFRLHGHAVAAACAAAGADCLDISGEPEFMERVEAELHEPAAKTGSLIVSACGFDSVPAELGFLFHSRQWEPPSALVSVEAYVYLQSSKRIVGNIGTYESAVLGVANAGQLQALRRSRPRPPKPNIPGPPPPKGSLIEGQNPLGMWAMKLPSADTVVVKRTLSTLTEHPEGLPGAEETPEYAEHRKKFWSSVKPAHFGVKIASRSLMMLVRFIFTGIFIGLFGNFSFGRSLLLKYPEFFSAGMFRRAGPTEEEVKSASFKMWFVGHGYSNVDRSLELGRSKPDKEVITKVSGPEVGYITTPIVLVQCALVLLSQRANLPKGGVYTPGTVFGPTDLQQRLQENGLSFEVNVTRTMS

SEQ ID NO: 396 - protein, 454 aa, Zea mays
  misc_feature (194)..(194): Xaa can be any naturally occurring amino acid
MAPPEPEMFDVVIFGASGFTGKYVIREALKFLNASSSASPLRSLAVAGRSRDRIAAALRWAAAPAPPPEDVPILVADTSDPASLAALASHARVVLSCAGPFRLHGHAVAAACAAVGADCLDISGEPEFMERVESELHEPAARSGSLIISACGFDSVPAELGFMFHSRQWEPPSAPATVEAYVSLQSTKRIVGBXGTYESAVLGVANAGQLQALRRSRPRRPRPNIPGPPPPKGSLIEGHNPLGMWAMKLPSADTVVVKRTLSTLTEHPEGLPGAEETPEYADHRKKFWSSVKPAHFGVKIASRSLLILVRFIFTGIFIGLLANFSFGRSLLLKYPEFFSAGLFSRAGPTEEEVKSASFKMWFVGHGYSNVDSSLELGRSKPDKEVITKVSGPEVGYVTTPIVLVQCALVLLSQRANLPKGGVYTPGTVFGPTDLQQRLQDNGLFFEVNTTRAMH

SEQ ID NO: 397 - protein, 456 aa, Oryza sativa Indica Group
MATPPPPPAPTPEVFDVVIFGASGFTGRYVIREALKFLPPSSSPLRSLALAGRSRDRVAAALRWAAGPGGAAPDLPILVADASDPASLAALAARARVVLSCAGPFRLHGRQVAAACAAAGADCLDISGEPEFMERVEAEFHEAAAKNGSLIISACGFDSIPAELGFLFHSRQWAPPSVPVTVQAYLSLESDKRIVGNFGTYESAVLGVANAGELQALRRSRPRRPRPNIPGPPPPKGSLVEHDKALGLWTIKLPSADTVVVKRTLSTVTEHPEGLPGVEESADFAEHRKSFWSSVKPAHFGVKLTSKSLLGIAQFIFTGLCIGLLGGFCFGRSLLLKFPSFFSAGWFRKSGPTEEQVSSASFKMWFVGRGYSDAARASDRGSKPDKEIITRVSGPEIGYITTPIVLVQCALVLLSQRGNLPKGGVYTPGAVFGPTDIQQRLQENGLSFDLVSTRTL

SEQ ID NO: 398 - protein, 455 aa, Hordeum vulgare subsp. vulgare
MAAPVPPGPEVFDVVIFGASGFTGKYVIREALKFLPPNASPLRSLALAGRSRDRVAAALRWAAAPGPAPDVPILVADASDPASLAAVAARARVLLSCAGPFRLHGRQVAAACAEAGADCLDISGEPEFMERVEADLHEVAAKNGSLIVSACGFDSIPAELGFLFNSRQWTPPSAPVSVVAYVNLESDRKIVGNFGTFESAVLGVANANQLQALRRSRPRPAKPRIPGPPPPKGSLIEHDKALGLWVMKLPSADTVVVKRTLAKLTEHPEGLPGVDETSDFAAHRKEFWSSVKPAHFGVKISTRSILGLFWWLCTGLFIGILGGFSLGRSLLLKFPEFFSIGLFRKTGPTEEEVRSASFKMWFIGRGYSDSARASERGSKPDKEIVTRVSGPEIGYITTPIVLVQCALVLLSQRANLPKGGVYTPGAVFGPTDLQKRLEENGLSFELISSRTLPSD

SEQ ID NO: 399 - protein, 432 aa, Oryza sativa Japonica Group
MAMPLTPPAPIPRVFDVVIFGGSGFTASYVIREALKFLPPSSSPLGSLALAGGSRDRVAAALAWAGGPGGAAPDLPILVADASDPGQVAAACAAAGADCLDISGEPEFMERVEAEFHEAAAKNGSLIISACGFDSIPAELGFLFHSRQWAPPSVPVTVQAYLSLESDKRIVGNFGTYESAVLGVANAGELQALRRSRPRRPRPNIPGPPPPKGSLVEHDKALGLWTIKLPSADTVVVKRTLSTVTQHPEGLPGVEESTDFAEHRKSFWSSVKPAHFGVKLTSKSLLGIAQFIFTGLCIGLLGGFSFGRSLLLKFPSFFSAGWFRKSGPTEEQVSSASFKMWFVGRGYSDAARASDRGSKPDKEIITRVSGPEIGYITTPIVLVQCALVLLSQRGNLPKGGVYTPGAVFGPTDIQQRLQENGLSFDLVSTRTL

SEQ ID NO: 400 - protein, 598 aa, Zea mays
MDFSAPSFSLGFDWDDDDPPASSDRREQPRGYGAPDAPSFSLGIDDDDDVEEPRIPARGRQNEQAREFTAPDPPSFSLGFDDEHGDGDILSADRCREQSQPQVAPGSPSNGTADDDDDKEDGFVVAGGKRPVRVERDTLYPDPLPTPAETNRFKRLRKGSATAHPAQTPQVPHREAPDAPSSSLSISDDDFLTGGQHHERLKPQASPRIPSSLSIEDEDDDFFLAGDRQPEPTLPQVTQLKRLRKGPVPPHLAPSPPPPKVPGQPTTEASPVMTEDAARGAVGSWEDEIEDWTTDEDRPVRDVPPSVGSCSTSSNSKFSLLNRGVLMTQSGTKASTSKFTQTPNTSASISLEESCTKKLLPKITVSPMRKIYLLDSDTDADDDYSQNKAKSMQQNRKPQMNSTVQKSGAMMSDNWATPALDEFCKEYFESPKDAGFSQPKEGNTHYKASQPKNSGHFQQQASSSGGEVDDGPPAMQYLYHPDPRVGDLFRNRLQHFVPIGAGSAIANEQNRAKSLRSCRRQSSSSAAATDDWVTPGRVSVPTDASKRRVHASGTHSGSGHWFTNDSGRKVRLYFQNFSSHVFKLLDRSDRSCLVFCAS

SEQ ID NO: 401 - protein, 748 aa, Sorghum bicolor
MDFSAPSFSLGFDWDDDDDPPAGSDRHEQPRGYEAPDPPSFSLGIDDDDVVEAPRIPAVDRQKGHERWSTAPDPPSFSLGFDDDVVEEPRIRAGGRRKEHARGYTAPDPPSFPLGFDDEDGDGDILAADQRCERARPPVAPGAPASTGAADDDDKEDGFVLAGGRRPVRVERHRLDRDPLPPPRLQTNRFAAPDPPSFSLGFDDEDGHGDILAADQRREQALPQAALGAPSSTGTGDDDDKDDDFVLAGGKRPVRVDRDTIDTDPLPPPASTNRFKRLRKGPAPAHPAPTPQVLHCEAPYSSLIINDDDDSLAGGQHHEQSKPQAAPRVPSSLSIEDEDGDFFLAGDQQPEPTLPEPEVTQLKRLRKGPAPPHLAPSPPPLKVPGQPTVVIDNAARAAVGSWEDEIEDWTTDEDRPVRDVPPSVGSCSTSSNSKFSLLNRGVLMTQSATKANRSKISQTPNTSASISLEESCTKKLLPKITVSPMRKIYLLDSDTDADDDHNQNKAKTQQQNTKPRGSSTVLKSGAMMNDNWATPALDEFCNEYFKSSKDAGFSQQKEGNTHYRVSQPKNSGHFQQQTSSSGAELYDGPPAMHYLFHPDPRVGNLFRNRLQHFVPIGAGSTRENGQNRAESLSSGRRQFSSSAAANDDWVTPGRISVPTDASKRRVRASGSHSGSGHWFTDDSGRKVYVSKNGQELTGRNAYRQYQKESGRGFGRYKKKGSSGTKRGAAKVKTETAAKRGTSRAKRKR

SEQ ID NO: 402 - protein, 436 aa, Sorghum bicolor
MESLVLASSCSASPRLPLISSAARFRRLPGSVPPPTVAAASTGGAARKGPRRPRLFVVAAAAPRGSGNVFEGLRAKGFASVSSSTGNENMSTGTGTLPPVPPPSSYFGSPVFWIGVGVALSVAFTTVSSMVKRYAMEQAFKSMMTQAPPNSFGSNSPFPFGMPPQASPTAPSSFPYLEPKKDTSPQVSTVDVSATEVEAAGTSKEVDVTETPEPSKKFAFVDVSPEELQQKNLQSSLETVDVKHDSTDSESKEDIEEKVLPTNGATFKPNEDAARGPTEPSNSGPMLSVETIEKMMEDPTVQKMVYPYLPEEMRNPDSFKWMLQNPMYRQQLQDMLNNMGASPDQWDNRMVDHLKNFDLSSPEVRQQFAQVGMTPEEVVSKIMANPDVAVAFQNPKIQTAIMDCSQNPLNIVKYQNDKEVMDVFMKISQIFPQING

SEQ ID NO: 403 - protein, 450 aa, Zea mays
MESLILASSCSASPRLPLLSSAARFRGLPVSVPPPSSASISGAARKGPMRPRLFVAAAAAPRGSGNVFEGLRAKGFASMSSSTGNENMSTGTGTLPPMPPTSSYIGSPVFWIGVGVALSVAFTTVSSMLKRYAMQQAFKSMMTQSAPNSFGSNSPFPFSMPPQASPTAPSTYPYLEPKKDTSPHVSTVDVSANEVEATGTSKEVDVTETPKPSKKFAFVDVSPEELQQKNLQSSPETVDVKHDSTYSESKEDTEEQVPTISTNTESKEDTEEKVPTNGASFKLNEGAAHGPTESNNSASMLSVETIEKMMEDPAVQKMVYPYLPEEMRNPNSFKWMLQNPMYRQQLQDMLNNMGATPDQWDNRMLDHLKNFDLSSPEVRQQFAQVGMTPEEVVSKIMANPDVAVAFQNPKIQTAIMDCSQNPLNIVKYQNDKEVMDVFMKISQIFPQING

SEQ ID NO: 404 - protein, 450 aa, Zea mays
MESLILASSCSASPRLPLLSSAARFRGLPVSVPPPSSASISGAARKGPMRPRLFVAAAAAPRGSGNVFEGLRAKGFASMSSSTGNENMSTGTGTLPPMPPTSSYIGSPVFWIGVGVALSVAFTTVSSMLKRYAMQQAFKSMMTQSAPNSFGSNSPFPFSMPPQASPTAPSTYPYLEPKKDTSPHVSTVDVSANEVEATGTSKEVDVTETPKPSKKFAFVDVSPEELQQKNLQSSPEMVDVKHDSTYSESKEDTEEQVPTISTNTESKEDTEEKVPTNGASFKLNEGAAHGPTESNNSASMLSVETIEKMMEDPAVQKMVYPYLPEEMRNPNSFKWMLQNPMYRQQLQDMLNNMGATPDQWDNRMLDHLKNFDLSSPEVRQQFAQVGMTPEEVVSKIMANPDVAVAFQNPKIQTAIMDCSQNPLNIVKYQNDKEVMDVFMKISQIFPQING

SEQ ID NO: 405 - protein, 433 aa, Zea mays
MESLVLASSCSPSPRLPLLSPFARFRRLPGSMPQAPASTSGATRKGPRRHMLFVAAATAAPSGSRNVFKELRAKGFASMSSSTGNENMSTETGTLPPMPPPSSYIGSPVFWIGVGVALSVAFTTVSSMLKKYAMEQAFKSMMTQAPPNSFGSNSPFPFGMPPQASPTAPSSFSYLEPKKDTSPQVSTVDVSATEVDAAGTSKEVDVTETPKPSKKFAFVDVSPEDLQQKDLQSSLEMVDVKHDSIESESKEDTEEKAPTNGATFKLNEDAARGPTESSQSGPMLSVETIEKMMEDPAVQKMVYPYLPEEMRNPDSFKWMLQNPMYRQQLQDMLKNMGGSPDQWDNRMLDHLKNFDLSSPEVRQQFAQVGMTPEEVVSKIMANPDVAVAFQNPKIQTAIMDCSQNPLNIVKYQNDKEVMDVFMKISQIFPQING

SEQ ID NO: 406 - protein, 429 aa, Oryza sativa Japonica Group
MESLVLASSCSASPRLPPLSAARRRRPSSQTLPATAAASGRRGAGRSKLVVVAAAAAAARGSGNGFEGLKTNGFASMSSSTNSENMSTGTGSLPPMPPPSSYIGSPVFWIGVGVALSAAFSMVSSMVKKYAMQQAFKSMMTQAPPNTFGSNSPFPFAMPPQAAPAAPSSYPYSQPRKDTSPQSATVDVSATKVEATGTLEEADVAEQPKKKFAFVDVSPEELQQKELQSSLETVDVKSESKQSETMEDTEQKAPTNGTAFKMNEGSASGTTESSNSGPMLSVDTIEKMMEDPAVQKMVYPYLPEEMRNPDSFKWMLQNPMYRQQLQDMLNNMGGSPDQWDNRMLDHLKNFDLSSPEVRQQFAQVGMTPEEVVSKIMANPEVAVAFQNPKIQTAIMDCSQNPLNIVKYQNDKEVMDVFMKISQIFPQING

SEQ ID NO: 407 - protein, 426 aa, Hordeum vulgare subsp. vulgare
MESLVLASSCSASPRLPLLSASSRPSRPLPAAPLSAAAGRRGSRRPRLVVSAASRGSRNVSDGLYTKGFASISSSTSSENTSTGTGTLPPMPPPSSYIGSPVFWIGIGVALSAAFSMVSSMVKKYAMEQAFKSMMTQAPPNTFGANSPFPFSMPPQAGSTAPSSYPYSGPRKNTPKGATVDVSASDVAATGSSEAADVAETSKPSKKFAFVDVSPEELQKQKELQSSLETVDIRSDSTGSETKDDSEQQVPTNGAAFKPSEDSSTWTTESSKSGPMLSIDTIEKMMEDPAVQKMVYPYLPEEMRNPESFKSMLQNPMYRQQLEDMLNNMGASPDQWDNRMVDHLKNFDLSSPEVRQQFAQVGMTPEEVVSKIMANPEVAVAFQNPKIQTAIMDCSQNPLNIVKYQNDQEVMDVFMKISQIFPQING

SEQ ID NO: 408 - protein, 342 aa, Zea mays
MAIVETAAAAAAAAAAADHTAPPREEEAPGAAADAGEREMRDLEDLLSKLNPMAEEFVPPSLASPISGAGAGHGALTPAPLSPAAYGFYPVNAGFAVASPGHRGVVSFPAVADAHAGRGMKKDGAGGFGGHGHGHPGRRRTNSRTSMAQRDEAIRRTVYVSDIDHQVTEENLAALFINCGQVVDCRMCGDPNSVLRFAFIEFTDEEGARAALNLSGTVLGYYPVKVLPSKTAIAPVNETFLPRSDDEREMCARTIYCTNIDKKVTQADLKLFFESICGEVFRLRLLGDYHHSTRIAFVEFVMAESATAALNCSGVVLGSLPIRVSPSKTPVRPRVPRHLMSY

SEQ ID NO: 409 - protein, 328 aa, Zea mays
MAVVEAAAADHAAPPLQEEAPGAGAGAGADAGEREMRDLEDLLSKLNPMAEEFVPPSLASPAALTPAPLSPAAYGFYPAGAGFAVASPGHGGVVGFPAVADAHAARGRKKGGAGGGFSGHGHPARRRTNSRTSMAQRDEIIRRTVYVSDIDHQVTEENLAALFINCGQVVDCRMCGDPNSVLRFAFIEFTDEEGARAALNLSGTVLGYYPVRVLPSKTAIAPVNPTFLPRSDDEREMCARTIYCTNIDKKVTQADLKLFFESICGEVFRLRLLGDYHHSTRIAFVEFVMAESATAALNCSGVILGSLPIRVSPSKTPVRPRAPRQLMH

SEQ ID NO: 410 - protein, 328 aa, Zea mays
MAVVEAAAADHAAPPLQEEAPGAGAGAGADAGEREMRDLEDLLSKLNPMAEEFVPPSLASPAALTPAPLSPAAYGFYPAGAGFAVASPGHGGVVGFPAVADAHAARGRKKGGAGGGFSGHGHPGRRRTNSRTSMAQRDEIIRRTVYVSDIDHQVTEENLAALFINCGQVVDCRMCGDPNSVLRFAFIEFTDEEGARAALNLSGTVLGYYPVRVLPSKTAIAPVNPTFLPRSDDEREMCARTIYCTNIDKKVTQADLKLFFESICGEVFRLRLLGDYHHSTRIAFVEFVMAESATAALNCSGVILGSLPIRVSPSKTPVRPRAPRQLMH

SEQ ID NO: 411 - protein, 348 aa, Sorghum bicolor
MAVVEAAAAVDHAAPPRHEEEEEEAPGTGAAAADAAGEREMRDLEDLLSKLNPMAEEFVPPSLTSPVAVAVGAGPGPGPLTPAPLSPAAYGFYPAANAGFAVASPAAHRGVVGFPAAVADAAHAGRGRKKGGAGGGFGGHGHPGRRRTNSRTSMAQRDEVIRRTVYVSDIDHQVTEENLAALFINCGQVVDCRMCGDPNSVLRFAFIEFTDEEGARAALNLSGTVLGYYPVRVLPSKTAIAPVNPTFLPRSDDEREMCARTIYCTNIDKKVTQADLKLFFESICGEVFRLRLLGDYHHSTRIAFVEFVMAESATAALNCSGVILGSLPIRVSPSKTPVRPRAPRQLMH

SEQ ID NO: 412 - protein, 302 aa, Oryza sativa Japonica Group
MAVVETSADHAAPPPPEGDAGEREMRDLEDLLSKLNPMAEEFVPPSLAAASPTAYAYYPTPTPSHVFPAVDGLAGPRPRKKGGGGGGGGGFGGQGHAGKRRMNSRTSMAQRDEVIRRTVYVSDIDHQVTEEQLAALFINCGQVVDCRMCGDPNSVLRFAFIEFTDEESARAALNLSGTVLGYYPVRVLPSKTAIAPVNPTFLPRSDDEREMCARTIYCTNIDKKVSQADVKLFFESICGEVYRLRLLGDYHHSTRIAFVEFVMAESATAALNCSGVILGSLPIRVSPSKTPVRPRAPRQLMH

SEQ ID NO: 413 - protein, 277 aa, Oryza sativa Indica Group
MAVVETSADHAAPPPPEGDAGEREMRDLEDLLSKLNPMAEEFVPPSLAAASPTAYAYYPTPTPSHVFPAGHAGKRRMNRRTSMAQRDEVIRRTVYVSDIDHQVTEEQLAALFINCGQVVDCRMCGDPNSVLRFAFIEFTDEESARAALNLSGTVLGYYPVRVLPSKTAIAPVNPTFLPRSDDEREMCARTIYCTNIDKKVSQADVKLFFESICGEVYRLRLLGDYHHSTRIAFVEFVMAESATAALNCSGVILGSLPIRVSPSKTPVRPRAPRQLMH

SEQ ID NO: 414 - protein, 324 aa, Hordeum vulgare subsp. vulgare
MAVVETSADHVAPAAAADHAAAPYRASEEGGDAGEREMRDLEELLSKLNPMAEEFVPPSLAAHPMPPPPYAGYYPNGPPAAGFAPVASPGHRGVVGFPAADGRGRKKFGGGYGGGYPHGGKRRVNSRTSQAQRDEVIRRTVYVSDIDHQVTEEQLAALFINVGQVVDCRMCGDPNSVLRFAFIEFTDEEGARAALTLSGTVLGYYPVRVLPSKTAIAPVNPTFLPRSDDEREMCARTIYCTNIDKKVSQADVKLFFESICGEVYRLRLLGDYQHNTRIAFVEFVMAESATAALNCSGVILGSLPIRVSPFKTPVRPRAPRPMMN

SEQ ID NO: 415 - protein, 379 aa, Ricinus communis
MAIVENASVDLGISIGSASSSSSSLDSSVSSASSNDQDHSNHNNSHDHGRSLIENSISIQPLYMKAQVQSPPPNLQVAQLHHHHQRSSGGGDLQRDIRELQELFSKLNPMAEEFVPPSLANNKISNNYIHGLNGLNVGFYTNNNNYDPAFMLTNASRNGQLNGSAARRKKNYNQGKRRLNSRTSMAQREEIIRRTVYVSDIDQQVTEEQLAALFVGCGQVVDCRICGDPNSVLRFAFIEFTHEEGARAALNLAGTVLGYYPVRVLPSKTAIAPVNPTFLPRSDDEREMCIRTIYCTNIDKKVTQADVKLFFESVCGEVYRLRLLGDYHHSTRIAFVEFVMAESAIAALNCSGVVLGSLPIRVSPSKTPVRPRAPRIPMH

SEQ ID NO: 416 - protein, 361 aa, Vitis vinifera
MAVVENAGNKVGSSSANSESADTNDFGQSQPSNHTVMQNLQQKNTNSKPILLPNDENYYSQKIPQFQQKAGSNGVAKIQMVGSFGRDREDGGDIRDLEDLLSKLNPMAEEFVPPSLANGHGWSAGAAFGYTNNFVLQANFGNANGNAGRRKRNNYNQKRRINSRTSMAQREEVIKRTVYVSDIDQQVTEEDLAALFINCGQVVDCRICGDPNSVLRFAFVEFTDEEGARAALSLAGTMLGYYPVRVLPSKTAIAPVNPTFLPRSEDEREMCARTIYCTNIDKKVTQAEVKLFFESICGEVHRLRLLGDYHHSTRIAFVEFVMAESAIAALNCSGAILGSLPIRVSPSKTPVRPRAPRPALH

SEQ ID NO: 417 - protein, 139 aa, Zea mays
MDRTANAVLDIEGLPQPPDKCCSGSPKMTRALSRKGSNRMERKGGDELLEQEDLARKLIIKVVPSQLEQQRALVAPHCTPCAPVLLIDSAEGRSSRRFGRLITPVNNPRRILLLFATLSSVGTTILIYFTLAINSRAEA

SEQ ID NO: 418 - protein, 138 aa, Sorghum bicolor
MDKTANVVLDIEGLPQPPDKCCSGSPKMIRALSRKGSNRMERRGSDELEQEDLAKKLIIKVVPSQLEQPLGQIKALVAPHCTPCTPVLIDSGEGRSKRFSRFTSINPRKILLLFATLSSVGTTILIYFTLAINSKAEA

SEQ ID NO: 419 - protein, 140 aa, Zea mays
MDRTANNAVLDIESLPQPPDKCCSGSPKMIRALSRKGSNRMERRGGGGGEQEQEDLAKKLVIKVVPSQLEQQPLGQNKALVAPHCTPVLVDSGEGRSKRFISRFTSINPRKILLLFATLSSVGTTILIYFTLAINSKAEA

SEQ ID NO: 420 - protein, 147 aa, Oryza sativa Japonica Group
MTSMDKAANVVLDIEGLPQQPDKCCTGSPKMTRALSRKGSNRMERRSGEEQEQDDLVKKLIIKVVPSQLEQLKMPLVQNKALVTPQSQCAACAPILTDSGEGRNKKFNRLTSVHPRKILLFFATLSSVGTMILIYFTLAINGGKAEA

SEQ ID NO: 421 - protein, 455 aa, Oryza sativa Japonica Group
MAAAGASALRPHLALLPAGGGGGGGGGTRSYALQALSFVSPLLPHCGRRRRCVLRSKASSSPSPPPSPGKEAVAVPTAESCVNLGLELFSKGRVKDALEQFENALELNPNPVEAQAALYNKACCHAFREESNKAADCLRTALRDYNLKFGTILNDPDLAPFRASPEFKELQEEALRGGEDIGSGFRRDLKLISEVQAPFRGVRRFFYVALTAAAGISTFFTIPRLILAVQGGDGAPDLLETVGNAAINIGGIVVLVALYFWENKKEEQQITQISRNETLSRLPVRLSTNRIIELVQLRDITRPVILAGSKASITRAMQRAERYRTELLKRGVLLIPVIFGASQKAQSKPRGFGSSRSAASAPSVGDDFEKRTESIAAKSRLKAEERFKADIVSPEQWESWIRDQQESEGVTPGEDVYIILRLDGRVRRSGRGMPNWNDILQELPRLEELLSKLER

SEQ ID NO: 422 - protein, 450 aa, Zea mays
MAAVAAAPRPQLPMLSGGGGAALSSLTLQTLAFISPLPISRCHRCVLRSNASSSPSPPPSQEEAAAAEVVPTAESCVNLGLQLFSKGRVKDALEQFENALELNPTSIEAQAALYNKACCHAYREESKKAAECLREALRDYNLKFGTILNDPDLAPFRASPEFKELQEEALRGGEDIGSGFRRDLKLISEVQAPFRGVRRFFYVALTAAAGISTFFTIPRLVLAVRGGDGAPDLLETAGNAAINIGGIVVLVALYFWENKKEEKQITQISRNETLSRLPVRLSTNRIIELVQLRDITRPVILAGSKASVTRALQRAERYRTELLKRGVLLIPVIFGASQKDQTKPRGFGARRAAASVPSVGGDFEKRTESIAAKSRLKTEVRFKADIVSPEQWESWIRDQQVSEGVTPGEDVYIILRLDGRVRRSGIGMPNWNDILQELPRLEDLMSKLER

SEQ ID NO: 423 - protein, 437 aa, Zea mays
MLSGGGGAALSSLTLQTLAFISPLPISRCHRCVLRSNASSSPSPPPSQEEAAAAEVVPTAESCVNLGLQLFSKGRVKDALEQFENALELNPTSIEAQAALYNKACCHAYREESKKAAECLREALRDYNLKFGTILNDPDLAPFRASPEFKELQEEALRGGEDIGSGFRRDLKLISEVQAPFRGVRRFFYVALTAAAGISTFFTIPRLVLAVRGGDGAPDLLETAGNAAINIGGIVVLVALYFWENKKEEKQITQISRNETLSRLPVRLSTNRIIELVQLRDITRPVILAGSKASVTRALQRAERYRTELLKRGVLLIPVIFGASQKDQTKPRGFGARRAAASVPSVGGDFEKRTESIAAKSRLKTEVRFKADIVSPEQWESWIRDQQVSEGVTPGEDVYIILRLDGRVRRSGIGMPNWNDILQELPRLEDLMSKLER

SEQ ID NO: 424 - protein, 448 aa, Hordeum vulgare subsp. vulgare
MAAAALRTHLSLLSAGGGIPNPALQTLSFVAPLLLRRRCRRRSSVVLSNASSSPPSPPPSPEKAVEAAPTAESCVNLGLEFFSKGRVKDALEQFDKALELNPNPTEAQAAFYNKACCHAYREESKKAADCLRIALRDYNLKFGTVLNDPDMAPFRASPEFKELQEEALRGGEDIGSGFRRDLKLISEVQAPFRGVRRFFYVAFIAAAGISTFFTIPRLILALQGGDGAPDFLETAGNAAINIGGIVVLVALFVWENKKEEEQITNISRNETLSRLPVRLSTNRITELVQLRDITRPVILAGSKASVTQAMQRAERYRTELLKRGVLLIPVIFGASQKVQGKPKGFGTTRSAASAPSIGGDFEKRTESIAAKSRLRAEVRFKADIVSPEQWESWIRDQQESEGVTPGEDVYIILRLDGRVRRSGRGMPNWNDILKELPRLEDLLSKLER

SEQ ID NO: 425 - protein, 349 aa, Sorghum bicolor
MKLSAAVLCALVAVQAAALLLATVPSAQAKELEVGYYGKKCKGVENVVKWHVIKAIKANRRTGAALVRLLFHDCFVRGCDGSVLLDASSDNPHPEKEAPVNIGLAAFDVLEEIKAAVEKRCPGVVSCSDILIYAARDAASALSNGHVHFAVPAGRLDGFVSKADEAQAELPDSTHDVQQLIDNFARKNFTVEELVILTGAHSIGQGHCSSFRGRLSEPSSQITPAYRDLLNYKCSQGSNPPVDNNVRDEDYDVVAKFVAGFTSRVRKIPDFLDNSFYHNNLAKIVTFHSDWTLLTHKEALGHVVEYAENGTLWDEDFSESLLKLSKLPMPAGSKGEIRKKCSVVNHRLY

SEQ ID NO: 426 - protein, 348 aa, Sorghum bicolor
MKLSAAVLFALVAVQAAVLLATVPSAQASELEVGYYSKKCKGVENVVKWHVIRAIKANRRTGAALVRLLFHDCFVRGCDGSVLLDASSDNPHPEKEARVNIGLAAFDVLEEIKAAVEKRCPGVVSCSDILIYAARDAASALSNGHVHFAVPAGRLDGFVSKADEAQAELPDSTHDVQQLIDNFARKNFTVEELVILTGAHSIGQGHCSSFRGRLSEPSSQITPAYRDLLNYKCSQGSNPPVDNNVRDEDYDVVAKFVAGFTSRVRKIPDFLDNSFYHNNLAKIVTFHSDWTLLTHKEALGHVVEYAENGTLWDEDFSESLLKLSKLPMPAGSKGEIRKKCSVVNHRLY

SEQ ID NO: 427 - protein, 348 aa, Zea mays
MKLSVAVLCALLAVQAAVLLATVPTSQASELEVGYYSKKCKGVENVVKWHVIKALKASRRTGAALVRLLFHDCFVRGCDGSVLLDASYDNPHPEKEAPVNIGLAAFDLLEEIKAAVEKRCPGVVSCSDILIYAARDAASVLSNGHVHFAVPAGRLDGFVSKAEEAQAELPDSNQDVQQLIDNFARKNFTVEELVILTGAHSIGQGHCSSFTGRLSEPSQQITPAYRDLLNYKCSQGSNPPVDNNVRDEDYDVVARFMPGFTSRVRKIPDFLDNSFYHNNLAKIVTFHSDWTLLTHKEAFGHVVEYAENATLWDEDFSDSLLKLSKLPMPKGSKGEIRKKCSVVNHRLY

SEQ ID NO: 428 - protein, 348 aa, Zea mays
MKLSAAVLCALVAVQAAVLLATVPTAQASELEVGYYSKKCKGVENVVKWHVIKAIKANRRTGAALVRLIFHDCFVRGCDGSVLLDASYDNPHPEKEAPVNIGLAAFDVLEEIKAAVEKRCPGVVSCSDILIYAARDAASILSNGHVHFAVPAGRLDGFVSKAEEAQAELPDSTHDVQQLIDNFARKNFTVEELVILTGAHSIGQGHCSSFTGRLSEPPSQINPAYRDLLNYKCPQGSNPPVANNVRDEDYGVVARYMPGFTSRVRKIPDFLDNSFYHNNLAKIVTFHSDWTLLTNKEAFGHVVEYAENATLWDEDFSDSLLKLSKLPMPAGSTGEIRNKCSVVNHRLY

SEQ ID NO: 429 - protein, 348 aa, Zea mays
MKLSAAVLCALVAVQAAVLLATVPTAQASELEVGYYSKKCKGVENVVKWHVIKAIKANRRTGAALVRLIFHDCFVRGCDGSVLLDASYDNPHPEKEAPVNIGLAAFDVLEEIKAAVEKRCPGVVSCSDILIYAARDAASILSNGHVHFAVPAGRLDGFVSKAEEAQAELPDSTHDVQQLIDNFARKNFTVEELVILTGAHSIGQGHCSSFTGRLSEPPSQINPAYRDLLNYKCPQGSNPPVANNVRDEDYGVVARYMPGFTSRVRKIPDFLDNSFYHNNLAKIVTFHSDWTLLTNKEAFGHVVEYAENATLWDEDFSDSLLKLSKLPMPAGSTGEIRNKCSVVNPRLY

SEQ ID NO: 430 - protein, 347 aa, Oryza sativa Indica Group
MRLSVAILCALVAVQAAALLLAGTAAAASELKVGYYHKKCKGVENVIKWHVIKALKQNRRTGAALVRLLFHDCFVRGCDGSVLLDKSYENPHPEKEAPVNIGLAAFDLLEEIKAAVEKRCPGVVSCSDILIYAARDAGSILSNGHVHFDVPAGRLDGVVSRADEAQAELPDSTMTVQQLKDNFAAKGFDTEQLVILSGAHSIGQGHCSSFTGRLSEPPQQITPAYRDLLNYKCSQAANPDVVNNVRDEDASVVARFMPGFVSRVRKISDFLDNTYYHNNLAKIVTFHSDWQLLTDATSLSKVHEYADNATLWDSDFSDSLLKLSQLPMPEGSKGEIRKKCSAINHLY

SEQ ID NO: 431 - protein, 347 aa, Oryza sativa Japonica Group
MRLSVAILCALVAVQAAALLLAGSAAAASELKVGYYHKKCKGVENVIKWHVIKALKQNRRTGAALVRLLFHDCFVRGCDGSVLLDKSYENPHPEKEAPVNIGLAAFDLLEEIKAAVEKRCPGVVSCSDILIYAARDAGSILSNGHVHFDVPAGRLDGVVSRADEAQAELPDSTMTVQQLKDNFAAKGFDTEQLVILSGAHSIGQGHCSSFTGRLSEPPQQITPAYRDLLNYKCSQAANPDVVNNVRDEDASVVARFMPGFVSRVRKISDFLDNTYYHNNLAKIVTFHSDWQLLTDATSLSKVHEYADNATLWDSDFSDSLLKLSQLPMPEGSKGEIRKKCSAINHLY

SEQ ID NO: 432 - protein, 324 aa, Oryza sativa Japonica Group
MRLSVAILCALVAVQAAALLLAGSAAAASELKVGYYHKKCKGVENVIKWHVIKALKQNRRTGAALVRLLFHDCFVRGCDGSVLLDKSYENPHPEKEAPVNIGLAAFDLLEEIKAAVEKRCPGVVSCSDILIYAARDAGSILSNGHVHFDVPAGRLDGVVSRADEAQAELPDSTMTVQQLKDNFAAKGFDTEQLVILSGAHSIGQGHCSSFTGRLSEPPQQITPAYRDLLNYKFMPGFVSRVRKISDFLDNTYYHNNLAKIVTFHSDWQLLTDATSLSKVHEYADNATLWDSDFSDSLLKLSQLPMPEGSKGEIRKKCSAINHLY

SEQ ID NO: 433 - protein, 348 aa, Zea mays; identical to SEQ ID NO: 428

SEQ ID NO: 434 - protein, 348 aa, Zea mays; identical to SEQ ID NO: 429

SEQ ID NO: 435 - protein, 348 aa, Zea mays; identical to SEQ ID NO: 427

SEQ ID NO: 436 - protein, 348 aa, Sorghum bicolor; identical to SEQ ID NO: 426

SEQ ID NO: 437 - protein, 349 aa, Sorghum bicolor; identical to SEQ ID NO: 425

SEQ ID NO: 438 - protein, 347 aa, Oryza sativa Indica Group; identical to SEQ ID NO: 430

SEQ ID NO: 439 - protein, 347 aa, Oryza sativa Japonica Group; identical to SEQ ID NO: 431

SEQ ID NO: 440 - protein, 324 aa, Oryza sativa Japonica Group; identical to SEQ ID NO: 432

SEQ ID NO: 441 - protein, 485 aa, Zea mays
MVHRLSDEARLEVGPRVGWWPQRGSGEYYRALVRSDIQRQKRRLAVLSLSKGGSTFSPGNDLGWLYYAWVDVGTPATSFLVALDTGSDLFWVPCDCIQCAPLSGYRGNLDRDLRIYRPAESTTSRHLPCSHELCQSVPGCTNPKQPCPYNIDYFSENTTSSGLLIEDTLHLNYREDHVPVNASVIIGCGQKQSGDYLDGIAPDGLLGLGMADISVPSFLARAGLVQNSFSMCFKEDSSGRIFFGDQGVPSQQSTPFVPLYGKLQTYAVNVDKSCIGHKCLEGTSFKALVDSGTSFTSLPLDVYKAFTMEFDKQMNATRVPYEDTTWKYCYSASPLEMPDVPTITLTFAADKSLQAVNPILPFNDKQGALAGFCLAVLPSTEPIGIIAQNFLVGYHVVFDRESMKLGWYRSECHDVEDSTTVPLGPSQRDSPEDPLPSNEQQTSPAVTPATAGTAPLSCATTNLQMLLASSYPLLLLTMSSVFFVS

SEQ ID NO: 442 - protein, 515 aa, Zea mays
MRFPFLFALQLVALAAAASAAEVAVTRSSRMVHRLSDEARLEVGPRVGWWPQRGSGEYYRALVRSDIQRQKRRLAVLSLSKGGSTFSPGNDLGWLYYAWVDVGTPATSFLVALDTGSDLFWVPCDCIQCAPLSGYRGNLDRDLRIYRPAESTTSRHLPCSHELCQSVPGCTNPKQPCPYNIDYFSENTTSSGLLIEDTLHLNYREDHVPVNASVIIGCGQKQSGDYLDGIAPDGLLGLGMADISVPSFLARAGLVQNSFSMCFKEDSSGRIFFGDQGVPSQQSTPFVPLYGKLQTYAVNVDKSCIGHKCLEGTSFKALVDSGTSFTSLPFDVYKAFTMEFDKQMNATRVPYEDTTWKYCYSASPLEMPDVPTITLTFAADKSLQAVNPILPFNDKQGALAGFCLAVLPSTEPIGIIAQNFLVGYHVVFDRESMKLGWYRSECRYVEDSTTVPLGPSQHDSPEDPLPSNEQQTSPAVTPATAGTAPLSCATTNLQMLLASSYPLLLLTMSSVFFVS

SEQ ID NO: 443 - protein, 515 aa, Zea mays
MRFPFLFALQLVALAAAASAAEVAVTRSSRMVHRLSDEARLEVGPRVGWWPQRGSGEYYRALVRSDIQRQKRRLAVLSLSKGGSTFSPGNDLGWLYYAWVDVGTPATSFLVALDTGSDLFWVPCDCIQCAPLSGYRGNLDRDLRIYRPAESTTSRHLPCSHELCQSVPGCTNPKQPCPYNIDYFSENTTSSGLLIEDTLHLNYREDHVPVNASVIIGCGQKQSGDYLDGIAPDGLLALGMADISVPSFLARAGLVQNSFSMCFKEDSSGRIFFGDQGVPSQQSTPFVPLYGKLQTYAVNVDKSCIGHKCLEGTSFKALVDSGTSFTSLPFDVYKAFTMEFDKQMNATRVPYEDTTWKYCYSASPLEMPDVPTITLTFAADKSLQAVNPILPFNDKQGALAGFCLAVLPSTEPIGIIAQNFLVGYHVVFDRESMKLGWYRSECRYVEDSTTVPLGPSQHDSPEDPLPSNEQQTSPAVTPATAGTAPLSCATTNLQMLLASSYPLLLLTMSSVFFVS

SEQ ID NO: 444 - protein, 519 aa, Zea mays
MRLPVLFALQLVALAAAASAAEAAATFSSRMVHRLSDEARLEAGPRMGLWPQRGSGGYYRALLRSDLQRQKRRLAGKNQLLSLSKGGSTFSPGNDLGWLYYAWVDVGTPTTSFLVALDTGSDLFWVPCDCIQCAPLSSYRGNLDRDLGIYKPAESTTSRHLPCSHELCQPGSGCTNPKQPCTYNIDYFSENTTSSGLLIEDSLHLNSREGHAPVNASVIIGCGRKQSGDYLDGIAPDGLLGLGMADISVPSFLARAGLVRNSFSMCFKEDSSGRIFFGDQGVSSQQSTPFVPLYGKLQTYAVNVDKSCIGHKCLEGSSFQALVDSGTSFTSLPPDVYKAFTTEFDKQINASRVPYEDSTWKYCYSASPLEMPDVPTIILAFAANKSFQAVNPILPFNDEQGALARFCLAVLPSTEPIGIIGQNFLVGYHVVFDRESMKLGWYRSECRDVDNSTTVPLGPSQHGSSEDPLPSNEQQTSPPVTPATTGTAPPSSATTNRQMLFASSYPLLFLTMSTVFFIS

SEQ ID NO: 445 - protein, 520 aa, Oryza sativa Japonica Group
MRLPVLLPLLLLLLAAAAAVAAAEAATLSARMVHRLSDEARLAAGARGGRRWPRRGSGDYFRALVRSDLQRQKRRVGGKYQLLSLSQGGSIFPSGNDLGWLYYTWVDVGTPNTSFLVALDTGSDLFWVPCDCIQCAPLSSYHGSLDRDLGIYKPSESTTSRHLPCSHELCSPASGCTNPKQPCPYNIDYFSENTTSSGLLIEDMLHLDSREGHAPVNASVIIGCGKKQSGSYLEGIAPDGLLGLGMADISVPSFLARAGLVRNSFSMCFKKDDSGRIFFGDQGVPTQQSTPFVPMNGKLQTYAVNVDKYCIGHKCTEGAGFQALVDTGTSFTSLPLDAYKSITMEFDKQINASRASSDDYSFEYCYSTGPLEMPDVPTITLTFAENKSFQAVNPILPFNDRQGEFAVFCLAVLPSPEPVGIIGQNFMVGYHVVFDRENMKLGWYRSECHDLDNSTTVSLGPSQHNSPEDPLPSNEQQTSPAVTPAVAGRAPSSGGSTTLQNLLANSNMLLLLTMSVFFIS

SEQ ID NO: 446 - protein, 520 aa, Oryza sativa Indica Group
MRLPVLLPLLLLLLAAAAAVAAAEAATLSARMVHRLSDEARLAAGARGGRRWPRRGSGDYFRALVRSDLQRQKRRVGGKYQLLSLSQGGSIFPSGNDLGWLYYTWVDVGTPNTSFLVALDTGSDLFWVPCDCIQCAPLSSYHGSLDRDLGIYKPSESTTSRHLPCSHELCSPASGCTNPKQPCPYNIDYFSENTTSSGLLIEDMLHLDSREGHAPVNASVIIGCGKKQSGSYLEGIAPDGLLGLGMADISVPSFLARAGLVRNSFSMCFKKDDSGRIFFGDQGVPTQQSTPFVPMNGKLQTYAVNVDKYCIGHKCTEGAGFQALVDTGTSFTSLPLDAYKSITMEFDKQINASRASSDDYSFEYCYSTGPLEMPDVPTITLTFAENKSFQAVNPILPFNDRQGEFAVFCLAVLPSPEPVGIIGQNFMVGYHVVFDRENMKLGWYRSECHDLDNSTMVSLGPSQHNSPEDPLPSNEQQTSPAVTPAVAGRAPSSGGSTTLQNLLANSNMLLLLTMSVFFIS

SEQ ID NO: 447 - protein, 378 aa, Zea mays
MQDRDLRIYRPAESTTSRHLPCSHELCQSVPGCTNPKQPCPYNIDYFSENTTSSGLLIEDTLHLNYREDHVPVNASVIIGCGQKQSGDYLDGIAPDGLLGLGMADISVPSFLARAGLVQNSFSMCFKEDSSGRIFFGDQGVPSQQSTPFVPLYGKLQTYAVNVDKSCIGHKCLEGTSFKALVDSGTSFTSLPFDVYKAFTMEFDKQMNATRVPYEDTTWKYCYSASPLEMPDVPTITLTFAADKSLQAVNPILPFNDKQGALAGFCLAVLPSTEPIGIIAQNFLVGYHVVFDRESMKLGWYRSECRYVEDSTTVPLGPSQHDSPEDPLPSNEQQTSPAVTPATAGTAPLSCATTNLQMLLASSYPLLLLTMSSVFFVS

SEQ ID NO: 448 - protein, 564 aa, Hordeum vulgare subsp. vulgare
DRHAPHPPPPPPPPPPRSSPPTPQTLAPGSLLRPPPRIPGRSVVGSPDPPMRLPLLLLALLAAAAPAPAASATLSTRMVHRLSDEARLAAGPHGARWPRHGSGGYYRALVRSDLQRQKRKHQLLSVSEAGGIFSPGNDFGWLYYTWVDVGTPNTSFMVALDTGSDLFWVPCDCIECAPLAGYRETLDRDLGIYKPAESTTSRHLPCSHELCPPGSGCSSPKQPCPYSTDYLQENTTSSGLLIEDILHLDSRESHAPVKASVVIGCGRKQSGSYLDGIAPDGLLGLGMADISVPSFLARAGLVRNSFSMCFKEDSGRIFFGDQGVSIQQSTPFVPLYGKYQTYAVNVDKSCVGHKCFEATSFEALVDSGTSFTALPLNVYKAVAVEFDKQVHAPRITQEDASFEYCYSASPLKMPDVPTVTLTFAANKSFQAVNPTIVLKDGEGSVAGFCLALQKSPEPIGIIGQNFLTGYHIVFDKENMKLGWYRSECHDPDNSTTVPLGPSQHNSPGVPLPSSEQQTSPTVTPPAVAGKAPTSSSGPPSNLHRLLANCCSLLLLTISTVFFIS

SEQ ID NO: 449 - protein, 273 aa, Zea mays
MAAVAAAPRPQLPMLSGGGGAALSSLTLQTLAFISPLPISRCHRCVLRSNASSSPSPPPSQEEAAAAEVVPTAESCVNIGLQLFSKGRVKDALEQFENALELNPTSIEAQAALYNKACCHAYREESKKAAECLREALRDYNLKFGTILNDPDLAPFRASPEFKELQEEALRGGEDIGSGFRRDLKLISEVQAPFRGVRRFFYVALTAAAGISTFFTIPRLVLAVRGGDDAPDLLETAGNAAINIGVCRRYCCAGSFVFLGKQERREADHTNFS

SEQ ID NO: 450 - protein, 273 aa, Zea mays
MAAVAAAPRPQLPMLSGGGGAALSSLTLQTLAFISPLPISRCHRCVLRSNASSSPSPPPSQEEAAAAEVVPTAESCVNLGLQLFSKGRVKDALEQFENALELNPTSIEAQAALYNKACCHAYREESKKAAECLREALRDYNLKFGTILNDPDLAPFRASPEFKELQEEALRGGEDIGSGFRRDLKLISEVQAPFRGVRRFFYVALTAAAGISTFFTIPRLVLAVRGGDGAPDLLETAGNAAINIGVCRRYCCSGSFVFLGKQERREADHTNFS

SEQ ID NO: 451 - protein, 345 aa, Hordeum vulgare subsp. vulgare
EDDHLTIPPYSIVAMAAAALRTHLSLLSAGGGIPNPALQTLSFVAPLLLRRRCRRRSSVVLSNASSSPPSPPPSPEKAVEAAPTAESCVNLGLEFFSKGRVKDALEQFDKALELNPNPTEAQAAFYNKACCHAYREESKKAADCLRIALRDYNLKFGTVLNDPDMAPFRASPEFKELQEEALRGGEDIGSGFRRDLKLISEVQAPFRGVRRFFYVAFIAAAGISTFFTIPRLILALQGGDGAPDFLETAGNAAINIGGIVVLVALFVWENKKEEEQITNISRNETLSRLPVRLSTNRITELVQLRDITRPVSIILLASFILTTPSVHICKMSWQFKLNCRNVLHL

SEQ ID NO: 452 - protein, 348 aa, Sorghum bicolor; identical to SEQ ID NO: 411

SEQ ID NO: 453 - protein, 328 aa, Zea mays; identical to SEQ ID NO: 409

SEQ ID NO: 454 - protein, 342 aa, Zea mays; identical to SEQ ID NO: 408

SEQ ID NO: 455 - protein, 328 aa, Zea mays; identical to SEQ ID NO: 410

SEQ ID NO: 456 - protein, 302 aa, Oryza sativa Japonica Group; identical to SEQ ID NO: 412

SEQ ID NO: 457 - protein, 277 aa, Oryza sativa Indica Group; identical to SEQ ID NO: 413

SEQ ID NO: 458 - protein, 485 aa, Oryza sativa Japonica Group
MISSSKLKSVDFYRKIPRDLTEASLSGAGLSIVAALAMVFLFGMELSNYLAVNTSTSVIVDRSSDGEFLRIDFNLSFPALSCEFASVDVSDVLGTNRLNITKTVRKYSIDRNLVPTGSEFHPGPIPTVSKHGDDVEENHDDGSVPLSSRNFDSYSHQYPVLVVNFYAPWCYWSNRLKPSWEKTAKIMRERYDPEMDGRIILAKVDCTEEIDLCRRHHIQGYPSIRIFRKGSDLKENQGHHDHESYYGDRDTESLVAAMETYVANIPKDAHVLALEDKSNKTVDPAKRPAPLTSGCRIEGFVRVKKVPGSVVISARSGSHSFDPSQINVSHYVTQFSFGKRLSAKMFNELKRLTPYVGGHHDRLAGQSYIVKHGDVNANVTIEHYLQIVKTELVTLRSSKELKLVEEYEYTAHSSLVHSFYVPVVKFHFEPSPMQVLVTELPKSFSHFITNVCAIIGGVFTVAGILDSIFHNTLRLVKKVELGKNI

SEQ ID NO: 459 - protein, 485 aa, Hordeum vulgare subsp. vulgare
MISSSKLKSVDFYRKIPRDLTEASLSGAGLSIFAALAMVFLFGMELSSYLAVNTTTSVIVDRSSDGEFLRMDFNLSFPALSCEFASVDVSDVLGTNRLNITKTVRKFSIDRNLVPTGSEFHAGPIPTVNKHGDDVEEYHGDGSVALSSRNFDSYSHQYPVLVVNFYAPWCYWSNRLKPSWEKAAQIIRERYDPEMDGRILLGKVDCTEEVELCKRHHIQGYPSIRIFHKGSDMKENQGHHEHDSYYGERDTESLVAAMETYVANIPKEAHVLALEDKSNKTVDPAKRPAPMTGGCRIEGFVRVKKVPGSVVISARSGSHSFDPSQINVSHYVTTFSFGKRLSSKMFNELKRLFPYVGGHHDRLAGQSYVVKHGDVNANVTIEHYLQIVKTELVTLRYSKELKVLEEYEYTAHSSLVHSFYVPVVKFHFEPSPMQVLVTELPKSFSHFITNVCAIIGGVFTVAGILDSILHNTLRLVKKVELGKDI

SEQ ID NO: 460 - protein, 485 aa, Triticum aestivum
MISSSKLKSVDFYRKIPRDLTEASLSGAGLSIFAALAMVFLFGMELSSYLAVNTTTSVIVDRSSDGEFLRIDFNLSFPALSCEFASVDVSDVLGTNRLNITKTVRKFSIDRNLVPTGSEFHAGPIPTVNKHGDDVEEYHGDGSVALSSRNFDSYSHLYPVLVVNFYAPWCYWSNRLKPSWEKAAQIIRERYDPEMDGRILLGKVDCTEEVELCKRHHIQGYPSIRIFHKGSDMKENQGHHDHDSYYGERDTESLVAAMETYVANIPKEAHVLALEDKSNRTVDPAKRPAPMTGGCRIEGFVRVKKVPGSVVISARSGSHSFDPSQINVSHYVTTFSFGKRLSSKMFNELKRLFPYVGGHHDRLAGQSYIVKHGDVNANVTIEHYLQIVKTELVTLRYAKELKVLEEYEYTAHSSLVHSFYVPVVKFHFEPSPMQVLVTELPKSFSHFITNVCAIIGGVFTVAGILDSILHNTLRLVKKVELGKDI

SEQ ID NO: 461 - protein, 485 aa, Zea mays
MISSSKLKSVDFYRKIPRDLTEASLSGAGLSIVAALAMVFLFGMELSSYLAVNTTTSVIVDRSSDGEFLRIDFNMSFPALSCEFASVDVSDVLGTNRLNITKTVRKYSIDRNLVPTGSEFHPGPIPILNKHGDDVEEDHVDGAFSLSSRNFDSFSHQYPVLVVNFYAPWCYWSNRLKPSWEKTAKIMRERYDPEMDGRILLGKVDCTEEVELCRRNHIQGYPSIRVFRKGSDIKENQGHHDHESYYGERDTESLVAAMETYVANIPKEAHALALEDKSNKTVDPAKRPAPMASGCRIEGFVRVKRVPGSVVISARSGSHSFDPSQINVSHYVTQFSFGKRLSPRMLHEFIRLTPYLRGYHDRLAGQSYTVKHGEVNANVTIEHYLQVVKTELVTQRSSKELKVLEEYEYTAHSSLVHSFYVPVVKFHFEPSPMQVLVTEVPKSFSHFITNVCAIIGGVFTVAGILDSIFHNTLRMVKKIELGKNI

SEQ ID NO: 462 - protein, 483 aa, Zea mays
MISSSKLKSVDFYRKIPRDLTEASLSGAGLSIVAALAMVFLFGMELSSYLAVNTTTSVIVDRSSDGEFLRIDFNMSFPALSCEFASVDVSDVLGTNRLNITKTVRKYSIDRNLVPTGSEFHPGPIPILNKHGDDVEEDHVDGAFSLSSRNFDSFSHQYPVLVVNFYAPWCYWSNRLKPSWEKTAKIMRERYDPEMDGRILLGKVDCTEEVELCRRNHIQGYPSIRVFRKGSDIKENQGHHDHESYYGERDTESLVAAMETYVANIPKEAHALEDKSNKTVDPAKRPAPMASGCRIEGFVRVKRVPGSVVISARSGSHSFDPSQINVSHYVTQFSFGKRLSPRMLHEFIRLTPYLRGYHDRLAGQSYTVKHGEVNANVTIEHYLQVVKTELVTQRSSKELKVLEEYEYTAHSSLVHSFYVPVVKFHFEPSPMQVLVTEVPKSFSHFITNVCAIIGGVFTVAGILDSIFHNTLRMVKKIELGKNI

SEQ ID NO: 463 - protein, 483 aa, Zea mays
MISSSKLKSVDFYRKIPRDLTEVSLSGAGLSIVAALAMVFLFGMELSSYLAVNTTTSVIVDRSSDGEFLRIDFNMSFPALSCEFASVDVSDVLGTNRLNITKTVRKYSIDRNLVPTGSEFHPGPIPILNKHGDDVEEDHVDGAFSLSSRNFDSFSHQYPVLVVNFYAPWCYWSNRLKPSWEKTAKIMRERYDPEMDGRILLGKVDCTEEVELCRRNHIQGYPSIRVFRKGSDIKENQGHHDHESYYGERDTESLVAAMETYVANIPKEAHALEDKSNKTVDPAKRPAPMASGCRIEGFVRVKRVPGSVVISARSGSHSFDPSQINVSHYVTQFSFGKRLSPRMLHEFIRLTPYLRGYHDRLAGQSYTVKHGEVNANVTIEHYLQVVKTELVTQRSSKELKVLEEYEYTAHSSLVHSFYVPVVKFHFEPSPMQVLVTEVPKSFSHFITNVCAIIGGVFTVAGILDSIFHNTLRMVKKIELGKNI

SEQ ID NO: 464 - protein, 478 aa, Ricinus communis
MISSSKLKSVDFYRKIPRDLTEASLSGAGLSIIAALSMVFLFGMELSNYLTVNTSTSVIVDKSSDGDFLRIDFNLSFPALSCEFASVDVSDVLGTNRLNITKTIRKFSIDHDLNPTGSEFQSGPVLHHIKHGDEIEGEVGEGSVSLNSRNFDQYAQQYPILVVNFYAPWCYWSNRLKPSWESAAKIMRERYDPEMDGRILLVNVDCTADAELCRRNHIQGYPSIRIFRKGSDIKDDHGHHDHESYYGDRDTESLVKTMESLVAPIQLESLKSENATQSTKRPAPLTGGCRIEGYVRVKKVPGNLIISARSGAHSFDPSQMNMSHVISHLSFGLKVSPKVMNEAKRLVPYIGGSHDKLNGRSFVNHRDVDANVTIEHYLQIVKTEVVTRRSSREHKLLEEYEYTAHSSLVQSVYIPAAKFHFELSPMQVLITENPKSFSHFITNVCAIIGGVFTVAGILDSILHHTVRLMKKVELGKNF

SEQ ID NO: 465 - protein, 482 aa, Vitis vinifera
MVSTSKIKSVDFYRKIPRDLTEASLSGAGLSVIAALSMMFLFGMELSNYLSVSTSTSVIVDQSSDGDFLRIEFNISFPALSCEFASVDVSDVLGTNRLNITKTIRKYSIDPDLRPTGAEFHSGPVGKVIKHGDETDEEYSEGSASLTAQNFYKYSHQHAILVVNFFAPWCYWSTRLKPSWEKAAKIIRERYDPELDGRIVMAKVDCTEEGELCRRHHIQGYPSIRIFRKGSDVRDDHGHHDHESYYGDRDTDTLVTTMETLVAPIPLESQRLALENKSDSTADHIKRPAPRTGGCRIEGFVRVKKVPGNLVISARSGSHSFDPSQMNMSHVISHLSFGRKIAPRVMSDMKRVLPYIGGSHDRLNGRSYISHPSDSNANVTIEHYLQVVKTEVITTRDHKLVEEYEYTAHSSLVQSLYIPVAKFHFELSPMQVLVTENRKSFWHFITNVCAIIGGVFTVAGILDSVLHNTMRLMKKIELGKNF

SEQ ID NO: 466 - protein, 484 aa, Populus trichocarpa
MVSTNKLKSVDFYRKIPRDLTEASLSGAGLSIVAALAMVFLFGMELNNYLTVNTSTSVIVDNSSDGEFLRIDFNLSFPSLSCEFASVDVSDVLGTNRLNITKTIRKFSIDHDLKPTGSEFHSGPVLHHINHGDEVHEEGSEGSVSLKAHNFDQYTHQYPILVVNFYAPWCYWSNRLKPSWEKAAKIIRERYDPEIDGRILLAKVDCTEEGDLCRRNHIQGYPSIRIFRKGSDLRDDHGHHDHESYYGDRDTDSLVKTMEGLVAPIAMESQRHALEHKPENATEHVKRPAPSAGGCRIEGYVRVKKVPGNLVISARSGAHSFDSAQMNLSHVISHFSFGMKVLPRVMSDVKRLIPHIGRSHDKLNGRSFINHRDVGANVTIEHYLQVVKTEVVTRRSSAEHKLIEEYEYTAHSSLAQTVYMPTAKFHFELSPMQVLITENPKSFSHFITNVCAIIGGVFTVAGILDSILHNTFRMMKKVELGKNF

SEQ ID NO: 467 - protein, 484 aa, Populus trichocarpa
MVSTNKLKSVDFYRKIPRDLTEASLSGAGLSIVAALAMMFLFGMELNNYLTVNTSTTVIVDNSSDGEFLRIDFNISFPSLSCEFASVDVSDVLGTNRLNITKTIRKFSIDHDLKPTGSEFHSGPVLHQIKHGDEVDEEGGEGSVSLKAHNFDQYSHQYPILVVNFFAPWCYWSNRLKPSWEKAAKIIRERYDPEMDGRILLAKVDCTEEGDLCRRNHIQGYPSIRIFRKGSNLREDHGRHDHESYYGDRDTESLVKTMEALVAPIAMESQRQALEHKPENATQHVKRPAPSAGGCRIEGYVRVKKVPGNLMISALSGAHSFDSKQMNLSHVISHFSFGMKVLPRVMSDVKRLLPYIGRSHDKLNGRSFINHRDVGANVTIEHYLQVVKTEVVTRRSSSERKLIEEYEYTAHSSLSQTVYMPTAKFHFELSPMQVLITENSKSFSHFITNVCAIIGGVFTVAGILDSILHHTVRMMKKVELGKNF

SEQ ID NO: 468 - protein, 450 aa, Zea mays; identical to SEQ ID NO: 422

SEQ ID NO: 469 - protein, 437 aa, Zea mays; identical to SEQ ID NO: 423

SEQ ID NO: 470 - protein, 455 aa, Oryza sativa Japonica Group; identical to SEQ ID NO: 421

SEQ ID NO: 471 - protein, 448 aa, Hordeum vulgare subsp. vulgare; identical to SEQ ID NO: 424

SEQ ID NO: 472 - protein, 305 aa, Zea mays
MGWLWHRRLAHVGMKNLHKLLKGEHILGLTNVHFEKDRICSACQAGKQVGAHHPHKNIMTTDRPLELLHMDLFGPIAYISIGGSKYCLVIVDDYSRFTWVFFLQEKSQTQETLKGFLRRAQNEFGLRIKKIRSDNGTEFKNSQIEGFLEEEGIKHEFSSPYTPQQNGVVERKNRTLLDMARTMLDEYKTPDRFWAAAVNTACYAINRLYLHRILKKTSYELLTGCCTSCAVRIKSGQIRQPEALGISAELKDKGYALLCVGFPSGDVEVETQDEDEVYWLQFGRYFARGPVERDDYALELAMGDE

SEQ ID NO: 473 - protein, 1068 aa, Zea mays
MQVYASGGSSWIIDSGCTNHMTGEKKMFTSYVKNKDSQDSIIFGDGNQGKVKGLGKIAISNEHSISNVFLVESLGYNLLSVSQLCNMGYNCLFTNVDVSVFRRSDGSLAFKGVLDDKLYLVDFAKEEAGLDACLIAKTSMGWLWHRRLAHVGMKNLHKLLKGEHVIGLTNVQFEKDRPCAACQAGKQVGGAHHSKNVMTTSRPLELLHMDLFGPVAYLSIGGSKYGLVIVDDFSRFTWVFFLQDKSETQGTLKRFLRRAQNEFELKVKKIRSDNGSEFKNLQVEEFLEEEGIKHEFSAPYTPQQNGVVERKNRTLIDMARTMLGEFKTPERFWSEAVNTACHAINRVYLHRLLKKTSYELLTGNKPNVSYFRVFGSKCYILVKKGRNSKFAPKAVEGFLLGYDSNTKAYRVFNKSSGLVEVSSDVVFDETNGSPREQVVDLDDVDEEDVPTAAMRTMAIGDVRPQEQLEQDQPSSSTMVQPPTQDDEQVHQQEACDQGGAQDDHVMEEDAQPAPPTQVRAMIQRDHPVDQILGDISKGVTTRSRLVNFCEHYSFVSSIEPFRVEEALLDPDWVLAMQEELNNFKRNEVWTLVPRPKQNVVGTKWVFRNKQDEHGVVTRNKARLVAKGYAQVAGLDFEETFAPVARLESIHILLAYAAHHSFRLYQMDVKSAFLNGPIKEEVYVEQPPGFEDERYPDHVCKLSKALYGLKQAPRAWYECLRDILIVNAFKVGKADPTLFTKTCDGDLFVCQIYVDDIIFGSTNQKSCEEFSRVMTQKFEMSMMGELNYFLGFQVKQLKDGTFISQTKYTQDLLKRFGMKDAKPAKTPMGTDGHTDLNKGGKSVDQKAYRSMIGSLLYLCASRPDIMLSVCMCARFQSDPKECHLVAVKRILRYLVATPCFGLWYPKGSTFDLVGYSDSDYAGCKVDRKSTSGTCQFLGRSLVSWNSKKQTSVALSTAEAEYVAAGQCCAQLLWMRQTLRDFGYNLSKVPLLCDNESAIRMAENPVEHSRTKHIDIRHHFLRDHQQKGDIEVFHVSTENQLADIFTKPLDEKTFCRLRSELNVLDSRNLD

SEQ ID NO: 474 - protein, 1068 aa, Zea mays
MQVYASGGSSWIIDSGCTNHMTGEKKMFTSYVKNKDSQDSIIFGDGNQGKVKGLGKIAISNEHSISNVFLVESLGYNLLSVSQLCNMGYNCLFTNIDVSVFRRCDGSLAFKGVLDGKLYLVDFAKEEAGLDACLIAKTSMGWLWHRRLAHVGMKNLHKLLKGEHVIGLTNVQFEKDRPCAACQAGKQVGGSHHTKNVMTTSRPLEMLHMDLFGPVAYLSIGGSKYGLVIVDDFSRFTWVFFLQEKSETQGTLKRFLRRAQNEFELKVKKIRSDNGSEFKNLQVEEFLEEEGIKHEFSAPYTPQQNGVVERKNRTLIDMARTMLGEFKTPECFWTEAVNTACHAINRVYLHRILKNTSYELLTGNKPNVSYFRVFGSKCYILVKKGRNSKFAPKAVEGFLLGYDSNTKAYRVFNKSSGLVEVSGDVVFDETNGSPREQVVDCDDVDEEDIPTAAIRTMAIGEVRPQEQDEREQPSPSTMVHPPTQDDEQVHQQEVCDQGGAQDDHVLEEEAQPAPPTQVRAMIQRDHPVDQILGDISKGVTTRSRLVNFCEHNSFVSSIEPFRVEEALLDPDWVLAMQEELNNFKRNEVWTLVPRPKQNVVGTKWVFRNKQDERGVVTRNKARLVAKGYAQVAGLDFEETFAPVARLESIRILLAYAAHHSFRLYQMDVKSAFLNGPIKEEVYVEQPPGFEDERYPDHVCKLSKALYGLKQAPRAWYECLRDFLIANAFKVGKADPTLFTKTCDGDLFVCQIYVDDIIFGSTNQKSCEEFSRVMTQKFEMSMMGELNYFLGFQVKQLKDGTFISQTKYTQDLLKRFGMKDAKPAKTPMGTDGHTDLNKGGKSVDQKAYRSMIGSLLYLCASRPDIMLSVCMCARFQSDPKECHLVAVKRILRYLVATPCFGLWYPKGSTFDLVGYSDSDYAGCKVDRKSTSGTCQFLGRSLVSWNSKKQTSVALSTAEAEYVAAGQCCAQLLWMRQTLRDFGYNLSKVPLLCDNESAIRMAENPVEHSRTKHIDIRHHFLRDHQQKGDIEVFHVSTENQLADIFTKPLDEKTFCRLRSELNVLDSRNLD

SEQ ID NO: 475 - protein, 1048 aa, Zea mays
MTGEKKMFTSYVKNKDSQDSIIFGDGNQGKVKGLGKIAISNEHSISNVFLVESLGYNLLSVSQLCHMGYNCLFTNVDVSVFRRSDGSLAFKGVLDGKLYLVDFAKEEAGLDACLIAKTSMGWLWHRRLAHVGMKNLHKLLKGEHVIGLTNVHFEKDRPCAACQAGKQVGGAHHGKNVMTTSRPLELLHMDLFGPVAYLSIGGSKYGLVIVDDFSRFTWVFFLQEKSETQGTLKRFLRRAQNEFELKVKKIRSDNGSEFKNLQVEEFLEEEGIKHEFSAPYTPQQNGVVERKNRTLIDMARTILGKFKTPEYFWTEAVNTACHAINRVYLHRLLKKTSYELLTGNKPNVSYFRVFGSKCYILVKKGRNSKFAPKAVEGFLLGYDSNTKAYRVFNKSSGLVEVSSDVVFDETNGSPREQVVDLDDVDEEDVPTAAMRTMAIGDVRPQEHLEQDQPSSSTMVHPPTQDDEQVPQMEACDQGGAQDDRVMEEEAQPAPPTQVRAMIQRDHPVDQILGDISKGVTTRSRLVNFCEHYSFVSSIEPFRVEEALLDPDWVLAMQEELNNFKRNEVWTLVPRPKQNVVGTKWVFRNKQDEHGVVTRNKARLVAKGYAQVAGLDFEETFAPVARLESIRILLAYAAHHSFRLYQMDVKSAFLNGPIKEEVYVEQPPGFEDERYPDHVCKLSKALYGLKQAPRAWYECLRDFLIVNAFKVGKADPTLFTKTCDGDLFVCQIYVDDIIFGSTNQKSCEEFSRVMTQKFEMSMMGELNYFLGFQVKQLKDGTFISQTKYTQDLLKRFGMKDAKPAKTPMGTDGHTDLNKGGKSVDQKAYRSMIGSLLYLCASRPDIMLSVCMCARFQSDPKECHLVAVKRILRYLVATPCFGLWYPKGSTFDLVGYSDSDYAGCKVDRKSTSGTCQFLGRSLVSWNSKKQTSVALSTAEAEYVAAGQCCAQLLWMRQTLRDFGYNLSKVPLLCDNESAIRMAENPVEHSRTKHIDIRDHFLRDHQQKGDIKVFHVSTENQLADIFTKPLDEKTFCRLRSELNVLDSRNLD

SEQ ID NO: 476 - protein, 1048 aa, Zea mays
MTGEKKMFTSYVKNKDSQDSIIFGDGNQGKVKGLGKIAISNEHSISNVFLVESLGYNLLSVSQLCNMGYNCLFTNVDVSVFRRSDGSLAFKGVLDGKLYLVDFAKEEAGLDACLIAKTSMGWLWHRRLAHVGMKNLHKLLKGEHVIGLTNVQFEKDRPCAACQAGKQVGGAHHSKNVMTTSRPLELLHMDLFGPVAYLSIGGSKYGLVIVDDFSRFTWVFFLQDKSETQGTLKRFLRRAQNEFELKVKKIRSDNGSEFKNLQVEEFLEEEGIKHEFSAPYTPQQNGVVERKNRTLIDMARTMLGEFKTPEYFWTEAVNTACHAINRVYLHRLLKKTSYELLTGNKPNVSYFRVFGSKCYILVKKGRNSKFAPKAVEGFLLGYDSNTKAYRVFNKSSGLVEVSSDVVFDETNGSPREQVIDCDDVDEEDVPTTAIRTMAIGDVRPQEQYERDQSSSSTKVHPPTQDDEQVHQQEACDQGGAQVDHVMEEEAQPAPPTQVRAMIQRDHPVDQILGDISKGVTTRSRLVNFCEHYSFVSSIEPFRVEEALLDPDWVLAMQEELNNFKRNEVWTLVPRPKQNVVGTKWVFRNKQDEHGVVTRNKARLVAKGYAQVAGLDFEETFAPVARLESIRILLAYAAHHSFRLYQMDVKSAFLNGPIKEEVYVEQPPGFEDERYPDHVCKLFKALYGLKQAPRAWYECLRDFLIANAFKVGKADPTLFTKTCDGNLFVCQIYVDDIIFGSTNQKSCEEFSRVMTRKFKMSMMGELNYFLGFQVKQLKDGTFISQTKYTQDLLKRFGMKDAKPAKTPMGTDGHTDLNKGGKSVDQKAYRSMIGSLLYLCASRPDIMLSVCMCARFQSDPKECHLVAVKRILRYLVATPCFGLWYPKGSTFDLVGYSDSDYAGCKVDRKSTSGTCQFLGRSLVSWNSKKQTSVALSTAEAEYVVAGQCCAQLLWMRQTLRDFDYNLSKVPLLCDNESAIRMAENPVEHSRTKHIDIRHHFLRDHQQKGDIEVFHVSTENQLADIFTKPLDEKTFCRLRSELNVLDSRNLD

SEQ ID NO: 477 - protein, 1048 aa, Zea mays
MTGEKKMFTSYVKNKDSQDSIIFGDGNQGKVKGLGKIAISSEHSISNVFLVESLGYNFLSVSQLCNMGYNCLFTNVDVSVFRRSDGSLAFKGVLDGKLYLVDFAKEEAGLDACLIAKTSMGWLWHRRLAHVGMKNLHKLLKGEHVIGLTNVQFKKDRPCVACQAGKQVRGSHHTKNVMTTSRPLEMLHMDLFGPVAYLSIGGSKYGLVIVDDFSRFTWVFFLQDKSETQGTLKRYLRRAQNEFELKVKKIRSDNGSEFKNLQVEEFLVEEGIKHEFSAPYTPQQNGVVERKNRTLMDMARTMLGEFKTPERFWSEAVNTACHSINRVYLHRLLKNTSYELLTGNKPNVSYFRVFGSKCYILVKKGRTSKFAPKAVEGFLLGYDSNTKAYRVFNKSSGLVEVSSDVVFDETNGSLREQVVNLDDVDEEDVPTAAMRTMAIGDVRPQEHLEQDQPSSTTMVHPPTQDDEQAPQVGAHDQGGAQDVQVEEEEAPQAPPTQVRATIQRNHPVNQILGDISKGVTTRSRLVNFCEHYSFVSSIEPFRVEEVLLDPDWVLAMQEELNNFKRNEVWTLVPRPKQNVVGTKWVFRNKQDEHGVVTRNKARLVAKGYAQVAGLDFEETFAPVARLKSIRIWLAYAAHHSFRLYQMDVKSAFLNGPIKEEVYVEQPPGFEDERFPDHVCKLSKALYGLKQAPRAWYECLRDFLIANAFKVGKADPTLFTKTCDGDLFVCQIYVDDIIFGSTNQNSCEEFSRVMTQKFEMSMMGELSYFLGFQVRQLKDGTFISQTKYTQDLIKRFGMKDAKPAKTPMGTDGHTDLNKGGKSVDQKAYRSTIGSLLYLCASRPDIMLSVCMCARFQSDPRECHLVAVKRILRYLVATPCFGIWYPKGSTFDLIGYSDSDYARCKVDRKSTSRMCQFLGRSLVSWNSKKQTSVALSTAEAEYVAVGQCCAQLLWMRQTLRDFGYNLSEVPLLCDNESAIRIAENPVEHSRTKHIDIRHHFLRDHQQKGVIEVFHVSSENHLADIFTKPLDEQTFCKLHSELNVLDSRNLD

SEQ ID NO: 478 - protein, 1063 aa, Zea mays
MTGEKRMFSSYEKNQDPQRAITFGDGNQGLVKGLGKIAISPDHSISNVFLVDSLDYNLLSVSQLCKMGYNCLFTDTGVTVFRRSDDSIAFKGVLEGQLYLVDFERAELDTCLVAKTNLGWLWHRRLAHVGMKNLHKLLKGEHILGLTNVHFEKDRICSACQAGKQVGTHHPHKNIMTTDRPLELLHMDLFGPIAYISIGGSKYCLVIVDDYSRFTWVFFLQEKSQTQETLKGFLRRAQNEFGLRIKKIRSDNGTEFKNSQIESFLEEEGIKHEFSSPYTPQQNGVVERKNRTLLDMARTMLDEYKTPDRFWAEAVNTACYAINRLYLHRILKKTSYELLTGKKPNISYFRVFGSKCFILIKRGRKSKFAPKTVEGFLLGYDSNTRAYRVFNKSTGLVEVSCDVVFDETNGSQVEQVDLDEIGEEQAPCIALRNMSIGDMCPKEFEEPPSTQDQPSSSMQASPPTQNEDEAQNDEEQNQEDEPPQDDSNDQGGDTNDQEKEDEEEPRPPHPRVHQAIQRDHPVDTILGDIHKGVTTRSRVAHFCEHYSFVSSIEPHRVEEALQDSDWVVAMQEELNNFTRNEVWHLVPRPNQNVVGTKWVFRNKQDEHGVVTRNKARLVAKGYSQVEGLDFGETYAPVARLESIRILLAYATYHGFKLYQMDVKSAFLNGPIKEEVYVEQPPGFEDSEYPNHVYRLSKALYGLKQAPRAWYECLRDFLIANGFKVGKADPTLFTKTLENDLFVCQIYVDDIIFGSTNESTCEEFSRIMTQKFEMSMMGELKYFLGFQVKQLQEGTFISQTKYTQDILAKFGMKDAKPIKTPMGTNGHLDLDTGGKSVDQKVYRSMIGSLLYLCASRPDIMLSVCMCARFQSDPKESHLTAVKRILRYLAYTPKFGLWYPRGSTFDLIGYSDADWAGCKINRKSTSGTCQFLGRSLVSWASKKQNSVALSTAEAEYIAAGHCCAQLLWMRQTLRDYGYKLTKVPLLCDNESAIKMADNPVEHSRTKHIAIRYHFLRDHQQKGDIEISYINTKDQLADIFTKPLDEQSFTRLRHELNILDSRNFFC

SEQ ID NO: 479 - protein, 1063 aa, Zea mays
MTGEKRMFSSYEKNQDPQRAITFGDGNQGLVKGLGKIAISPDHSISNVFLVDSLDYNLLSVSQLCQMGYNCLFTDIGVTVFRRSDDSIAFKGVLEGQLYLVDFDRAELDTCLIAKTNMGWLWHRRLAHVGMKNLHKLLKGEHILGLTNVHFEKDRICSACQAGKQVGTHHPHKNIMTTDRPLELLHMDLFGPIAYISIGGSKYCLVIVDDYSRFTWVFFLQEKSQTQETLKGFLRRAQNEFGLRIKKIRSDNGTEFKNSQIESFLEEEGIKHEFSSPYTPQQNGVVERKNRTLLDMARTMLDEYKTPDRFWAEAVNTACYAINRLYLHRILKKTSYELLTGKKPNISYFRVFGSKCFILIKRGRKSKFAPKTVEGFLLGYDSNTRAYRVFNKSTGLVEVSCDVVFDETNGSQVEQVDLDEIGEEQAPCIALRNMSIGDVCPKESEEPPSTQDQPSSSMQASPPTQNEDEAQNDEEQNQEDEPPQDDSNDQGGDTNDQEKEDEEEPRPPHPRVHQAIQRDHPVDTILGDIHKGVTTRSRVAHFCEHYSFVSSIEPHRVEEALQDSDWVVAMQEELNNFTRNEVWHLVPRPNQNVVGTKWVFRNKQDEHGVVTRNKARLVAKGYSQVEGLDFGETYAPVARLESIRILLAYATYHGFKLYQMDVKSAFLNGPIKEEVYVEQPPGFEDSEYPNHVYRLSKALYGLKQAPRAWYECLRDFLIANGFKVGKADPTLFTKTLENDLFVCQIYVDDIIFGSTNKSTCEEFSRIMTQKFEMSMMGELKYFLGFQVKQLQEGTFICQTKYTQDILTKFGMKDAKPIKTPMGTNGHLDLDTGGKSVDQKVYRSMIGSLLYLCASRPDIMLSVCMCARFQSDPKESHLTAVKRILRYLAYTPKFGLWYPRGSTFDLIGYSDADWAGCKINRKSTSGTCQFLGRSLVSWASKKQNSVALSTAEAEYIAAGHCCAQLLWMRQTLLDYGYKLTKVPLLCDNESAIKMADNPVEHSRTKHIAIRYHFLRDHQQKGDIEISYINTKDQLADIFTKPLDEQSFTRLRHELNILDSRNFFC

SEQ ID NO: 480 - protein, 165 aa, Sorghum bicolor
MDARMFGLETPLMVALQHLLDVPDGDAGAAGGDKAGAGAGGGATRTYVRDARAMAATPADVKELPGAYAFVVDMPGLGTGDIKVQVEDDRVLVISGERRREEREDAKYLRMERRMGKFMRKFVLPDNADMDKISAVCRDGVLTVTVDKLPPPEPKKPKTIEVKVA

SEQ ID NO: 481 - protein, 162 aa, Triticum aestivum
MEGRMFGLETPLMTALQHLLDVPDGEAGGPGNAAGEKQGPTRAYVRDARAMAATPADVKELPGAYAFVVDMPGLGSGDIKVQVEDERVLVISGERRREEKEDAKYLRMERRMGKMMRKFVLPENADMEKISAVCRDGVLTVSLEKLPPPETKKPKTIQVQVA

SEQ ID NO: 482 - protein, 162 aa, Hordeum vulgare subsp. vulgare
MEGRMFGLETPLMTALQHLLDIPDGEAGGPGHAGGEKQGPTRAYVRDARAMAATPADVKELPGAYLFVVDMPGLGSGDIKVQVEDERVLVISGERRREEKEDARYLRMERRMGKLMRKFVVPDNADTEKISAVCRDGVLTVTVDKLPPPEPKKPKTIQVQVA

SEQ ID NO: 483 - protein, 164 aa, Zea mays
MDAVMFGLETPLMAALQHLLDVPDGDAGAGGDNKTGSGGSATRTYVRDARAMAATPADVKELPGAYAFVVDMPGLGTGDIRVQVEDERVLVVSGERRREEREDDAKYLRMERRMGKFMRKFVLPDNADVDKVAAVCRDGVLTVTVEKLPPPEPKKPKTIEVKVA

SEQ ID NO: 484 - protein, 160 aa, Triticum turgidum subsp. dicoccon
MAGMVFGLENPMMTALQHLLDIPDGEAGNTAGGEKQGPTRAYVRDARAMAATPADVKELPGAYAFVVDMPGLGSGDIKVQVEDERVLVISGERRREEKEDAKYLRMERRMGKLMRKFVLPENADMEKISAVCRDGVLTVTVDKLPPPEPKKPKTIQVQVA

SEQ ID NO: 485 - protein, 159 aa, Hordeum vulgare subsp. vulgare
MAGMVFGLETPVMTALQHLLDIPDGEAGAAGGEKQGPTRAYVRDARAMAATPADVKELPGAYAFVVDMPGLGSGDINVQVEDERVLVISGERRREEKEDAKYVRMERRMGKMMRKFVLPENADMEKISAACRNGVLTVTVEKLPPPEPKKPKTIQVQVA

SEQ ID NO: 486 - protein, 159 aa, Triticum turgidum subsp. dicoccoides
MAGMVFGLENPMMTALQHLLDIPDGETGAPGGEKQGPTRAYVRDARAMAATPADVKELPGAYAFVVDMPGLGSGDIQVQVEDERVLVISGERRREEKEDTKYLRMERRMGKLMRKFVLPENADMEKISAVCRDGVLTVTVDKLPPPEPKKPKTIQVQVA

SEQ ID NO: 487 - protein, 160 aa, Triticum turgidum subsp. durum
MAGMVFGLENPMMTALQHLLDIPDGEAGNTAGGEKQGPTRAYVRDARAMAATPADVKELPGAYAFVVDMPGLGSGDIKVQVEDERVLVISGERRREEKEDAKYLRMERRMGKLMRKFVLPENADMEEISAVCRDGVLTVTVDKLPPPEPKKPKTIQVQVA

SEQ ID NO: 488 - protein, 164 aa, Zea mays
MDAVMFGLETPLMAALQHLLDVPDGDAGAGGDSDNKTGGGATRTYVRDARAMAATPADVKELPGAYAFVVDMPGLGTGDIRVQVEDERVLVVSGERRREEREDDAKYLRMERRMGKFMRKFVLPDNADVDKVAAVCRDGVLTVTVEKLPPPEPKKPKTIEVKVA

SEQ ID NO: 489 - protein, 159 aa, Hordeum vulgare subsp. vulgare
MAGMVFGLEAPMMTALQHLLDTPDGESGAAAGEKQGPTRAYVRDARAMAATPADVKELPGAYAFVVDMPGLGSGDIKVQVEDERVLVISGERRREEKEDARYVRMERRMGKMMRKFVLPENADMEKISAACRDGVLTVTVEKLPPPEPKKPKTIQVQVA

SEQ ID NO: 490 - protein, 312 aa, Sorghum bicolor
MLLHHRLLPRLLVPSTHTSTLLRPSRLPLRLSLSPRFSALSHLAAPQTVDQSDDEGAPQGKVQVQLPLDRLFVPPGATVDAGDQDAVSARVLKGSNIVLGPYARGDAQVVNADFVKSSVRPDDCPRDGLPEFALVGRSNVGKSSLLNSLVRRKRLALTSKKPGKTQCINHFKVNDSWYLVDLPGYGYASAPQEARTNWDEFTRNYFLSRENLVSVFLLIDASIPAKKIDLDYASWLGQNKVPMTLVFTKCDKRKKKKNGGRRPEENVETFQSLIREYFEAAPPWIMTSSVTNQGRDEILLHMSQLRNYWLKH

SEQ ID NO: 491 - protein, 313 aa, Zea mays
MLLHHRLLPRLLLVPSTHTSTLLCPSRLPRRLSLSPRFYALPHLAAPQTVDHSDDEGAPQGEGQIKLPLDHLFVPPGATMDAGDQEAVSARVLKGSNIVLGPYARGDAQVVNADFVKSSVRPDDCPRDGLPEFALVGRSNVGKSSLLNSLVRRKRLALTSKKPGKTQCINHFKVNDSWYLVDLPGYGYASAPQEARTNWDEFTRNYFLSRENLVSVFLLIDASIPAKKIDLDYASWLGQNKVPMTLVFTKCDKRKKKKNGGRKPEENVETFQGLIREYFEAAPPWIMTSSVTNQGRDEILLHMSQLRNYWLKH

SEQ ID NO: 492 - protein, 354 aa, Zea mays
MLLHHRLLPRLLLVPSTHTSTLLCPSRLPRRLSLSPRFYALPHLAAPQTVDHSDDEGAPQGEGQIKLPLDHLFVPPGATMDAGDQEAVSARVLKGSNIVLGPYARGDAQVVNADFVKSSVRPDDCPRDGLPEFALVGRSNVGKSSLLNSLVRRKRLALTSKKPGKTQCINHFKVNDSWYLVDLPGYGPARPFLGEIEGESRALLLQILLEWIWQQSPTHGLSKKLVRIYASAPQEARTNWDEFTRNYFLSRENLVSVFLLIDASIPAKKIDLDYASWLGQNKVPMTLVFTKCDKRKKKKNGGRKPEENVETFQGLIREYFEAAPPWIMTSSVTNQGRDEILLHMSQLRNYWLKH

SEQ ID NO: 493 - protein, 316 aa, Oryza sativa Japonica Group
MLLHHRLLPRLLLSPSTPVTTTLLVHRTSLFPTRRILSPCCSALSQVAAAPETVDHSDGDEPQGDVQVQLPLDRLFVPPGASVSAGDAEAVTARVLKGSNIVLGPYARGDANVIAADFVKSSVRPDDCPRDGLPEFALVGRSNVGKSSLLNSLVRRKRLALTSKKPGKTQCINHFKVNDSWYLVDLPGYGYAAAPQEARTNWDEFTRNYFLGRENLVSVFLLVDASIPAKKIDLDYASWLGQNKVPMTLVFTKCDKRKKKKNGGKRPEENVENFQSLIREYFEAAPPWIMTSSVTNQGRDEILLHMSQLRNYWLKH

SEQ ID NO: 494 - protein, 344 aa, Oryza sativa Indica Group
MLLHHRLLPRLLLSPSTPVTTTLLVHRTSLFPTRRILSPCCSALSQVAAAPETVDHSDGDEPQGDVQVQLPLDRLFVPPGASVSAGDAEAVTARVLKGSNIVLGPYARGDANVIAADFVKSSVRPDDCPRDGLPEFALVGRSNVGKSSLLNSLVRRKRLALTSKKPGKTQCINHFKVNDSWYLVDLPGYGYAAAPQEARTNWDEFTRNYFLGRENLVSVFLLVDASIPAKKIDLDYASWLGQNKCKIQKSSQTSNYVGINLVPETPLKTSSNVPMTLVFTKCDKRKKKKNGGKRPEENVENFQSLIREYFEAAPPWIMTSSVTNQGRDEILLHMSQLRNYWLKH

SEQ ID NO: 495 - protein, 422 aa, Sorghum bicolor
MGPTVGAGEDKAISELREQHRVDLERLTITSRPFKTLAFFVLAIAQSLERTCSSVLKKGYRLKIAMPLVAVTWVLLLFTDGLHEKHLQELLWYVRFGLWWIILGVASSIGLGSGLHTFIMYLGPHVALFTIKAVQCGRVDLKSAPYDTILLKRSPSWLEKDCLQFGPPIYHETIPFSKILQEVCLEAVLWGIGTALGELPPYFLSRAASMSGRLIDELEDLDASIPEGFLSSTLRQAKRWLMSHSQHLSFTLILLLASVPNPLFDLAGMLCGQFNIPFWKFFLATLIGKAIVKVCIQTTLVITLCNNQLLDLVEKRLIWAFSNVPGVASVLPSLVSKLKMAKNKFLSAHVAASASSSVKGKKWTLSFSLVWNTLVWLMVVNFIIQIVTSTAQGYLRTQQEQEISKKLETELSTSEPSSGLPK

SEQ ID NO: 496 - protein, 414 aa, Zea mays
MGPTAGSGEDKAMLELRKKHRVDLERLTITSRPFKTLSFFVLAIAQNLERTCSSVLKKGYQLKTAMLLVVATWLLLMFTDGLNEKHLQELFWYVRFGLWWIILGVASSIGLGSGLHTFIMYLAPHVALFTIKAVQCGRVDLKSAPYDTILLERRPSWLEKDCLQFGPPIYHETIPFSKILQEVYLEAILWGIGTALGELPPYFLSRTASMSGRIIDELEDLDASISEGFLSSALRQAKRWLMSHSQYLSFTLILLLASVPNPLFDLAGILCGQFNIPFWKFFLATLIGKAIVKVCIQTTLVITLCNNQLLDLVEKRLIWAFSNVPGVASVLPSFVSKLKMDKNKFLSAHVAASASTSVKGKKWNLSFSLVWNTLVWLMVANFIIQIVTSTAQGYLRTQQEREISKKLETELSAS

SEQ ID NO: 497 - protein, 424 aa, Hordeum vulgare subsp. vulgare
MMEHTAFGEDQAISDLRDKHRLDLESLTLTSRPFKTLALFVLAIGQSIRSTCSCVLKEGSRLKFIVLLLGATCVLLLVTNGPHEKHMQELLRYARFGLWWVILGVASSIGLGSGLHTFVLYLGPHIALFTMKAVQCGRVDLKSAPYDTILLKRRPSWLEKDCLDFGPPIYQETIPFSKILHEVHLEAVLWGIGTALGELPPYFISRAASMSGQKVEELAELDASISKEGFLSSTLHRAKRWLMSHSQYLNFPTILLLASVPNPLFDLAGILCGQFNVPFWKFFLATLIGKAIIKVYMQTTLVITLCNNQLLELVEERLVWVLSNFPGVSSMLPSLVTKLKTAKDKFLMASVAASASSAAKGNKWNLSFSLIWNTVVWLMIVNFLVQIITSTAQNYLKKQQELEISMKSSATISSASEPAARISN

SEQ ID NO: 498 - protein, 416 aa, Oryza sativa Japonica Group
MGPAAADDAAAGEDQALSDLREKHQFDLERLTLTSQPLRTLALFALAIGQSIKSTCLCVLKDSARLKFLVLLVASACTPLLLTNGPHEKHVQELLWYIRFGLWWVILGVASSIGLGPHIALFTIKAVHCGRTDLKSAPYDTILLKMRPSWLEKDCLEFGPPMYQETIPFSKILHEVHLEAVLWGIGTALGELPPYFLSRAASMSGRKLDELEELDASVSGEGFLSSTLHRAKRWLMSHSQYLNFPTILLLASVPNPLFDLAGILCGQFNIPFWKFFLATLIGKAVIKVYIQTTLVITLCNNQLLDLVEKRIMWVFGNVPMVSSVLPSLVAKLKTAKSKFLSSSVAASASSVVKETKWNLSFSLIWNTVVWLLIMNFIVQIITSTAQSYLKRQQELEIRKKLSATIQTVSETTGLSN

SEQ ID NO: 499 - protein, 416 aa, Oryza sativa Indica Group
MGPAAADDAAAGEDQALSDLREKHRIDLERLTLTSQPLRTLALFALAIGQSIKSTCLCVLKDSARLKFLVLLVASACTPLLLTNGPHEKHVQELLWYIRFGLWWVILGVASSIGLGPHIALFTIKAVHCGRTDLKSAPYDTILLKMRPSWLEKDCLEFGPPMYQETISFSKILHEVHLEAVLWGIGTALGELPPYFLSRAASMSGRKLDELEELDASVSGEGFLSSTLHWAKRWLMSHSQYLNFPTILLLASVPNPLFDLAGILCGQFNIPFWKFFLATLIGKAVIKVYIQTTLVITLCNNQLLDLVEKRIMWVFGNVPMVSSVLPSLVAKLKTAKSKFLSASVAASASSVVKETKWNLSFSLIWNTVVWLLIMNFIVQIITSTAQSYLKRQQELEIRKKLSATIQTVSETTGLSN

SEQ ID NO: 500 - protein, 1317 aa, Zea mays
  misc_feature (232)..(232): Xaa can be any naturally occurring amino acid
MASFNDQAGAASDPKLVLPITGGSSSEPANKKQKKEAQRRVQHVGVQGPFIKSRWSHIPITFSQEDLQLKDYPHNDAMVISCVIKGFLVHNVLVDTGSAADIIFAKAFRQMQELEDKIHDATHPLCGFGGRQIVALGKITMSVTFGFINNTRTEQVVFDIVDMEYPYNAIIGRGTLNAFEAILHPAYLCMKMPSDQGPIAIHGSQEAARRAEGNWTDSKAIHNIDGAEACEXYKFRREKAASADQPKPMLLCEDIAEQKVLLGSQLSEEQEKTLIRFLFNNKDVFAWSANDLCGVNRDVIEHSLNVDPSFRPRKQRLRKMSDDKAEGARNEVKRLLSAGVIREVKYPEWLANTVMVKKANGKWRMCIDFTDLNKACPKDEFPLPRIDSLVDATASSELMSLLDCYSGYHQIWMKREDEPKTSFITPSGTYCYLRMPEGLKNAGGSFSRMTAKVLQSQIGRNVLTYVDDIIVKSTKQENHIADLQETFASFRQAGLKLNPEKCVFGVKKGKFLGCLVSTKGIEANPSKIEAILRMEPPTTKKGAQRLTGRLASLNRFISRSAERNLPFFEVLKSAEVFQWGPIQQKAFEELKQYLIDLTALTPPMPGAPLLLYVAASHSAVSAALVQEKLDGQTRKQVPVYFVSEVLSISKKNYTELEKVLYVVLMASRKLRHYFQAYNIIVPSSQPLKDIMRNREATGRIGKWAAELNEFCIEYVHRSSIQSQALADFIADWTPGAQEEEANKDTEAWTVFCDGSWGTFGAGAAAVLVSPSKVKTCYVAKLDFSCTNNIAEYEALLLGLRKLKAMGIRRAVLKTDSQVVSGHIDKSCKAKDPKLEKYLDMVRRVEASFEGFSVKNIPRGQNEHADLLAKSAAQGLPLPSDVFFETIKAPSVELLERAVLNISPVYSEDWRTEIISYLQGKFLSDDEAYNRRIEARARPYVMIEGELYKHGVCAPLLKCLSRTEGIELMKEIHAGLCGSHIGSRPLLGKIFRQGFYWPKAASDAAELVQKCEGCQKCARDQKQPSSLTQLIQPIWPLQRWGLDLLGPLPPAQGNLRYVVVAVEYFSKWIEAKPLATITSATVQKFFWQNIVCRFGVPKAITVDNGTQFDSEAFRDFCDQIGTKIHFASVRHPESNGLVERANGIIMTGIMKSIFNQPRGKWPDQLTKVVWSHNTTTSRSTGFTPFKLLFGDEAITPEEAKTGSIRVVASAASGSEADYSVEKDALEGIRLQAVENINKYQAETIKWRDRKVRLKNIEPDTWCFRRVANPETVGKLQLKWDGPFLVASSSRPGSYRLKDMDGNDIPRSWNADELRRYYV

SEQ ID NO: 501 - protein, 1317 aa, Zea mays
MASFNDQAGAASDPKLVLPITGGSSSEPANKKQKKEAQRRVQHVGVQGPFIKSRWSHIPITFSQEDLQLKDYPHNDAMVISCVIKGFLVHNVLVDTGSAADIIFAKAFRQMQEPEDKIHDATHPLCGFGGRQIVALGKITMSVTFGFINNTRTEQVVFDIVDMEYPYNAIIGRGTLNAFEAILHPAYLCMKIPSDQGPIAIHGSQEAARRAEGNWTDSKAIHNIDGAEACEQYKFRREKAASADQPKPMLLCEDIAEQKVLLGSQLSEEQEKTLIRFLFNNKDVFAWSANDLCGVNRDVIEHSLNVDPSFRPRKQRLRKMSDDKAEGARNEVKRLLSAGVIREVKYPEWLANTVMVKKANGKWRMCIDFTDLNKACPKDEFPLPRIDSLVDAAASSELMSLLDCYSGYHQIWMKKEDEPKTSFITPSGTYCYLRMPEGLKNAGGSFSRMTAKVLQSQIGRNVLTYVDDIIVKSTKQENHIADLQETFASFRQAGLKLNPEKCVFGVKKGKFLGCLVSTKGIEANPSKIEAILRMEPPTTKKGAQRLTGRLASLNRFISRSAERNLPFFEVLKSAEVFQWGPIQQKAFEELKQYLIDLTTLTPPMSGAPLLLYVAASHSAVSAALVQEKLDGQVKRQAPIYFVSEVLSLSKKNYTELEKVLYAVLMASRKLRHYFQAYNIIVPSSQPLKDIMRNREATGRIGKWAAELNEFCIEYVHRSSIQSQALADFIADWTPGAQEEETNKDNEAWTVFCDGSWGTFGAGAAAVLVSPSKVKICYAAKLDFNCTNNIAEYEALVLGLRKLKAMGIRRAILKTDSQVVSGHIDKSCKAKDPKLEKYLDMVRRIEASFEGFSVKNIPRGQNEHADLLAKSAAQGLPLPSDVFFETIKAPSVELLERAVLNISPVFSEDWRTEIISYLQGKFLSDDEAYNKRIEARARPYVMIEGELYKHGVCAPLLKCLSRTEGIELMKEIHAGLCGSHIGSRPLLGKVFRQGFYWPKAASDAAELVQKCEGCQKCARDQKQPSSLTQLIQPTWPLQRWGLDLLGPLPPAQGNLRYVVVAVEYFSKWIEAKPLATITSATVQKFFWQNIVCRFGVPKAITVDNGTQFDSEAFRDFCDQIGTKIHFASVRHPESNGLVERANGIIMTGIMKLIFNQPRGKWPDQLIKVVWSHNTTTSRSTGFTPFKLLFGDEAITPEKAKAGSIRIVASAESDSEAAYSIEKDALEGIRLQAVENINKYQAETVKWRDRKVRLKNIEPGHLVLRRVANPETVGKLQLKWDGPFLVASSSRPGSYRLKDMNGSDIPRSWNADELRRYYV

SEQ ID NO: 502 - protein, 479 aa, Zea mays
EFPLPRIDSLVDAAASSELMSLLDCYSGYHQIWMKKEDEPKTSFITPSGTYCYLRMPEGLKNAGGSFSRMTAKVLQSQIGRNVLTYVDDIIVKSTKQENHIADLQETFASFRQAGLKLNPEKCVFGVKKGKFLGCLVSTKGIEANPNKIEAILRMEPPTTRKGAQRLTGRLASLNRFISRSRERNLPFFEVLKSAKVFQWGPSQQKAFEELKQYLIDLTTLTPPMPGAPLLLYVAASHSAVSAALVQEKLDGQLKKLVPVYFVSEVLSVSKKNYTELEKVLYAVLMASRKLRHYFQAYNIIVPSSQPLKDIMRNREATGRIGKWAAELNEFYIDYVHRSSIQSQALADFIAVWTPGAQDEEANKDAEVWTVFCDGSWGIFGAGAAAVLVSPSKVKTCYAARLDFSCTNNIAEYEALLLGLRKLKAMGIRRAILKTDSQVVSGHVDKSCKAKDPKLEKYLDTVRRIEASFEGFSVKNIPR

SEQ ID NO: 503 - protein, 349 aa, Sorghum bicolor
MAPPAAPTALHHRTPLLLPRRATAAPGATATATARAARAASLAVVRAQPDTTAATSAPEPPTPEFKPPPGFKVPEPKRFEVKPGQQNSVLGASLAIPLRLGTGVFVLGYSPSLVSPSEIPSDQYALEFGAWKVKEESKIGQCKRPEKPIEIYEFEGCPFCRKVREMVSVLDLDVLFYPCPQKGPTFRPKVLEMGGKKQFPYMVDPNTGVAMYESDDIIKYLADTYGDGTVPIMLSLGLLTTITAGLATLGRFGKGNSYTASKVPPQPIEIWAYEGSPFCRLVRETLVELELPHLLHSCARGSPKRQEFLKKKGVFQAPYIEDPNTGVQMFESAEIIDYLKATYALYPSS

SEQ ID NO: 504 - protein, 347 aa, Zea mays
MAPPAAPTALHHRTPLLLPRRTVALGATATARAARAASLAVRAQPDTTAAAVSTSAPEPAPEFKPPPGFKAPEPKRYEVKSGQVGSVLGASLAIPLRLGTGVFVLGYSPSLVSPSEIPSDQYALEFGAWKVKEESKIGQCKRPEKPIEIYEFEGCPFCRKVREMVTVLDLDVLFYPCPQKGPTFRPKVLEMGGKKQFPYMVDPNTGVAMYESDDIIKYLADTYGDGTVPIMLSLGLLTAITAGLATLGRIGKGNSYIASKVPPQPIEIWACEGSPFCKLVRETLVELELPHLLHSCARGSPKRQEFFKKKGLFQAPYIEDPNTGVQMFESAEIIDYLKATYALYPSS

SEQ ID NO: 505 - protein, 344 aa, Zea mays
MAPPAALHHRTPLLLPRRTVALGATATARAARAASLAVRAQPDTTAAAVSTTAPEPTPEFKPPPGFKAPEPKRFEVKSGQLGSVLGASLAIPLRLGTGVFVLGYSPSLVSASEIPSDQYALEFGAWKVKEESKIGQCKRPEKPIEIYEFEGCPFCRKVREMVTVLDLDVLFYPCPKKGPTFRPKVLEMGGKKQFPYMVDPNTGVAMYESDDIIKYLADTYGDGTVPIMLSLGLLTAITAGLATLGRIGKGNSYIASKVPPQPIEIWAYEGSPFCKLVRETLVELELPHLLHSCARGSPKRQEFFKKKGLFQAPYIEDPNTGVQMFESAEIIDYLKATYALYPSS

SEQ ID NO: 506 - protein, 387 aa, Zea mays
MEMRVVLLLCQVICMQAAVIGAVAAAAGARPPAMYVFGSSILDVGNNNYLRGPAVGRANSPYNGVDFPGSIPTGRFSNGYNIADYVAKSMGFACSPPPYLSLAQAPAPAPAQSSGPDLAQTALTIGINYASGGAGILDSTNAGNTIPLSEEVKYFGATKAKMVAAAGPSAVNPLISRSIFLIGMGNNDLYVFGASERARNRSDAEQRRDAAAALYASLVSNYSAAVTELYSLSLGARKFAVINVWPLGCVPGERVLSPTGACSGVLNDVAGGFNDALRSLLIGLAERLPGLVYALADSFGFTLDVLADPRASGYTDVASTCCGGGRRLGAEAWCTRSSTLCVDRDRHVFWDRVHPSQRTAFLLAQAFYDGPPKYTTPINFMQLAHSS

SEQ ID NO: 507 - protein, 381 aa, Sorghum bicolor
MRIGVLLLPCLGICMQVALIGGTTVASGGGGVRAPAMFVFGSSILDVGNNNYLQGATVGRANSPYNGVDFPGSVPTGRFSNGYNIADYVAKNMGFACSPPPYLSMVQSSSGPLVQTALTSGINYASGGAGILDSTNAGSTIPLSKEVKYFGATKAKMVAAVGPNTANPAISQSIFLIGMGNNDLYVFAASERARNRSAADDERSDAAAAALYAGLISNYSAAVTELYTLGARKFAVINVWPLGCVPGQRVLSPTGACSDTLNEVAAGFNAALGSLLVDLAARLPGLVYSLGDAFGFTEDVLADPAASGYTDVAGTCCGGGRLGAEAWCSRNSTLCVNRDQHVFWDRVHPSQRTAFLIARALYDGPSKYTTPINFMQLAKSN

SEQ ID NO: 508 - protein, 472 aa, Sorghum bicolor
MAETVDDKVSYFQAVTGISDADLCTEILAAHNWDLQLAVSSITANPSPSASASTSSRGDPAPSAPLSADAEFVAPPPPPPMQLPLPPQQQQPGIAWRLVTLPFYVVSGGVGLVAGTFRLGAWVAGGVLSRSLSLLGLAGQAGSGDRLLELPPSAAEAADFVAEFAREFGAGRGPSFVAEGFADALQRAQREFKLLFVYLHSPDHPDTPAFCGGCLCAEPVAAFIDENFVAWGGSIRRTEGFKMSNSLNASRFPFCAVVMASTNQRIMLLQQVEGPKSPEEMITILQRVVEECTTSLVAARIEAEERLNNQRLREEQDAAYRAALEADQARERERIEELERREREAAEAERKRKEDEEALARAAQEAAEKEAALARRRQEKAMALGAEPEKGPGVTRVLIRFPTGERKERRFHSSTTVTSLYDYVDSLDCLKAEKYSLVSNFPRVTYGPEKHSLTLEEAGLHPQASLFIEIEQ

SEQ ID NO: 509 - protein, 469 aa, Zea mays
MAETVDDKVSYFQAVTGISNTDLCTEILAAHNWDLQLAVSTITANPSSPSASASTSSRDPAPSAPLAVDAEYVAPPPPLPLPLPPQQQPGIAWKLVTLPFHVVSGGVGLVAGTFRLGAWVAGGVLSRSLSLLGLAGQAGSGDRLLELPPSAAEAADFVAEFEREFGAGRGPRFVAEGFADALKRAQREFKLLFVYLHSPDHPDTPAFCGGCLCAEPVAAFIDENFVAWGGSIRRTEGFKMSNSLNASRFPFCAVVMASTNQRIVLLQQVEGPKSPEEMITVLQRVVEECATSLVAARIEAEERLNNQRLREEQDAAYRAALEADQARERERLEELKRREREAAEAEKKRKEEEEAVARASQEAAEKEAALARRRQEKAMALGAEPEKGPGVTRVLIRFPTGERRERRFYSSATVASLYDYVDSLDCMKAEKYTLVSNFPRVTYGPEKQSLTLEEAGLHLQASLFIEIEQ

SEQ ID NO: 510 - protein, 466 aa, Zea mays
MAETVDDKISYFQAVTGISDTDLCTEILAAHNWDLQLAVSSITANPSSPSAPVSTSSRDPAPSAPLADAEFVAPPPPIPPPPQQQPGIAWKLVTLPFYVVSGGASLVAGSFRLGAWVAGGVLSRSLSLLGLAGQAGSGDRLLELPPSAAEAADFVAEFERECGAGRGPRFVAEGFADALQRAQREFKLLFVYLHSPDHPDTPAFCGGCLCAEPVAAFIDENFVAWGGSIRRTEGFKMSNSLNASRFPFCAVVMASTNQRIVLLQQVEGPKSPEEMITILQRVVEECATSLVAARIEAEERLNNQRLREEQDAAYRAALEADQARERERIEEQERREREAVEAEKKRKEEEEAVARAAQEAAEKEAALARRRQEKAMALGAEPEKGPGVTRVLIRFPTGERKERRFHSSATVTSLYDYVDSLDCMKAENYSLVSNFPRVTYGPEKHSLTLEEAGLHPQASLFIEIEQ

SEQ ID NO: 511 - protein, 463 aa, Hordeum vulgare subsp. vulgare
MAETVDDKVAYFQAVTGIPDPDLCSQILAANNWDLQLAVSSMTGDPSSPEPSTYAPPPPPPLESDSIAYQPPAPAPQQQQQRQQPGIAWRLVTLPFYVVSGGVGLVTGSIRLGVWVASGVLSRSLSLLGLAQGGADRLLELPPSAAEAVGFLAEFEHEFGAGRGPRFVAEGFSDALQRAQREYKLLFVYLHSPDHPDTPAFCGGCLCSEPVAAFIDENFVAWGGSIRRTEGFKMSNSLNASRFPFCALVMASTNQRIVLLQQVEGPKSPEEMITILQRVVEECTASLVAARIEAEERLNNQRLREEQDAAYRAALEADQARERQRREEQEILEREAAEAERKRIEDEEAQARAVQEAAEKEAALARRRQEKAMALGAEPEKGPDVTRVLIRFPTGERKERRFHSSATITSIYDYVDSLDCLKAEKYSLVSNFPRVTYGPEKNSQTLVEAGLHPQASLFIEIEQ

SEQ ID NO: 512 - protein, 466 aa, Oryza sativa Japonica Group
MAETVDDKVSYFQAVTGISDHDLCTEILAAHNWDLQLAVSSITANPSSPDPAPSAPLPPLAPREADLVAPHLPPPPQQQQQQQQPGIAWKLVTLPFYVVSGGVGLIAGSIRLGAWVAGGVLSRSLSILGLAQGGGGGGDRLLELPPSAAEAADFVAEFEREFGAGRGPHFVAEGFADALQRAQREYKLLFVYLHSPDHPDTPAFCGGCLCAEPVAAFIDENFVAWGGSIRRTEGFKMSNSLNASRFPFCAVVMASTNQRIVLLRQIEGPKSPEEMITTLQGAVEECSASLVAARIDAEERLNNQRLREEQDAAYRAALEADQARERQRREEQEKREREAAEAERKRKEEEEAQERAAQEAAEKEAALARRRQEKAMALGAEPEKGPDVTRVLIRFPTGERKERRFNSSTTITSLYDYVDSLDCLKAEKYSLVSNFPRVTYGPEKLSQTLEEAGLHPQASLFIEIEQ

SEQ ID NO: 513 - protein, 465 aa, Oryza sativa Indica Group
MAETVDDKVSYFQAVTGISDHDLCTEILAAHNWDLQLAVSSITANPSSPDPAPSAPPPPLAPREADLVAPHLPPPPQQQQQQQPGIAWKLVTLPFYVVSGGVGLIAGSIRLGAWVAGGVLSRSLSILGLAQGGGGGGDRLLELPPSAAEAADFVAEFEREFGAGRGPHFVAEGFADALQRAQREYKLLFVYLHSPDHPDTPAFCGGCLCAEPVAAFIDENFVAWGGSIRRTEGFKMSNSLNASRFPFCAVVMASTNQRIVLLRQIEGPKSPEEMITTLQGAVEECSASLVAARIDAEERLNNQRLREEQDAAYRAALEADQARERQRREEQEKREREAAEAERKRKEEEEAQERAAQEAAEKEAALARRRQEKAMALGAEPEKGPDVTRVLIRFPTGERKERRFNSSTTITSLYDYVDSLDCLKAEKYSLVSNFPRVTYGPEKLSQTLEEAGLHPQASLFIEIEQ

SEQ ID NO: 514 - protein, 436 aa, Oryza sativa Japonica Group
MAETVDDKVSYFQAVTGISDHDLCTEILAAHNWDLQLAVSSITANPSSPDPAPSAPLPPLAPREADLVAPHLPPPPQQQQQQQQPGIAWKLVTLPFYVVSGGGGGGGGDRLLELPPSAAEAADFVAEFEREFGAGRGPHFVAEGFADALQRAQREYKLLFVYLHSPDHPDTPAFCGGCLCAEPVAAFIDENFVAWGGSIRRTEGFKMSNSLNASRFPFCAVVMASTNQRIVLLRQIEGPKSPEEMITTLQGAVEECSASLVAARIDAEERLNNQRLREEQDAAYRAALEADQARERQRREEQEKREREAAEAERKRKEEEEAQERAAQEAAEKEAALARRRQEKAMALGAEPEKGPDVTRVLIRFPTGERKERRFNSSTTITSLYDYVDSLDCLKAEKYSLVSNFPRVTYGPEKLSQTLEEAGLHPQASLFIEIEQ

SEQ ID NO: 515 - DNA, 1232 bp, Sorghum bicolor
ccatttcgtcgtctctcgctccctcggtccctccccccttctcccccgctcctttcccctcacctcgccatctccttgttcctcacctcgccatggcgttcttctctcaccaccatctccagcagccacacccgcagcaggcgccaccgccgcatcagcagcagccggtccttccttccttcaggaacgcgctaccggtgcctgtggatggccagatcccagcgcccctcaccttcttcaacccgccgcctgccttcccggagcagcccgcgcaggcaccgctggtggatgcgatggggctgacggcagctgcggggcttggatggaggcagccgagggagcaggaactgcttggggaaaactcccagatgtcatccatcgattttctgcagacgggctcggcggtgtcgacggggctggcgctgtctctggaggaccggcgccacggcggcggcggggctgggaactcctccggcgattcaccgctgctcctgctgcccatgctggacgatgacatctcacgcgaggtccagcggcttgacgctgatatggaccgcttcattaaagctcagagtgaacggctgaggcaatctatactggagaaagttcaggcaaagcagtttgaggcactggcctcagttgaggacaagatactcagaaaaatacgggataaagaggcggaagtggagaccatcaacaaaaggaactctgaactagaggaccagattaagcatttgggagtggaagttggtgcttggcagcaaagggccaagtacaatgagagcatgatcaatgcactcaagtacaacttggaacaggtatgtgctcatcagagcaaggatttcaaggaaggttgcggcgatagcgaggtagatgacacggcgtcctgtcgcaatggtggtgctgtcaatttgcagctgacaccgaaggagaacagacaacagaaggatttgacggcttgcagggtctgtaaatcaagtgaggcatgcatgctcttgctgccttgtcggcatctttgtctatgcaaggaatgtgagagcaagctgagcttctgccccctgtgccagtcatccaagatacttggcatggagatatattacgcgtagaatagaatttatgtatcacatgagtatcttacgagatactgctatgttaatacgtcaatgtattgccaaactttagaacctatgtaccactatgacttgccactggatctaaaaagactgccgttt

SEQ ID NO: 516 - DNA, 1259 bp, Zea mays
cccatttcgtcgtctctcgctccctcggtccttccttcacccatctcacccgcgacccgcccctttcccctaagccatctccttcctcctcacctcgccatggcgttcttctctcatcaccatctccagcagccacacgcgcagcagccagtgctcccttccttcaggaacgcgctaccggtgcctgtggatggccagatcccagcgcccctcaccttcttcaacccgccgcctgccttcccggagcaacccgcgcaggcacctctggtggatgcggtgggcttgacggcagctgcggggcttgggtggaggcagccgagggagcaggaactgcttggggaaaactcccagatgtcgtccattgattttctgcagacgggctcggcagtgtcgacggggttggcgctgtctctggaggaccggcgccacgtcggcggcggggctgggaactcctctggcgattcaccgctgctcctgctgcccatgctggacgatgacatctcacgcgaggtccagcggcttgacgctgatatggaccgctttattaaagctcagagtgaacggctgaggcaatctatactggaaaaagttcaggcaaagcaatttgaggcactggcctcagttgaggacaagatactcagaaaaataagggacaaagaggcggaagtggagaccataaacaaaaggaactctgaactagaggaccagattaagcatttgggagtggaagttggtgcttggcagcatagggccaagtacaatgaaagcatgatcaatgcactcaagtacaacttggaacaggtttgtgctcaccagagcaaggatttcaaggaaggctgcggcgatagcgaggtagatgacacggcgtcctgtcgcgatggtggtgctatcaattttcaactgactccgaaggagaacagacaaccgaaggatttgacggcttgcagggtctgcaaatcaagtgaggcatccatgctcttgctgccttgtcggcatctttgtctatgcaaggagtgcgagagcaagctgagcttctgccccctgtgccagtcctccaagatacttggcatggagatatattatgcgtagaatagaatttatgtatcacatgagtatcgtacgagatactgctatgttaatacgattaatctattgccaaactttagaacctatgtaccagtaccactatgacttgccactggatcaaaagacactgccgttgatggtagatttaccgcagcaaatttctgtgagaagcc

SEQ ID NO: 517 - DNA, 1322 bp, Zea mays
aactcccgattcccgaaggcccatttcgtcgtctcttgctccctcggtccttccttcacccatctcacccgcgacccgcccctttcccctaagccatctccttcctcctcacctcgccatggcgttcttctctcatcaccatctccagcagccacacgcgcagcagccagtgctcccttccttcaggaacgcgctaccggtgcctgtggatggccagatcccagcgcccctcaccttcttcaacccgccgcctgccttcccggagcaacccgcgcaggcacctctggtggatgcggtgggcttgacggcagctgcggggcttgggtggaggcagccgagggagcaggaactgcttggggaaaactcccagatgtcgtccattgattttctgcagacgggctcggcagtgtcgacggggttggcgctgtctctggaggaccggcgccacggcggcggcggggctgggaactcctctggcgattcaccgctgctcctgctgcccatgctggacgatgacatctcacgcgaggtccagcggcttgacgctgatatggaccgctttattaaagctcagagtgaacggctgaggcaatctatactggaaaaagttcaggcaaagcaatttgaggcactggcctcagttgaggacaagatactcagaaaaataagggacaaagaggcggaagtggagaccataaacaaaaggaactctgaactagaggaccagattaagcatttgggagtggaagttggtgcttggcagcatagggccaagtacaatgaaagcatgatcaatgcactcaagtacaacttggaacaggtttgtgctcaccagagcaaggatttcaaggaaggctgcggcgatagcgaggtagatgacacggcgtcctgtcgcgatggtggtgctatcaattttcaactgactccgaaggagaacagacaaccgaaggatttgacggcttgcagggtctgcaaatcaagtgaggcatccatgctcttgctgccttgtcggcatctttgtctatgcaaggagtgcgagagcaagctgagcttctgccccctgtgccagtcctccaagatacttggcatggagatatattatgcgtagaatagaatttatgtatcacatgagtatcgtacgagatactgctatgttaatacgattaatctattgccaaactttagaacctatgtaccagtaccactatgacttgccactggatcaaaagacactgccgttgatggtagatttaccgcagcaaatttctgtgagaagcccatcgttgatttgtgctaaaaaaaaaagaaaaaaaaaaaaaaaa

SEQ ID NO: 518 - DNA, 1291 bp, Zea mays
gtctttcactccatcaccccctctcccccgtccctttcccctcagccctcagccctcagccatctccttccccctcacctcgccatggcgttcttctctcaccaccatctccagcagccacacccgcagcaggcaccgcccccgaatcagcagcagccggtgcttccttccttcaggaacgcgctaccggtgcctgtggatggccagatcccagcgcccctcaccttcttcaacccgccgcctgccttcccggagcagcccgcgcagacaacgctggtggatgcggtggggctgacggcagctgctgggcttgggtggaggcagccgagggagcaggaactgcttggagaaaactcccagatgtcgtccatcgattttctgcagacgggctcggcggtatcgacggggctggcgctgtctctggaggaccggcgccacggcggcggcggggctgggaactcctccggcgattcaccgctgctcctgctgcccatgctggacgatgacatttcacgcgaggtccagcggcttgacgctgatatggaccgcttcattaaagctcagagtgaacggctgaggcaatctatactggagaaagttcaggcaaagcaatttgaggcactggcctcagttgaggacaagatattcagaaaaatacgggataaagaggcggaagtggaaaccatcaacaaaaggaactctgaactagaggaccagattaagcatttgggagtggaagttggtgcttggcagcaaagggccaagtacaatgagagcctgatcaatgcactcaagtacaacttggaacaagtatgtgctcaccagagcaaggacttcaaggaaggctgcggtgatagcgaggtagatgacacggcgtcctgtccctatggtggtgctgtcaatttgcaactgatgccaaaggagaacagacaaccgaagaatttaacggcttgcagggtctgtaaatcaagtgaggcatgcatgctcttgttgccgtgtcggcatctttgtctatgcaaggagtgcgagagcaagctgagcatctgccccctgtgccagtcctccaagatacttggcatggagatatattatgcatagaatataatttatgtatcacattagtatcgtacgagatactgctatgttaatacgtcaatctattgccgaagttcagaacctatgtaccactattgacttgccactggatcaaaaaaagactgccgtttatggtagatttaacgcagcaaatttctttgcgaagctaaaaaaaaaaacaaaaaaaaaaaaaaaa

SEQ ID NO: 519 - DNA, 1311 bp, Zea mays
tttttttttttgccatttgccacccccaactcccgagggcccatttcgccgtctttcactccatcaccccctctcccccgtccctttcccctcagccctcagccctcagccatctccttccccctcacctcgccatggcgttcttctctcaccaccatctccagcagccacacccgcagcaggcaccgcccccgaatcagcagcagccggtgcttccttccttcaggaacgcgctaccggtgcctgtggatggccagatcccagcgcccctcaccttcttcaacccgccgcctgccttcccggagcagcccgcgcagacaacgctggtggatgcggtggggctgacggcagctgctgggcttgggtggaggcagccgagggagcaggaactgcttggagaaaactcccagatgtcgtccatcgattttctgcagacgggctcggcggtatcgacggggctggcgctgtctctggaggaccggcgccacggcggcggcggggctgggaactcctccggcgattcaccgctgctcctgctgcccatgctggacgatgacatttcacgcgaggtccagcggcttgacgctgatatggaccgcttcattaaagctcagagtgaacggctgaggcaatctatactggagaaagttcaggcaaagcaatttgaggcactggcctcagttgaggacaagatattcagaaaaatacgggataaagaggcggaagtggaaaccatcaacaaaaggaactctgaactagaggaccagattaagcatttgggagtggaagttggtgcttggcagcaaagggccaagtacaatgagagcctgatcaatgcactcaagtacaacttggaacaagtatgtgctcaccagagcaaggacttcaaggaaggctgcggtgatagcgaggtatatgacacggcgtcctgtccctatggtggtgctgtcaatttgcaactgatgccaaaggagaacagacaaccgaagaatttaacggcttgcagggtctgtaaatcaagtgaggcatgcatgctcttgttgccgtgtcggcatctttgtctatgcaaggagtgcgagagcaagctgagcatctgccccctgtgccagtcctccaagatacttggcatggagatatattatgcatagaatataatttatgtatcacattagtatcgtacgagatactgctatgttaatacgtcaatctattgccgaagttcagaacctatgtaccactattgacttgccactggatcaaaaaaagactgccgtttatggtagatttaacgctaaaaaaaaaaaaaaaaaa

SEQ ID NO: 520 - DNA, 1239 bp, Oryza sativa Japonica Group
aactgtagaccccgtctcgccttctctctcctctcttccctctaccttccctttcccctctctccctccttcccccgacttcctccccgtcctcggccatggcgttcttctcccatcaccacctccagcagccgcatcctcaggctccgccgccgccgccgccgcagcagcagcagcaaccggtgcccccttccttcaggaacgcgctgccggtgccggtagatgggcagatcccggcgcctcttcccttcttcaacccgccgccggccttccaggaccagcccgcgcagccaccactggtggacgcgatggggcttacggccgcggcggggctagggtggaggcagcctagggagcaggagctgctaggagagaactcccagatgtcgtccatcgatttcctgcagacgggctccgcggtgtccactgggctggcgctctctctggaggacagacgccatggcggtggcagcggcgctggggctgggaactcctccggcgattcgccgttgctcctgctcccgatgttggatgatgacatctctcgcgaggttcagcggctcgatgcagatatggaccgcttcatcaaggcccagagtgagcggcttaggcagtccatattggagaaagttcaggcaaagcaatttgaggcgctggcctctgttgaggataagatacttagaaaaatacgggataaagaggcagaagtggagaacattaacaaaaggaactctgaacttgaggaccagattaaacagttggcagtggaagttggtgcgtggcagcaaagggccaagtacaatgagagcatgataaacgcactgaagtacaacttggaacaggtatgtgcccatcaaagcaaggatttcaaagaaggttgtggtgatagcgaggtggatgacacggcatcctgttgcaatggtggtgccgccaatttgcaactaatgccgaaggagaacagacactccaaagatttgaccgcatgtagagtctgcaagtcaagcgaggcttgcatgctattgttgccttgtcggcatctttgcctttgcaaggagtgcgaaagcaagctgagcttctgcccgctatgccagtcttcgaaaatacttggcatggagatatatatgtagaatagaatttatgtattactcgagtatcgtcccagatactgctgtgtttatacaacagtctattgttaaactgtaccactagtatggaccaacatgagatgccactggatcg

SEQ ID NO: 521 - DNA, 1163 bp, Hordeum vulgare subsp. vulgare
ggcgcaccttcctctcgccatggccttcttctcccaccaccacctccagcagccccaccccgcggcgccgccgccaccgcagcagcagcagccggcgcctctctccttcaggaacgcgctgccggtgccggtcgatggacagatcccggcgcctctcgccttcttcaacgcgccgcccgctttcccggaccaggcggggcagccacagctggacgcggctgggctgacggctgcggcgggtatggggtggaggcagccgagggagcaggagctgctgggcgagaactcgcagatgtcttccatcgatttcctgcagacgggctcggcggtgtcgacgggcctggcgctctctctggaggaccggcgccatggcggcggcggcgctggcgctgggaactcctcgggcgattcgccgctgctcctgttgccgatgctggacgacgacatctcccgtgaggtccagcggttagatgctgatatggaccgattcatcagggcccagagtgagcgcctgaggcagtctatactggagaaagttcaggcgaagcagtttgaagcgctggcctctgttgaagacaagatcctccgaaaaatacgcgataaagagtcagaagttcagaacattaacaaaaggaacctggaacttgaggaccagatcaagcaaatgtctggggaagttggtgcgtggcagcaacgggctaagtacaatgagagcatgatcagcgcactcaagtacaacctggagcaggtctgtgcccatcagagcaaggacttcaaagaaggctgcggcgacagcgaggtagacgatacggcgtcctgctgcaacggcggcgccgtcaatctgcagctgatgcccaaggcgaacaatcaccccaaggatttgatggcctgcagggtctgtaaatcaagcgaggcgtgcatgctcttgctgccctgccggcatctttgcctgtgcaaagagtgcgagagcaagctgagcttctgccccctgtgccagtcctccaagatacttggcatggagatatatatgtgatgtagaatataattttatgtaccgcttgagtatcttatctttcgagatgctgatgtacttagacatcaatgtattgtcaactgtagtctcactgggtcgataagactgccatttctggtagaattactgc

SEQ ID NO: 522 - DNA, 1665 bp, Zea mays
ccactcctggcgccgctgacttcctcaaccctatgcggccgacgccggcgctcgtcgccggtggacgcatggtaacaagcttcttatccgccactgaatggatgcttccgtctccggccacgcaagtccacaccatctccgtacttccctcccgtcgcgacttcgccttctccaacctcacgatgttgctcaggaatagcggcggcaacgagggagagagtggcagtactaagttccacgtagtacgggacgacctcctccacccgctcgccaacggcaacaaggcgcgcaagctcgacgccctcctgcccatcctccgccgctgcggcgttactgacatcgttacatgtgggggttgccagagcgcccatgccgcagctatcgcggttcactgtgccgaatggggaatcaggccacatatactgctgagaggcgagcaactggatgttcccacagggtataatctcatctcattgatgtttggcaatgtgacatatgtctctcggtctttgtatgcccaaagagacgagatgctttatgagcatgccataaaggttgcaggatatagtggcacagtgatgtgggcagatgaagttataggaaagggtttgggtgtagatgaggacaccactgatggaaatggttcaagaagagtgatgattgttaaggaaggggcaggtagtgttcaagcactgcttggtaaggagcgattctttttggctagtttccatttatcattcatgattacacatgatgtttgtactgccaataaaacaaaataaattgataggatcatattctagtccatgcagctttgactggtcactggtttcacttcatcatattcaagctgtatttcatcaggactgagaaattaaattctgagcattaagatcactattatcaagtactttgcaccagcatatgtttatttcttatatctgttctgagatttcagatttgtaaaaggaaaacttttactggagctcgataaagttattttgctacttttcacatgatttattctctcttcaggtgtcatgcggctactgaagtatctttctggtttgacattatttagaaaggatgagaaagttcatatcgtggtagattctggaacaggaacaactgctgtggggttagctcttggagcgactccagtggagggttactgctgttatgcttgctgacacacttgaaggatataaacagcgagagagatctcttttatctgattttgagaaggttttcccggaaatctaccatggaatggtggaagatgctactcatgacaatctagttcaatgggtggagcggttttcacctagaagatttggcaaggtgctggatggtgaaatcgcaatgtgccgccaggtagctcaacagaccggtatcctgctggatcctatgtataccttggctgcctgggagcaagctgttgatatatgctgtggagacagtgaagccaaagtcttgatgatccatacgggtggcacccttggcctttttggattggcacaaaggtattcatcacagttcaacacaggcgaacaaccttaggcatgtgcaatgatgatgttcaaatgttacggtttgtgggtatggactatggaatgtgatctttgactttgaataatcaaaagtagaaagaggtggggctttgtt

SEQ ID NO: 523 - DNA, 750 bp, Sorghum bicolor
atgcggccgacgccggcgcttgccgccggcggacgcacggtcgcaagcttcctatccgccacggaatggatgcttccgtctccggccacccaagtccacaccatctccgtccttccctctcgtctcgagttcgccttctccaacctcacgacgtcgctcaggaatggcggcggcaacggtagtgagactggcaatcctaagttccagatagtacgggacgacctcctccacccgctcgccaacggcaacaaggcgcgcaagctcgacgccctcctgcccgtcctccgccactgcggcgctactgacatcgttacatgtgggggttgccagagcgctcatgccgcagcagttgcggttcattgtgccgagtggggaatcaggccacatatactgctgagaggcgagcaactggatgttcccacagggtataatctgatctcattgatgtttggcaatgtgacatatgcctctcggtctttgtatgcccaaagagatgagatgctttatgagcatgccataaaggttgcaggatgtagtggcacagtgatgtgggcagatgaaattataggaaaggatttgggtttagatgaggacaccactgatggaaatggttcaagaaaagtaatgattgttaaggaaggggcaggtagtgttcaagcactgcttggtaagaagggattcgttttggctagtttccatttttcattcatgattacacatgatgtttctactgccaataaaataaaataa

SEQ ID NO: 524 - DNA, 1330 bp, Zea mays
cgccgctgacttcctcaaccctatgcggccgacgccggcgctcgtcgccggtggacgcatggtaacaagcttcttatccgccactgaatggatgcttccgtctccggccacgcaagtccacaccatctccgtacttccctcccgtcgcgacttcgccttctccaacctcacgatgttgctcaggaatagcggcggcaacgagggagagagtggcagtactaagttccacgtagtacgggacgacctcctccacccgctcgccaacggcaacaaggcgcgcaagctcgacgccctcctgcccatcctccgccgctgcggcgttactgacatcgttacatgtgggggttgccagagcgcccatgccgcagctatcgcggttcactgtgccgaatggggaatcaggccacatatactgctgagaggcgagcaactggatgttcccacagggtataatctcatctcattgatgtttggcaatgtgacatatgtctctcggtctttgtatgcccaaagagacgagatgctttatgagcatgccataaaggttgcaggatatagtggcacagtgatgtgggcagatgaagttataggaaagggtttgggtgtagatgaggacaccactgatggaaatggttcaagaagagtgatgattgttaaggaaggggcaggtagtgttcaagcactgcttggtgtcatgcggctactgaagtatctttctggtttgacattatttagaaaggatgagaaagttcatatcgtggtagattctggaacaggaacaactgctgtggggttagctcttggagcggtatgtctaggactccagtggagggttactgctgttatgcttgctgacacacttgaaggatataaacagcgagagagatctcttttatctgattttgagaaggttttcccggaaatctaccatggaatggtggaagatgctactcatgacaatctagttcaatgggtggagcggttttcacctagaagatttggcaaggtgctggatggtgaaatcgcaatgtgccgccaggtagctcaacagaccggtatcctgctggatcctatgtataccttggctgcctgggagcaagctgttgatatatgctgtggagacagtgaagccaaagtcttgatgatccatacgggtggcacccttggcctttttggattggcacaaaggtattcatcacagttcaacacaggcgaacaaccttaggcatgtgcaatgatgatgttcaaatgttacggtttgtgggtatggactatggaatgtgatctttgactttgaataatcaaaagtagaaagaggtggggctttgtt

SEQ ID NO: 525 - DNA, 2674 bp, Oryza sativa Japonica Group
atgcggccatcgccggcgctcgccggcggcggcaggacggtcgcaaatcttctctccgccacggagtggatgcttccttctccggccacccaagtccacaccatctccgtcctcccctcccactcaccgccgtcccctcctcaccacttcgcgttctccaacctcaccaccgcgcctaagcgcaacggaggcaagggggaagaggagggccgcccaaggttcgaggtggtgcgcgacgatctcctccacccgctcgccaatggcaacaaggcccgcaagctcgacgccctcctgccgctcctgcgccgccgcggcgctactgacgttgtccgtgctcaccgttgcattccccttcacccagccttgatcacatcttgtttttcaaatctgatggtatcttcactgttctggacttcggattgcaggtgacttgtgggggttgccagagcgcccatgctgcggccactggtgagatatggattacccattttgtttttcttcattccacttgaatctgtgtgtaatttccagttcattctttacatgagctatgaccttataagccttggtaaacgatcccaatgcatccctgcaaaattgctctctaggtcatgcagatttgtcccttgattagcgcgctgatatagtgaatgtgctgcttttctttcttgaattcggttgagtccaacgaaaatgttgctttgctcatagcattcactttttttttttcatttactgcattagcggtccactgtgctgagtggggaatgaggccacacatattgctgagaggtgaacagccagatatcccgacaggctacaatcttatctctttgatgtttggcaatgtggcttatgcctctcggtcagtgtacgcacacagagatgaaatgctttacaatcacgccagaaaagttgcaggcacaggtggtacagtgttgtgggctgatgatattagcaaagaggattttgttttagatgaagataatggttgtgaaattggttcgagaagagtagttattattaaggaaggggctggtgacgtccaagcattgctaggtaagtaatggactgtttttgccctgaactcctgattttagttccgttcatcagtaaaaataaattttcgacaacagaataatctaatacccataacttagaatgcatgtgtccttgtattgctatatttgcttataggttgaaaattttcactttgagtattaggatcagggcagtcaattttgctttcacagtatgttgttttcttattcacttgttaatctgaaacctttaacttgggccccaaagaaaagggaatcttgcatatttcacatggctttgttgtaccttcaggtgttattcggctagtggagtacctttacaatctgtcgtcatttcataaacatgagaatgttcatgtcgtggtagatgctgggacaggcacaacagctgtggggttagctcttggagcggtatgtctagggtgcgtttgttaatactacttgcatattatgctgccagaataaattgagagttatcattacagcttttgtacactttgaacttttgagagtttctaatggtattacaggtatcatgattttccatttcttttatataaaggctttgttgttggagatacttttggaatatctaaagcacaacaatgagaacagttcttgcacttgatctatcaaagaaaaattgggataaattaatgtctctgatgacaaatgtggtgcattttaacttggtcaagcaatactaattaaaaatcgtgtcaatcaaaatgttcatcacctagtatttccatgtctatgttgttgctttctccatccatctttgctagagatcacagtttttctcacgatccttgcagattgcattggagagtaactgctgtcatgcttgctgacacactcgaaagatataaagaacgagagaagtccttaatatctgactttaagaagctttgccataacaactaccatgaaatggtgggagaaaatgatattggtgacagtttagttgaatgggtggaacgattttcaccaagacggtatgcttcaatcaattaatttaatatgctgcattttactgagcattcattttattcaatacatgctgctttctcaagtgtttctgcaatacaatgttgtcttgggtcattttcaaggcatgtcactataaattacagaacattctggacgtattcatgattttgtaatttgagggtgttcatttactaagtactagtttccttattagtatctagtaattttcttggtaatattatagtcggcggttgaagtggacttgatgttctgattattatttgttttggtgaataattatgtccttctcatgcctttagttcttgctattagaatctttagaatttgcgttcgaatactgatttttcttggggcctttttttttttgttcagatttggcaaggtgctgaacggtgaaattgcattatgccgccagattgcgcagcaaactggtatcctgttggatccaatgtacaccttagctggttgggagcaagctgtggatctatgtgttggagacagtagaaccaaagtggtgatgatccatacgggaggaacgcttggcttctgcggattggcgcagcggtactcatcgcacttcacctcggatgagcaaactt

SEQ ID NO: 526 - DNA, 1523 bp, Hordeum vulgare subsp. vulgare
tgagctttcttccgtgtcagcgtctcgccggttcaccatcggtcaagctgcagccgtctcccgccgccatctcctcatgcggccagcgccggtgctcgccgccggcggcaggacgctcggaaacattctatccgccacggagtggatgctcccctccccggccacccaagtccacaccatctccgtcctcccctcccacgcaccgtcccctgctccccagttcgccttctccaacctcaccaccgcgttgaggagcagcggcggtaaaggggacgagcaggggaccccgagattcgacgtgctgcgggacgacctcctccatccccttgccaacggtaacaaggcccggaagctcgatgccctcctgccgctcctccgccgcctgggtgccaccgacgtgataacatgcgggggttgccagagcgcccatgcagcagccgtcgccgtccattgtgcagaatgggggatcaggccacacctactgctgagaggagagcagctagacgtgccgacaggctacaatttgatctctttgatgtttggcaacgtgacctatgcatctcggtcggtctatgcacatcgagatgagatgctttatgagcatgccaggaaggttgctggtaacagcggtaccgtgctgtgggctaatgatattgtcagagataatttagcagtggatgaagagactgtccttgaaaatgattcgagaagggtggtgattattaaggaaggtgctggtactgttcaagcgttactaggtgttatgcgactagtggagtacctctctaatttgtcgtcatttcataatgatgaggaagtccgtattgtggtggatgctgggacaggaacaacagctgttgggttagctcttggagcggtatgtctaggacttaattggagggttactgctgtcatgcttgctgatacacttgaaagatatcaagaacaggagaagtccctgatatctgattttaaggggctttgccatgaagacttccatgacttggtcggaacagatggtctggttcactgggtggaccgcttttcgccgagaagattcggtaaggtgctgagtggcgaaatcacgtcgtgccggcaggtcgctcagcaaacgggcatcctgctggatcccgtgtacaccttggcagcgtgggagcaggccgtggatctgtgctgcggagacggtagaggggccaaagtggccatgatccacaccggcggaacgctggggctgttcggattggcgcaaaggtatcccctacactttggcgcgactgcgaacgagcaagcttgagcagaccaacaggtgtatcacctggcgagggtcacacgcacacacttgatccgggctgggagactggatggcgtcatcgactgcgggtgactgagggttaagttgagggccagcttctgtaagtgagagggtctgggatgtactgacggagtcaatccaagctgtatgcaaaagcagaaaatgtgtaactgaagaattgttttatttatcactggctctctttcgttct

SEQ ID NO: 527 - DNA, 750 bp, Sorghum bicolor; identical to SEQ ID NO: 523

SEQ ID NO: 528 - DNA, 1665 bp, Zea mays; identical to SEQ ID NO: 522

SEQ ID NO: 529 - DNA, 1708 bp, Sorghum bicolor
gcaaattagcaaatccgcacgcatttcacatacacaaaatatacagctcctcagctccacattgatcatttggccgttatatccagcgcggataaattaatccttgtcttcatcgctccatcgtcgtcgtctgaccgccgcccgccgtcgccgtgaccatcaacaatcaggctagctatagctcctgctgcggcctctgcatcgatcgccggcgccgcgactgccgggggagccgcgcgcggatcgtcgtcgatcggagccacacaagtacgcacagacatggctaagctcaaggcggcgcgcgccaccgacgtcccgtccgccttgccgccggagccggacatcgccgcggacctcgacggcctagcagccgccgcgtcctcgtgctcgtgcatcagagcgggcgcggcggaggcgacgacgacggcagccgagggacggccgctggtggtgatagggcaccgcggcaaggggatgaacacgctggtgtcgccggacccgcggctgcgcggggacgtcagggagaacaccctccgcgccttcaacgacgccgccgccagccaccccgccgtcgcctacgtcgagttcgacgtccaggtgaccaaggacggctgccctgtcatcttccacgacaacttcatctacacccaacaagacggcgaaatctcagggaagcgtgtcaccgaccttgacctggacgaattcctctcctacgggccacaaagagagcaggggaaggccggcaagccacttttccggaagctcaaggacgggaggatcctcaagtgggacgtgcggtccgaggacgccctctgcacgctgcgtgaggtcttccatggcgtccaccgccgtgtcggcttcaacgtcgagctcaagttcgacgacgacctcgtctacacggaggacagcctcacctgcatcctacaagccgtcctcaaggttgtcttggagcacgccggcgacaggcccatcatcttctccagcttccagcccgacgccgcgcagctcatccgcaagctgcaagacaagtaccctgtgttcttcctgacgaacggagggacgcaggtgtacgccgaccagcgccggaactcgctggaggaggccgtcaagctgtgcgtcgccggcgggctgcaggggatcgtgtccgaggtccgcgcgatactcaggcagccgtcggcggtggccgagatcaaggacgccaacaagctgtcgctcatgacctacggccagctcaacaacgtgccggaggtggtgtacgtgcagcacctgatgggggtggacggcgtcatcgtcgacctggtgggggagatcgccgaggccgtgtcggcgttcacggtcacggccgtgcaggcgtcggggtcccaggatggcggcggcggcgtggtgggcgagaggatggagacggccgccgccctggcggtggcagcagggacgacgccgagcttctcgccgcgggagatgtccttcctgctgaggctcattcccgagctagtgcagtagcgtggtgttgttgctggcggaatttctgccaaggattgacccggcccatttgtagatttatcaaccagcgtcgttgacttcttttttttctttttgtctgtcaactgaaatcgaaaaggttgtaggttgcatttgtaatatcccctgtacatgaattagaaacactgtagcttgcatcagtgaaatctgtagtcctctctgttatccg

SEQ ID NO: 530 - DNA, 1661 bp, Zea mays
gctccgaagagtacctcccgtgtgtataaatagccagctgtcctcgctcggcgcctccacaaattagcaaagccgcgcgcattacattacattacatacaaacatacacagtttggccgttaattagccagcgctgacaaattaaccctcgtcttcgtcgcctgacccgccgccgaccgccgtacgtgaccaccaaccaggctatagagctacctccagccgccggcccgcgcgtcgtccgccgcggtgtacgtacgtctgccgcggagccacgcgcgcggacatggctcagctgaaggccgcgcgcgccaccgacgtcccgcccgccatgccggacccggacccggacgtcgtcgccgccgacctcggcgcgtgcgtacggcacgggcgcgttgacggtttggcagcaggaagcggcagggcggaggcgacggcgacggcgacgaccaccgcggcggcggccgatcagggacgacgacggccgccgctggtggtggtagggcaccgcggcaaggggatgaacgcgctggcgtcgccagacccgcggctgcgcggcgacatcagggagaacaccctccgcgccttcaacgccgccgccgccagccaccccgccgtcgcctacgtcgagttcgacgtccaggtgaccagggacggctgccctgtcatcttccatgacaacttcatctacacgcaacaagacggccaagtctcagcgaagcgtgttaccgagctgaacctggacgagttcctgtcctacgggccgcaaagagaccaggggaaggccggcaagccacttctccggaaactcaaggacgggaggatcctcaagtgggacgtgcagtccgaggacgcgctctgcacgctccgtgaggtcttcgagggcgtccaccggcgtgtcggcttcaacgtggagctcaagttcgatgacgacctcttctacacggaggagaggcttacctgcatcctaaaatccgttctcaaggttgtcttcgagcacgccaacgacaggcccatcatcttctccagcttccaacccgatgccgcgcagctcatccgcaagctgcaagacaaataccctgtgctcttcctgaccaacggagggacgcaggtgtacgccgacccgcgtcggaactcgctggaggaggccgtcaagctgtgcgtcgccggcgggctgcaggggatcgtgtcggaggtccgggcgatactcaggcagccgtcggcggtggccaagatcaaggaggccaacaaactgtcgctgatgacctacggtcagctcaacaacgtggcggaggtggtgtacgtgcagcacctgatgggggtggacggcgtcatcgtcgacctggtgcaggagatcgcggaggccgtgtcggcgttcacggtcgttacggccgtgcaggcgtcgggctcccaggacggcggcggcatcgtggtcggcgagaggatggagacggctgccgtggcggtggcagggacgccgagcttctcgccgcgggaggtgtccttcctcctgaggctcattcccgagctagtgcaatagcgcgttcttgctgctttgctggcggaatctcgcgacgagatcctctgtatccgtagagttaggtcactaacgtgtgaatccggcctttttgtttgtcaactgaaatcgaaaaaggttatgggtt

SEQ ID NO: 531 - DNA, 1447 bp, Zea mays
cgcgcgcattacattacattacatacaaacatacacagtttggccgttaattagccagcgctgacaaattaaccctcgtcttcgtcgcctgacccgccgccgaccgccgtacgtgaccaccaaccaggctatagagctacctccagccgccggcccgcgcgtcgtccgccgcggtgtacgtacgtctgccgcggagccacgcgcgcggacatggctcagctgaaggccgcgcgcgccaccgacgtcccgcccgccatgccggacccggacccggacgtcgtcgccgccgacctcggcgcgtgcgtacggcacgggcgcgttgacggtttggcagcaggaagcggcagggcggaggcgacggcgacggcgacgaccaccgcggcggcggccgatcagggacgacgacggccgccgctggtggtggtagggcaccgcggcaaggggatgaacgcgctggcgtcgccagacccgcggctgcgcggcgacatcagggagaacaccctccgcgccttcaacgccgccgccgccagccaccccgccgtcgcctacgtcgagttcgacgtccaggccggcaagccacttctccggaaactcaaggacgggaggatcctcaagtgggacgtgcagtccgaggacgcgctctgcacgctccgtgaggtcttcgagggcgtccaccggcgtgtcggcttcaacgtggagctcaagttcgatgacgacctcttctacacggaggagaggcttacctgcatcctaaaatccgttctcaaggttgtcttcgagcacgccaacgacaggcccatcatcttctccagcttccaacccgatgccgcgcagctcatccgcaagctgcaagacaaataccctgtgctcttcctgaccaacggagggacgcaggtgtacgccgacccgcgtcggaactcgctggaggaggccgtcaagctgtgcgtcgccggcgggctgcaggggatcgtgtcggaggtccgggcgatactcaggcagccgtcggcggtggccaagatcaaggaggccaacaaactgtcgctgatgacctacggtcagctcaacaacgtggcggaggtggtgtacgtgcagcacctgatgggggtggacggcgtcatcgtcgacctggtgcaggagatcgcggaggccgtgtcggcgttcacggtcgttacggccgtgcaggcgtcgggctcccaggacggcggcggcatcgtggtcggcgagaggatggagacggctgccgtggcggtggcagggacgccgagcttctcgccgcgggaggtgtccttcctcctgaggctcattcccgagctagtgcaatagcgcgttcttgctgctttgctggtggaatctcgcgacgagatcctctgtatccgtagagttaggtcactaacgtgtgaatccggcctttttgtttgtcaactgaaatcgaaaaaggttatgggtt

SEQ ID NO: 532 - DNA, 1864 bp, Zea mays
caccaccgccgtcctcgcgacggcacagacggacgcactcgcgcgcgcgcatacatttacgcagcgaggagctcgaggacgacccccacagcaagcagcgatggcgcacgacggctttctcgggggattccacgagctttcctggcctcttgttcatgctgcagccgccggcgccgcgccgttcgatcccctgctggtacatgtgccgcacgcgcttatgggcgccggtgcggggtggcaacacgaggctgcggtgggcgcgatcgtgccgtcgcagtcgcagtcgcaatcgccaccgccaccgccatcgtcgctcgcggcggccgccgtaggaggagcagatgccgttgaggccgccatgatggagcagctcgcgagcaggctcggcgtcagcgtcccgtcgccgccgtcatcgcggtacgtgtcgtgccacagtacgccggtggcgccgtgcgtgctcgccggggacgcggagcgcgccgaaagactgtcgtgcttcccggcctccggtaggaagctctcgcgcgtggccagcagccagtcgcttctccgcgaacaggctccggcgcccgcgcccgcgccctcgcctggcgctgctgctaaacagcacgcgggcgatggggcgtgcgatggcccctgccgcaagcggaaggcgtcgggcacgagcagcaagcagtccaaggccaaggaagcggtcaccacggctccacccgagtcccgggagactgcagagacgagggccaagaaatgcaagctctccacggacgaggagcggaagccggcggccggagagggatggcgtggcagtggcaagggtaaggagctggtggcggcggatgcggagccacccaaggactacatccacgtccgcgcgcgccggggccaagccaccgacagccacagcctcgccgagcgggtgaggagggagaagatcggcgagcgcatgaagctactgcaggacctcgtgccgggctgcagcaaggtgaccgggaaggccgtgatgctggacgagatcataaactacgtgcagtcgctgcaacggcaagtagagttcttgtcgatgaagctgtcgaccgtcaacccgcgcctcgaactcggcgcggacgacagcttcgtccccagagacgacgccaacaagatgtgcgccgccgcgacgtcctccatctccatggcacagcagccactgccactgccagcagcctaccacgcgctcgagggctcgagcccggcgttctgctacaccaccacgcccccagctcccggcaccgccgcgcggctgggcgttgctgcgtcggacgccaaagccttcgaaatggctcctccttcgtcggcggccaccgtgaaccacgccggcaccgcggagcggcggccactcgaaggacctgctgatgagaacgcgagtccccagatgggggggaggagcttgtgggaagagggcgatgatgatctgcagagcctagtcctgatgggattccgggggcgacacgtgatcattggcggcccgatctgattggcggacggacggacggacggacagttcagtttcaccgatcgccacatgacgacggcaggggttaggctccaatcattggacattctccatgattgtacatagcaacaggactgtcacacgctaatcgcctcacacttgagtttccagctcagcagtagcagaggccaagaaaacacacacacacacacaaaaaaaaggcgaaaagaagacgctttgtttgttgcattgcgtttgggcccccgcacgaatttgcagtttgatctaatgtaatgtaatgtaatgatgcttatactctcataaacatcaagttgacgaaactttatatacatgtgaggcaacagctgctggacg

SEQ ID NO: 533 - DNA, 1671 bp, Zea mays
gttttcaggtctgttggcccctagctcctcgtctgcttgccggaccgccgctttttggtgcgacttccacatcttgtcctgacggggatcgctggtttcttcctccagagatcgcatccctggtccgcgggatccgatgagatgcgtgggtactcccgcagtccgaactcgtagcaggcatggctgaagcggccgcatcttcgtcttcgtccggatcctgcgccccgcgccgcctccatggcgccggcatcgtcagggacgcgctcacgtacaatggcctcgccgcactcccgccgcctctgccgccggcgcaggtgcaggttacggcttacggcagcggcggcggcggaggaggaggaggaggaggaggagggaagattagccccgcggtgcttttcatcatcgtgattctcgcggtggttttcttcatctccggcctgctccacctcctggtgcgtgtcctcatgaagaagcagcgccgccgagggggcacggcgtcagcagcggcgcgggggtctggaggggagggcggcggggcggacgctgcgttgcagcggcagctgcagcagctgttccacctccacgactccgggctggaccaggccttcatcgacgcgctgccggtcttcgcctaccgcgagatcgtcgtgggcggcggcggcgacggggacaaggagccgttcgactgcgcggtgtgcctgtgcgagttcgatgccgaggaccggctccggttgctgccgctgtgcgggcacgccttccacctcaattgcatcgacacgtggctgctctccaactcgacctgcccgctctgccgcggggtgctcttcgtcccggggctcatgggcgaggacagcccgatgttcgatttcgaggagggcctggaggaagggcggttgtccgaggactgtgacgacggatttggattgcctgggcggaaggcttcagggttggcacagacaccggtggccgagaagaaggtattccctgtgaggttggggaagttcaagaacgtcggaacccatggtgcggtggaaggtggcaatgccaatgccaatgctaatcccagggtgttgactagggatgaaggggagagtagcagcagcaggttggatggaaggagatgcttctccatgggcacctatcagtatgttcttggcacatctgagctccgggtagctctccagcctggctgtatccggaatgacactggtggtgcaatgaggggaatgcctcctggtttaagttcaatcaatgctgatattatggaggggaagaagatctgtgcacgcaacaaaggggagagtttctccgtgtctaaaatttggcaatggtctaatcttaagggcaagctacctgctggttctgatgaatgttcggatgctgggagccttccatggatgaagaaaggaggtgctgtggatacatcgaacttatgactctctgtactggtataatgtgatagtggcctttctttagttagtgttgctcaccgaagttcttacctgtagtcatttttcttatctagttttcatgtgctgattttgattggagtgccaacctcattggggggcttaacttttggtgatcttgccatgttagtatgttgcgccatgtacattgtgatgacctagaatgatctgattctggtctgccttaaaaaaaaaaaaaaaa

SEQ ID NO: 534 - DNA, 1793 bp, Zea mays
ctccacacagtgcagggctccaggcttccctccctcccctccacggcttcgctcgctcacccgccctcctgctctaagcccaaagctcccgtcccgagggcttcaggtcttggcccctactcctcgtccgcttcccgggccaccgcttttaggtgtgacttcctcatcatctgccctgacggggatcgctggtttcttcctccagagatcgcatctctggtccgcgggatccgatgagatgcgggggtgctctcgcagtccgacctcgtagcaggcatggctgaagcggccacttcttcgtcttcgtccggatccttcgccccgcgccgcctccatgacgccggtgtcgtcagggaatcgctcccgtacagtgttctcgctgcacccccgccgccgcctctgcctccggtgcaggtgcaggttgcgggttccggcggcggcggtggagggaagattaaccccgcggtgcttttcatcatcgtgattctcgcattagtgttcttcatctccggcctgctccaccttctcgtgcgcgtcctgtcgaagaagcagcaccgccgcggcggcccaagggacacggcgtcggcggcggcgccgaggactggagtggaggcaggcggggttgacgtggcgttgcagcgccagctgcagcagctgttccacctccacgactccgggctggaccaggccttcatcgacgcgctgccggtcttcgcgtaccgggatatcgtcgtgggcggcggcggcgacggggacaaagagccgttcgactgcgcggtgtgtctgtgcgagttcgatgccgaggaccggctccgtctgctgccgctgtgcgggcacgccttccacctcaattgcatcgacacgtggctgctgtccaactcgacctgcccgctctgccgcggggttctcttcatccccgggctcatgggcgagggcaaccccatgtttgatttcgaggagagactggaggaagggcggttgtccgaggactgtgacgacggatttggattgcctgggctgaaggcttcagggttggcacagacaccggtggctgagaagaaggtattccctgtgaggttggggaagttcaagaatgtcggaacccagggtgcggtggaaggtggcaatgccaatgccagtgtgttgagtagggatcaagtggagagtagcagcagcagcagcttggatggaaggagatgcttctccatgggcacctatcagtatgttcttggcacttctgagctccgagtagctctccagcctggccgtattagaaatggcactggtggtgcaatgatgggaagacctcctggtttaagttcgatcaatgctgatattatggaggggaagaagatctgtacacgcaacaaaggggagagtttctctgtgtcgaaaatttggcaatggtctcatattaagggcaagctacctgctggttcggatgaatgttcggatgccgggagccttccttggatgaagagaggaggtgctgcggatacatcaaacttatgactctgcactagtgtaatgagcctttctttagttagtgatacccacctaattttcacctgtagtcatttttcttatctaattttcatgtgctcattttgattggagtgccaacctcattgggggcttagcttttggtgatcttgccatgttagtatgtttcaccacgtagaattgtagattgtgatgatttatttgatctgattctggtctgcctaatgttttgtgttgggtctgatgtatcatttattcctccatccaaaattatattggtcattgtggct

SEQ ID NO: 535 - DNA, 1453 bp, Zea mays
ggccgcatcttcgtcttcgtccggatcctgcgccccgcgccgcctccatggcgccggcatcgtcagggacgcgctcacgtacaatggcctcgccgcactcccgccgcctctgccgccggcgcaggtgcaggttacggcttacggcagcggcggcggaggaggaggaggaggaggaggaggaggagggaagattagccccgcggtgcttttcatcatcgtgattctcgcggtggttttcttcatctccggcctgctccacctcctggtgcgtgtcctcatgaagaagcagcgccgccgagggggcacggcgtcagcagcggcgcgggggtctggaggggagggcggcggggcggacgctgcgttgcagcggcagctgcagcagctgttccacctccacgactccgggctggaccaggccttcatcgacgcgctgccggtcttcgcctaccgcgagatcgtcgtgggcggcggcggcgacggggacaaggagccgttcgactgcgcggtgtgcctgtgcgagttcgacgccgaggaccggctccggttgctgccgctgtgcgggcacgccttccacctcaattgcatcgacacgtggctgctctccaactcgacctgcccgctctgccgcggggtgctcttcgtcccggggctcatgggcgaggacagcccgatgttcgatttcgaggagggcctggaggaagggcggttgtccgaggactgtgacgacggatttggattgcctgggctgaaggcttcagggttggcacagacaccggtggccgagaagaaggtattccctgtgaggttggggaagttcaagaatgtcggaacccatggtgcggtggaaggtggccatgccaatgccaatgccaatgccaatgctaatcccagggtgttgactagggatgaaggggagagtagcagcagcaggttggatggaaggagatgcttctccatgggcacctatcagtatgttcttggcacatctgagctccgggtagctctccagcctggctgtatcaggaatggcactggtggtgcaatgaggggaatgcctcctggtttaagttcaatcaatgctgatattatggaggggaagaagatctgtgcacgcaacaaaggggagagtttctccgtgtcaaaaatttggcaatggtctaatcttaagggcaagctacctgctggttctgatgaatgttcggatgctgggagccttccatggatgaagaaaggaggtgctgtggatacatcgaacttatgactctctgtactggtataatgtgatagtggcctttctttagttagtgttgctcaccgaagttcttacctgtagtcatttttcttatctagttttcatgtgctgattttgattggagtgccaacctcatcgggggcttaacttttggtaatcttgccatgttagtatgttgcgccatgtacattgtgatgactt

SEQ ID NO: 536 - DNA, 1814 bp, Hordeum vulgare subsp. vulgare
gagcgattcccaccgcaatcctccgtctcctccccgcatccccgccgtgtccacctgcccgccatccgaccggaggaagcctccgggggttctcttggtccctagcgccttggacgcttccccccgggctgcaccagcccgccgcttttaggtgccgtccggcctccgcttttgcgtcccttttcggacgggattgctgccggtttctcgcgaaagatcgcatctcttgcctgccggatcagatgagatgcgggggtgccggtgcctctaggagacatggctgaagaagcggtctcgtcctcgcccggatcctccgcggtgacggcggtggctgcgtacccctacccgtaccgagtggcgcgcagcctccatggcgccctcgtcgtcagggacgagctcccctactcgtaccccgctgctgccgctgccgccccgccgccacccgcgcaggtgcagcagggctcctccggcgggggaggcggcaagattagccccgcggtgctcttcatcatcgtgattcttgcggtggtgttcttcatctccggcctgctccacctcctcgtgcggctgctcatgaagaagcagcaccgccgccgagggggctcggcggccgcggcggcgcaggggcccggggaggccgacgcggcgctgcagcgccagctgcagcagctgttccaccttcacgactccggcctggaccaggccttcatcgacgcgctgcccgtcttctcctaccgggagatcgtcgtaggcggcggcggcggcgacaaggagccctttgactgcgccgtgtgcctgtgcgaattcgacgccgaggacaggctccggctgctgccgctctgcgggcacgccttccacctcaactgcatcgacacatggctgctgtccaactcgacctgcccgctctgccgcggggtgctcttcgccccagggctgacagccgagaataacccgatgtttgatttcgatgaggggttggaggaagggcggctgtcggagtgctgcgaggatggtttcggattgcccacgcagaagtcctcggaggggttgcaggagccggcggccgagaaaagagtgttcccggtgaggcttgggaagttcaagaatgtcggcacccagggtgctgttgaaggtggaaatgccgattctgctgtgctgaggagggaggaaggggagagtagcagcagcagtttggatgcaaggaaatgcttctctatgggcacttatcagtatgttcttgggacttcagaacttcaggtggctctccagccgggccgagctagaaatggtggtgcgatgagattaagacctccgggaataagttgtgtcaatgcggacattatggagggaaagaaaatttgcgcacggaacaaaggggagagcttctccatgtcgaagatttggcagtggtctaatctcaagggcaagttacctgctggctcagatgattgttcagaagcagggagccttccatggttgaagagaggtggcactggggataaattgaacatgtgatgtgactctgtactgtgatactagctaatatttctcttcttagtgccactccattaatttcttacctataattattctagtctaattttcatattcaggttttaattggaattggttaatctcatggggagataagttttccgtagtcatgccaccttactctattgcgccaatttgtgatagcttacagatcatgtgatttctgctgcatgctgctttgtttatgttcttgtatcggtttgaagctaccttcatattcctgaaactttccttccaagaatgctcaaagtaaagttagc

SEQ ID NO: 537 - DNA, 1668 bp, Oryza sativa Japonica Group
atcacatcacgcggcctcctcctcctccaccaccgccgcgccgtcgcgttcgccttttttcctccttcccggacctcgtgcgctcccaccaccaccaccccgcggcttcgctcgcgccaccgccactgattcgccggagagttgctgttcccttcgtgatttcgtcggcggtggcggcggcgggggtggtctcctgttgctgtacagaccagcatcgttggggggaatcggatgagatgagatgagatgagatgcgggggtggtggtgatggaggcgctctcccggaccgagcgtgtaggaggaggaggtggagccatggttgaagtggccttcgcttcgtccgccggatcctccgccgcggccccgcgccgccttcgtggggagctcgtcgtcagggacgctattccgtatgccggggtggctcctccgccgcccgcgctgccgctgccgcagccgcagctgcagccgcaggtgcaggctacgacgagtgggggcggcggcggggggaagattagccccgcggtgctgttcatcatcgtgattctcgcggtggtgttcttcatctccggcttgctccacctcctggtgcggctactcatgaagaagcagcatcgccgcggaggaggagggggtgcggcggccggggtgtcgcggtcggccgccggggatgacgcggggggaggaggggacgcggcgctgcagcggcagctgcagcagctgttccaccttcacgactccgggctggaccaggcgttcatcgacgcgctgccggtgttcgcctaccgggagatcgtcgtgggcggcggcggcgacggcgacaaggagcccttcgactgcgcggtgtgcctgtgcgagttcgacgccgaggaccgcctccggctgctgccgctgtgcgggcacgccttccacctgcattgcatcgacacatggctgctgtccaactccacctgcccgctctgtcgcggggtgctctttgtccctgggctcacggagaacaatccgatgtttgatttcgatgaggggttggaagaagggaggctgtctgaagattgcgataacggattcggatatcccgggcacaaggctacggaggggatgcagacgccagggactgagaagagggtgttccctgtgaggcttgggaagttcaagaatgtcgggacccagggcgctgtcgaaggcggtggcatcggcaatgccaatggtgctgtcttgaggagagaggaaggggagagcagcagcagcagcttggatgcaaggagatgcttctcaatggggacttaccagtatgttctagggacctcagagctcagggtgtctctccagccagaccgaattagaaatggcggcggcggtgtgacgagggcaaggccgacagggttaagctctgtcaatgctgagatcatggaggggaagaagatatgcgcacggaacaaaggggagagcttctctgtgtcgaagatttggcagtggtctaatctgaagggcaagctacctactggctcagatgaatgttcggaagcagggagccttccatggatgaagagaggtggcattggggatacatcaaatatgtgactgtagtctgtattatgatagtggctaatcttttctcttgttggtgctgctcacttaatctcttacctatagttatcttgacttttttc

SEQ ID NO: 538 - DNA, 783 bp, Zea mays
ggctgcagctacctgcttgcttgctagctagctccaaacagaccgatagatacaacccccggcccttcacatcatcagtccacacacccaacccaacaagcgagtcacgactgaagctgcagcctaatagctagccgctagcctagcagtccaatgagaaggcacggcgccagcgaggcctccccttccatcatccacacgtcctccatagctctcctccaggagaggttcagaaacctgcagaaggtgaaggagatgagggaaggcagggagctgcagagggtgcacgctgctgatactactactaccaccaccaaccgcaccgcttcgtcgccgtcgtcctcgtcgtccctgtcgtcggctctcagcctcggcctccaacaggccgccaacgccaacgaccacccgaggtggttcttgcacccggacttgatccggccgtccaggccgctgcgcggacacgcgtgccacggcctcggcgccaccggtggtggtgtcgtcgtccagacgacgtcgccgccgccactaccgccgagctcatcgtggggaggagcgcagaattcgggctataggactgatatagatgtcgatacctcgctccatctgtaatctcttctataataagcacgtatggccgtgctgttctttcgttgcttttttttttggtatggcttgtcagtttcccggccttatttgcagctagctagcactacgtacttcttctgtcgtctcgcggcctgccttgtaactgcttgggtacttttactatatatgaggcttcct

SEQ ID NO: 539 - DNA, 405 bp, Sorghum bicolor
atgagaaggcacggcggcagcgaggcctccccttccatcatccacacgtcttccatagctctcctccaagagaggttcagaaacctgcagaaggtgaaggagatgagagaaggaagggcgttgcagagggtgcacactactgataccgaccgcaccggttcgtcgtcgtccctgtcgtcggctctcagccttggtctccaagccgccaacagcaacgagcagccgaggtggttcttgcacccggacttgatccgtccgtctaggccgctgcgcggacctgcgtactaccatgggcttggcgccaacggtgtccagacgtcgccgccaccggcgagctcatggggaggaatgcagaattcaggctatagggctgatgtagatgtcgatacctcgcttcatctgtaa

SEQ ID NO: 540 - DNA, 1855 bp, Zea mays
agtctctaggctctggagacctcgcgcaccatcccaccagcagcaagcgcccactaattccgcaccacaacgcgcactctccggcaccaccgccgtcctcgcgacgtcacatagtacgcattacgcactcgcgcgcgcgcgtgcgcgtacatttacgcagcgatgagctcgagaacgcaccacccctgctttgcgtctgtggagtcatgggagcaagcggcgatggcgcacgacggcttcctcggcgatcttgcctgcccgctcccgctcgctcacgctgcaaccgcggcgccgttcgacccgctgcgggtacatgtggcgcacgcgctcacgggcgccggcgcggggtgggaacacgacgccgcgacgggcgcgctcgtgccgtcgcggccgcgaccgctgtcgccgtcctcgctcgcggcggccaccgccgtagtagttggaggaggaggagacgccgtggaggccgcgctgatggagcagcttgcgagcaggctcggcgtcagcgtgccttcgccgccgccatcgcggtacgcgtcctgccacggcacgccggcgggctccccctccaagtcggcggcgccgtgggtgctggccggggacgcggcgcctgcggagcgcgccacagggctcccgtgcttcccggcctcctgtggggagctctcgcgcgtgcccagctgccagtcgtcgcttctcggcgagcacgcaccgactccggcgcccgcgccgttgcctggcgctgccaaacagcacgcgagcgacgggtcgtgcagcgatggcccctgccggaagcggaaggcgtcgggcggcaaggccaaggacgtggtcaccacggccacacccaagtcccgggagccggagacgatggccaagagacgcaagctctcgacagacgccgcccgcgacgaggctgggtcgcacgggaacggcaaggggaaggaggtggcgccggcggcagagccagagccacagccacccaaggactacatccacgtgcgagcgcggaggggccaggccaccgacagccacagcctcgccgagcgggtgaggagggaaaagatcagcgaacgcatgaagctgctgcaggacctcgtgccaggctgcagcaaggttaccgggaaggccgtgatgctggacgagatcataaactacgtacagtcgctgcagtgccaggtggagttcctgtcgatgaagctgtcgacggtcgacccgcgccgggagctcgacgtgggctgcttcgtcgtccccaaagacgacgtaacgatgcaggccaacaggctgtgcgcgcccgcgacgtcgtcgtcgagctcagccttctgctacgccgcgcggagtgttgttacgaacgccaaaggattcgagacgccgctgcccttggcgaaccatggcgtcgcggcggacgacaggccacttgagcggcggactcgagacgcaggtccccaggcggggagcttgtgggaagaggacgatctgcagagcctggtcctgatgggattccggggccgttgatcgttgacgctctgattaggctaggccgctagggacgacagttcgtttccaccgaccgccaaccaaagcgagagttgcagggccacgtaacagcagggttgggctccaatcattgggaactctccatgattgtacacagacaggacgcttacacgctaatttccagctcggcggaggccaagaaacgaaacaaaaaaaaaaggcgaaaagaagatgtttttttctcgcattccccctcacgaatttgcagtttaatcgatgtaagataactcaatgtaattattaatggtatttgagtcttatagacatcaagttgatgaaattttataccaaaaaaaaaaaaaaa

SEQ ID NO: 541 - DNA, 1447 bp, Zea mays; identical to SEQ ID NO: 531

SEQ ID NO: 542 - DNA, 1661 bp, Zea mays; identical to SEQ ID NO: 530

SEQ ID NO: 543 - DNA, 1708 bp, Sorghum bicolor; identical to SEQ ID NO: 529

SEQ ID NO: 544 - DNA, 1847 bp, Sorghum bicolor
gtcctggtctcagcttctcttctcttctcgtctccgtcttccggtcgccagggaggaaggagggagaggccagactgccgctagggttagggtttcggttgagaggggcagaggcggggctccagccatggcgctcaagttcctgaacaagaaggggtggcacacggggtccctccgcaacatcgagcgggtatggaaggcggagcaggcggaggaggcggagcgccgcaagacggaggagctcaagaagcaggtcgccgccgagaaggagaaggccgagttccgggccatgcaggagcgcgccggcctcaggccggcgcaggagaggctcgacttcctctacgagtcggggttggccgtcggcaagagctccgaagggttccaggcgctgcagcaatctgcaccgggggcagctgccgcgtccacttctgcacaggggagtgcggctgattcttccaaggcagctacaccaggagctttatttgaggataaaccccaatctgcaaatgatacatggagaaagctccactctgatcctctactcctaataaggcagcgtgagcaggatgcaattgcaaggattaaaaacaatccaatcaagatggccgagataaagaaatctgttgaagctgagaaaaagcaaaaagaagagaagaaagagaagaaaaggcacaagaagcatcgccaccataagtcaaagagtaagaggcatcactcagatgagaatttagattcagatgaagtaagtgatggcaaggatgagagaaggaagagggctcattcttctcttggccataagaaagaagagaacaggtccagacataagaagcagcacagagaagattcatcagattcagataacgatgaaccacagagaagaaagcaagatgcatcagaagatgatgaaccgaggagaagacagcaggatgacaatgaaccgaggagaagacagcgggatgacaatgaaccgaggagaagacggcaggacaacggtgaaccaaggagaagacggcaggacgacgatgaaccaaggagaagacggcaggacgacgatgaaccaaggagaagacggcaggacgacgatgagccaaggggaagacggcaggatgatgagaaaccaagggaaagaggctacgttgaccgtccaagatatgatcgctttgatgttgatgataggaaaaggagacatcattcacctccagactctaggcccaaaagagtggatgatagccacaaaactggaaattccacttctgaacaccattcccgctctgaacaaggctctggcgagcagacaaggcgagaaagtgaacatggcaggaacaagggtccttcattcaatcgtcgacggggtggtgtccaccatatgtcggaagaggagaggttagctcggctgcgccagatggaggctgatgctgaggtccatgaggagcagaggtggaagaggctcaagaaagctgcagacgatgatgctaaagaggcagcaactgtgaatgtgaaccagttcaaagggaaaaacttcttggaagatgaaaagaagagcatatttggaacagataaaggtggcagcgccacaattgaagagagcatcaggcgccgtgctttttactcccagggtggccgtgatgctgaaggcaatgccttcaggcggtgaatttcctgctgtattgttttgttgtttgcttgactcgtcttgccgtcgtgttcgtgttagtattgtacgtgaaaagttgagggctatgtacaacagctgttctcaataacaggaaatttatgttcaattttaaatttttgatgcagaatttggcttaaattgcacctaagaatgatagcctcggatttcatct

SEQ ID NO: 545 - DNA, 1835 bp, Zea mays
cctcgatctgaccttctcttcaatcgcatccgcccgcgtcgtctcgtcacccccgttgtggtcgcctgggaagaggagggaggccagcttgccgctagggttagggtttcgggcgggagggacagaggcggggctgcagccatggcgctcaagttcctgaacaagaagggatggcacacggggtccctccgcaacatcgagcgggtatggaaggcggagcaggcggaggaggcggagcgccgcaagacggaggagctcaagaagcaggtcgcggccgagagggagaaggccgagttccgggccatgcaggagcgcgccggcctcaggccggcgcaggagaggctcgacttcctctacgagtcggggttggccgtcggcaagagctccgaagggttccaggcgctgcagcaatctgcaccgggggcagctgccgcgtccacttctgcacaggcgagtgcggctgattcttccaaggcagctacaccgggagctttatttgaggataaaccccaatctgcaaatgatacatggagaaaactccactctgatcctctactcctaataaggcagcgggagcaggatgcgatttcaaggattaaaaacaatccaatcaagatggccgagataaagaaatctgttgaagctgagaaaaagcaaaaagaagagaagaaagcgaagaaaaagcacaagaagcatcaccaccataagtcaaagagtaagaggcatcactcagatgagaattctgattcagatgaaataagtgatggcaaagatgagagaaggaagaggtctcattcttctcttcataagaaagaagagaacatgtccaggcataagaagcagcacagagaagattcatcagattcagacgatgaaccgcagagaagaaagcaggatgtatcagaaaatgatgaaccgaggagaagactacatgacgacaatgaaccgaggagaagatggcaggatgacgttgaaccgaggagaagactgcatgacgacgatgaaccgagaagatggcaggatgacgttgaaccgaggagaagaagacaggatgatggtgaatcaaggagaagatggcaggacgacgatgaactaaggggaagacggcaggttgatgagaaaccaagggaaagaagctacgttaatcgtccaagatatgaccgctctgacgctgatgataggaggagacaccattcacctcgagacactaagcccaaaagagtggatgatggccacaaaactggaaattccacttctgaacaccattcccgctctgaacaaggctctggcgagcagacaaggcaagagagcgaacatgacaggaatagtggtccttcattgaaccgacgacgcggtggtgtccaccatatgtcagaagaggagaggttagctcgtctgcaccagatgcaggctgacgctgaggtccacgaggagcagagatggaagaggctcaagaaagctgcagacgacgatgctaaagaggcaacaactgtgaatgcaaaccagttcaaagggaagaacttcttggaagatgaaaagaagagcatatttggaacagataagggtggcagtgccacgattgaagagagcatcaggcgccgcgctttctactcgcagggtgggcgtgatgccgagggcaatgccttcaggcggtgaatatattgttttgttgtttgctgccttgttggactcatcttgccgtcgtgttcgttttattattgtacgtgaaagttgagaactatgtacaacaatttctcaataacagcaattttatatgcaacttcaaatttttgatacagaatttggcctaaactgcaccgaagagtgattgcctc

SEQ ID NO: 546 - DNA, 1191 bp, Zea mays
cttcctttcttcctcctgctatttagacggttctcaccggagctatcgcctccctatcatctcaatatgttgtagtgagtttgcctctatcccgcccacctcaccgtcgttgtctccgccaccgccactgctcccaccactgccatgcattaacctcaacccttccgcaaactattcactgtcactttgtcatcggcgctccatcgttcactcaaatgtggtctccgatacctggcaccctcatgaggactagttcactccctgctgtcattgaggcttctggcaatgatgactggaagaaacgaaaggaagcacagagcctgaagaggctcgaggttaagaagaagaggattgagaggaggaactctctcgcctgcaacacttcaaaagaagctgctgggcagagtccaaaagagatgaatgcaaacactgacaaattagtaagttctgatgaaactattgtcagcgctaacgaaagtcatagcagtggcaagcatctggtgaaggggcttccaccaaagtaccaggccacaattacatcagaagacagttcgtcagcaatgcgaaagaagccaaactcggccttcaaagccatcactgaggagcagaactcatcatcgtctgttccttcctccggtgaagctataagtagcgtgacggcaccaagtctgcctctgttgtctttggtccccataacagcaacccttggttccagggaagaccaaagcattttaggcagggctggtgcaagggcaaacggcatgggggacgtggaaaggaggatgatgcaggagatgccgggcgtgttcaccaagggcctgtccaacggcagcagggtcgaaggcttcctgtacaaatacagcaaaggagaagtgaggatcgtatgcatctgccatggaagcttccttactccttcggagtttgtggagcacgccggcgccggcaaggtagataacccgctgcgacacattgtcgtcagcgctaccccgaacctgtgactgtgaggccaggcagacccgtgcacaagctatagtgttctgtagactcaggacctgagcctagcgtcagagcaatgtcaccgttagactgtgtggtgcggtgcttatgcccgattaaattggtgggcattgtggtaacataacctgttgataatgttttgacaatgttttgatcaaaaaaaaaaaaaaaaaa

SEQ ID NO: 547 - DNA, 1114 bp, Zea mays
gtgagtttgcctctatcccgcccacctcaccgtcgttgtctccgccaccgccactgctcccaccactgccatgcattaacctcaacccttccgcaaactattcactgtcactttgtcatcggcgctccatcgttcactcaaatgtggtctccgatacctggcaccctcatgaggactagttcactccctgctgtcattgaggcttctggcaatgatgactggaagaaacgaaaggaagcacagagcctgaagaggctcgaggttaagaagaagaggattgagaggaggaactctctcgcctgcaacacttcaaaagaagctgctgggcagagtccaaaagagatgaatgcaaacactgacaaattagtaagttctgatgaaactattgtcagcgctaacgaaagtcatagcagtggcaagcatctggtgaaggggcttccaccaaagtaccaggccacaattacatcagaagacagttcgtcagcaatgcgaaagaagccaaactcggccttcaaaggaacagccatcactgaggagcagaactcatcatcgtctgttccttcctccggtgaagctataagtagcgtgacggcaccaagtctgcctctgttgtctttggtccccataacagcaacccttggttccagggaagaccaaagcattttaggcagggctggtgcaagggcaaacggcatgggggacgtggaaaggaggatgatgcaggagatgccgggcgtgttcaccaagggcctgtccaacggcagcagggtcgaaggcttcctgtacaaatacagcaaaggagaagtgaggatcgtatgcatctgccatggaagcttccttactccttcggagtttgtggagcacgccggcgccggcaaggtagataacccgctgcgacacattgtcgtcagcgctaccccgaacctgtgactgtgaggccaggcagacccgtgcacaagctatagtgttctgtagactcaggacctgagcctagcgtcagagcaatgtcaccgttagactgtgtggtgcggtgcttatgcccgattaaattggtgggcattgtggtaacataacctgttgataatgttttgacaatgttttgatccttcctatg

SEQ ID NO: 548 - DNA, 1487 bp, Zea mays
ctctctcctgttccccgcgagagtcgctcagggccgcgacgaggagaagcggcagcgcgtcacctctccaatggcatccccgtccctcctccgtgcaacctgtgcgcttctcgagtgctgaggctccctgtccctaagacaagcttgcgcgcgcgatggagggtttttcgagggacttgctgtgcgggattggcaagggggacgcgccgccaccggagaagaggccggggcagctgcgggaggagatggaggaggtggagcttagcctcgggctgtctcttggcggccgattcgggctcgacaggaaggggagcaagctcccccggtcgtcgtccgtggcggccatgctgacaacgccggtggaggtgccggcgccgccctccctctcgcgggcgagctcgctgccggtccaggcggaggcgtcggaagttgagaggaagcaggggctggatggatggggttcttgccgtgagggcggcggtctcggcgtgcaacacgcggcgaggctgccggcgagcgggaacccttcctctgcctcttcggcaccctcatgaggactagttcactccctgctgtcattgaggcttctggcaatgatgactggaagaaacgaaaggaagcacagagcctgaagaggctcgaggttaagaagaagaggattgagaggaggaactctctcgcctgcaacacttcaaaagaagctgctgggcagagtccaaaagagatgaatgcaaacactgacaaattagtaagttctgatgaaactattgtcagcgctaacgaaagtcatagcagtggcaagcatctggtgaaggggcttccaccaaagtaccaggccacaattacatcagaagacagttcgtcagcaatgcgaaagaagccaaactcggccttcaaaggaacagccatcactgaggagcagaactcatcatcgtctgttccttcctccggtgaagctataagtagcgtgacggcaccaagtctgcctctgttgtctttggtccccataacagcaacccttggttccagggaagaccaaagcattttaggcagggctggtgcaagggcaaacggcatgggggacgtggaaaggaggatgatgcaggagatgccgggcgtgttcaccaagggcctgtccaacggcagcagggtcgaaggcttcctgtacaaatacagcaaaggagaagtgaggatcgtatgcatctgccatggaagcttccttactccttcggagtttgtggagcacgccggcgccggcaaggtagataacccgctgcgacacattgtcgtcagcgctaccccgaacctgtgactgtgaggccaggcagacccgtgcacaagctatagtgttctgtagactcaggacctgagcctagcgtcagagcaatgtcaccgttagactgtgtggtgcggtgcttatgcccgattaaattggtgggcattgtggtaacataacctgttgataatgttttgacaatgttttgatc

SEQ ID NO: 549 - DNA, 1114 bp, Zea mays; identical to SEQ ID NO: 547

SEQ ID NO: 550 - DNA, 1487 bp, Zea mays; identical to SEQ ID NO: 548

SEQ ID NO: 551 - DNA, 1191 bp, Zea mays; identical to SEQ ID NO: 546

SEQ ID NO: 552 - DNA, 1114 bp, Zea mays; identical to SEQ ID NO: 547

SEQ ID NO: 553 - DNA, 1487 bp, Zea mays; identical to SEQ ID NO: 548

SEQ ID NO: 554 - DNA, 1191 bp, Zea mays; identical to SEQ ID NO: 546

SEQ ID NO: 555 - DNA, 1696 bp, Zea mays
aaaccagcacaaaaaggagcacaaagctctctctccctcccccctctctctctctctctcctgttccccgcgagagtcgctcagggccgcgacgaggagaagcggcagcgcygtcacctctccaatggcatccccgtccctcctccgtgcaacctgtgcgcttctcgagtgctgaggctccctgtccctaagacaagcttgcgcgcgcgatggagggtttttcgagggacttgctgtgcgggattggcaagggggacgcgccgccaccggagaagaggccggggcagctgcgggaggagatggaggaggtggagcttagcctcgggctgtctcttggcggccgattcgggctcgacaggaaggggagcaagctcccccggtcgtcgtccgtggcggccatgctgacaacgccggtggaggtgccggcgccgccctccctctcgcgggcgagctcgctgccggtccaggcggaggcgtcggaagttgagaggaagcaggggctggatggatggggttcttgccgtgagggcggcggtctcggcgtgcaacacgcggcgaggctgccggcgagcgggaacccttcctctgcctcttcggtaggtgaaggacagattttgcaaggcaccctcatgaggactagttcactccctgctgtcattgaggcttctggcaatgatgactggaagaaacgaaaggaagcacagagcctgaagaggctcgaggttaagaagaagaggattgagaggaggaactctctcgcctgcaacacttcaaaagaagctgctgggcagagtccaaaagagatgaatgcaaacactgacaaattagtaagttctgatgaaactattgtcagcgctaacgaaagtcatagcagtggcaagcatctggtgaaggggcttccaccaaagtaccaggccacaattacatcagaagacagttcgtcagcaatgcgaaagaagccaaactcggccttcaaaggaacagccatcactgaggagcagaactcatcatcgtctgttccttcctccggtgaagctataagtagcgtgacggcaccaagtctgcctctgttgtctttggtccccataacagcaacccttggttccagggaagaccaaagcattttaggcagggctggtgcaagggcaaacggcatgggggacgtggaaaggaggatgatgcaggagatgccgggcgtgttcaccaagggcctgtccaacggcagcagggtcgaaggcttcctgtacaaatacagcaaaggagaagtgaggatcgtatgcatctgccatggaagcttccttactccttcggagtttgtggagcacgccggcgccggcaaggtagataacccgctgcgacacattgtcgtcagcgctaccccgaacctgtgactgtgaggccaggcagacccgtgcacaagctatagtgttctgtagactcaggacctgagcctagcgtcagagcaatgtcaccgttagactgtgtggtgcggtgcttatgcccgattaaattggtgggcattgtggtaacataacctgttgataatgttttgacaatgttttgatccttcctatgcgtgatttagttctgcaaaaaaaaaaaaaaaaaaaaaaaaaaaaaaaaaaaaaaaaaaaaaaaaaaaaaaaaaaaaaaargaaaaaaaaaaaaaaaaaaaaaaaarraaaaaaaaaaaaaa

SEQ ID NO: 556 - DNA, 1468 bp, Sorghum bicolor
ctcttctctcctgttcgccgctagagtcgcctcgaggctgcggtgaggagaagcggcagcgcctcacctctccaatggcggcctcctccctcctccttgcaacctgtgcgcttctcgtttactgaggctccctgagacaagcttgcgctcacgatggagggtttttcgagggacttgctgtgtgggattgggaagggagacgcgccgccaccggagcagaggccggggcagctgcgcgaggagatggaggcggtcgagctcagcctcggactgtcgctcggcggccggttcgggctagacaggaagggggacaagctcccccggtcctcgtccgtggcggccatgctgacgccgccggtggaggtgccgacgccgcgcgccctcccgcggacgagctcgctgccggtcctggccgaggcgtcggaggttgcgaagcagcaggggctggctggatggggttcttgccgtgatggcgggggtctcggcgtggaacacgcggcgaggctgccggcgagcgggagcccttcctctgcctcttcgggaggtgatgggcagagattgcagggcaccctcatgagaactagttcactccctgctgccattgaggctgctggcaatgatgaatggaagaaacgtaaggaagcacagagtctgaagaggctcgaggttaagaagaaaaggattgagaggaggaactctcacacttgcaacacttcaaaagaagcagctgggcagattccagaagagatgaatgcacacactgacaaattagtagcttctgatgaagctgttgtgatgaataacgaaaatcatagcagtggcaagcatctggtgaaggggcttcctccaaagtaccaggctacaattgcatcacaagatagtttgtcaacagtgggaaagaagccaaactcagccttcaaagccatcgttgaggagcacagcccgtcatcatctattccttcctccggtgaagctataagtagcgtcacggcagcaagtccaccatcttcgtctttggctcacagaacagctacccttggtcccgcgggagatcaaagcattttaggcagggctgcttcaagggcgaacagcatgggggacgtggaaaggaagatgatgcaggagatgccgggcgtgttcaccaaggggctgcccaatggcaacagggttgaaggcttcctgtataaatacaggaaaggagaagatgtcagaatcgtatgcatctgccatggaagcttccttactccttcggagtttgtggaacacgccggagccggcaaagtagacaacccgctgcgacacattgtcgtcaaccctacccctaccccaaacctgtgaaccttcgccagcagacctgtgcaggcgtcgtgtagagtcagccttcagcctagcgtcgagtagtctcattgtcagattgtgtttgtggtgcagtgcttacttatgcccgattaaattggtgggcattatg

SEQ ID NO: 557 - DNA, 1270 bp, Zea mays
cgtcgatcgcttgagttagtttgcagccaacaagtcaagatgaacgacgccgacgtcgggaagcaggtgcagcagatggtccggttcatcctgcaggaggccgacgagaaagccagcgagatcagtgttgccgccgaggaggtcggtacagactctcgtcttcaccaaatcccaacatatatacttagatctgtacgcatgcatgcatgcaggagttcagcatcgagaagctgcagctggtggagtcggaaaaacggaaggtgcggcaggagtacgagcgcaaggagaagcaggtggacgtccgcaggaagatgtgagcagacgatccatccattcgttcgttttcagcatctcatcattcttcatttaccgatgcaaattccacacgctcatgcatgcatgcagcgagtactcgacggagctgaacgcggcgcgcatcaagctgctgcgggcgcaggacgacgtggtgaccgggatgaaggagagcgccggcgacgcgctgctccgcgtcaccaaggacgccaacgcctacaagagggtcctcaagggcctcatcgtgcagagcctgcttcgcctgagggagccggcgctggtgctgcggtgccgagaggcggaccggagcctggtggaggcggtgctggaggtggccaagaaggagtacgccgagaaggccaaggtcaacctccccaagatcatcatcgacggcaaggtctacctgccgccgcagaggaccagccgcgacgcgcacgggccgtcctggtacttacttacttgctgacgtcacatcacgaaaccttagttagtgacgagagggcgatgaattgatcgatgcgtgtgaattgtgtgatggcgatcgtacaaacacagctccggcggcgtggtgctcgcgtcccaggacggcaagatcgtctgcgacaacacgctggacgccaggctcagcgtctccttcaggcaaaagctccctgaggtgcgtcggttatatggttgtttcctccttacagatttcctactactactgcattgatcagactcgtaatgtccatgactacttcgtctttgcagatcaggaagaaactcttcagccagcaagtatcgtcctaatgtatttttctttgttactctgatcgattgttttctgaaataaaccagaagcggtccgatcctacgaaggtacacaggtcctgacattgggtgaagcccgtatgtgcacgtttcggatttcgcaacatcgatttgagcttgaacagttcttcgctagcttgtcggtaga

SEQ ID NO: 558 - DNA, 1798 bp, Sorghum bicolor
atggtggcgtcggccaagggacggctcgtgtccgtgctcgcggtggcggcggcgctcgcggccgtgctcctctaccgcgcccccttctccaagagcttgggcggcgaagggtgcagcctcctcccgcacgaccacttctgggtcgccagcgaccgcgtcgtcacgctcggccgcgtcggccccgccgcagtggaggtcaaaggagggctcatcaacgccatcgcggtcggggactaccggagcttcgtgctccgccgtcctctcctggactacggggacgccgtcatcatgcccggcctcatcgacgtgcatgcccatctcgacgagcctggacgtgccgagtgggagggcttctctactggtacaagagcagctgcggcaggcgggataacgacgttggtggatatgccactcaacagcttcccgtcgacagtctctgaagaaactctcaaactgaagctggaagcagctcaagataagctatatgttgatgttgggttctggggaggacttgtgccagagaacgccttcaacccaagtgctttggagggcctcctaaatgcaggcgttttaggactcaagtcttttatgtgcccctcaggcatcaacgacttccccatgacaaattcaactcatattgaggaaggattggttacactggcaaaatacaagagacctttacttatccatgcagaacgtatacctgaggctgaggatgatgatatgcgagaggatgaactagatcctcgatcctatatgacgtatctaaagtctagaccaccatcatgggaggaatcagctatcagagatctacaccgtgcaatgaaggatacggagtcggggggtcggtccgaaggagctcatattcacattgttcatctatcagatgcaaaaacttccttggaacttatgaaggatgctaaacgcagtggtgcaagtttatcaatagaaacatgccctcattacctggcattttcatctgaagaagttccagatggcgatactcgctttaaatgttctcctcccatacgtgatgacacaaacagagaaaatctttggaaagctctacttgatggacacatagacatgctaagttcagaccactcaccatcaactcctgatctcaaactaatggaggaaggcaactttttaagggcatggggaggcatatcatcattgcagtttgtcctcccggtaacatggtcatatgggcgaaagtacggcattactctgaatcagctatcctcatggtggagcgaaaatccagccaagcttgcaggccaaaagaacaagggagctattctaccaggataccatgctgacatagtagtatggaaacccgaaactgagttccaactcgatgacagccatgttatatatcataaacatcagaatatttcggcgtatctaggaaagcaactttctggtaaggtcctgtcaacttttgtgagaggaaaccttgtgtttgctgaagacaagcatgcaaatgttgcttgtggtgttcctatcctcgctaagtaacatgcaggtggatccagagctgccattgttgatgatccgtagtgtatacaatcgtatgcaccatgtcaatttgttggttgctcttgtatattttttaaacaaactgcagaagctctgcccctcaattaagagaggagtaaaagagttttatgtacaggttatagatgaactgcaagggaaaacagagaaggccaacaagagtggcaaatattagcagaaacccgggtagaacacattaaatgtcattgttgtgtagtagcagtctaaaggtattggc

SEQ ID NO: 559 - DNA, 1817 bp, Zea mays
cacgggcagaaagggacgcgactcgtcagggcgattccgattacgagtagacgggcaggacaggacaagggaggaacggcggcggcggcgcagggcagggtaaaccatggcggcatcggccaagggacggctcgtgcccgtgctcgcggtggcggcggcgctcgcggccgtgctcctctaccgcgcgcccttctccaagagcttgggcggcgaagggtgcagcctcctcccgcacgaccacttctggatcgccagcgaccgcgtcgtcacgctcggacgcgtcggccccgccgcagtagaggtcaaaggagggctcatcaacgccatcgccgtcggggactaccggagcttcgtgctccgccgaccgctccttgactacggggacgccgtcatcatgcccggcctcatcgacgtgcatgcccatctggatgagcctggacgtgccgagtgggaaggcttctccaatggcacaagagcagctgcggcaggtgggataacgacgctggtggatatgccactcaacagcttcccgtcaacagtctctgaagaaactctcaaactgaagctggaagcagctcgggataagctatatgttgatgtggggttttggggaggccttgtgccagagaatgccttcaacccaagtgctttggagggcctcctaaaggcaggcgttttaggactcaagtcttttatgtgcccctcaggcatcaacgactttcccatgacaaattcaactcatatcgaagaaggattggttacactggcaaaatacaagagatctttacttatccatgcagaacgtatacctgaggctgaggatcatgatttgcaagaagatgaattagatcctcggtcctatatgacgtatctgaagtctagaccaccatcatgggaggaagcggctatcagagatctgcaacgtgcaatgaaggatacggagttggggggtcggtccgaaggagctcatattcacattgttcatctatcagatgcaaaaactagcttggaacttatgaaggatgctaaacgcagtggtgcaagtctgtctatagaaacatgccctcattacctggcattttcgtctgaagaagttccagatggagatactcgctttaaatgttctcctcccatacgtgatgacacaaacagagaaaatctttggaaagctctgcttgatggacacatagacatgctaagttcagaccactcaccatccactcctgacctcaaactaatggaggaaggcgactttttaagggcatggggaggcatatcatcattgcagtttgtcctcccggtgacatggtcatatgggcgaaagtatggcgttactctgaatcagctagcctcatggtggagcgaaaggccagccaagcttgcaggccaaaagaataagggagctattctaccaggataccatgctgacattgtagtatggaaacccgaaacagagtttcaacttgacaacaaccatgctatatatcataaacatcagaatatttcagcgtatttaggaaagcaactttctggtaaggtcctgtcgacttttgtgagaggaaatcttgtgtttgctgaagacaagcatgcaaatgctgcttgtggtgttcctatcctcgctaagtaacatacaggtggatccagaactgccattgttgatccgtagtgtatacaatcgtatgcacgtgtcaatttgtaggttgctctcctgtatataattgaactcattcatgtcattgttatatagtagcaatctatttatattggcacacattttgccttgatccctaattagactatcattagtttttttttct

SEQ ID NO: 560 - DNA, 1798 bp, Zea mays
agaaagggacgcgactcgtcagggcgattccgattacgagtagacgggcaggacaggacaagggaggaacggcggcggcggcgcagggcagggtaaaccatggcggcatcggccaagggacggctcgtgcccgtgctcgcggtggcggcggcgctcgcggccgtgctcctctaccgcgcgcccttctccaagagcttgggcggcgaagggtgcagcctcctcccgcacgaccacttctggatcgccagcgaccgcgtcgtcacgctcggacgcgtcggcccctccgcagtagaggtcaaaggagggctcatcaacgccatcgccgtcggggactaccggagcttcgtgctccgccgaccgctccttgactacggggacgccgtcatcatgcccggcctcatcgacgtgcatgcccatctggatgagcctggacgtgccgagtgggaaggcttctccaatggcacaagagcagctgcggcaggtgggataacgacgctggtggatatgccactcaacagcttcccgtcaacagtctctgaagaaactctcaaactgaagctggaagcagctcgggataagctatatgttgatgtggggttttggggaggccttgtgccagagaatgccttcaacccaagtgctttggagggcctcctaaaggcaggcgttttaggactcaagtcttttatgtgcccctcaggcatcaacgactttcccatgacaaattcaactcatatcgaagaaggattggttacactggcaaaatacaagagatctttacttatccatgcagaacgtatacctgaggctgaggatcatgatttgcaagaagatgaattagatcctcggtcctatatgacgtatctgaagtctagaccaccatcatgggaggaagcggctatcagagatctgcaacgtgcaatgaaggatacggagttggggggtcggtccgaaggagctcatattcacattgttcatctatcagatgcaaaaactagcttggaacttatgaaggatgctaaacgcagtggtgcaagtctgtctatagaaacatgccctcattacctggcattttcgtctgaagaagttccagatggagatactcgctttaaatgttctcctcccatacgtgatgacacaaacagagaaaatctttggaaagctctgcttgatggacacatagacatgctaagttcagaccactcaccatccactcctgacctcaaactaatggaggaaggcgactttttaagggcatggggaggcatatcatcattgcagtttgtcctcccggtgacatggtcatatgggcgaaagtatggcgttactctgaatcagctagcctcatggtggagcgaaaggccagccaagcttgcaggccaaaagaataagggagctattctaccaggataccatgctgacattgtagtatggaaacccgaaacagagtttcaacttgacaacaaccatgctatatatcataaacatcagaatatttcagcgtatttaggaaagcaactttctggtaaggtcctgtcgacttttgtgagaggaaatcttgtgtttgctgaagacaagcatgcaaatgctgcttgtggtgttcctatcctcgctaagtaacatacaggtggatccagaactgccattgttgatccgtagtgtatacaatcgtatgcacgtgtcaatttgtaggttgctctcctgtatataattgaactcattcatgtcattgttatatagtagcaatctatttatattggcacacattttgccttgatccccaaaaaaaaaaaaaaaa

SEQ ID NO: 561 - DNA, 1758 bp, Hordeum vulgare subsp. vulgare
ggagagatagagaggtaggggacgagcgatggcggctgggaagggccgggtgctgccgctgctggccgtggcggcggcgctcgccgccgcgctcctctacaccgcgcccttctccaagagcctgggcggcgaagggtgcagcctgctaccgcacggccacttctggatcgccagccagcgggtcgtcgcgctcggccgcgtcggccccgccgcagtggaggtgaaggaggggctgatcaacgccatcgccgtcggggactaccggagcttcgtgctccgccgcccgctcgtcgactacggggacgccgtcatcatgcccggcctcatcgacgtgcacgcgcatctcgacgagcccgggcgggcggagtgggagggcttctccaccggcacaagagccgccgccgcaggtggcataactacgttggtggacatgcctctcaacagcttcccctcaacggtctctgaagaaactctcaaactcaaggtggatgcagctcgggataagctatatgttgatgtcgggttttggggaggccttgtacccgagaacgccttgaacccaagcaaattggagagcctgctaaatgcaggagtgttagggcttaagtctttcatgtgcccctctggtatcaacgacttccccatgacaaattcaactcatatcgaggagggcctagttacattggcaaagtacaagagacccttgcttatccatgcagaacgcataccggatgtcgcgagtgatgaggagcttgatggtgaattggatcctcgatcatacgcaacatacctgaaatctagaacacctgcatgggaggaatcagccgttagagatttgaaacgtgccatgaaagacactgaagtggggggtcggtcagaaggagctcatcttcacattgttcatctctcagattcaaaaactagcctcaggcttctaaaggatgcaaaacacagtggcgcaaaagtcactatagaaacctgtcctcattacctcgcattttcggctgaggaagttccagacggagacactcgtttcaagtgctctcctcccatacgtgatgctgccaacaaggaaaacctctgggaagctctgcttgacgggcacatcgacatgctcagctcagaccactcgccgtcgactcctgatctcaagctaatggaggaaggcaacttcatgaaggcatggggaggtatctcatctctgcagtttgtcctccctgtaacatggtcacacgggaaaaagtatggcatcaccctgaaccagctagcctcatggtggagcgagaagcccgccgagctcgcggggcagaagaacaaggggtctattctgccggggtaccatgccgacattgtggtgtggaatcccgaggcacaattccatctcgacgacagccatgccgtataccacaagcaccggaacatctcggcgtaccttgggaatgagctatcgggcaaggtcctgtcgacattcgtgagggggaacctagtgttcgccgaaggaaagcacgctggggccgcctgcggcgccaccatcctcgccaagtaaaaccgtagagctagaatgttgttgccgatttctagcgtatatgatcgtgtgcgcttgtgtagtatgtatgtgtgcaggtctgtagttgtttccctgtgtataatttggatccatcgcatgcatccatccatcccatcccccaccattgttgtatacccacccattcattggacagcaccagtgtaggttatatctctgaattgttcagatgc

SEQ ID NO: 562 - DNA, 4126 bp, Oryza sativa Indica Group
ttccaaggtctccgggagattccctttcccccggtattcgaatccgcgatctcttctctcgtacgagaaagctgaggagaatccctttgtctttgcagagcctgggcggtgaggggtgcagccttctcccccacgaccacttctggatcgccagcgagcgcgtcgtcacgctcggacgggtcggccccgccgcaggtgatgacctcgatcgacgacaagtggactgattgattattactctgatgatgatagagcagttgaatgctttgggttttcagagtgagcgagtccatgtcgctgacggattcttcttgttgtggattgtgtgtgtctgtgtgtgtgtgcagtggaggtgaagggagggctgatcaacgcgatcgccgtcggggattaccggagcttcctgctccggcgaccggtggtggactacggtgacgcggttatcatgcccggactgatcgatgtgtaggcttcgatctctagcgacttgccagaatcaatcacttatacgaacgattgcttgaaactagtggtgtgactgcactgcactgttctgatttcaggcacgcgcatcttgatgagccaggacgtgctgagtgggaggggttctccactggtacaagagcagcagctgcaggtgcagctttttatcagtcattatcaatctaaatcaagttaaccctcattaacgtgttggcttgtcaatctaaataaatttaatccttgcgtactaatgtcggggatgctctaaataaggcacgtttcttagttcttatccctctcatgtgggatgcattctgaattcggtacggcaacatccctcgcatatggtgggatgtgttctgaatactatactgccactgggactgttgttttatcattttcgtattcttggattgagacatgagaccgagttagtagggagtaatcaattttctttttcttttcaataacagaaagagatcagactttttgctcaaagtttcacggtttgttcatttcaggtggcattacaacattagtggacatgcctcttaatagctacccgtcaactgtttctgaagaaactctcaagctgaaggtcagtgtttctttatcgtaccaatatcagtatataaagcatcaaattgctactacctgctttctctttagtcaacactgacattacgtgcttgattatcagttggatgcagctaaggataaactacatgttgatgtaggtaagttgcaatgcaatagttacacgtttcagtatcattgcacattagcaagtagagaaccaagggaggtaaaaacagctcatccaccataataacagtaattctgcatctaaacttgtttcatggtccgaccttttttgacttgtctgctgttctcaaacagggttctggggaggcctcgttccagagaatgccctcaatccaagtgcactagagagcctattaaattcaggcgtcttagggctcaaggtttgttcatacttacaagagtaatcactcaacttctgttgttctacatgtttattcatcttctcaacttgttaaagaagccttagtttcaggcatgcaaagctccaaagtaagtttggttagtactaggatcccacaggtttattcacgtccttttcatgtcattgtaacgtccttatcatgccatcatgtcactctgtttattctcctttactttaaataagcaaatgatagaatgatacactgattgatcttttttttcttgatttagtcatttatgtgcccctcaggtataaatgacttccccatgacaaattcaactcatattgaggtgcgctgctttgacaattctgttatttattaccttgcgaccacaagagttccataattcagcttatcaactccctgaagagttcatattcctgtttttatactgtaggagggcctggttacattggcaaagtataaaaggccgttacttatccatgcagaacgcatacccgatgttcagaatgaagatgggatcgatggtgaactagatcctaaagcctatacgacatatcttaaatctagaccaccagcatggtaatttgagtcagttattgcctgagttattgcactcagtccttggcataggccggtctggctgagtgcgtcgtgtaacaaaaactctattcttctaatatattgacgtgcaatccttttgcgcgttcgcgaaaaaaaaattgcctgagtgaatcatagtctagtctgtgtgttaatcagaatgcacaattctgattttaaactatatggctgtctggaaagcatatgtacaacaaatcaatgagaataccatggcattatgctgttttagtacatagtatgcaatcgtgtaaaaaaagcttaaccaatagccatcactgaaaagaaccaaagtactcacaacttaacacctttttttttttcctgttgagctgatcacaacttcaaacttcactaattctattgccatttatatctagggaggaagcagcgatcaaagatctgcaacgtgcgatgaaagacacggagatagggggtcggtcagaaggagctcatattcacatagttcatctctcagatgcaaaaacttctcttgggcttcttaaggtatgatgtcattatcaaatggacagaccagaacgtattaatgattcatctgtttttgtgaagtcatgaaagaaagttctgtctcaaccaaacaaaagaatattatattcacaatcgccgagaacattttacattgcttatctaaactgattatttattgttgatgaaaaagcttatgcacagtggagtacgatttattcaaatgacttatggttttcttggtccatttattactccaattttttatatggttgtaggatgcaaaacaaaatggtgcaagggttagtgtagaaacctgtcctcattacctggcgttttcagctgaagaagttcctgatggagatactcgctttaaatgtgctcctcctatacgcgattcaaccaacagggataatctctgggaagctctgcttgtacgccattcttcttattatgattggtttgttgaactttactaaactgttataggctaactggccaactattatatggctaacattaggatggacacatagacatgttgagctcagaccattcaccatcagctcctgatctcaaactcatggaggaaggtaacttcttaagggcatggggaggcatatcatctttgcaggtaagttttttagtgcatatgaataaatgtaccgtgccaagagtgccaagtaacgattttattttcccctaatcttaatacaaattggtcaacgttccaccgctggcccgtgaaaaacattttgagtaaaatcataatggtgaagtgtgaaggcctccagattgtgcttgcatagtagtaattagtttggtatgaacatttgcagtttgttctccctgtaacatggtcgcatgggaaaaaatacggtatcagtttgaatcaactggcatcatggtggagcgaaaggcctgctatgcttgcagggttaaagaaaaaggtaatgggctaatgtcatcttttttagcaaaatgcatggcatcattgtgccatactactgttcttactggatgacacttgtgtaacttaaaaccagctaatggttatgattaatgttttcatctttgtttatatcatcatctgttgtctcactcgatacagtacatgctgatattgctaaaaagaaattaaactcaatttgtagggtgctgttctgccgggataccgtgctgatattgtggtatggaaacctgaggctcaattccatcttgatgacagccatcctgtctaccataagcatcgggtttgctttctaactcgaacccgttagaattccacttgtttccatataaaatgtcggaccatgtggaacttttgacctcttcctcaacaatcagctagaaaatgctacaaattgaagatcacattttatatgtgaagtatgtgtaaagtttatttcacatttttgcagaatatttcggcatatttgggaaagcagctttcagggaagatactgtccacctttgtgggtgggaatcttgtgttcgctgaagacaaacatgcaaaggttgcatgtggtgctccaatcctcgccaaa

SEQ ID NO: 563 - DNA, 1563 bp, Zea mays subsp. parviglumis
aaattggagcaacttcacgtattttctataaatgacatgctaaattaataaatttagcaatgtaataacataagtagtaaccatgatttatttctctctctaataatatattatagtacgtcctccgatttttatttgtttcaaaatcaactaactagcgacaaatattttaaaacgtataaataaatacctcctccgtttctttttatttgtcgctggatagtgtaaaattgtactatccagcgacaaataaaaagaaacggagggagtaattgggaacctggactatttttaaccgatctagcatattttaactgtttcttttatctatctcttatcgttctcacctgaaaaagttcgcagcttcaccgaacgaaaatgtcctgtcgttacatttccaaccccgtctcgtctccgccgccacaacaatatcgcattgacagatcgttcatcgtagctgcctccagtcgtctcccgagatcttctccggctataaatttccgccccaattccccaatccagatgcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccgtaagccctcaaccccctttgcctgtttgctaccccttctctgtgacgtgcccgtgttctgctggtattgagatcctctgcagttacctcccctgcagttgggtcactgatgtgtgggcccggccatggcattgagcatttgcgatacagacacaaacaaagatggttcagtacgtaatctaggctgaagatttctgcggcacattgaatttcatattgtcgcttggattacgtgtaaattcatattgaccagcagtactaatattgaactttgaagcctagtcagatcagatattaataaattcattgttttatgataatgatactcggtagaggtaaagaaataaagattgttcaagatttaccactatcgttatgcagtcacaaaataaatggtactaatatattgtttgtaaaatagagatctatgctaatgttttggtccacggtaaatacgaaattttggattgcaattaacctcctgcgttggcgctgtgcagaatgctcttctggggttcgagaagcttgtgaaggccaagacacaagtggttgctggcacgatgtactatctcactattgaagtgaaggatggcgaagtcaagaagctctacgaagctaaggtctgggagaagccatgggagaacctcaaggggctgcaggaattcaagcctgttgaagagggtgctagcgcctaaggtagatttgtgcatgttttacatactatctggcccagttctgttcattgctgaacgatgcatcttccagtccttttgtattaggtttttagctgttcaccagtcattgggagagttttatcttacaggtacattg

SEQ ID NO: 564 - DNA, 1480 bp, Zea mays subsp. parviglumis
aaattggagcaacttcacgtattttctataaataacatgttaaattaataaatttagcaatgtaataacataagtagtaaccgtgatttatttctctctctaataatttattatagtacgtcctccgttttttatttgtttcaaaatcaactagcgacaaatattttaaaacgtataaataaataattgggaacctggactatttttaaccgacctagcatattttaactgcttcttttctctatctcttatcgttctcacctgaaaaagttcgcagcttcaccgaacgaaaatgtcctgtcgttacatttccaaccccgtctccgtctccgcccgccagaacaacatcgcattgacagatcgttcatcgtagccgcctccagtcgtctcccgagatcttctccggctataaatttccgccccaattccccaatccagatgcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccgtaagccctcaaccccctttgcctgtttgctaccccttctctgtgacgtgcccgtgttctgctggtattgagatcctctgcagttacctcccctgcagttgggtcactgatgtgtgggcccggccatggcattgagcatttgcgatacagacacaaacaaagatggttcagtacgtaatctaggctgaagatttctgcggcacattgaatttcatattgtcgcttggattacgtgtaaattcacattgaccagcagtactaatattgaactttgaagcctagtcagatcagatattaataaattcattgttttatgataatgatactcggtagaggtaaagaaataaagattgttcaagatttaccactatcgttatgcagtcacaaaataaatggtactaatatattgtttgtaaaatagagatctatgctaatgttttggtccacggtaaatacgaaattttggattgcaattaaccttctgcgttggcgctgtgcagaatgctcttctggggttcgagaagcttgtgaaggtcaagacacaagtggttgctggcacgatgtactatctcactattgaagtgaaggatggcgaagtcaagaagctctacgaagctaaggtctgggagaagccatgggagaacctcaaggggctgcaggaattcaagcctgttgaagagggtgctagcgcctaaggtagatttgtgcatgttttacatactatctggcccagttctgttcattgctgaacgatgcatcttccagtccttttgtattaggtttttagctgttcaccagtcattgggagagttttatcttacatggtacattg

SEQ ID NO: 565 - DNA, 1081 bp, Zea mays
ccccaatccagatgcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcgcaacaagaaggccgtaagccctcaaccccttgcctgttgctaccctttttggacgtgccgtgttctgctggtatgagatctctgcagtactccctgcagttggtcactgatgtgtggcccggccatgcattgagcatttgcgatacagacacaaacaaagatggttcagtacgtaatctaggctgaagatttctgcgccacattgaatttcatatgtcgctggattacgtgtaaattcatattgaccagcagtactaatattgaactttgaagcctagtcagatcagatattaataaattcattgttttatgataatgatactcggtagaggtaaagaaataaagattgttcaagatttaccactatcgttatgcagtcacaaaataaatggtactaatatattgtttgtaaaatagagatctatgctaatgttttggtccacggtaaatacgaaattttggattgcaattaaccttctgcgttggcgctgtgcagaatgctcttctggggttcgagaagcttgtgaaggccaagacacaagtggttgctggcacgatgtactatctcactattgaagtgaaggatggcgaagtcaagaagctctacgaagctaaggtctgggagaagccatgggagaacctcaaggggctgcaggaattcaagcctgttgaagagggtgctagcgcctaaggtagatttgtgcatgttttacatactatctggcccagttctgttcattgctgaacgatgcatcttccagtccttttgtattaggtttttagctgttcaccagtcattgggagagttttatcttacatggtacattgatcaaaatcgtaccaattgcaggatctctccttctccatgtgcga

SEQ ID NO: 566 - DNA, 1333 bp, Zea mays subsp. parviglumis
ttttatttgtttcaaaatgaactaacgagtgataaataaataattgggaacctgtactatttttaaccgacctagcatattttaactgtttcttttctctatttcttatcattttctcacgttcgcagctgcaccgaacgaaaatggcttatcgttccctttccaaccccgtctccgcccgccacaacaatatgacattgacagatcgttcatcgtagcctcctccattcgtctcccgggatcttctccggctataaatttccgccccaaatctccaatccagatgcgcaaacatcgaatcgtctcgctcgtgtttgccctgctcatactgcttgccctcgccgtatcgtccacccgcaacgcacaggaggattccatggccgacaacaccgggacgttggcgggcggcatcaaggacgtgccggggaacgagaacgaccttcacctccaggagctcgcccgattcgccgtcgatgagcacaacaagaaggccgtaagccctcaaccccctttgcctgtttgctaccccttctctgtgagactgtgacgtgcccgtgttctgctggtattgagatcctctgcagttacctcccctgcagtttgggtcactgatgtgtgggcccggccatggcattgagcatttgcgatacagacacaaacaaagatggttcagtacgtaatctaggctgaagatttctgcggcacattgaatttcatattgtcgcttggattacgtgtaaattcatattgaccagcagtactaatattgaactttgaagcctagtcagatcagatattaataaattcattgttttatgataatgatactcggtagaggtaaagaaataaagattgttcaagatttaccactatcgttatgcagtcacaaaataaatggtactaatatattgtttgtaaaatagagatctatgctaatgttttggtccacggtaaatacgaaattttggattgcaattaaccttctgcgttggcgctgtgcagaatgctcttctggggttcgagaagcttgtgaaggccaagacacaagtggttgctggcacgatgtactatctcactattgaagtgaaggatggcgaagtcaagaagctctacgaagctaaggtctgggagaagccatgggagaacctcaaggggctgcaggaattcaagcctgttgaagagggtgctagcgcctaaggtagatttgtgcatgttttacatactatctggcccagttctgttcattgctgaacgatgcatcttccagtccttttgtattaggtttttagctgttcaccagtcattgggagagttttatcttacaggtacattg

SEQ ID NO: 567 - DNA, 1721 bp, Zea mays subsp. parviglumis
aaattggagcaacttcacgtattttctataaatgacatgctaaattaataaatttagcaatgtaataacataagtagtaaccatgatttatttctctctctaataatatattatagtacgtcctccgatttttatttgtttcaaaatcaactaactagcgacaaatattttaaaacgtataaataaatacttcctccgtttctttttatttgtcgctggatagtgtaaaattgcactatccagcgacaaataaaaagaaacggagggagtaattgggaacctggactatttttaaccgacctagcatattttaactgtttcttttatctatctcttatcgttctcacctgaaaaagttcgcagcttcaccgaacgaaaatgtcctgtcgttacatttccaaccccgtctccgtctccgcccgccacaacaatatcgcattgacagatcgttcatcgtagctgcctccagtcgtctcccgagatcttctccggctataaatttccgccccaattccccaatccagatgcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccgtaagccctcaaccccctttgcctgtttgctaccccttctctgtgacgtgcccgtgttctgctggtattgagatcctctgcagttacctcccctgcagtttgggtcactgatgtgtgggcccggccatggcattgagcatttgcgatacagacacaaacaaagatggttcagtacctaatctaggctgaagatttctgctgcacattgaattttatatggtcgcttggattacgagtaatcacatatcaccgcccaagaggtcacctgagccattgaccagcagtaataatattgaactttgaagcctagtcagatcagatattaataaactcaatgttttatgataatgatattcggtagaggtaaagaaataaaggttgttcaagatttaccactatcgttatgcaatcacaaaacaaatggtactaatttattgtttgtatggaataattggtatcttgcaactcagaatgttgactgattagtcagatctattgtgtgctaactcagaatgttgattgattagtcagatctattgttttatgataatgatactcggtagaggtaaagaaatagagatctatgctaatgttttggtccacggcaaatacgaaattttggattgcaaataaccttctgcgttggcgctgtgcagaatgctcttctggggttcgagaagcttgtgaaggccaagacacaagtggttgctggcacgatgtactatctcactattgaagtgaaggatggcgaagtcaagaagctctacgaagctaaggtctgggagaagccatgggagaacttcaaggagctgcaggaattcaagcctgttgaagagtgtgctagcgcctaaggtagatttgtgcatgttttacatactatctggcccagttctgttcattgctgaacgatgcatcttccagtccttttgtgttaggtttttagctgttcaccagtcattgggagagttttatcttacaggtacattg

SEQ ID NO: 568 - DNA, 2204 bp, Zea mays
ccaggcggtacaaagtcaacgatcacatacatggcggtggaaaattctgtacatacgtttccttgggtgcaacagttgcgcattgatcgacgactagtacctcctccgtgatagacgcgagcaacctatatgcacatggagccatccttacacgctaaattggagcaacttcacgtattttctataaataacatgctaaattaataaatttagcaatgtaataacataagtagtaaccataatttatttctctctctaataatttattatagtacgtccttcgttttttatttgtttccaaatcaactaaagagcgacaaatattttaaaacgtataaataaataattgggaacttggactatttttaaccgacctagcatattttaactgtttcttttctctatctcttatcattttctcacctgaaaaagttcgcagcttcaccgaacgaaaatgtcctgtcgttccctttccaaccccgtctccgtctccgcccgccacaacaatatcgcattgacagatcgttcatcgtagcctcctccagtcgtctcccgggatcttctccggctataaatttccgccccaattccccaatccagatgcgcaaacatcgaatcgtctcgctcgtggctgccctgctcatactgcttgccctcgccgtatcgtccacccgcaacgcacaggaggattccatggccgacaacaccgggacgttggcgggcggcatcaaggacgtgccggggaacgagaacgaccttcacctccaggaactcgcccgcttcgccgtcgatgagcacaacaagaaggccgtaagccctcaaccccctttggctgtttgctaccccttctctgtgacgtgcccgtgttctgctggcattgagatccgtctgcagttacctcccctgcagttgggtcactgatgtgtggccccggccatggcatcgagcatttgcgatacagacacaaacaaacgaaaaatttgctattttagcctttttaacgtgggctaaatactattatgtgaccctctgtctatgatttatgggaccatctgtgtctatgatttgtgggcctgggtctaaaatagagaagttcacaactgagagtgataaaatagcaaattccccacaaacaaagatggctcagtatgtaatctaggctgaagatttctgcggcacattgaatttcatattgtcgcttggattacgagtaatcacgtatcaccacccaagaggtcacctgagccattgaccagcagtactaatattgaactttgaagcctagtcagatcagatattaataaattcgatgttttatggatagtgatactcggtagaggtaaagaaatagaggtggttcaagatttaccactatcgttatgcaatcacaaaacaaatggtactaatttattgtttgtatggaataattggtatcttgcaactcagaatgttgattgattagtcagatctactgtgtgctaactcagaatgtggattgattagtcagatctattgttttatgataatgatactcggtagaggtaaagaaatagagatctatgctaatgttttggtccacggcaaatacgaaattttggattgcaaataaccttctgcgttggcgctgtgcagaatgctcttctggggttcgagaagcttgtgaaggccaagacacaagtggttgctggcacgatgtactatctcactattgaagtgaaggatggcgaagtgaagaagctctacgaagctaaggtctgggagaagccatgggagaacttcaaggagctgcaggaattcaagcctgttgaagagggtgctagcgcctaaggtagatttgtgcatgttttacatactatctggcccagttctgttctgttcattgctgaacgatgcatcttccagtccttttgtattaggtttttagctgttcaacagtcgttgggagagttttatcttacatggtacattgatcaaaatctaccaattgcaggatctctccttctccatgtgcgagcctgaagctcaaagcaaagttgcagaataaggagccacctcccaacatgctagaccatgctcccttgtgtaatttcataagactacaacccttttagggcttgtccggttggtgtctgtgtcttaagggaattgagggtgattaaattttccttcttttacaaatagagggggttttaatccactccaaa

SEQ ID NO: 569 - DNA, 1316 bp, Zea mays
tcgacctgcaggtcaacggatcttctccggctataaatttccgccccaattccccaatccagatgcgcaaacatcgaatcgtctcgctcgtggctgccctgctcatactgcttgccctcgccgtatcgtccacccgcaacgcacaggaggattccatggccgacaacaccgggacgttggcgggcggcatcaaggacgtgccggggaacgagaacgaccttcacctccaggaactcgcccgcttcgccgtcgatgagcacaacaagaaggccgtaagccctcaaccccctttgcctgtttgctaccccttctctgtgacgtgcccgtgttctgctggcattgagatcgtctgcagttacctcccctgcagttgggtcactgatgtgtggccccggccatggcatcgagcatttgcgatacagacacaaacaaacgaaaaatttgctattttagcctttttaacgtgggctaaatactattatgtgaccctctgtcatgatttatgggaccatctgtgtctatgatttgtgggcctgggtctaaaatagagaagttcacaactgagagtgataaaatagcaaattccccacaaacaaagatggctcagtatgtaatctaggctgaagatttctgcggcacattgaatttcatattgtcgcttggattacgagtaatcacgtatcaccacccaagaggtcacctgagccattgaccagcagtactaatattgacctttgaagcctagtcagatcagatattaataaattcgatgttttatgatagtgatactcggtagaggtaaagaaataaaggtggttcaagatttaccactatcgttatgcaatcacaaaacaaatggtactaatttattgtttgtatggaataattggtatcttgcaactcagaatgttgactgattagtcagatctactgtgtgctaactcagaatgttgattgattagtcagatctattgttttatgataatgatactcggtagaggtaaagaaatagagatctatgctaatgttttggtccacggcaaatacgaaattttggattgcaaataaccttctgcgttggcgctgtgcagaatgctcttctggggttcgagaagcttgtgaaggccaagacacaagtggttgctggcacgatgtactatctcactattgaagtgaaggatggcgaagtgaagaagctctatgaagctaaggtctgggagaagccatgggagaacttcaaggagctgcaggaattcaagcctgttgacgagggtgctagcgcctaaggtagatttgtgcatgttttacatactatc

SEQ ID NO: 570 - DNA, 466 bp, Zea mays
ttccgccccaattccccaatccagatgcgcaaacatcgaatcgtctcactcgtggctgccctgctcatactgcttgccctcgccgtatcgtccaaccgcaacgcacaggaggattccatggccgacaacaccgggacgttggtgggcggcatccaggacgtgccggagaacgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtcaagaagctctacgaagctaaggtctgggagaagccatgggagaagttcaaggagctgcaggaattcaagcctgttgaagagggtgctagcgcctaaggatctctccttctccatgtgcgagcctgaagctcaa

SEQ ID NO: 571 - DNA, 757 bp, Coix lacryma-jobi
ggcacgagccgggatctcctcctccggctataaatttccggccccaatcccccaatccagatgcgcaaacaacgaatcgtcccactcgtggctgccctgctcgtgctgctcgccctcgccgtatcgtccacccgcaacgcacgagaggaggagtccatggccgacgacgccgggatgttggccggcggcatcaaggacgtgccggcgaacgagaacgacctccacctccaggagctggcccgcttcgccgtcgatgagcacaacaagaaggccaatgctcttctggggtacgagaagcttgtgaaggccaagacacaagtggttgctggcacgatgtactatctcactattgaagtgaaggatggtgaagtcaagaagctctatgaagctaaggtctgggagaagccatgggagaacttcaaggagctgctggaattcaagcctgttgaagaggacgctagcgcctaaggatctctcttctccatgtgcaatttgctgcctgaagcgcaagacaaaagttgcagaataaggagctgctttggaacatgccagagcatgctcccttgtgtaataatttcataaaattacagtgctcttaatgtaatatctttaaattgacgtgccctgtgtaatatcatgaataacagttgctattatggattctaaatgtgtaccatggcagaagtctcatatcagtctttgttggaatacattgcagaattgccacattgctttgctgaaaaaaaaaaaaaaaaaa

SEQ ID NO: 572 - DNA, 943 bp, Zea mays
ttaaatcttgtactactgaaaatgctcttaatctcattgaaaatcgaagatcgaatccactgccatctctatccatgtccgtagcgtgacgcgtccacaacagtagaacacgtgttacgacggcgcagtttcagtgtagaaagcctagaagggtaaaatgtcctccctttccctttccaatccccacgccgccacaacaatatcgcattgacacatcgttcatcggatccagtcctctcccgggatcacctccggctataaatttccgtccccaattcacccaatccagatgcgcaaacatcgaatcgtctcgctagtggctgccctactcgtgctgcttgcccttgccgccgtttcctccacgcgcagcacacaaaaggagtccgtggctgacaacgccgggatgttggcaggcggcatcaaggacgtgccggcgaacgagaacgacctccagctccaggagctcgcgcgcttcgccgtcaatgagcacaaccaaaaggccaatgctcttctggggttcgagaagcttgtgaaggccaagacacaagtggttgctggcacgatgtactatctcactattgaagtgaaggatggcgaagtcaagaagctctatgaagctaaggtctgggagaagccatgggagaacttcaagcagctgcaggaattcaagcctgttgaagagggtgctagcgcctaaggatctgtcgtctccctgtgcaatttcctgcctgaagcgcaaaactaagttacagaataaggagctgcttcggaacatgccagagcatgcaccctcgcgtaatttcataaaatcacagggctcttaatgtaatatcttgaattgccgtgccatgtgtaataagtaatatcatgaataacagttgctactatgggttctaaaggtttattaacagccatccatgggccatggcagagttctcatatt

SEQ ID NO: 573 - DNA, 2485 bp, Hordeum vulgare subsp. vulgare
gacgccggagtccagttcactccgctgtacgatcccatcccctccgcatcggcaaggcacggcgccgacgccgacgccgatcgctcccaacccaggggccgccgggcggcgagcatgaaggctctcctgagcgcgcacgcctccgacctgctccgcggcccgcacctcgtccgcgccgccgtgctcttcttcgcctgcgccgcctccttcctcgtcggctaccgctggtccgacgcctccgcgagccccctcttcttctcctccgtcttctcccccgcgcccccctcctcccgcatctcgtctcgttccccttccgtcgccatctcgcccaactctaacatctccttcgacccatccctaatccccgcccccgcagctgctccgcccgcttcgtctactcccaatgcctcgccgccgccgccgcctccagtggcatctccgccacctccaatgccaaccccgtcgccgccgccgccgcctcccctaccgccctcgccccctcccccgcccgcccgcctcggcatcgtcggcgaggacggcgctatgcgggacgactttgacatcggcgccggcgtcaacgaaaccgatctggccaccgacgagggcgcgccgcaggagcctggcaatgcgggcgccggccgcggcaacagggttcgggttgggaagttccctgcctgccccgcgagcatgagggagtacattccctgcctcgacaacgacgaggagatcaggcggctgccctccacggagcgtggcgagcggttcgagcggcactgcccggccaaggaaaaggccctgagctgcctcgtgccagcccccaaggggtataaggcgcccatcccctggcctcggagcagagacgaggtgtggtttaccaatgtacctcatacacgattggttgatgacaaaggagggcagaattggattaccaaggctaaagataaatttacatttcctggaggaggaacccagttcatacatggagcaaatcaatacctggatcagatatctcagatggtaccagatattgcatttggctctcgcactagagttgttcttgatgttggctgtggagtagcaagttttggtgcatacttactttcacgtgatgtgttgacattgtccattgctcccaaagatgttcatgagaatcagatacagtttgctcttgagcgtggtgttcctgcaatggtggcagcatttgcaacacaccgactattatatcccagtcaagcatttgagattatccactgttcccgctgcagaataaattggacacgtgacgatggaatcctgctcctggaggttaatagaatgctaagagctggtgggtattttgcttgggcagcacagcctgtttataagcatgaagaggcccagcaagaggcgtggaaagagatggaggacctcacaacccgactttgttgggagcttgtgaagaaagagggatatgtggctatgtggaggaagcctttaaataactcatgctatatgagccgtgaacctggggtcaaacctccactttgtgatactgatgataatccagatgatgtctggtatgttggtctcaaagcatgtatcagtagattacctgtaaatggtgacggatcagctccatttccatggcctgcacgcttaatggagcctccaaggagacttcaaggtgttgaaatggatgcttactcatcaaagaatgagcttttcaaagcagaaacgaaattttgggatgacatagtcggaggttacattcgtgttttcaagtggaaaaagttcaaactccggaatgtaatggacatgagggctcgatttggagggtttggagctgcattgatcggtcgcaagcttgattgctgggtgatgaatgttgttcctgtcactgagccaaacacgctgcctgtaatttatgaccggggacttcttggagtggcccatgactggtgtgaaccctttgacacatatccaaggacttatgatctactgcatgcattcgggctattctcaaaggagcagaaaaggtgtaacgtctcaagtatcttgcttgagatggatcgcatactcaggcctggtggtagggcgtatatccgcgataacagggaaacgatagaggatatcaaagaaataacggacgccatggggtggagatccactatacgtgagaccggtgaaggcgcgcatgctagcaggaaggttttgacgtgtgacaagccgatggtgcgctagccgatcagatcaggcagaccattctccggcaagcaatgccgcggcgggcgcctgcagttttagttctccggcaccgttggaactgactaccagaactgcagtggactggaggttgacatcgcgctccgtagataggatacgtggaggtcgaagctgtaacttaatttgattcatcatttgtttgtacaagtccgatctagctcggcgtgttctgttgtaacatatatatactaatatatatacagtgatctgaagaagacttctc

SEQ ID NO: 574 - DNA, 2434 bp, Oryza sativa Japonica Group
agtccccggcagtgcacgatcccatccctcccgcatcggcaaggcaccgccgcgccgaccgctctccgcaccgcgacgcgacgcgacgcgaggcgaggcgaggcgagcatgaagcccctgggcgcgcacggcgccgacctgctctgcggcccgcgcgtcctccgcgctgcggccctcgccttcgcctgcgccgccgccttcctcgtcggctaccactggtccgactcctccccgcgcctgctcttcttctcctccaccgcctcctcctcctcctcgccgctcctctccaccggctccccttccgtcgccgtctcccccaacgccaacctctccttcgacccctccctgatccccacccctgccgcctccacgccgcctgcttctcctactgccaatgcctcgcccccaccttcgctgccgccgcctcctcctcccctccgcccccctccccctcccgcccgcctcggcatcgtcggcgaggacggcgcgatgcgcgacgacttcgacgtcgtcgtcggcggcgccaacgacaccgatctggccgccaccgacgaggccctgccgcaggagccgaccgacgcgggccccgccgtcgggagcagggttcggattgggaggttcccggtttgtcctgagagcatgagggagtacataccctgcctcgacaacgaggaagagatcaggaggctgccctcgacggagcgtggcgagcggttcgagcggcactgccctgccaaggacaagggtctgagctgcctcgtgccggcacccaaggggtataaggcacccattccttggcctcggagcagagatgaggtatggtttagcaatgtacctcacacgcggttggttgatgacaaaggagggcagaattggattagtaaagctaaggataaatttagatttcctggaggaggaactcaatttatccatggagcaaatcaatacctggatcagatttctcaaatggtaccagatattgcatttggctctcacactagagttgccctggatgttggctgtggagtagcaagttttggtgcatacttactttcacgtgatgtgttgacattatccatagctcccaaagacgttcatgagaatcagatacagtttgctcttgagcgtggtgtgcctgcaatggcagcagcatttgcgacacaccgattactatatcccagtcaagcatttgacttaatccattgttcacgctgccgaataaattggacccacgatgatggaatcctgcttctggaggttaatagaatgctcagagccggcggttattttgcttgggcagcacagcctgtttataagcatgaagaggctcagcaagaagcatggaaagagatggaagacttcactgcaagactctgttgggagcttgtgaagaaagagggatatattgctatgtggaggaaaccattaaataactcatgctacatgaaccgtgaccctggggtcaaacctgcactttgtgatcctgatgataatccagatgatgtctggtatgtcaatctgaaagcatgtatcagccggcttcctgaaaacggtgatgggctgactccctttccatggcctgcacgtttaatggagccaccaaaaaggcttgaaggtgttgaaatggatgcacactcatcaaagaaggagcttttcaaagcagaaaccaaattttgggatgacattgttgaaggttatattcgtgtttttaagtggagaaagttcaaactccggaatgtattggacatgagggctggatttggagggtttgcagctgcattgattaatcgtaaacttgattgctgggtgatgaatgttgttcctgttagtgagccaaacacactgcctgtaatctatgaccggggacttcttggagtggctcatgactggtgtgaaccatttgatacatatccaaggacatatgatctgctccatgcgtttagcctattctcgaaggaacagaaaagatgtaacatctcaagtatcttgctggagatggatcgaatactcagaccaggcggtagggcttacattcgtgacctaaaacaagttgtacaggatgtcaaagagataacaaccgccatgggatggcgatccatcatgcgtgacaccgcagaaggcccgtatgctagcaggaaggttttgatgtgcgacaagccgatggtgcgttagccgatcaggctggtccagagcaatgatgcgagccctggttttgttttccggagccttttgaactgactaccacagctactacggactggagattgacatctgtttcaatacatagggataggtgaatgccaaagttgtaactaatcaatttgattcgtcattcgtttgtacaacgactgatgtagcccctaacgattggcttgtttttgttgtatcatccacacaacagtaattatgaataggagttaggaaggtttttgag

SEQ ID NO: 575 - DNA, 2339 bp, Sorghum bicolor
atgaaggccctgggcgcgcacggcgccgacctgctccgcggcccgcacctcctccgcgccgccgttctcgctttcgccgttgcgctcgccttcctcgttggctaccactggcccaacgcctccccgcgccttgtcttcttctcgtccgccgcctcctcgtcggcgcccaggtcctcctcccgctctcctgccgtcgcgctctcccccaactccaacatctccttcgaccagtccctgatccctacccccgccaccccgcctgcttctcctgctcccaatgcctggcccccgccctcactaccaccgccgacaccggcgccgccgcctcccctcctccctcctccaccaccagcgcgcctcggcatcgtcggcgaggatggcgctatgcaggacgagttcgacatcggcagcatcggcgccaacgacactgatctggccaccgacgacaccgccccgcaggagcctagcaacgggggcgccagcggcggaccacccagggtgcggattgggaggttcccggtctgccccgagagcatgagggagtacataccctgcctcgacaacgaggaggagatcaagcggctgccctcgacggagcgcggggagcggtttgagcggcactgccctgccaaggacaagggtctcagttgcctggtgccggcgcccaacgggtacaaggcgcccatcccctggcctcggagtagagatgaggtctggtttagcaatgtgcctcacacaagattggttgatgacaaaggaggacagaattggatcaccaaggtcaaagataagttcagatttcctggaggcggaactcaattcattcatggagctaatcaatacttagaccagatttcccagatggtacctaatgttgcatttggatctcatactagagttgtcctggacgttggctgcggagtagcaagttttggtgcatatttactttcacgtgatgtcctgacattgtccatagctccaaaagatgttcatgaaaatcagatacagtttgctcttgaacgtggtgtgcctgcaatggtagcagcatttgcaacacgccgattattatatccaagccaggcgtttgacataatccattgctcacgttgccgaataaattggactcgtgatgatggtatcctgctcctggaagttaatagattgcttagagctggaggctactttgcttgggcagcccaacctgtttataagcatgaagaggcccaacaagaggcatggaaagagatggaagacctcactacccgactttgttgggagcttgtgaagaaagagggatatattgctatgtggaggaaacccttaaataactcttgctacatgaatcgtggtcctgcagtcaaacctccactttgtgatgctgatgataacccagatgatgtctggtatgttagtctgaaagcatgtattagtcggcttccagagaatgccgaagcaccaactcctgttcaatggcctgcacgcttaatggagccaccaaagaggcttcaaggtgttgaaatggatgcctactcatcaaagaatgagcttttcaaagcagaaacaaaattttgggaggacataattgatggttatatccgtgtctttaagtggaggaagttcaaactccgaaatgtaatggatatgagggctggatttggagggtttgcagctgcattgatcagccggaaacttgattggtgggtgatgaatgttgttcctattagtgagccaaatacattacctgtaatttttgatcgggggcttcttggagtagctcatgactggtgtgagccctttgatacataccctaggacgtatgatctgctgcacgcatctggtcttttctcaaaggagcagaaaaggtgtaatatctctagcatcttgctggagatggaccggatactcagaccaggtggtaaagcatatattcgtgaccggaaagaagttatacaggagatcaaagaaataacaaacgccatggggtggcgtggtactatacgtgacactgccgaaggtgcatacgccagtaggaaggttttgatgtgtgacaagcctatggggcgttaggcgatcaggggaaggtatgatgacacctttggaatttcgaattgctaagcaggggtaattttcaggcactttttggaactgacaagagctgctgtcgagactgacattcgttctgtagatagggtaggtcaaggtctaatttgtaatgatttgattgatcatccatttgtacaatgatgatcggtgtaattcctgagatgccattttttgttgtataattgtcatggaaaccttgcaaaagtgtaggagatattttttcagaagaatggtca

SEQ ID NO: 576 - DNA, 2390 bp, Zea mays
ccccttccgatcccatcccttccgcatcgtccccgaacgacgcagacggacgcaaggcacggcgccgacatctccccgtggcccgagggcccagacatgaaggccctgggcgcgcacgccgccgacctgctccgaggcccgcacctactccgcgccgccgtcttcgctttcgccgttgcgctcgccttcctcgttggctaccactggcccaacgcctccccgcgccttgtcttcttctcgtccgatgcctcctcgtcgtcgcccaggtcgtcctcccgctctccttccgtcgtgctctcccctaactctaacgtctccttcgacccatccctgatccctacccccagcaccccgcctgcttcttctactcccaatgcctggtccccgcccgcactaccaccgccgacatcggcgccgccgcctcccctcccccctcctccaccaccagcgcgcctcggcatcgtcggcgaggacggcgctatgcaggacgacttcgacatcggcaacgtcggcgccaacgacactgatctggccaccgacgagaccgcgccgcaggagcctagcgacgtgggcgccagcggtggaccacctagggtgcggattgagaggttcccggtctgccccgagagcatgagggagtacataccctgcctcgacaacgaggatgatatcaagcggctgccctcgacggagcgcggggagcggtttgagcggcactgccctgccaaggacaagggtctcagctgcctcgtgccggcgcccaacgggtacaaggcgcccatcccctggcctcggagcagagacgaggtctggtttagcaacgtgcctcacacaagattgattgatgacaaaggaggacagaattggatcaccaaggtcaaagataaattcagatttcctggaggcggaactcaattcattcatggagcaaatcaatacctagaccagatctcccagatggtaccaaatgttgcatttggatctcatactagagttgtcttggatgttggctgtggagtagcaagttttggtgcatatttactttcacgtgatgtcctgacattgtccatagctccaaaagatgttcatgaaaatcagattcagtttgctcttgaacgtggtgtgcctgcaatggcagcagcatttgcaacgcgccggttgttatatacaagccaagcgtttgatataatacattgctcacgctgccgaataaattggacccgtgatgatggtatcctgctcctggaggttaatagattgcttagagctggaggctactttgcttgggcagcccaacctgtttataagcatgaagaggcccaacaagaggcatggaaagagatggagaacctcactgcccgactttgctgggagtttgtgaagaaagagggatacatcgctatgtggaggaaacccttaaataactcttgctacattaaccgaggtcctgaaggaaaacctccactttgtgatgctgatgataacccggatgatgtctggtatgttggtctgaaagcatgtattagtcggcttccagagaatggcgaagcaccaactcctgttcaatggcctgcacgcttaatggagccaccaaagaggcttcaaggcgtcgaaatggatgcctactcatcaaagaatgagcttttcaaagcagaaacaaaattttgggacgacataattgacggttatatccgtatctttaagtggaggaagttcaaagtccggaatgtaatggacatgagggctggatttggagggtttgcagctgctttgatccgccagaaactggattggtgggtgatgaatgttgttcctattagtgagccaaatacactacctgtaatttttgatcgggggcttcttggagtagctcatgactggtgtgaaccctttgatacataccctaggacgtacgatctacttcatgcatctggtcttttctcaaaggagcagaacaggtgtaatatctctagcatcttgctggagatggaccggatactcagaccaggtggtaaagcatatattcgtgaccggaaagaagttatacaggagatcaaagaaataacgaatgccatggggtggcgtggtactatacgtgacactgccgaaggcgcgtacgccagtaggaaggttttgatgtgcgacaagcctatggcgcgttaggcgatcaggtgaagacaagcaggggtaattttaggtacttttgcaactgaaaagagctgctgtcgggactgacatttgtgctgtagatagggtaggtcaaggactaatttgtaactatttgattgatcatccatttgtaaaatgatgatctgtgtagtttctgacatgtgccaatttcttttgttgaaacattgtcatggaaaccctacaaaagtgggggaaatacg

SEQ ID NO: 577 - DNA, 2429 bp, Zea mays
aggcgatcccatattccccttccgatcccatcccttccgcatcgtccccgaacgacgcagacatctccccgtggcccgagggcccagacatgaaggccctgggcgcgcacgccgccgacctgctccgaggcccgcacctactccgcgccgccgtcttcgctttcgccgttgcgctcgccttcctcgttggctaccactggcccaacgcctccccgcgccttgtcttcttctcgtccgatgcctcctcgtcgtcgcccaggtcgtcctcccgctctccttccgtcgtgctctcccctaactctaacgtctccttcgacccatccctgatccctacccccagcaccccgcctgcttcttctactcccaatgcctggtccccgccctcactaccaccgccgacatcggcgccgccgcctcccctcccccctcctccaccaccagcgcgcctcggcatcgtcggcgaggacggcgctatgcaggacgacttcgacatcggcaacgtcggcgccaacgacactgatctggccaccgacgagaccgcgccgcaggagcctagcgacgtgggcgccagcggtggaccacctagggtgcggattgagaggttcccggtctgcccggagagcatgagggagtacataccctgcctcgacaacgaggatgatatcaagcggctgccctcgacggagcgcggggagcggtttgagcggcactgccctgccaaggacaagggtctcagctgcctcgtgccggcgcccaacgggtacaaggcgcccatcccctggcctcggagcagagacgaggtctggtttagcaacgtgcctcacacaagattgattgatgacaaaggaggacagaattggatcaccaaggtcaaagataaattcagatttcctggaggcggaactcaattcattcatggagcaaatcaatacctagaccagatctcccagatggtaccaaatgttgcatttggatctcatactagagttgtcctggatgttggctgtggagtagcaagttttggtgcatatttactttcacgtgatgtcctgacattgtccatagctccaaaagatgttcatgaaaatcagattcagtttgctcttgaacgtggtgtgcctgcaatggcagcagcatttgcaacgcgccggttgttatatccaagccaagcgtttgatataatacattgctcacgctgccgaataaattggacccgtgatgatggtatcctgctcctggaggttaatagattgcttagagctggaggctactttgcttgggcagcccaacctgtttataagcatgaagaggcccaacaagaggcatggaaagagatggagaacctcactgcccgactttgctgggagtttgtgaagaaagagggatacatcgctatgtggaggaaacccttaaataactcttgctacattaaccgaggtcctgaaggaaaacctccactttgtgatgctgatgataacccggatgatgtctggtatgttggtctgaaagcatgtattagtcggcttccagagaatggcgaagcaccaactcctgttcaatggcctgcacgcttaatggagccaccaaagaggcttcaaggcgtcgaaatggatgcctactcatcaaagaatgagcttttcaaagcagaaacaaaattttgggacgacataattgacggttatatccgtatctttaagtggaggaggttcaaagtccggaatgtaatggacatgagggctggatttggagggtttgcagctgctttgatccgccagaaactggattggtgggtgatgaatgttgttcctattagtgagccaaatacactacctgtaatttttgatcgggggcttcttggagtagctcatgactggtgtgaaccctttgatacataccctaggacgtacgatctacttcatgcatctggtcttttctcaaaggagcagaacaggtgtaatatctctagcatcttgctggagatggaccggatactcagaccaggtggtaaagcatatattcgtgaccggaaagaagttatacaggagatcaaagaaataacgaatgccatggggtggcgtggtactatacgtgacactgccgaagggcgtacgccagtaggaaggttttgatgtgcgacaagcctatggcgcgttaggcgatcaggtgaagacaagcaggggtaattttaggtacttttgcaactgaaaagagctgctgtcgggactgacatttgtgctgtagatagggtaggtcaaggactaatttgtaactatttgattgatcatccatttgtaaaatgatgatctgtgtagtttctgacatgtgccaatttcttttgttgaaacattgtcatggaaaccctacaaaagtgggggaaatacgaagagaccgttttaaactaaaaaaaaaagaaaaaaaaaaaaaaaaaa

SEQ ID NO: 578 - DNA, 975 bp, Sorghum bicolor
atggcgcacgcgaaagcaggagcgtctctgccggtgcccaacgtgcaggcactcgctcagacttggcatggatcaggcgagccagggcctgtccggtacgtcaggacagaggagaccagcgccggggaggtcgtcgccggctgcgccattccagtcgtggatctcagcaggttgcttgacccgcgatcgtcggaagaggagctcgcaaacctcggctctgcctgtcagcactggggtttctttcagcttatcaaccatggggtggtggacgaggtgatccaggacgtgaagagagacatgatcgagttcttcaagctcccgctggaggccaagaaggtgcacgcgcaggtaccgggcggcctggagggctacggccaggccttcgtcttctccgagacccagaagctggactgggcggacatgatctacctcatgatcagccccaaggagtcgcgggacctgaggttctggcctacccggcctccgtccttcagggactccgtggacaggtactcggccgaggtggcgaaggtgacggtgtgcctgctgcggttcatggccgcggacctaggcgtggagccgaagcgcctcctggaggcgttccggggacagccgcagagcatgcggacgacctattacccgccgtgcaggcaggccgccgatgtgctgggcctgtcgccgcacaccgacgccactggcctggcgctgctgctccacgtcaacgacgtgcagggcctgcagatctggagggacggcaagtggcacgccgttgaccctctcgatggcactttcgtcgtcagcatcggcgacatactggagattctaagcaacgggaggtacagaagcattgagcacaaagccgtggtccacccggacaaagagcgcatctcggcggcgatgttccatcagcctcggcagcgatgttccatcagccgtgccccaacacgacggtcggccctctgccggagctcgtga

SEQ ID NO: 579 - DNA, 1242 bp, Zea mays
ctgaaatggaaactgtcaactggccactataatctctcagatcgtcaatggcgcacgcgaaagccggagcgtctctgccggtgcccaacgtgcaggcactagctcagacttggcatggatcaggcgagccggtgcctttccggtacgtcaggacagaagagatcgtcgccggcgaagtcgtcgccggctgcgccatcccggtcgtggatctcagcaggttgcttgacccgcggtcgtccgaagaggagctcgcaaacctcggctctgcctgtcagcactggggtttctttcagcttatcaaccatggggtgccggacgaggtgatccaggacacgaagaaagacatggtggagttcttcaagctccctgtggaagccaagaaggtgcacgcgcaggtaccgggcggcatcgagggctacggccaggccttcgtcttctccgagacccagaagctggattgggcggacatgatctacctcatgattagccccaaggagtcgcgggacctgaggttctggcccacccggcctccctccttcagggactctatcgaaaggtactcggccgagacggcgaaggtgacggcgtgcctgctgcggttcatggccaaggacttgggcgtggagccggagcgcctcctggaggagttccggggattgccgcagagcatgcggacgacctactacccgccgtgcaggctggccgccgatgtgcttggcctgtcgccgcacaccgacgccaccggcctgacgctgctgctccacgtcaacgacgtgcagggcctgcagatcaggagggacggcaagtggctcgccgttgaccctctggacggtgctttagtcgtcagcatcggcgacatactggagattctaagcaatgggaggtacagaagcattgagcacagagccattgtacacccggacaaagaacgcatctcggcggcgatgttccatcagacatgccccaacacgacggtcggccctctgcaggagctcgtggaaagagacagtggcggggcacggtacagatccatggactacatggatttcatgaagggcttcttcgcggccaagctcgatgggcgaaggagccacatggacgctttgaggatatactagtccaaatgctggatgaatcatgttcctgtcttcataatgaattggacaactagtagtaaaatatctaaggctatccccaatagttcctctatctttatcctctatcacatcccgtattttgggt

SEQ ID NO: 580 - DNA, 964 bp, Sorghum bicolor
atctctcaggatttccgcaggaaggagaggattcagatcgtcaatggcgcacgcgaaagcaggagcgtctctgccggtgcccaacgtgcaggcactcgctcagacttggcatggatcaggcgagccgatgcctgtccggtacgtcagaacagaggagaccagcgccggggaggtcgtcgccggctgcgccatcccagtcatggatctcagcaggttgcttaacccgcggttgtccgaagaggagctcgcaaacctcggctttgcctgtcagcactggggtttctttcagcttatcaaccatggggtgccggacgaggtgatccaggacgtgaagagagacatgatcgagttcttcaagctcccgctagaagccaagaaggtgcacgcgcaggtaccgggcggccttgagggctacggccaggccttcgtctactccgagacccagaaactggactggtcggacatgatctacctcaggatcagccccatggagtcgcgggacttaaggttctggcccactcggcctccctccttcagggactccgtcgataggtactcggccgagacggcgaaggtgacggcgagcctgctacggttcatggccgtggatctgggggtggagtcggagcgcctcctagaggcgttccggggacagccgcagagcatgcggacgagctactacccggcgtgcaagcaggtcgccgatgtgctgggcctgtcgccgcacaccgacgccaccctggcgctgctgctccacgtcaacgacgtgcagggcctgcagatcaggagggatggcaagtggcacgccattgaccctatcgacggcgctttcgtcgtaagcatcggcgacatactggaggtatatataatacgagagatgttgatgcctgataggcacaggcagttgacccaaatactcaccctgtttgaatccttgaaattaaattcattttcataattataa

SEQ ID NO: 581 - DNA, 1338 bp, Sorghum bicolor
aagtagtacttactactgtaaatgtgtgtgtgtgagagagattactctaatctatatcgtacagagacaagtttacagcaggaagaagaggaaccaacactattatccatggcgcacgcgaaatccgccggagggaatctgcaggttcccaacgtgcaggctctgtcgcagacctggaaccaatcaggcgagctggtgcccgcacggtatgtcaggacggaggagaccagcgacgctgtggtcgtcgccggctgcgctctcccggtcgtcgatctcggcaggctgctcgacccgaggtcgtcgcaggaggagctcgcagtgctcgggtctgcctgccagcaaggtttctttcagctcgtcaaccatggggtgccggacgatgtggtcttggatgtcaggagagacatagccgagttcttcaggctgccgctcgaagccaagaaggtgtacgcgcagctaccagacggcctggagggctacggccaggccttcgtcttctccgaggctcagaagcttgactggtcggacatgatgtacctcatgctccgccccgtcgagtcgcgggacatgagcttctggcccgtccaccctccgtcgttcaggacctccgtggatcggtactcggcagaggcggcgaaggtggtgtggtgcctgctgcggttcatggccgcggacatgggcgtggaaccggagcttctccaggagatgttcgccggccagccgcagaccatgaagatgacgtactacccaccgtgccggcaggccgacaaggtgatcggcctgtcgccgcacacggacgcctgcgccgtgacgctgcttctccacgtcaacgacgtgcagggcctgcaaatcaggatggacgatggcaaatggcaccccgttgaacctctcgacggcgcactcattgtcagcgtcggtgacatcatcgagattctaagcaatgggaagtacagaagcattgagcacagagccgtggtgcacccggacaaagagcgcatctcagcggcaatgttccatcagccgcgcggtagcataacggtggaacctctaccggagttggtgaagaaagatggcggcgtagcacggtacaaatcagttggctacgccgaattcatgaagcgcttcttctcagccaaactcgatggacgaaaaggccacctcgaccacttcagggtctaattaaaagataatgaaatatcatgatatatcaaaagaaatgtcaggcatatcaaaagataatgttctcccgtcaatgacgtatatggattactgattgtttctatgctggggctaccagcttgtgatgcttgacataagtaaaaataaaaggcacttgtg

SEQ ID NO: 582 - DNA, 2681 bp, Zea mays
acagcgccagcgcggcagagagtcgagaccttctagctaggccgctgccacgtcaaaactagctcctccagacaaccaatcagctagccgaagccggtcgattagcatgcagcagcgctagtagacgtcgtctccgggtctccactctccacacagaaacccatacaaaatccgcatccagaatcaccggagatacgagtccgcgcgtacgttgcagttgaattgtgaagagaggctgtgcgcagtgctgctgctgcttcttcttcttcgacgcatgcacgcacatggatggtgctgctgagtgctgacctccggccgtacgtgatcttcgatctccacacggcggcaagcgatcgagaggcgtggttcccgtggcgtcaaccgacacctagcagctgctagctcatctgcttgatctctagctgagactccgagcaaaatgcagcagccaggaacaacaagctaggccccctcacgcagaccgcacgaccgagcgcgcggcattgaccgacccatcgccgccgccgccgcctcgatcgaccatgacgcttgcgagcacggacaaggtggtgctgggatgcatcgcgttcagcatcttctgggtgctggccgtcttcccctcggtgccgttcatgccggtgggccgcaccgcgggctcgctcctgggcgccatgctcatggtgctcttccgcgtgatgaccccggaggaggcctacaaggccatcgacctcccgatcctgggcctgctcttcggcaccatggtggtcagcatcttcctggagcgcgccgacatgttcaagtacctcggcagcgcgctggcgtggcggagccggggcagcaaggacctgctgttccgcgtctgcctcgtgtccgccgtggccagcgcgctcttcaccaacgacacctgctgcgtggtgctcaccgagttcatcctcaagctggcgcggcagaacaacctgcccccgcagccgttcctgctggccctcgcctccagctccaacatcggctcctccgccacgcccatcggcaacccgcagaacctcgtcatcgccgtgcagagcggcatcaccttcggccagttcctcgtcggcgtcttcccggccatgatcgtcggcgtcgccgccaacacctgcatcctgctctgctacttctggaggtgcctctccgcgccggagaaggaccaggagggcggcgccgccgccgcggggcccgacgtcgccgtcgtggccgacgaggaggtcacctcgcacaggttcacgccggcgcggatgtcgcgcgcctcgtccgtcaacgggggcggcgccgacgccgactgcgtcggcgagctcatccgccggagcgatagcctcagccgggccgacactacgctaggcatgagcatgaggagccggagctacaactcggagggcggcgacatccaggtcgccatcaggtccatgcgcgcgtccagcatgtcgcaggagatggtggaggtgtccaccgtctgcgacaggcgcgacgacggcggtgccgggcccagaaaggtcaccaggaccaccagccaccagcgcagcgtcatcatcgaggacgcgcccgaggctgacgccgccgacgacgacgacgatggccacaagggcaaggacggtgacagcgtcaccaacaaggagaagaggtggaaggtgctcgtgtggaagactgccgtgtatctcaccacccttgggatgctggccgcgctcctcatggggctcaacatgtcctggtccgccatcactgctgctcttgtccttctcgcgcttgatttcactgacgcacaggcgtgcctggagaaggtgtcatactctttgctgatcttcttctgcggcatgttcataacggtcgacggcttcaacaggaccggcatacccaatgcgctctgggagctggtcgaaccgcactcgagaatcgacagcgccaaaggcacggcgcttctcgcagtcgtgatcctagtcctttcaaatgtggcctcaaacgttccaactgttcttctgctgggcacaagggtggcagcgtcagcaggcacaatctccccagagtcagagaagaaagcctggctcatactagcatgggtgagcacggtggccggcaacctgaccctcttgggctcggcggcgaacctgatcgtctgcgagcaggcgcggcgggcacagttcttcgggtacaacctcaccttctggagccacctccgcttcggcttgccgtcgacgatcatcatcacggcgatcggcctgctcatcgtcgccagttactgaaccccacacaagctagggtctcggcctcgcacaaacggcggggtgtgtagccagatggcaggcagaacgctgcagaaaacagcatgcagcactgcctgacatcgaaggagatgttgtactgattggcctttgtttgtacgttgtaacagtttttatgtcgttcgtgtaagtctgtacgtttcgcgcaaccgatgccgcaaggcgccgggttgcccatctgctaaggcaaataatgcgcaagactagtagatggcatggagtatagaaggccggcaccactgttctaggaaggcaaaaacttgctctagctagttcaggtaggagagccggcgaaaatgtatggtgtgcttctcgatttggtaatgtcaagggacttgtccttatgtttggagcaaagaaaaaaaaaaaaaaaaa

SEQ ID NO: 583 - DNA, 2016 bp, Zea mays
cgcaccgcgggctcgctcctgggcgccatgctcatggtgctcttccgcgtgatgaccccggaggaggcctacaaggccatcgacctcccgatcctgggcctgctcttcggcaccatggtggtcagcatcttcctggagcgcgccgacatgttcaagtacctcggcagcgcgctggcgtggcggagccggggcagcaaggacctgctgttccgcgtctgcctcgtgtccgccgtggccagcgcgctcttcaccaacgacacctgctgcgtggtgctcaccgagttcatcctcaagctggcgcggcagaacaacctgcccccgcagccgttcctgctggccctcgcctccagctccaacatcggctcctccgccacgcccatcggcaacccgcagaacctcgtcatcgccgtgcagagcggcatcaccttcggccagttcctcgtcggcgtcttcccggccatgatcgtcggcgtcgccgccaacacctgcatcctgctctgctacttctggaggtgcctctccgcgccggagaaggaccaggagggcggcgccgccgccgcggggcccgacgtcgccgtcgtggccgacgaggaggtcacctcgcacaggttcacgccggcgcggatgtcgcgcgcctcgtccgtcaacgggggcggcgccgacgccgactgcgtcggcgagctcatccgccggagcgatagcctcagccgggccgacactacgctaggcatgagcatgaggagccggagctacaactcggagggcggcgacatccaggtcgccatcaggtccatgcgcgcgtccagcatgtcgcaggagatggtggaggtgtccaccgtctgcgacaggcgcgacgacggcggtgccgggcccagaaaggtcaccaggaccaccagccaccagcgcagcgtcatcatcgaggacgcgcccgaggctgacgccgccgacgacgacgacgatggccacaagggcaaggacggtgacagcgtcaccaacaaggagaagaggtggaaggtgctcgtgtggaagactgccgtgtatctcaccacccttgggatgctggccgcgctcctcatggggctcaacatgtcctggtccgccatcactgctgctcttgtccttctcgcgcttgatttcactgacgcacaggcgtgcctggagaaggtgtcatactctttgctgatcttcttctgcggcatgttcataacggtcgacggcttcaacaggaccggcatacccaatgcgctctgggagctggtcgaaccgcactcgagaatcgacagcgccaaaggcacggcgcttctcgcagtcgtgatcctagtcctttcaaatgtggcctcaaacgttccaactgttcttctgctgggcacaagggtggcagcgtcagcaggcacaatctccccagagtcagagaagaaagcctggctcatactagcatgggtgagcacggtggccggcaacctgaccctcttgggctcggcggcgaacctgatcgtctgcgagcaggcgcggcgggcacagttcttcgggtacaacctcaccttctggagccacctccgcttcggcttgccgtcgacgatcatcatcacggcgatcggcctgctcatcgtcgccagttactgaaccccacacaagctagggtctcggcctcgcacaaacggcggggtgtgtagccagatggcaggcagaacgctgcagaaaacagcatgcagcactgcctgacatcgaaggagatgttgtactgattggcctttgtttgtacgttgtaacagtttttatgtcgttcgtgtaagtctgtacgtttcgcgcaaccgatgccgcaaggcgccgggttgcccatctgctaaggcaaataatgcgcaagactagtagatggcatggagtatagaaggccggcaccactgttctaggaaggcaaaaacttgctctagctagttcaggtaggagagccggcgaaaatgtatggtgtgcttctcgatttggtaatgtcaagggacttgtccttatgtttggagc

SEQ ID NO: 584 - DNA, 2623 bp, Zea mays
gcgccagcggcagagagtcgagaccttctagctaggccgctgccacgtcaaaactagctcctccagacaaccaatcagctagccgaagccggtccattagcatgcagcagcgctagtagacgtcgtctccgggtctccactctccacacagaaacccatacaaaatccgcatccagaatcaccggagatacgagtccgcgcgtacgttgcagttgaattgtgaagagaggctgtgcgcactgctgctgctgctgcttcttcttcttcgacgcgtgcgtacgtgcacatggatgctgctgacctcccgtgatcttcgatctccacacggcggcaagcgatcgagaggcgtggttcccgtggcgtcaaccgacacctagcagctgctagctcatctgcttgatctctagctgagactccgagcaaaatgcagcagccaggaacaacaagctaagctaagccccctcacgcagaccgcacgaccgagcgcgcggcattgaccgacccatcgccgccgcctcgatcgaccatgacgcttgcgagcacggacaaggtggtgctgggatgcatcgcgttcagcatcttctgggtgctggccgtcttcccctcggtgccgttcatgccggtgggccgcaccgcgggctccctcctgggcgccatgctcatggtgctcttccgcgtgatgaccccggaggaggcctacaaggccatcgacctcccgatcctgggcctgctcttcggcaccatggtggtcagcatcttcctggagcgcgccgacatgttcaagtacctcggcagcgcgctggcgtggcggagccggggcagcaaggacctgctgttccgcgtctgcctcgtgtccgccgtggccagcgcgctcttcaccaacgacacctgctgcgtggtgctcaccgagttcatcctcaagctggcgcggcagaacaacctgcccccgcagccgttcctgctggccctcgcctccagctccaacatcggctcctccgccacgcccatcggcaacccgcagaacctcgtcatcgccgtgcagagcggcatcaccttcggccagttcctcgtcggcgtcttcccggccatgatcgtcggcgtcgccgccaacacctgcatcctgctctgctacttctggaggtgcctctccgcgccggagaaggaccaggagggcggcggcgccgccgccgcggggcccgacgtcgccgtcgtggccgacgaggaggtcacctcgcacaggttcacgccggcgcggatgtcgcgcgcctcgtccgtcaacgggggcggcgccgacgccgactgcgtcggcgagctcatccgccggagcgatagcctcagccgggccgacactacgctaggcatgagcatgaggagccggagctacaactcggagggcggcgacatccaggtcgccatcaggtccatgcgcgcgtccagcatgtcgcaggagatggtggaggtgtccaccgtctgcgacaggcgcgacgacggcggtgccgggcccagaaaggtcaccaggaccaccagccaccagcgcagcgtcatcatcgaggacgcgcccgaggctgacgccgccgacgacgacgacgatggccacaagggcaaggacggtgacagcgtcaccaacaaggagaagaggtggaaggtgctcgtgtggaagactgccgtgtatctcaccacccttgggatgctggccgcgctcctcatggggctcaacatgtcctggtccgccatcactgctgctcttgtccttctcgcgcttgatttcactgacgcacaggcgtgcctggagaaggtgtcatactctttgctgatcttcttctgcggcatgttcataacggtcgacggcttcaacaggaccggcatacccaatgcgctctgggagctggtcgaaccgcactcgagaatcgacagcgccaaaggcacggcgcttctcgcagtcgtgatcctagtcctttcaaatgtggcctcaaacgttccaactgttcttctgctgggcacaagggtggcagcgtcagcagttgcaatctccccagagtcagagaagaaagcctggctcatactggcatgggtgagcacggtggccggcaacctgaccctcttgggctcggcggcgaacctgatcgtctgcgagcaggcgcggcgggcacagttcttcgggtacaacctcaccttctggagccacctccgcttcggcttgccgtcgaccatcatcatcacggcgatcggcctgctcatcgtcgccagttactgaacggaaccccacacaagctagggtctcggcctcgcacaagcggcggggtgtgtagccagatggcaggcagaacgctgcagattggcctttgtttgtacgttgtaactgtttttatgtcgtttgtgtaagtctgtacgtttcgcgcaaccgatgccgcaaggcgccgggttgcccatctgctaaggcaaataatgcgcaagactagtagatggcatggagtatagaagggcggcaccactgttctaggaaggcaaaaacttgctctagctagttcaggtaggagagccggcgaaaatgtatggtgtgcttctcgatttggtaatgtcaagggacttgtccttaaaaaaaaaataaaaaaaaaaaaaaaaa

SEQ ID NO: 585 - DNA, 2611 bp, Oryza sativa Japonica Group
agctactctgcttcggtgttggttatatccacgagagtacgagagacgcgcgcgggcgcgagctgaggttgctgctgcagcgcaggcaaagaggggcaagctagcgcaagcgacgctaagcccgcgcgcgcctgcgtgcgtgcgtcgtcggagagcgcgggcgccaaacggcgccgcggcggagtacgtcgagcgtcgcgtggacgttggcagcggcaaggtttcctctggatacaccgttcttgagtttgagttgggcaaggaggttgtgaacgtagcctgaacctgacctgagattgtgaacgtaattttggggggaaaggttgttctgtactgtctcttcaatctgtgagttcgtgacaggttcttgcaaaaaccaaaacatcatcagtgaaaaattgttcgtagcattttagctctagtatagatcgatcaatcgatcgttcgttcgttcgatcgttcgaggacgagagatttgctaacatggcgttggcagggacctccaaagtagtgctgggatgtgtcgcgtttgggatattctgggtgctggccgtcttccccaccgtcccgttcatgcccgtcggccgtacggccggctccctccttggcgccatgctcatggtcctcttccgtgtcatctcgccggaggacgcctatgccgccatcgacctcccaatcatcggcctcctctttggcaccatggtcgtcagcatcttcctcgagagggctgacatgttcaagtacctcggcaacctgctctcctggaagagcaggggcagcaaggacctgctcttccgcgtctgcatcgtgtccgccattgccagcgcgctcttcaccaatgacacctgctgcgtcgtgctcaccgagttcatcctcaaggttgccaggcagaacaacctgccgccgcagccgttcctcctcgccctcgccaccagctccaacatcggctccgcggcgacgcccatcggcaacccgcagaaccttgtcattgccgtggagagcggcatctcctttggacagttcttgcttggagttttcccggcgatgatcgtcggcgtcctgacaaatgctgccatcctcctctgttacttctggaagtacctttcagtggagaaggatcaggaaggcgggcagccggctgggccggaggtggtcgccgacgacgaggtcacctcacacaggttcacacctgcaagaatgtcacacgtctcatctctgaacccggatgatatggactgcataagtgagccaatcatcaggagcaacagcgtgaggagcaccagtgctaatgagaatctgaggagcaggagtgtgaattcggaggcggacatacagctcgcgatcaagtcgctccgggcatcgagcatgtcgcatgagatggtcgaggtctcaactgtcactgacaggagggatgaaggtgcatcctccaggaagttcacaagaactgctagccagcagaggagtgtgatcatagaggactcgccgccgtctcccgccagcaatggcgacaaggagaaggaagatgaggttgcggagaagagatggagggtgtttgtgtggaagactgctgtttatctcatcactcttggcatgctcattgcacttctcatggggcttaacatgtcatggacagccatcactgcggctcttgttcttctggcgcttgattttactgatgcacaggcttgtctggagaaggtgtcatactcattgctgatcttcttctgcgggatgtttattacggtcgatggcttcaacaaaactggcataccgaacacactttgggagctcgttgaaccgtattcacgaattgacagtgctaagggtgttgctcttcttgctgtggtaattcttatcctctcaaatgtggcctcaaatgttcccacagtactactgctcggcacaagagtggctgcatcagctgctgcaatctctcacgattcagagaggaaggcctggcttatcctagcgtgggtcagcaccgttgccgggaacctcacactactgggctcggctgcgaacctcatcgtctgcgagcaggctagaagagctcagttcttcggctacaacctctccttctggagccacctccggttcggggtgccgtcgaccatcgtcgtcacggcgatcgggctgctcatcgtcaccagttactgaagaagaagaagaagaagaagaagctgacagcagcataaggtagcgtacaagaaggagatagatgaacgaaccctttggatcaataagagagagtacatgtaaaatttctaaaataggcttgtcctgtaaaactcgtgtgtgttttgtgtgtatctatgccagctgctgcgtctgtgcccttgctcttttgttgtcgctaagcagacggtgattgagaaggatgcagatgtagcaggctaagcaacctgcattttcagtgtttttcttcagagtcggaagttgcaaatagggcgagtaaatgaagaatgctatgacaatctgattttagtttttatatttgtttcctactcaattaatttgtagccgcggtagaattttggaaatggtgtttgtacaactgcacatgcgcatggttactactagatcaaattgttttttccgcgggaaaaaggcc

SEQ ID NO: 586 - DNA, 2672 bp, Zea mays
accggagacacgtaccggaccagcagccggacgggcgtatcaaacataacaagctagctaaggccgcctcgctcgctcagcatatacggaggcagccgccggtaggccgcgcgcgcgtgcatccatccatccatccgtcgtccaccgcccgcgcgcgctcgccaccgcacccagctagcagcacaagaaaagtctggtggtggcgtcgacggcggcggcggccggcttgcctcagtccaatccttggaccggccaaaaagcagttgaaggcgcgagcgagcaagctagcgcgccccttcgtcgctacgcctacgcgcgatcgagccgggcattgctgacctcgagttaagttgggcgaggagaggtggttcattccagcagggatccttctcgtgagcccagtcgatctgaccgtccttggtatctgggggggttgttctgtactctctctttaatttgtgagtcgtgacaggttcttgaagtgcaattgttaagagttttagttgtagaggaagagaaggatttgctaatatggcgttggcagggacctccaaagtagtgctgggatgtatcgcctttgggattttctgggtgatggccgtcttccccaccgtcccgttcatgcctgttgggcggacggctgggtccctccttggtgctatgctaatggtcctgttccgcgtcatctccccggaggacgcgtacgccgcgattgacctcccgatcatcggcctgctcttcgggacaatggtcgtcagcatcttccttgagagggctgacatgtttaagtacctcgggaacctgctctcgtggaagagcagaggcagcaaggacctgctcttccgagtctgcatcgtgtccgcgtttgccagcgcgcttttcaccaatgacacatgctgtgttgtcctcacagagttcatcctcaaggttgctaggcaaaacaacctgccaccacagcctttccttctggcccttgccactagttcgaacatcggctctgctgccacgccgatcggcaaccctcagaaccttgtcatagctgtcgagagtgggatctcatttggccagttcttgctgggagttttcccagctatgatcgttggggttctcacaaacgctgctatcctccttttgtacttctggaaatacttgtcggtggagaaggatcaggagggtgggcagcccacaggaccagaggtggttgccgacgatgaggttacttcccatcggttcacaccggctagaatgtcacatgtttcttctctgaatccagatgacatggattgcgtaagcgaaccgatcatcaggagcaacagtgtcagtactactgggaatgagaacctgagaagcagaagcatcaattctgaggctgacattcagcttgcgatcaagtctctgcgggcatcaagcatgtcgcatgagatggtagaggtctcgacggttcctgatcggagagatgaaggtgcatcctcaaggaagttcacaaggactgccagccagcaaaggagcgtgataatagaggatttagcaccctccccagagattaatggggaaaaggagaaagaaactgaagttgcagagaagagatggaaagtacttgtgtggaagactgctgtttatcttatcactctcggtatgctcattgcacttctaatgggactgaacatgtcctggactgcaatcactgcagctcttgttcttctggcactcgattttacggacgcacaagcttgtctcgagaaggtgtcatattcactgctgatctttttctgcgggatgtttatcactgttgatggcttcaacaaaacgggcataccgaacacactatgggagttagtggaaccatattcacgaatcgatagcgctaaaggtgttgcacttcttgctgtggtgattcttatcctttcaaacgtggcctctaatgttcctacagtcctattgctcggtacaagagtggctgcatcagcggcttcgatttctcatggttcagagaggaaagcctggctcatccttgcatgggtcagcaccgtggctgggaacctcaccctcctaggctctgcggcgaatctgattgtctgcgagcaggccaggcgggcccagttctttggctacaacctcaccttctggagccacctccggttcggggtcccgtcgaccatcatcgtcacggcgattggtttgctcatcgtcatcagttactgaaacagctgaaggcagaagagcgtagtgtacgagaagcagaatggataaaaatccttccaataagaagtacatgtaaattaggcttgccctataactcaagtgtgtatcggtacgttatgtctccgtctgagctcttgctcgtgagcaagcagcacatggctgaccgtgtagcttgcatttccattgcataataggcttatgaagaatgctttggtaatatgattttacagtctgacaaggattgtgaagcagaggcagtgtaccatcaagataatacctctggaagcatataaaaaaaatcgtatatttggatttcaaatccagtctgcttcagactggaaattcatattatcttctggaatcgtgctttattgtcagaaacatgggctaaaattggaaagtccgtcatttattggtcttgcaatgggacaaccttttgggtctgttatataccaaaaaaaaaaaaaaaa

SEQ ID NO: 587 - DNA, 2386 bp, Zea mays
acacgctcacgcggctcccatggtgcacagccacggccacgggccatggcgacaccccccgcggcccgcctatttagccgcccccactcacatcgcggcggggtctccatgcctgcagtccagagtccagactccaggactaccagtctaccaccacttcgtctcgtcctcacacctcactccaccacctctgccttgcaaagccttccacaccgatccgccgcctcgtccgcgcgctcgcaggcagcagtgtggactacccgccccatactccatcccctactcgaaggacctcgagttaagttgggcgaggagaggtggttcattccagcagggatccttctcgtgagcccagtcgatctgaccgtccttggtatctgggggggttgttctgtactctctctttaatttgtgagtcgtgacaggttcttgaagtgcaattgttaagagttttagttgtagaggaagagaaggatttgctaatatggcgttggcagggacctccaaagtagtgctgggatgtatcgcctttgggattttctgggtgatggccgtcttccccaccgtcccgttcatgccttttgggcggacggctgggtccctccttggtgctatgctaatggtcctgttccgcgtcatctccccggaggacgcgtacgccgcgattgacctcccgatcatcggcctgctcttcgggacaatggtcgtcagcatcttccttgagagggctgacatgtttaagtacctcgggaacctgctctcgtggaagagcagaggcagcaaggacctgctcttccgagtctgcatcgtgtccgcgtttgccagcgcgcttttcaccaatgacacatgctgtgttgtcctcacagagttcatcctcaaggttgctaggcaaaacaacctgccaccacagcctttccttctggcccttgccactagttcgaacatcggctctgctgccacgccgatcggcaaccctcagaaccttgtcatagctgtcgagagtgggatctcatttggccagttcttgctgggagttttcccagctatgatcgttggggttctcacaaacgctgctatcctccttttgtacttctggaaatacttgtcggtggagaaggatcaggagggtgggcagcccacaggaccagaggtggttgccgacgatgaggttacttcccatcggttcacaccggctagaatgtcacatgtttcttctctgaatccagatgacatggattgcgtaagcgaaccgatcatcaggagcaacagtgtcagtactactgggaatgagaacctgakaagcagaagcatcaattctgaggctgacattcagcttgcgatcaagtctctgcgggcatcaagcatgtcgcatgagatggtagaggtctcgacggttcctgatcggagagatgaaggtgcatcctcaaggaagttcacaaggactgccagccagcaaaggagcgtgataatagaggatttagcaccctccccagagattaatggggaaaaggagaaagaaactgaagttgcagagaagagatggaaagtacttgtgtggaagactgctgtttatcttatcactctcggtatgctcattgcacttctaatgggactgaacatgtcctggactgcaatcactgcagctcttgttcttctggcactcgattttacggacgcacaagcttgtctcgagaaggtgtcatattcactgctgatctttttctgcgggatgtttatcactgttgatggcttcaacaaaacgggcataccgaacacactatgggagttagtggaaccatattcacgaatcgatagcgctaaaggtgttgcacttcttgctgtggtgattcttatcctttcaaacgtggcctctaatgttcctacagtcctattgctcggtacaagagtggctgcatcagcggcttcgatttctcatggttcagagaggaaagcctggctcatccttgcatgggtcagcaccgtggctgggaacctcaccctcctaggctctgcggcgaatctgattgtctgcgagcaggccaggcgggcccagttctttggctacaacctcaccttctggagccacctccggttcggggtcccgtcgaccatcatcgtcacggcgattggtttgctcatcgtcatcagttactgaaacagctgaaggcagaagagcgtagtgtacgagaagcagaatggataaaaatccttccaataagaagtacatgtaaattaggcttgccctataactcaagtgtgtatcggtacgttatgtctccgtctgagctcttgctcgtgagcaagcagcacatggctgaccgtgtagcttgcatttccattgcataataggcttatgaagaatgctttggcaaaaaaaaaaaaaaaa

SEQ ID NO: 588 - DNA, 2257 bp, Zea mays
caccacctctgccttgcaaagctttccaccgatccgccgcctcgtccgcgcgctcgcaggcagcagtgtggactacccgccccatactccatcccctactcgaaggatacaccgacctcgagttattaagttgggcgaggagaggtggttcattccagcagggatccttctcgtgagcccagtcgatctgaccgtccttggtatctggggggggttgttctgtactctctctttaatttggacctccaaagtagtgctgggatgtatcgcctttgggattttctgggtgatggccgtcttccccaccgtcccgttcatgcctgttgggcggacggctgggtccctccttggtgctatgctaatggtcctgttccgcgtcatctccccggaggacgcgtacgccgcgattgacctcccgatcatcggcctgctcttcgggacaatggtcgtcagcatcttccttgagagggctgacatgtttaagtacctcgggaacctgctctcgtggaagagcagaggcagcaaggacctgctcttccgagtctgcatcgtgtccgcgtttgccagcgcgcttttcaccaatgacacatgctgtgttgtcctcaccgagttcatcctcaaggttgctaggcaaaacaacctgccaccacagcctttccttctggcccttgccactagttcgaacatcggctctgctgccacgccgatcggcaaccctcagaaccttgtcatagctgtcgagagtgggatctcatttggccagttcttgctgggagttttcccagctatgatcgttggggttctcacaaacgctgctatcctccttttgtacttctggaaatacttgtcggtggagaaggatcaggagggtgggcagcccacaggaccagaggtggttgccgacgatgaggttacttcccatcggttcacaccggctagaatgtcacatgtttcttctctgaatccagatgacatggattgcgtaagcgaaccgatcatcaggagcaacagtgtcagtactactgggaatgagaacctgagaagcagaagcatcaattctgaggctgacattcagcttgcgatcaagtctctgcgggcatcaagcatgtcgcatgagatggtagaggtctcgacggttcctgatcggagagatgaaggtgcatcctcaaggaagttcacaaggactgctagccagcaaaggagcgtgataatagaggatttagcaccctccccagagattaatggggaaaaggagaaagaaactgaagttgcagagaagagatggaaagtacttgtgtggaagactgctgtttatcttatcactctcggtatgctcattgcacttctaatgggactgaacatgtcctggactgcaatcactgcagctcttgttcttctggcactcgattttacggacgcacaagcttgtcttgagaaggtgtcatattcactgctgatctttttctgcgggatgtttatcactgttgatggcttcaacaaaacgggcataccgaacacactatgggagttagtggaaccatattcacgaatcgatagtgcgaaaggtgttgcacttcttgccgtggtgattcttatcctttcaaacgtggcctctaatgttcctacagtcctattgctcggtacaagagtggctgcatcagcggcttcgatttctcatggttcagagaggaaagcctggctcatccttgcatgggtcagcaccgtggctgggaacctcaccctcctaggctctgcggcgaatctgattgtctgcgagcaggccaggcgggcccagttcttcggctacaacctcaccttctggagccacctccgattcggggtcccgtcgaccatcatcgtcacggcgattggtttgctcatcgtcatcagttactgaaacagctgaaggcagaagagcgtagtgtaagagaagcagaatggataaaaatccttccaataagaagtacatgtaaattaggcttgccctataactcaagtgtgtatcggtacgttatgtctccgtctgtgctcttgctcgtgagcaagcagcacatggctgaccgtgtagcttgcatttccattgcataataggcttatgaagaatgctttggtaatatgattttacagtctgacaaggattgtgaagcagaggcagtgtaccatcaagataatacttctggaagcatataaaaaaatttcgtatatttggatttcaaatccagtctgcttcagactggaaattcatattatcttctgg

SEQ ID NO: 589 - DNA, 2565 bp, Hordeum vulgare subsp. vulgare
ggacatttacagaccacctccaccgctcctcctcctcctcctcgctctcgccgcaacagagcagagcagagagcactcactcactgtcgactatcctcgcccctactccagtccgaggacacaacgtgagtaggcgcggtggtgctctgcttctgcttctgcttctccttgattgattgattgattgttgatatccattcccattccatatgcgctgtgcatgtccccggttttcgtggccgctaatccatccgatttttgtgttccccggccaaaattaaactcatttcgtccacaacaggatctttgtctttccttttctgctaattgatcctaccttttcggttcctggatttaaagctcttcttttgttgctccaattttttgcaggattcctcaacttacttgggcatggacagattgttttcgctgccgcagatcgattccagcaacacatccattaacgtcgtctgactgacttggggattagtaactgttttcgcctgctgttctttcccctcccttgcctgcgacaggttcttgatcatctcagtgcagagtttgctagcgttttgccgaggcttggagagaccaatatcagtcgtgggacggtaggattctgtgttggctagcgaagatggtgcttgcgcacacgtccaaggtggtgctgggatgcgtggcgttcggcatcttctgggtgctggcggtgttccccagcgtgcccttcatgccggttggccgcaccgccggctccctgctgggcgccatgctcatggtgctgttccgcgtcatctccccggaggacgcgtacgcggccatcgacctccccatcatcggcctcctcttcggcaccatggtcgtgtccatcttcctggagcgcgccgacatgttcaagtacctcggcaacctgctccagtggaagagccgcggcccaaaggacctgctcttccgcgtctgcatcgtctccgccatcgcctccgcgctcttcaccaacgacacctgctgcgtcgtcctcaccgagttcatcctcaaggtggcccgccagaacaacctgcccccgcagccctttcttctggcgctcgccaccagctccaacatcggctccgccgccacgcccatcggcaacccgcagaacctcgtcatcgccgtcgagagcggcatctccttcggacagttccttcttggcgtcttcccggccatgatcgtcggcgtgctcaccaacgccgccatcctcctctgctacttctggaggtacctcgccgtcgagccgaccgaccagctggagcgcggcggcggcggcgtctccacgcggggggccgagctgcaggtcggcgacgacgaggtccagtcgcaccggttcacgcccgccaggatgtcgcacgtctcctcgctcaacccggacgacttcgactgcgtcagcgagcccatcatcaggagcgccagcgtcaacggtggcgacaacctgcggagcaggagcgtcaactccaacgccgccgacgccgacatgcagttctccatcaggtccctccgctcctccagcatgtcgcacgagatggtggaggtctccacggtccccgtcctcctcgacggctccgcctcctccaggaagttcaccaggacggccagccagcagaggagcgtcatcatcgaggacgcgccgccgtcgtcgcccacagacgacgacgacgcagccaacggcgacaaggacaagggggagctgcccgaggtcgcggagaagaggtggaaggtgctggtgtggaagacggccgtgtacctcatcaccctcggcatgctcatcgccctcctcatggggctcaacatgtcctggaccgccatcaccgccgctctggttctcctcacgctcgatttcacggacgcccaggcctgcctcgagaaggtgtcctactcgctgctcatcttcttctgcgggatgttcatcaccgtcgacggcttcaacaagaccggcatacccaacaccatgtgggagctggtcgagccctactcgcggatcgacagcgccagaggcgtcgcgctcctcggcctcgtcatcctcatcctctccaacgtcgcatcaaatgttccaacagttctgctgctcggcacaagggtggccgcgtcggctgcggcgatatcgccggcgtcggagaggaaggcgtggctgatactggcgtatgtgagcacggtggcagggaacctgacgctgctcgggtcggcggcgaacctgatcgtgtgcgagcaggcgaggcgggcgcagttcttcggctacaacctctccttctggagccacctccggttcggggtgccgtccaccatcgtcgtcaccgccatcggcctcctcatcgtcagcagctactgaaccaagcaagaaactgaacatagtagtactactgtgcgaggagcgtaacgaaatcctttcttcaataatggagactactcatgtaaaatcgctaggcttgtcttgtaacccgtttatgttttgtgtatcagtaatcagtgttgtttcagctgttgtcgctaaagcagacggccggtacgggtgtcagaccaagtagcctgcattttcag

SEQ ID NO: 590 - DNA, 2474 bp, Hordeum vulgare subsp. vulgare
gaggtgagctccccgcccgcgcgcgcgcattgccctgattgatctatcgtccgtccgccgtccccggccgcccgaccacacggccggatctcacgtatatctttgggttggcacggaaggcgacccggccaaaaggtcgacgagagagccgacgtgccggagcgagctgccatcggcggcgtgaggcgtcatcgatcgaccagggcattgttgcgattcctcaacttacttgggcatggacagattgttttcgctgccgcagatcgattccagcagcacatccattaacgtcgtctgactgacttggggattagtaactgttttcgcctgctgttctttcccctcccttgcctgcgacaggttcttgatcatctcagtgcagagtttgctagcgttttgccgaggcttggagagaccaatatcagtcgtgggacggtaggattctgtgttggctagcgaagatggtgcttgcgcacacgtccaaggtggtgctgggatgcgtggcgttcggcatcttctgggtgctggcggtgttccccagcgtgcccttcatgccggttggccgcaccgccggctccctgctgggcgccatgctcatggtgctgttccgcgtcatctccccggaggacgcgtacgcgaccatcgacctccccatcatcggcctcctcttcggcaccatggtcgtgtccatcttcctggagcgcgccgacatgttcaagtacctcggcaacctgctccagtggaagagccgcggcccaaaggacctgctcttccgcgtctgcatcgtctccgccatcgcctccgcgctcttcaccaacgacacctgctgcgtcgtcctcaccgagttcatcctcaaggtggcccgccagaacaacctgcccccgcagccctttcttctggcgctcgccaccagctccaacatcggctccgccgccacgcccatcggcaacccgcagaacctcgtcatcgccgtcgagagcggcatctccttcggacagttccttcttggcgtcttcccggccatgatcgtcggcgtgctcaccaacgccgccatcctcctctgctacttctggaggtacctcgccgtcgagccgaccgaccagctggagcgcggcggcggcggcgtctccacgcggggggccgagctgcaggtcggcgacgacgaggtccagtcgcaccggttcacgcccgccaggatgtcgcacgtctcctcgctcaacccggacgacttcgactgcgtcagcgagcccatcatcaggagcgccagcgtcaacggtggcgacaacctgcggagcaggagcgtcaactccaacgccgccgacgccgacatgcagttctccatcaggtccctccgctcctccagcatgtcgcacgagatggtggaggtctccacggtccccgtcctcctcgacggctccgcctcctccaggaagttcaccaggacggccagccagcagaggagcgtcatcatcgaggacgcgccgccgtcgtcgcccacagacgacgacgacgcagccaacggcgacaaggacaagggggagctgcccgaggtcgcggagaagaggtggaaggtgctggtgtggaagacggccgtgtacctcatcaccctcggcatgctcatcgccctcctcatggggctcaacatgtcctggaccgccatcaccgccgctctggttctcctcgcgctcgatttcacggacgcccaggcctgcctcgagaaggtgtcctactcgctgctcatcttcttctgcgggatgttcatcaccgtcgacggcttcaacaagaccggcatacccaacaccatgtgggagctggtcgagccctactcgcggatcgacagcgccagaggcgtcgcgctcctcggcctcgtcatcctcatcctctccaacgtcgcatcaaatgttccaacagttctgctgctcggcacaagggtggccgcgtcggctgcggcgatatcgccggcgtcggagaggaaggcgtggctgatactggcgtatgtgagcacggtggcagggaacctgacgctgctcgggtcggcggcgaacctgatcgtgtgcgagcaggcgaggcgggcgcaattcttcggctacaacctctccttctggagccacctccggttcggggtgccgtccaccatcgtcgtcaccgccatcggcctcctcatcgtcagcagctactgaaccaagcaagaaactgaacatagtagtactactgtgcgaggagcgtaacgaaatcctttcttcaataatggagactactcatgtaaaatcgctaggcttgtcttgtaacccgtttatgttttgtgtatcagtaatcagtgttgtttcagctgttgtcgctaaagcagacggccggtacgggtgtcagaccaagtagcctgcattttcagatttctgaacttggagttgcagataggttcctgttgaagttgaactaagaaattatattgtaatctgatttcatttttggtgttt

SEQ ID NO: 591 - DNA, 1362 bp, Sorghum bicolor
atggcgccgccggagccggaggtgttcgacgtcgtcatcttcggggcctcgggcttcaccggcaagtacgtcatccgcgaggctctcaagttcctcaactcctcctccaactccccgctccgctccctcgcggtcgccggccgcagccgggaccgcgtggcggccgcgctgcgctgggccgcggccccggcgccgcctcccgaggacgtgcccatcctcgtcgccgacacctccgacccggcctccctcgcggcgctcgccgcccgcgcccgcgtcgtgctctcctgcgcggggcccttccgcctgcacggccacgccgtggcggcggcgtgcgcggcggcgggtgccgactgccttgacatctccggggagcccgagttcatggagcgcgtcgaggccgagctccacgagcccgccgccaagaccggctcgctcatcgtctccgcctgcggcttcgactccgtccccgccgagctcggcttcctgttccactccaggcagtgggagccaccgtccgcgctggtctccgtggaggcgtacgtgtacctgcagtcgtccaagaggatcgtcgggaacattggcacctacgagtcggccgtgctcggggtggccaacgctggccagctgcaggcgctgcgccggtccaggcccaggccgcccaagcccaatattccaggccctccgcctcctaaaggctcactgattgagggtcagaatcctttgggaatgtgggctatgaagttgccttccgctgacacagtggtcgtgaagagaactctatcaaccttgactgagcatcctgagggccttcctggtgcagaagaaaccccagagtatgctgaacacaggaagaagttctggtcttctgtcaaacctgcccatttcggcgtgaagatcgcctccagatccttgatgatgctcgtgcgcttcatcttcaccggaatcttcatcggcctgtttggcaatttctccttcggcaggtccctccttctgaagtaccctgagtttttctccgctgggatgttcaggagagccggtccgactgaggaagaggtgaagagcgcctcgttcaagatgtggtttgtcgggcacggctacagcaacgtggataggtcgttggagctcggaagaagcaagccggacaaggaggtgatcaccaaggtttcgggacctgaggttggttacatcacaactccgatcgtgctggtgcagtgcgccctcgtcctgctgagccagcgtgccaacctaccaaagggtggggtgtacacgcctggcaccgtattcggccctaccgacctccagcagcgcctccaggagaacgggctgtcgttcgaggttaacgtgactaggaccatgagctga

SEQ ID NO: 592 - DNA, 1739 bp, Zea mays
accccagcgctcaccgacctttctccaaaccgtcgtcgcgcccgccccgtgccgcccgccatggcgccgccggagccggagatgttcgacgtcgtcatattcggggcctcgggcttcaccggcaagtacgtcatccgcgaggccctcaagttcctcaacgcctcctcatccgcctccccgctccgctccctcgcggtcgccggccgcagcagggaccgcatcgcagccgcgctccgctgggccgcggccccggccccgccgcccgaggacgtgcccatcctcgtcgccgacacctctgacccggcctccctcgcggcgctcgcctctcacgcccgcgtcgtgctctcctgcgcgggacccttccgcctccacggccacgccgtggcggcggcctgcgcggccgtgggcgccgactgcctcgacatctccggggagcccgagttcatggagcgcgtcgagtccgagctccacgagcccgccgccaggagcggctccctcatcatctccgcctgcgggttcgactctgtccccgccgagctcggcttcatgttccactccaggcagtgggagcccccgtccgcgccggccaccgtggaggcgtacgtgagccttcagtcgaccaagaggatcgtcgggracaycggcacctacgagtcagctgtgctcggagtggccaacgctggccagctgcaggcgctgcgccggtccagacccaggcgaccccggcccaatattccaggccctccacctcccaaagggtcgctgattgaaggtcacaatcctctgggaatgtgggctatgaaactgccttccgctgacacagtggtcgtgaagagaactctatcaaccttgactgagcatcctgagggccttcctggcgcagaagaaaccccagagtacgctgatcataggaagaaattctggtcttctgtcaaacctgcccattttggcgtgaagatcgcctccagatccctgctgatccttgtgcgcttcatcttcaccggaatcttcatcggcctgctcgccaacttctccttcggcaggtccctcctgctgaagtaccctgagtttttctccgctgggctgttcagcagagccggcccgaccgaggaagaggtgaagagcgcctcgttcaagatgtggtttgtcggtcacggctacagcaacgtggatagctcgttggagctcggaagaagcaagccggacaaggaggtgatcaccaaggtttcgggacccgaggtcggttacgtcacaactccgatcgtgctggtgcagtgcgccctcgtcctgctgagccagcgtgccaacctgcccaagggcggggtatacacgcctggcaccgtctttggccctactgatctccagcagcgcctccaggataacgggctgtttttcgaggttaacaccactagagccatgcattgaagttcactggctccactcagtacatcctgtggaaaaacttggcagaaggatgcaacttgagcaataagaagcgccaattagcaacttaaacggcttgtttggaagtaaggataccgccggagaggagctgaaaccccttgctattcaattttgaatataaggggattttagctccttaaatcccgtcgggtataattgcttccaaaagccataactgtgtgtgtcgtaccaacagtcctatggagtcttactagttactaccgctgtaccttctgaatttacctagttccttattctgaaaaaaaaaaaaaaaa

SEQ ID NO: 593 - DNA, 1631 bp, Hordeum vulgare subsp. vulgare
gcaagccacctcgcactagtcagtccaccgcgccgcaccccgaaagcccaagcccctcttccatggcggcgccagtgccgccggggccggaggtgttcgacgtcgtcatcttcggggcctcgggcttcactggcaagtacgtcatccgcgaggccctcaagttcctgccccccaacgcctccccgctccgctccctcgcgctcgccggccgcagccgggaccgcgtcgccgccgcgctccgctgggcggccgcgccgggccccgcccccgacgtccccatcctcgtcgcggacgcctccgaccctgcctccctcgccgcggtcgcggcgcgggcgcgcgtcctgctctcctgcgcggggcccttccgcctccacggccgccaggtggccgcggcctgcgccgaggcgggggccgactgcctcgacatctccggcgagcccgagttcatggagcgcgtcgaggccgacctccacgaggtcgccgccaagaacgggtcgctgattgtctccgcctgcgggtttgactccatccccgcggagctcgggttcttgttcaactccaggcagtggacgccgccctccgcacctgtgagcgtggtcgcgtacgtcaacctggagtcggacaggaagatcgtcgggaacttcggcacgtttgagtcggccgttctcggggtggccaacgccaaccagctgcaggcgctgcgccggtccaggccaaggccggccaagcccaggattccggggcctccgcctcccaaaggatcactgattgagcatgacaaggcactaggattgtgggtcatgaagttaccttctgctgacacagtggttgtgaagagaacactagcaaaactgacagagcatcctgagggccttcctggcgtggacgagacctcagatttcgcggcgcataggaaggaattctggtcatctgtcaaacctgcacatttcggtgtgaagatcagcacccgttccatcctgggccttttctggtggctgtgtaccgggcttttcatcggcattctcgggggcttctccttgggcaggtccctcttgctgaaattccccgagttcttctccatcgggctgttcagaaagaccggaccgacagaagaggaggtccgcagtgcctcgttcaaaatgtggttcatcggccgtggctacagcgactcggcccgcgcgtcggagcgtggaagcaagccagacaaggagatcgtgaccagagtttcggggccagagatcgggtacatcaccacgccgatcgtcctcgtccagtgcgccctcgtccttctgagccagcgggccaatctgccgaagggcggggtgtacacgccgggcgccgtcttcggccccacggatctccagaagcgcctcgaggagaatggcctgtcgttcgagctcatctcttcgaggaccctcccctcggattaacaggctcgtgcttcccacacctgatctcgtcgttaaaccagttgtctgccgctgcttctctaccgtctgtcacctgggtgtctagcaggctcgctcgctcaatggccttatactatttgtgaagaagaaacatagtgtgagtccgtattactattacttaccgcgcatgaaatgaagaagaggatgcgctcgtctactatg

SEQ ID NO: 594 - DNA, 3148 bp, Zea mays
ctcaaaatcccattcgaaacctcccgattccctccacgaaatttacaaaaccacagcactcccgccaatctcccgcacgtttgggacccaaatccgcgatcccgttgcccagccgcagcgtacggaaacctagctccccccccgccgccgccgccgccgctgggatggacttctcggcgccctcattctcgctgggttttgactgggacgacgatgaccccccggccagcagcgaccggcgcgagcagccgcgcgggtacggggcccccgacgcgccgtcgttctcgttagggatcgacgacgacgacgacgtggaggagccccgcatcccggcgagaggccgccagaatgagcaggcgcgtgagttcacggcgcccgatccgccgtcgttctccctgggcttcgacgacgaacacggcgatggtgacatactctctgccgaccgttgccgcgagcagtcgcagccccaggtagcgcccggatctccttcaaatggcactgcagatgatgatgatgataaggaggatggcttcgtcgtcgctggtggcaagcggccggttcgagtggagcgtgacacgctatacccagatcccctgccgacgccagcggagaccaatcggttcaagcggctgcggaagggctctgcgacagcccatccggcgcaaactccccaggtgccgcaccgtgaggcgcctgacgctccgtcttcctcccttagcatcagcgacgacgacttcctaactggcggccagcatcacgagcgactgaagccacaagcctctcctcggatcccctcatcgctcagtatcgaagacgaggacgacgacttcttcctcgctggtgaccgacagccagagccaacactgcctcaagtgactcaactcaagcggctgcggaagggccctgtcccgccacatctggcgccatcaccgcctcctcccaaggtgccaggacagcccacgacggaagcctctccagtaatgactgaagatgcagcacgaggggcggttgggagttgggaagacgagatcgaggattggacaacagacgaggaccgaccagttcgagatgtgccaccatctgttggtagctgcagcacttcaagcaactcaaagttctctctgcttaaccgtggtgtccttatgacccagtcaggaactaaagcgagtacatcaaaatttacacaaacaccaaatacatctgcttcaatatctttggaagaaagctgcacaaagaaattacttcctaagataacagtaagcccgatgaggaaaatttatttgcttgattctgacactgatgctgacgatgactacagtcaaaataaagcaaagagcatgcagcaaaacaggaagccccaaatgaacagtactgtacagaagagcggggctatgatgagtgacaattgggcaacacctgccttggatgagttctgcaaggaatacttcgaatctccaaaagatgcaggattttctcagccgaaagaaggaaacactcattacaaggcttcacaacctaagaactctgggcacttccagcaacaagcgtcttcaagtggaggtgaagtggatgatggtcctcctgctatgcaatatctgtaccaccctgacccaagggtgggtgatttgttccggaacaggctgcaacatttcgttcctattggggcaggaagtgccatagcaaatgagcaaaacagagcaaaaagtctaagaagttgcaggaggcaatccagctcgagtgcagctgctaccgatgactgggtaactcctgggagggtctcagttccaactgatgctagcaaaagaagggtgcatgccagtggaactcattctggctctggccattggtttactaatgacagtgggaggaaggttaggctatacttccagaatttcagttcacatgtttttaaacttttagatagaagtgatagaagttgtttggtcttttgtgcttcttgagtatgatggatgcatattagcttgcatttcaatgttttttcaagattatccttttatcctctttttgaaaaaaaaacatatccaatcataatatttgctacaggtttacgtctcaaaaaatggacaagagttgactgggcgtgatgcctatcgacaatatcaaaaggtaacatgatgcttatcttttcgagtgatttgtgcttttattcatgttgacaaactggtactaggtaatggacttgatgaaatttagatatccactgctcagaattatgtatatgtcacctgcaatgatgtgttcgatcagggatttgaattattaataatgcacttggcatgattgtatgtattgcttgtagctggcattgctatttctctatgaccattacctcgaccaaactttcttgggatcttataaaaattgaatacaaattgatggtctttgagggtataaaaactgttgtgctggtggaaaggaaacatgtgtctctttcacagcatgctgccatgctggtaacaccgtctcaatgtgccttacaggaaagtggcaggggattcaacaggtacaagaagaaaggttcatcaggaaccaaacgaggtgctgctcaagtgaaaactgagactgcagccaaacgaggtactgctcaagtgaaaactgagactgcagccaaacgaggtacgagtagagcaaaaaggaagcggtgactgcctacattggctaggattctgtagttaggttttcacctcgcgtgcttgagttcacagccgatttgttggtagaagtagaaccatatgaatgtataacaagcctcagctgctctcgggtcttcttttagggtgcgtttggttgcaatgacaggacgggataggacgagacgatccctcaaataagattgttttgttcagggtcaagggttgggacaggattatcccagtgttgtccccagttatccctcaaaattggagggacgagaggatgccagaggacgtccctatcctggttgtcccgcaaccaaacacacccttatatcaggaggctagcgtatacgtcagtacatggttctattgtgtgtttgtaaatatgattttgctcttcatgtattcttctttttttggatgccaatgaggcaatgatctgtatgcaaaaggctggattactccacaggatgaataaaccattatttcac

SEQ ID NO: 595 - DNA, 2406 bp, Sorghum bicolor
atggacttctcggctccctcattctcgctgggtttcgactgggacgacgacgacgaccccccggccgggagcgaccggcacgagcagccgcgcgggtacgaggcccccgacccgccgtcgttctcgttagggatcgacgacgacgacgtcgtggaggcgccccgcatcccggcggttgaccgccagaaggggcacgagcggtggtccacggcgcccgatccaccgtcgttctcgctgggcttcgacgatgacgtcgtggaggagccccgcattcgggcgggtggccgccggaaggagcacgctcgggggtacacggcgcccgatccgccatcgttccccctgggctttgacgacgaagacggcgatggtgacatactcgctgccgaccagcggtgcgagcgggcgcggcccccggtggcgcccggagctcccgcttcgaccggcgctgcagatgacgatgataaggaggatggcttcgtcctcgccggtggcaggcggccggtccgagtggagcgtcacaggctagaccgagatcccctgccgccgccgcggctgcagaccaatcggttcgcggcgcccgatccgccgtcgttctcattgggcttcgacgacgaagacggccatggtgacatcctcgctgccgaccagcgccgcgagcaggcgctgccgcaggcggcgctcggagcaccctcttcgaccggcactggagatgacgatgataaggatgatgacttcgtcctcgccggtggcaagcggccggtccgggtggatcgcgacacgatagacacagatcccctgccgccgccggcttcgaccaatcggttcaagcggctgcggaagggccctgcgccagcccatccggcgccaacaccccaggtgctgcactgtgaggcgccgtattcctcccttataatcaacgacgacgacgactccctagctggcggccagcaccacgagcaatcgaagccacaggccgcacctcgggtcccctcgtcgctcagtatcgaagatgaggacggcgacttcttcctcgctggtgaccaacagccagagccaacactgcctgagcctgaagtgactcaactcaagcggctgcggaagggccctgcaccaccacatctggcgccatcaccgcctcctttgaaggtgccaggacaacccacggtagtgattgacaatgcagcaagagcggcggttgggagttgggaagacgagatcgaggattggacaacagacgaggaccgaccggttcgagatgtgccaccatctgttggtagttgcagcacttccagcaactcaaaattctctctgcttaatcgtggtgttcttatgactcagtcagcaaccaaagcaaacagatcaaaaatttcacaaacaccaaatacttctgcttcaatatctttggaagaaagctgcacaaagaaactacttcctaagataacagtaagcccgatgaggaaaatctatttgcttgattctgacactgatgcagacgatgaccacaatcaaaataaagcaaagacccagcagcaaaacacgaagccccgagggagcagtactgtgctgaagagtggagctatgatgaatgacaattgggcaacacctgccttggacgagttctgcaatgaatacttcaaatcttcaaaagatgcagggttttctcagcagaaagaaggcaacactcactacagggtttctcaacctaagaactctgggcatttccagcaacaaacgtcttcaagtggagctgaactatatgatggtcctcctgctatgcattatttgttccaccctgacccaagggtgggtaatttgttcaggaacaggctgcaacattttgttcccattggggcaggaagtaccagagaaaatgggcaaaacagagcagaaagtctcagcagcggcaggaggcaattcagctcgagtgcagctgctaacgatgactgggtgactcctgggaggatctcagttccaactgatgccagtaaaagaagggtgcgtgccagtggatcccattctggctctggccattggtttactgatgacagtgggaggaaggtttatgtctcaaaaaatgggcaagagttgactggccgcaatgcctatcgacaatatcaaaaggaaagtggcaggggattcggcaggtacaagaagaaaggttcatctggaaccaaacgaggtgctgctaaagtgaagaccgaaactgcggccaaacgaggcacgagtagggctaaaaggaagcggtgactgcctgcccgcttcacattgggcaggattctgtagctagtaccccccctctccacctcgcgtgcttcacttgatagccgatttgttgatagaaccatatgaatgcataataaagcctcaattgctctcggttttcccttatatcaggaggcacacgca

SEQ ID NO: 596 - DNA, 1876 bp, Sorghum bicolor
caccgcgcgaagaagaaacctcgccgccacggcgccacgcgagcaaaaaccctagcgcgagcaagcaagcgatagggagacagagacctcagttcctcgcgcagcgcggacccggcccggcccgacggcatggagagcctcgtcctcgcctcctcctgctccgcgtccccacggctcccgctaatctcctccgccgcccgcttccggaggctgcccggctccgtgccgccgccgacggtggcggcggcgtccaccggcggtgccgcgcggaaagggcccaggaggcccaggctcttcgtcgtcgccgccgcggctcctcgcggatccgggaacgttttcgagggattgagagcaaaaggctttgcaagcgtgtcatcttcgactggcaatgagaatatgtctactggaaccggtaccctgcctcccgtgcctcccccatcatcatactttggttcacctgttttctggattggagttggtgtagcattgtctgtggcgtttaccacggtctcttccatggtaaagagatatgccatggaacaagcatttaagtcaatgatgacccaggcaccaccaaactcatttggctccaactcgcctttcccatttggcatgccaccacaggcatctcctactgcaccaagcagttttccgtacttggaaccaaagaaagatacctccccacaggtgtcaactgttgatgtctcagctaccgaagtggaagctgctggaacatcgaaagaggtggatgtgactgaaactccagagccttcaaagaaatttgcatttgttgatgtttctcccgaagagttgcagcaaaagaacctccaatcttcactggagacagtagatgtaaaacatgatagtacagacagtgaaagtaaggaggatattgaggaaaaagttcttcccacaaatggagcgacttttaagccgaatgaagatgctgctcgtgggccaactgaacctagtaactcgggacctatgctatcagttgagacaattgagaaaatgatggaagatccaactgtgcagaagatggtgtatccctacttgcctgaagagatgaggaacccagattcgttcaagtggatgctgcagaatccaatgtaccgtcaacaactacaggatatgctaaataacatgggtgcatctcctgatcaatgggataaccgcatggttgatcacctgaagaactttgacctcagcagtccagaagtgcggcagcagtttgcgcaagttggcatgactcccgaggaagtggtatcgaaaataatggcaaacccagatgtagctgttgcattccagaatccaaaaatacagacagccatcatggactgttcgcagaaccctctaaacattgtaaaataccaaaacgacaaggaggtcatggacgttttcatgaagatatcacaaatcttcccacaaattaacggctagccgaacttcatcgcgggattgcagttctgattttttgtcggcccatcatccatctcctgtctggaggactgctgcggtttccacgtgtcaagaaagggaacacctgttgggtcatgacgctccagatagatccctcactgtgtcaaggtcctttgagttgcctatgtacgtcgtatgatgtagcggccttggtttagctatgagtatgaccctactttcataaagtcagtctagcgagcatagcagggtcaaaggcttttatttacatttgtatcggcaggcagtcagtgcgctgctttgacgttgcatggttttatctcgtaggatgtggaagccgcagcagaggtggttcgtatcagatcaattttgctatatataattgctatcaatgtgtaacatattagagacacaatggcgattcaagtaatctgtttcg

SEQ ID NO: 597 - DNA, 1881 bp, Zea mays
ctccccgtctctactccctactggcctcctcccacgagtcggataccgaacctcggcggcgtcggcgccacgcgagcaaaaaccctagtgcgagcaagcgagaggcagagacctcagtgcctcgagcaacgcgcgcccggcccgacggcatggagagcctcatcctcgcctcctcctgctccgcgtccccacggctcccgctactctcctccgccgcccgcttccgcgggctgcccgtttccgtgccgccgccgtcttcggcgtccatcagcggtgccgcgaggaaagggccgatgaggcccaggctcttcgttgccgcggcggcggctcctcgcggctccggaaacgttttcgagggattgagagcaaaaggctttgcaagcatgtcatcttcgactggcaatgagaatatgtctactggaactggtacactacctcccatgccacccacatcatcatatattggttcacctgttttctggattggagttggtgtagcattgtctgtggcgtttaccacggtctcttccatgttaaagagatatgccatgcaacaagcatttaagtcaatgatgacccagtcagcaccaaactcatttggctccaactcgcctttcccatttagcatgccgccacaggcatctcctactgctccaagcacttacccgtacttggaaccaaagaaagatacttccccgcatgtgtcaactgttgatgtctcagctaatgaagtggaagccactggaacatcgaaagaggtggatgttactgaaacgccaaaaccttcaaagaagtttgcatttgttgatgtttctcccgaagagttgcagcaaaagaacctccaatcttcaccggagacggtagatgtaaaacatgatagtacatacagtgaaagtaaggaggatactgaggaacaagttcccacaattagtacaaacactgaaagtaaggaggatactgaggaaaaagttcccacaaatggagcatcttttaagctgaacgaaggtgctgctcatgggccaactgaatctaataactcggcatctatgctatccgttgagacaattgagaaaatgatggaagatccagctgtgcagaagatggtgtatccctacttgcctgaagagatgcggaacccaaattcattcaagtggatgctgcagaatccaatgtaccgccaacaactacaggatatgctaaataacatgggcgcaactcctgatcaatgggataaccgcatgcttgatcaccttaagaacttcgaccttagcagtccagaagtgcggcagcagtttgcgcaagttggcatgactcctgaggaagtagtatcgaaaataatggcaaacccagatgtagctgttgcattccagaatccaaaaatacagacagccatcatggactgctcgcagaaccctcttaacattgtaaaataccaaaatgacaaggaggtcatggatgttttcatgaagatatcacaaatcttcccccaaattaacggctagctgatcttcgtcgtgggatagcacttctgatttttgtcggcccgtcatctccagtctggagggctgctgcggtagcatctatcaagaaaagggtcgtgacgctccgatataccctccccgtgtcaaggtttttgagtttcttatgtacatcatgtgatgtagcggccttggtttagctatgagtaattgagtatgacccttgccagttcattaagtcaggctattgacatagcagggtccaagtttttattaagccagccaatcagtggaaaggtgcagcagagacggttcgtatcagatcaattttgatatataattgttattattaatctgtaatatattagagacacaatggcaatgcaagtaatctgttacgaca

SEQ ID NO: 598 - DNA, 1901 bp, Zea mays
aaaaactccccgtctctactccctactggcctcctcccacgagtcggataccgaacctcggcggcgtcggcgccacgcgagcaaaaaccctagtgcgagcaagcgagaggcagagacctcagtgcctcgagcaacgcgcgcccggcccgacggcatggagagcctcatcctcgcctcctcctgctccgcgtccccacggctcccgctactctcctccgccgcccgcttccgcgggctgcccgtttccgtgccgccgccgtcttcggcgtccatcagcggtgccgcgaggaaagggccgatgaggcccaggctcttcgttgccgcggcggcggctcctcgcggctccggaaacgttttcgagggattgagagcaaaaggctttgcaagcatgtcatcttcgactggcaatgagaatatgtctactggaactggtacactacctcccatgccacccacatcatcatatattggttcacctgttttctggattggagttggtgtagcattgtctgtggcgtttaccacggtctcttccatgttaaagagatatgccatgcaacaagcatttaagtcaatgatgacccagtcagcaccaaactcatttggctccaactcgcctttcccatttagcatgccgccacaggcatctcctactgctccaagcacttacccgtacttggaaccaaagaaagatacttccccgcatgtgtcaactgttgatgtctcagctaatgaagtggaagccactggaacatcgaaagaggtggatgttactgaaacgccaaaaccttcaaagaagtttgcatttgttgatgtttctcccgaagagttgcagcaaaagaacctccaatcttcaccggagatggtagatgtaaaacatgatagtacatacagtgaaagtaaggaggatactgaggaacaagttcccacaattagtacaaacactgaaagtaaggaggatactgaggaaaaagttcccacaaatggagcatcttttaagctgaacgaaggtgctgctcatgggccaactgaatctaataactcggcatctatgctatccgttgagacaattgagaaaatgatggaagatccagctgtgcagaagatggtgtatccctacttgcctgaagagatgcggaacccaaattcattcaagtggatgctgcagaatccaatgtaccgccaacaactacaggatatgctaaataacatgggcgcaactcctgatcaatgggataaccgcatgcttgatcaccttaagaacttcgaccttagcagtccagaagtgcggcagcagtttgcgcaagttggcatgactcctgaggaagtagtatcgaaaataatggcaaacccagatgtagctgttgcattccagaatccaaaaatacagacagccatcatggactgctcgcagaaccctcttaacattgtaaaataccaaaatgacaaggaggtcatggatgttttcatgaagatatcacaaatcttcccccaaattaacggctagctgatcttcgtcgtgggatagcacttctgatttttgtcggcccgtcatctccagtctggagggctgctgcggtagcatctatcaagaaaagggtcgtgacgctccgatataccctccccgtgtcaaggtttttgagtttcttatgtacatcatgtgatgtagcggccttggtttagctatgagtaattgagtatgacccttgccagttcattaagtcaggctattgacatagcagggtccaagtttttattaagccagccaatcagtggaaaggtgcagcagagacggttcgtatcagatcaattttgatatataattgttattattaatctgtaatatattagagacacaatggcaatgcaagtaatctgttacgacaaaaaaaaaaaaaaaa

SEQ ID NO: 599 - DNA, 1692 bp, Zea mays
atccgtccctcctctcctgttccctccccgagtcgatatctcaccgtccgtgcgagtaaaacaaagcctcgccgccacggcgccacgcgagcaaagacctagcgcgagcaagcaagggaggcagagaccttagtgcgtcgcgcaacgcggctcggcccgacggcatggagagcctcgtcctcgcctcctcctgctccccgtccccacggctgccgctactctcccccttcgcccgcttccgccggctgcccggctccatgccacaggcgccggcgtccaccagcggtgccacgcggaaaggtcccaggaggcacatgctcttcgtcgccgccgccaccgcggccccttccggatccaggaacgttttcaaggaattgagagcaaaaggctttgcaagcatgtcatcttcgactggcaatgagaatatgtctactgaaactggcaccctgcctcccatgcctcccccatcatcatacattggttcacctgttttctggattggagttggtgtagcattgtctgtggcgtttaccacggtttcttccatgctaaagaaatatgccatggaacaagcatttaagtcaatgatgacccaagcaccaccaaactcatttggctccaactcgcctttcccatttggcatgccaccacaggcatctcctactgcaccaagcagtttttcgtacttggaaccaaagaaagatacctccccacaggtgtcaactgttgatgtctcagctaccgaagtggatgccgctggaacatcgaaagaggtggatgtgactgagacaccaaaaccttctaagaaatttgcatttgttgatgtttctcccgaagatttgcagcaaaaggacctccaatcttcactggagatggtagatgtaaaacatgatagtatagaaagtgaaagtaaggaggatactgaggaaaaggctcccacaaatggagcgacttttaagctgaatgaggatgctgctcgtgggccaactgaatccagtcaatcaggacctatgctatctgttgagacaattgagaagatgatggaagatccagctgtgcagaagatggtttatccctacttgcctgaagagatgaggaacccagattcgttcaagtggatgctgcagaatccaatgtaccggcaacaactacaggatatgctaaagaacatgggtggatctcctgatcaatgggataaccgtatgctcgatcacctgaagaactttgaccttagcagtccagaagtgcggcagcagtttgcgcaagttggcatgactcccgaggaagtggtatcgaaaataatggcaaacccagatgtagctgtcgcattccagaacccaaaaatacagacagccatcatggactgctcgcagaaccctcttaacattgtaaagtaccaaaacgacaaggaggtcatggatgttttcatgaagatatcacagatctttccccaaatcaacggctagctggtcttcactgcgggattgcagtcttgattttttttgtcggcctatcatcccctgtgtctggagggcctgctgcggtaaccatctttgaaggaaaagggaacacctgttgctgttgggccgtgacgctctggataaaccctccctgtgtcgagctttttgagtttcatatgtagtagagtacatcgtgtgatgtagcggccttggtccaaaaaaaaaaaaaaaa

SEQ ID NO: 600 - DNA, 1937 bp, Oryza sativa Japonica Group
acgcgcgcacccacccacccaaaaccctagcgcgagtggggaggggcgagggggtggtagttgtagtagcagcagcagtagagctaagctagggttttccctccccccgcgcgcgcagcaggcggcatggagagcctggtcctcgcctcctcctgctccgcttctccccgcctgcctcccctctccgcggcccgccgccgccgcccctcctcgcagactctcccggcgacggctgcggcgtccgggcggaggggagctgggaggtccaagctcgtcgtcgtcgccgccgccgccgccgcggcccgcgggtccgggaacggtttcgagggattaaagacaaatggatttgcaagcatgtcgtcttcgaccaacagtgagaatatgtcaactggaacgggttccctacctcccatgccacccccatcgtcatacatcggttcgcctgttttctggattggagttggtgtagcattgtccgcagcattttctatggtctcttcgatggtaaagaaatatgcaatgcaacaagcattcaagtcaatgatgacccaggcaccgccaaacacttttggctcaaactcgcctttcccatttgccatgccaccacaggcagctcctgcagctcctagcagttacccatactcacaaccaaggaaagatacctctcctcaatctgcaactgtcgatgtttcagctactaaagtggaagcaactggaactttggaagaggctgatgtggctgaacagccaaagaagaaatttgcctttgttgacgtttctcctgaagagttgcagcaaaaggaacttcaatcttcactggagacagtggatgtaaaaagtgagagtaaacagagtgaaactatggaggatactgagcaaaaagctccaacaaatggaactgcttttaagatgaatgaaggttctgctagcgggacaactgaatctagcaattcagggcctatgttgtccgttgatacaattgagaaaatgatggaagatccagccgtgcagaagatggtttacccctatttgcctgaggagatgaggaaccctgattcattcaagtggatgctgcagaatccaatgtaccgccaacaactacaggatatgctaaacaacatgggtggatctcctgatcaatgggataaccgaatgctcgatcacttgaagaattttgaccttagcagtccagaagtcaggcagcagtttgcgcaagttggcatgactccagaggaggtagtatcgaaaataatggcaaacccagaagttgctgttgcattccagaacccaaagattcaaacagcgatcatggattgctcacaaaacccgctcaatattgtaaaataccagaacgacaaagaggtcatggatgtttttatgaagatatcacaaatcttccctcaaattaatggctagtggatcgtcgccgtgagattgcagttttgatttttgttgccctatcatctcttccaagtggctgcggtaacatctgttgatcggctgagtaaaaggaaacgaagttcatctgttcagtcattacggacaagatgtaaaagctttcctgtcagggttttttgagttgccaatgtacatcatcatatcgcctagtgtttggtttggtagtgaccctgcctcaagccagagcaggcaacgaagcgaagttaaggattttttttatttacatccccgcgcccccgtacaactgtgtagcttgtgctttgacgttacgaggtttgtggtaggttgtgaagatgcagagatagttcatatcacctcaattttgataatattatgtattatatctgtgttagcattgcaatgcaagcgaacaagtttactatcttccaaagcaacttggttggattggtgcttgtgttactctacatataatttggaggctaataattcaagttcttgaggctactgagctcatgatc

SEQ ID NO: 601 - DNA, 1831 bp, Hordeum vulgare subsp. vulgare
gggtttcgccatccagttcggcttctccgcacgcaaacccaaaaccctagcgccagccacaggcgagagcaacaaggcctcgtgacccggagaccggagtgaagctaggctaggctgcctcccccaggctcgtgatggagagcctcgtcctcgcctcctcgtgctccgcgtctccccgcctgcccctcctctccgcctccagccgcccgtcgcggcccctcccggcggcgccgctctctgctgccgccggccggagggggtccaggcggccgaggctcgtcgtctccgccgcgtcccgcggatctaggaacgtttcagatggattgtacacaaagggatttgccagcatatcttcttcaaccagcagcgagaatacatcgacgggaactggtaccctgcctcccatgccgcccccctcatcatatattggttcacctgttttctggattggcattggtgtagcattgtccgcggcattttccatggtctcttcgatggtaaagaaatatgcaatggaacaagcattcaagtcaatgatgacccaggcaccaccaaacacatttggtgcgaactcgccattcccattctccatgccaccacaggcaggttccacggcaccaagtagttatccatactcagggccaaggaaaaatacgccaaaaggtgcaactgttgatgtttcagctagtgatgtggcagcaactggatcttcggaagcagccgatgtggccgaaacatctaagccttcaaagaaatttgcctttgttgatgtttctcccgaagagttgcaaaaacagaaggagcttcaatcttcattggagacagtagatataagaagtgatagcactgggagtgaaacgaaggatgattccgaacaacaagttcctacaaatggtgctgcttttaagccaagtgaagattcctctacctggacaactgaatccagtaagtcaggacctatgctatctattgatacaattgagaaaatgatggaagacccagctgtgcagaagatggtttacccctacttgcctgaggagatgaggaatccagagtcattcaagtcgatgcttcagaatccgatgtaccgccagcaattggaggatatgctaaacaacatgggcgcatctcctgatcaatgggataaccgcatggttgatcacttgaagaacttcgaccttagcagtcctgaagtcaggcagcagtttgcgcaagttggcatgactcctgaggaagttgtatcgaaaataatggcgaacccagaagttgctgttgcattccagaatccaaaaattcaaacggccatcatggattgctcgcagaaccctctgaatattgtaaaataccaaaatgaccaagaggtcatggatgtttttatgaagatatcgcaaatcttcccccaaattaatggctagtggatgtgcatcacggaattgcagtttttgatttgccttggcctgttatctccagcctaagcgactgcagtagcatctgttaaccggctgaggaacagtgaaacttcatgtgttcggtcattttgcgcaaagatgtatccttgctgtcaaggtttttgagttgccaatgcacatcatatgatccagcgtttcggtttggttgcgaccatacctgaagtcagagtagtgaagtagcaaagtttgagatatatatttacgccaccgctctgtagaattgtgtagttggtgctttgacactatatggtttgctgtaggatgtgaaggtgccgatgtagttcatatcacctcaattttgatacattgtgttaccatgacagtgcatgaaaatgttggctatgttgtcccaaaaaaaaaaa

SEQ ID NO: 602 - DNA, 1737 bp, Zea mays
ccagcgtaccgaaaaaaaaaaggcaaaggggagcctgtctgaccgaggacgaaagaggcgcaggcgcacatcctccccctcccttgccgtcctccccctccccttgctggccgtcgcctgctgctgctgtcgcaggcgcgccagcgccaccgacccgccgatgagcgtctagctaggcatcatctccgcgacgagtcgacccaccacccacccacccactggcttgcctgcgaaccacccctgcgccgatccacctccgctgcctgtctgcctgcttctacatataatcgcgccggcctccgcctcgtcgcctgcgacccccaccacagaaccctccccctcacctccgctatcctcctccccggccgctccccgacagactccgatggccatcgtcgagactgccgctgccgctgcggctgccgctgccgctgccgaccacaccgcgccaccgcgcgaggaggaggcgccgggcgccgccgccgacgccggggagcgcgaaatgcgggatctggaggacctcctctccaagctcaaccccatggccgaggagttcgtccctccctccctcgcctcccccatctccggcgccggggccgggcacggggccctcacgcccgcgccgctctccccagccgcctacggcttctacccggtcaacgccggcttcgcggtcgcctcgccgggccaccgcggcgtcgtcagcttcccggcggtcgccgacgcccacgccggacgcggcatgaagaaggacggagccggagggttcggcggccacggccacggccaccccggcaggcggcggaccaacagccgcaccagcatggcgcagcgggacgaggccatccgccgcaccgtctacgtctccgacatcgatcaccaggttactgaagaaaacctcgcagcactatttataaattgcggacaggttgtggactgtcgcatgtgtggggacccaaattcagtccttaggtttgctttcatagagttcactgatgaggagggtgcaagagctgctctgaatctgtcaggaaccgtgcttggatattatcctgtcaaggttctgccgtcaaaaactgccattgcaccagtcaacgaaacattcctacccaggtctgacgatgaacgtgaaatgtgtgcaaggactatctactgcacaaacattgacaagaaggtcactcaagcagatctaaaattattctttgagtccatatgtggtgaggtctttcggctgaggttgcttggcgactaccatcattctacccgcatcgcttttgtggaattcgtgatggcagaaagtgctactgctgctctcaactgtagcggtgtggtactgggatccttgccaataagggtgagcccgtccaagacgcccgtgcgtccccgcgtccctcgccacctgatgtcgtactaggtatacatacatgaggtgctgacgatgccactgctcatatataagtaatagagatagacatgtatgaaaagggtcttttgtttttaagttgtgggctcggcctttttttctctctccttgattcaccgttggtcgaggctgttcttttttttaccttgcacatagaggagagcttcttactaagaaggaagaatgaagaaggaagcgcgtgggggtttttttttttaccttgatgcttttttaacctgtgttcagttgattggctgcgtctggttgctactcaacaaacaagaacacaagctaaaacttggtgatcggagact

SEQ ID NO: 603 - DNA, 1853 bp, Zea mays
gaggagagagaggcgcagcgcagcgcagcgcaggcgcgcatctcccccctccccttgccggctggcccctgctgcagctctgctccggtcggctctgcccccccgctctgctgactgctctgccgctgctgctgtcgcaggcgcgccaccaacccgccgatgcgcgcgtagcggcgtaggtaccatcatcatccatccccgcgacgacccaccacccacccctgcagtctgcagcatccccttccccactcccggctggtctgctgcggccacccctgcgccgatccacctccgctgcttcctgcctcaatatattcgcccgcctcgtcgcgtccgaccccgccacagaaggccttccagaaccctccgacccctcacctccgccccgctccactctcctcctcctcccgggccggccgactccgatggccgtcgtcgaggccgccgccgccgaccacgccgcgccgccgctccaggaggaggcaccgggcgcgggcgcgggcgctggcgccgacgccggggagcgcgagatgcgggatctggaggacctgctctccaagctcaaccccatggccgaggagttcgtcccgccgtccctcgcctcccccgccgccctcacgcccgcgccgctctcccccgccgcctacggcttctacccggccggcgccggcttcgcggtcgcctcgccgggccacggcggcgtcgtcggcttcccggccgtcgcggacgcccacgccgcacgaggcaggaagaagggcggagccggaggagggttcagcggccacggtcaccccgccaggaggcggaccaacagccgcaccagcatggcgcagcgcgacgagatcatccgccgcaccgtctacgtctccgacatcgatcaccaggttactgaagaaaacctggcagcactatttataaattgtggacaggttgtggactgtcgcatgtgtggagacccaaactcagtccttcggttcgccttcatagagttcactgatgaggagggtgcaagggctgctctgaatctgtcaggaactgtgctcggatattatcctgtcagggttctgccatcgaaaactgccattgcaccagtcaatccaacattcctacccaggtctgatgatgaacgggaaatgtgtgcgaggactatttactgcacaaacattgacaagaaggtcactcaggcagatctgaaattgttctttgagtctatatgtggagaggtctttcggctgaggttgcttggtgactaccatcattctactcgcatcgcttttgtggaatttgtgatggcagaaagtgctaccgctgccctgaactgcagtggcgtgatactgggatccttgccaataagggtgagcccctcgaagactcccgtgcgtccccgtgcgcctcgccagctgatgcactagaggtgtcctaggtacaggaggtgcggaaggcactgcttatatatcatcatcatatatatataatagagaatagacatatatgaaagaggggaggggaaaagtggcgtcacttgttctaagttatgggctcggcctttttgttttgggttcttgcttcaccaccgtgtgactgagtactaaagtgcctacgtacgccccgggtcgacgccggctggcagggcccttttgtttactaccttgcacatagaaggagaggagatggagagcttctcactagaaggatcggaagcgcgcgcgggggggtctgcctgatgctcttgtccttgatgcaacaacaggcggaaaactcctggacttttaccctgctgttcagttgtttgctgctgtgtcctggttgctactgaaacaaactggttaaaaaaaacttgggtattggagact

SEQ ID NO: 604 - DNA, 1702 bp, Zea mays
acccctgcagtctgcagcatccccttccccactcccggctggtctgctgcggccacccctgcgccgatccacctccgctgcttcctgcctcaatatattcgcccgcctcgtcgcctccgaccccgccacagaaggccttccagaaccctccgacccctcacctccgctccgccccgctccactctcctcctcccgggccggccgactccgatggccgtcgtcgaggccgccgcagccgaccacgccgcgccgccgctccaggaggaggcaccgggcgcgggcgctggcgctggcgccgacgccggggagcgcgagatgcgggatctggaggacctgctctccaagctcaaccccatggccgaggagttcgtcccgccctccctcgcctcccccgccgccctcacgcccgcgccgctctccccggccgcctacggcttctaccctgccggcgccggcttcgcggtcgcctcgccgggccacggcggcgtcgtcggcttcccggccgtcgcggacgcccacgccgcacgaggcaggaagaagggcggagccggaggagggttcagcggccacggccaccccggcaggaggcggaccaacagccgcaccagcatggcgcagcgcgacgagatcatccgccgcaccgtctacgtctccgacatcgatcaccaggttactgaagaaaacctggcagcactatttataaattgtggacaggttgtggactgtcgcatgtgtggagacccaaactcagtccttcggttcgccttcatagagttcactgatgaggagggtgcaagggctgctctgaatctgtcaggaactgtgctcggatattatcctgtcagggttctgccatcaaaaactgccattgcaccagtcaatccaacattcctacccaggtctgacgatgaacgggaaatgtgtgcgaggactatttactgcacaaacattgacaagaaggtcactcaggcagatctgaaattgttctttgagtctatatgtggagaggtctttcggctgaggttgcttggtgactaccatcattctactcgcatcgctttcgtggaatttgtgatggcagaaagtgctaccgctgccctgaactgcagtggcgtgatactgggttccttgccaataagggtgagcccctcgaagactcccgtgcgtccccgtgcgcctcgccagctgatgcactagaggtgtcctaggtacaggaggtgcggaaggcactgcttatatatcatcatcatcatatatatatatataatagagaatagacatatatgaaagaggggaggggaaaagtggcgtcacttgttctaagttatgggctcggcctttttgttttgggttcttgcttcaccaccgtgtgactgagtactaaagtgcctacgtacgccccgggtcgacgccggctggcagggcccttttgtttactaccttgcacatagaaggagaggagatggagagcttctcactagaaggatcggaagcgcgcgcgggggggtctgcctgatgctcttgtccttgatgcaacaacaggcggaaaactcctggacttttaccctgctgttcagttgtttgctgctgtgtcctggttgctactgaaacaaactggttaaaaaaaaacttgggtattggagactatgtgccctgcctgttggtttggtttggtttggtttggttaaaaaaaaaaaaaaaa

SEQ ID NO: 605 - DNA, 1500 bp, Sorghum bicolor
atggccgtcgtcgaggccgccgccgccgtggaccacgccgcgccgccgcgccatgaggaggaggaggaggaggcgccgggcaccggcgctgccgccgccgacgcggccggggagcgcgagatgcgggatctggaggacctcctctccaagctcaaccccatggccgaggagttcgtcccgccctccctcacctcccccgtggccgtcgccgtcggcgccgggccgggcccggggcccctcacgcccgcgccgctctcccccgccgcctacggcttctacccggccgctaacgccggtttcgcggtcgcctcgccggcggcccaccgcggcgtcgtcggattcccggccgccgtcgccgacgccgcccacgccggacgcggcaggaagaagggcggagccggaggagggttcggcggccacggccaccccggcaggcggcggaccaacagccgcaccagcatggcgcagcgcgacgaggtcatccgccgcaccgtctacgtctccgacatcgatcatcaggttactgaagaaaacctggcagcactatttataaactgcggacaggttgtggactgtcgcatgtgtggggacccaaactcagtccttcggtttgccttcatagagttcactgatgaggagggtgcaagggctgctctgaatctgtcaggaactgttcttggatattatcctgtcagggttctgccatcaaaaactgccattgcaccagttaacccaacattcctacccaggtctgatgatgaacgtgaaatgtgtgcaaggactatttactgcacaaacattgacaagaaggtcactcaggcagacctgaaattgttctttgagtccatatgtggagaggtctttcgactgaggttgcttggtgactaccatcattctactcgcatcgcttttgtggaatttgtgatggctgaaagtgctactgctgctctcaactgcagtggtgtgatactgggatccttgccaataagggtgagcccgtcaaagactcccgtgcgtccccgcgcgcctcgccagctgatgcactagatgtcgtaggtacaggaggtgctgatggcactgcttatatataatagagatagacatatatatgaaaaggggaggaaagaagtcgcgacatgtgtcttttgtttttaagttatgggctcggccttttttttttcttgcttcaccgttcctccgtgagtaaagcgcctgcgcccggagccagagagatggggaaatcccgggtcgaggctgggtcctttttaccttgcacttgcacatagaggagagcttcttactagaaggaagcatggggtcggtctgcctgatgatgctcttgtccttgatgcaacaaaggcaaaactcctggacttttaccctgtgttcagttgtttgctgtgtcctggttgctactgaaaaaaaaacataaacttggggattggagactatgaactcttgcttaccgttatatgccctacaaaaccttttggttgcttc

SEQ ID NO: 606 - DNA, 1667 bp, Hordeum vulgare subsp. vulgare
gaggagagagaaacaagagagagagagagagagagagagagaggcacctcctccctccctcccctgccggcctcccctgctctccccccctgcgccggtcggctgcagcagctgctgtcccctccccacccccgatccccatgctctccctctcctagcccgccgcaacgaccaaccaccctcgcccgcggttggctgtccccctcatctccgatccgactccggggatcgatccgctcttccgcaccgcaccgggcctatatataacccccccccaccatccccgcaccgaaccttccagaacctcacccccctccctccctctccggcagcagattcttcgttccgttcgggatggccgtagtcgagacctccgccgaccacgtcgcccccgcggctgccgccgaccacgccgccgcgccataccgcgcctcggaggagggcggcgacgcgggggagcgcgagatgcgggatctggaggagctcctctccaagctcaaccccatggcggaggagttcgtcccgccctcgctcgccgcgcaccccatgccgccgcccccctacgccgggtactaccccaacggcccccccgccgccggcttcgcgccggtcgcctcgccgggccaccgtggggtcgtcggcttccccgccgccgacggccgcggcaggaagaagtttggtggagggtacggcggcggctacccccacggcggcaagcggcgggtcaacagccgcaccagccaggcgcagcgcgacgaggtgatccgccgtacggtctacgtctccgacatcgatcatcaggtcaccgaggagcaactggcagcactatttatcaacgtagggcaggttgtggactgccgcatgtgtggggatccaaattcagttcttcgttttgcttttatagagtttactgatgaggagggtgcaagggctgctctaactctgtcaggaactgtgcttggatattatcctgtgagggttctgccatcaaaaacagcaattgcaccagtcaatccaacgttcctgcccaggtctgatgatgagcgtgagatgtgtgcaaggaccatctactgcacaaacatcgacaagaaggtctcccaggcagatgtgaaactgttcttcgagtcaatatgtggagaggtctatcgcctgaggttgcttggggactaccagcataatactcgcattgcctttgtggagtttgttatggctgaaagtgctacagctgctctcaactgcagtggtgttatactgggttccctgccaataagggtgagtccatttaagactcccgttcgtccccgtgctcctcggccaatgatgaactagagttgtaggtacaggaggtgccaatggcactgcttatatatagagatcgacatatgtgaaagagaaattaagatatgtcttttcttctaagttatccgctcgagtgtctttttattgtatcggcagtaagtatctagactcgagcggaggagggggaaagaaaaattagaaatggttggtcggtgtttaccttttgcacatagagctttttagaagcgggcctgttgctcttgtcctggatgcagcaaggcaaaactcgtgtactttttgtctttgttcagttgttggctgtgtcttgtttgctacttactggaaagttgcagcaagtcgtttacccg

SEQ ID NO: 607 - DNA, 1140 bp, Ricinus communis
atggcaattgtagaaaatgcgagtgtcgatttagggataagtataggctcggcctcatcatcatcgtcaagtctagattcaagtgtatcatcagcatcatccaacgatcaggatcactccaaccacaacaacagccacgaccacggacggtcgctaatcgaaaacagtatctcgattcagccactctacatgaaggctcaggttcaatctccgcctccaaatctgcaggtggctcagcttcatcatcatcatcagcgatccagcggtggaggtgatttgcagagggatataagggagttgcaggaattgttttctaagctaaatcctatggctgaagagttcgtgcctccttctcttgctaacaacaaaatttccaataactatattcatggacttaatggactcaatgtgggtttttatactaataacaacaactatgaccctgcctttatgcttaccaacgcctctagaaatggacaacttaatggaagcgccgctcgaaggaagaagaactataatcaagggaaacggaggttgaacagcaggacaagtatggctcagagggaggagattattcgcaggaccgtctatgtgtctgacattgatcaacaggtcacagaagagcagcttgcggccctatttgttggctgtgggcaggtggtggactgtcggatatgtggtgatcccaattctgtacttcgttttgcctttattgagtttactcatgaggaaggtgcacgtgctgctttgaacctagctggaactgtgcttggatactaccctgtgagggtgctgccttctaaaaccgctattgcaccagttaatccaacctttttaccaaggtctgatgatgaacgtgaaatgtgcataagaactatctactgcacaaacattgataagaaggttactcaggcagatgttaaactcttttttgaatccgtctgtggagaggtttatcgcttgaggctgctaggggattatcatcattctactcgtattgcttttgtggaatttgtgatggctgaaagtgcaattgctgctctcaattgcagtggtgtggttcttggatcattgccgattagggttagtccatcaaagacaccagttcggccgcgtgctcctcgtattcccatgcattga

SEQ ID NO: 608 - DNA, 1766 bp, Vitis vinifera
atccgaacaacgcctatttattttctctctctgaaaaaaactttctatttctctctctatctctggaggatcaacagtggaatagttttatattgaaatatttgataataatatagaaaagaaaaagcccttctctggttttacctcccttttttctccccgttttctcatcgaattttgcagggaactccggtttcctttcgcattcctcgatcttcaggctgtctggttgtggcatcgaatggaaacattttagattaaggcgcaggggggtcgtgtgatttcgggggttctgatcatggcggttgtggagaatgctggaaataaagtggggtcgtcgagtgcgaattctgagagtgcggacaccaacgattttggtcaatcgcagccgagtaatcacacagttatgcagaatttgcagcagaagaacactaatagcaaaccgattttgctgccaaatgatgaaaactattactcgcagaagataccccaatttcagcagaaagcggggagcaacggagtggccaagattcagatggtggggagtttcggaagagatagagaagatggtggggatattagggatttggaggaccttctctccaagttgaaccccatggccgaagaatttgttccaccttctctcgcaaatggccatggatggtctgctggtgctgcttttggatacactaacaactttgtattgcaggctaattttggcaatgcaaatgggaatgctggtagacggaagaggaacaattataatcagaagcggagaatcaacagccgaaccagcatggcacagcgggaggaagtgattaagaggacagtatatgtgtctgacattgatcagcaggtcactgaggaagatcttgctgctctttttatcaattgtggccaggttgttgactgtcgtatatgtggtgatcctaattccgttctccgatttgccttcgttgaatttactgatgaggaaggcgcgcgggctgctctgagtttggcgggaacaatgcttgggtattatccagtgagagtgctaccttcaaaaactgcaattgcacctgttaacccaacatttttgccaaggtctgaagatgaacgtgaaatgtgcgccaggactatttactgtacaaatattgataagaaggtgacccaggcagaagtcaaacttttctttgaatcaatttgtggagaggttcatcgcttgaggctgcttggagactatcatcactctactcgaattgcttttgtcgagtttgtaatggccgagagtgcaattgcagcccttaactgtagcggcgccattttaggatccctgcctataagagtcagcccatcaaagacgcctgtcaggccacgagctcctcgcccggccttgcattgaaccagccttgcatgtgtcctggatggatctattgctgctataatatttacatatacatacatagatacagacatgttatttaaggtacttgtggcttttgtttatcatcttagtttcgtcctcagtgacttagcccggtatctttgttacctgtaggggttatttatggttgtttatcttagcatgtagagctggaggggttacccatgtttgtttgtttaccttgtagagatgggtggaatttcgaggctttaaaccattcccattatggttgatagagtaggtctgctgtcccaaaagactaatgtttgttcgaattttatgatgtttctaactcctgaaggattcttcaaagaccaattttaaaacttttggttcttaa

SEQ ID NO: 609 - DNA, 1355 bp, Zea mays
accgtgcccatggccgcctgaccaatccccttcctcgttcctcctcccccccacaagctacagggctccggttcatggaactggtcttcgcggcgcgggcgtggggccggggcgagagcgcctcgtgaggcaaaccaaaccgcctccttcctgctcccttcatggcttcctgtctgtctctgtctatcctgccgccgccgctttaccactccagactccactcttgttccttccgccttcgccacctcccccacctctccctccgtctgatcctgcccgcgcctccccttcccccagtccgtcgataaagccgaggcatcgggactgcggcaggtagaaggagcacccattgattccgcatctcgtgcaggctcccccctccgcactcccacgcctgataccataccattccgccgccgcatcgacttctcctcctctgaacccgcggcgggggcggacggagatccattccagccggacctggatcggtctactccgacaccggcgtatctccggttaattaaaaaggtccgcttcttcagctttttgggaagataaacaagactgcccttcagctgagtgctcggaagaagtgggagggatttcacggttcatatccgtatatatctgcctcgaggacgaggaacccgctgcgagaaaaagggagtggacaggggctcggtcactcacgagctatggacagaaccgccaatgcggtgttggatatcgagggtctgcctcaaccacctgataaatgctgctccggaagtccaaaaatgaccagggccttgtcacgcaagggttcgaatcggatggaaaggaagggtggtgatgagctgctggagcaagaggatctggccagaaaacttatcatcaaagttgtgccatctcagctggagcagcagcgggccctggttgctccacactgcactccctgcgcgcctgtcctcctcattgactccgcggaaggaaggagcagcaggaggtttggccggctcatcacgcccgtcaataaccctcggaggattctgctcttattcgcgacgctgtcgagcgtggggacgacgatactgatctacttcacgctggcgatcaacagcagagcagaggcctagtcgtctgaagaggaccaggggagatcagatgcagcgtgtctgtctttattcgtgagcgagtgagacgatggatgagggggagttgtacccccttcttcctcgcgtgtatgtatatcggttgctctcatgctctgtgtgcctttttttcttcatcttcttcttgtagatgaacgttgaccttgttgattttcctctcgatagcagcacaagagtcacatgtgcaaaaaaaaaaaaaaaaaa

SEQ ID NO: 610 - DNA, 1015 bp, Sorghum bicolor
gtccgttgctcctgcccgcgcctccaccagtccgtcgataaagctgcggcattgggacggcgggaggtacaaggagctttccgctcattgcttccccatctcgtgtaggctctccactccgcactcccacgcctgataccattccgccgccgccgccgcctctgaacccacggtgcggcggagatccagccgggcctggatcggcctactccgacactgctttgtgaagataaacaagactgcttgctgtctgctgggaagtggactaagctcacggctgatatcatctgccttgaaggaaccagtgggagaaaagggagtggacagggcccaatcagaagcatggacaaaactgccaatgtggtattggatattgaaggtctgcctcaaccacctgataaatgctgctccggaagtccaaaaatgattagggccttatcacgcaagggttcaaataggatggaaaggaggggcagtgatgagctggagcaagaggatttggcgaaaaaacttatcatcaaagttgtgccgtctcaactggagcagcccctgggccagatcaaggctctggttgctccacattgtactccctgcacacctgttcttattgattctggggaaggaaggagcaaaaggttcagccgattcacgtctatcaaccctcggaaaatcctcctcttattcgcaacgctgtcgagtgtggggacgacaatactgatctacttcacactggcaatcaacagcaaagcggaggcgtagtcgtttgcagacaccaccaccatttgcttcggcggcagcagcagtacattccgagcttgagtttttctcgatttgtttgtggggggaagaagaggaccagatcagatgcagccagtttcaggtgtctccgtgtctgtatccgtgactgagtgagagacactgctaactgcttgagggggtgctcgcgcgttgtacttgtaatttgtattgccttcagttcacccccctcacctcccaaattcccgtcttccttgcg

SEQ ID NO: 611 - DNA, 887 bp, Zea mays
gacgggtacaaggagcactcattgcctccccatctcgtgtaggctctccccctcctccgcgctccgtccgtctctcatcaccgttccgccgccgccccacctctccctcctctcgccgccgcctccgaacccgccacggcgcggcggagatccaaccggacggatctggatcgacctactccgacaccgggccccccgatcacgagcatggacagaactgccaataatgcggtattggatatcgagagccttcctcaaccgcctgataaatgctgctctgggagtccgaagatgatcagggccttgtcgcgtaagggttcgaaccggatggagaggaggggcggcggcggcggcgagcaggagcaagaggatttggcgaaaaaacttgtcatcaaagttgtgccgtctcaactggagcagcagcccctgggtcagaacaaggcgctggtcgctccacattgcacacctgttcttgttgattctggggaagggaggagcaaaagattcattagccggttcacgtccatcaaccctcggaagattctcctcttgttcgcaacgctgtcgagcgtggggacaacgatactgatctacttcacgctggcgatcaacagcaaagcggaggcctagtcgcctggagacacccaccaccaccatttgcgtcggcgagcgggcggcggcagtacattccgagcttgagtttttatttttctctatttttgtttgtgaggtagctgccgcggcgagattagatgcagcctgccgctcaggtgtctgtatccattgactgagtgagagactgcttcagtgggtgtcattcttcctcgcgtgtatgtatattggtggaatcgttgatgtgacttttttagtcaaaaaaaaaaaaaaaa

SEQ ID NO: 612 - DNA, 1004 bp, Oryza sativa Japonica Group
gaggcgagcactaagagtatttttgacgtgtttaccggaatgtatttccgctattgctccgaaatggtttagatagcaaggaggccgcagagaagtggagaggactcacgaatcacgatccatttctatcttgagggaattggggatagcaaaagtcagtgaaaagggccagatgacaagcatggacaaggcagcaaatgtggtattggatattgaagggctgcctcagcaacctgataaatgctgcactggaagtccaaaaatgactagagccctatctcgcaagggctcaaatcgcatggaaaggaggagcggtgaagagcaggaacaagatgacttggtgaagaaacttattattaaggttgtgccatctcagttggagcagcttaagatgcccctggtgcagaacaaagccttggtcactccacaatcacaatgtgctgcctgtgcacctattctaactgactctggggaaggaaggaacaagaagtttaatcgacttacttcggttcacccccggaaaatcctactgttctttgcaactctgtcgagcgtgggcacaatgatactgatatacttcacgctcgcaatcaacggtggcaaagcggaggcgtagtcgtcaccggagcgaaacacgacaacggtttcagaagtgcatttcatagctggaattttcgcttctcgttatcagattttggtttgtttgggaggagagaactggaggaggaagcaacagtagcagcagcaatgatgcagccaggctctcatgcctgacacacaatgctgggagtgttgctcgatcagtgctccattgtcacctttgcctgacctgatctccctgaattcttttgatctgtacatgtaaattgctgtgaggcctttgttgagaggtagagagagagagaaagagagatccatggattgttgttggtgtaaatgagctggggcgaagctatccatttctgccatgcgagtcccagcttagctgtaaaagatctgaagcg

SEQ ID NO: 613 - DNA, 1681 bp, Oryza sativa Japonica Group
cctcacctcacgaaaccggcaatggcggccgccggagcatcggctctccggccacacctcgcccttctccccgccggcggcggtggaggcggaggcggcggaacccgtagctatgccctccaagcgctatccttcgtctcgcccctcctccctcattgcggccgacgacgccgctgcgtgctccgctccaaggcctcttcgtctccgtctcccccgccatcgccggggaaggaggcggtggctgtcccgacggcggagtcgtgcgtcaacctgggactcgagctcttctccaagggcagggtgaaggatgctcttgaacaatttgagaatgccctagagctgaatccaaatcctgttgaagcccaagcagcactatacaataaagcatgctgccatgcatttagggaagaaagcaacaaagctgcagattgcttaaggacagctctgcgagattataatctcaagtttggtactatacttaatgatcctgacttggcaccgttcagggcatcaccggaattcaaggaacttcaagaagaggcattgcgtggtggagaagatattggttctgggttccgaagagacctgaaactcattagtgaagtacaagcaccatttcgtggtgtccgaaggttcttttatgtggcgttaactgcagcagctggaatttcaacattctttaccattcctagacttatacttgcagttcaaggtggcgatggtgcccctgatctgctggaaactgttgggaatgctgccatcaatattggaggtattgttgtgctcgtggctttgtatttctgggaaaacaagaaagaagagcagcagatcacacaaatttctcgcaatgaaaccctttcaaggttacctgtccgcctgtcaaccaatcgcattattgagcttgtgcaactccgggacattactaggccagttatactggcaggttcaaaagcatccattactcgagcaatgcaaagagctgagagatatcggactgaactgctgaaacgaggtgttcttctaattcctgtgatctttggtgcttctcagaaagcccaaagtaagccaagaggctttggaagttcaagatctgctgcatcagctccttcagttggggatgactttgagaagcgtactgaatctattgcagcgaaatcacggttaaaagctgaagagcgatttaaggctgatattgtctctcctgaacaatgggaaagttggatacgtgaccagcaagagtctgaaggtgtcactcccggtgaagatgtctatataatcctccgattggatggtcgtgtcagaagatctggaagaggcatgccaaattggaacgacatattgcaggaacttccacgacttgaagaactgctgagcaaacttgaacgttgatgaaggtgtgtatacaactgcagtttgatcatccatatgtttctccattgtattattaattccctaatctatgtatagaccataccaatgtaattttgagggaaaattttgtttatgccactaatatatgaattcccaacttctgacgtactccactagttactgtgtgacttctcgtttatgtcactactatcaagccacataccattttttttcctgttttgctcccattctgtcaatttggactgtaagagaaaacattgcaaaatgacagatatatcttccctgtgtc

SEQ ID NO: 614 - DNA, 1560 bp, Zea mays
ggataacgagaaagacgataacctcacactttccttctcccacggcaatggcggccgtagcggcggctccacggccgcagctccccatgctatctggcggcggcggcgcggcactttccagtctcaccctccaaacactggccttcatttcccccctccccatcagccgctgtcaccgctgtgtgctccgctccaacgcctcgtcgtccccgtctccgccgccatcgcaggaggaggcagcggcggctgaggtggttccaacagctgagtcctgcgtcaatctcggtctccagctcttctccaaaggcagggtgaaggatgctcttgaacaatttgagaatgcattagagctgaatccaacatctattgaggcccaggcagcgctatataacaaggcatgctgccatgcgtatagagaagaaagcaaaaaggctgcagaatgtttaagggaagctttgagagactacaatctcaaatttggtaccatacttaatgatccagacttggcgccattcagagcatcaccagaattcaaggaacttcaagaagaggctttgcgtggtggagaagatattggttctggtttccgaagagacctgaaactcattagtgaagtacaagcaccattccgtggtgttcgaagattcttctatgtagctttgacagcagcagctggaatttcaacattctttaccattccccgacttgtactagcagttcgagggggtgatggcgcccctgatcttctggaaactgctggaaatgctgccatcaatattggaggtattgttgttctggtagctttgtatttctgggaaaacaagaaagaagagaagcagatcacacaaatttctcgtaatgaaaccctttcaagattacctgtgcgcctgtcaaccaatcgcattattgaacttgttcaactccgggacatcactaggcctgtgatattggcaggttcaaaagcatctgttactcgggcattgcaaagagctgagaggtatcggactgaactgctcaaacgaggcgttcttctaattcctgtgatctttggtgcttctcagaaagaccaaaccaaaccaaggggttttggtgcaagaagagctgctgcatcagttccttctgttgggggtgactttgaaaagcgtactgaatctattgcagcaaaatcacggttgaagactgaggttcggtttaaggctgatattgtttccccagaacaatgggaaagttggatacgagaccagcaagtgtctgaaggtgtcactcctggtgaggatgtctacataatccttcgtctcgatggacgtgtcagaagatctggaataggcatgccaaactggaatgacatattacaggaactgccacgacttgaagatctgatgagcaaacttgaacggtgaaaaaggtgtgggagcagctaaagttttaccattactctttttcccccattccattcgccttgcccttatctgctgaaacttgaagctggaccatcgtagttcttgtataatatagtgaaattctgctattttgtttatagcttgccgaagtttttctgtc

SEQ ID NO: 615 - DNA, 1486 bp, Zea mays
gcggccgtagcggcggctccacggccgcagctccccatgctatctggcggcggcggcgcggcactttccagtctcaccctccaaacactggccttcatttcccccctccccatcagccgctgtcaccgctgtgtgctccgctccaacgcctcgtcgtccccgtctccgccgccatcgcaggaggaggcagcggcggctgaggtggttccaacagctgagtcctgcgtcaatctcggtctccagctcttctccaaaggcagggtgaaggatgctcttgaacaatttgagaatgcattagagctgaatccaacatctattgaggcccaggcagcgctatataacaaggcatgctgccatgcgtatagagaagaaagcaaaaaggctgcagaatgtttaagggaagctttgagagactacaatctcaaatttggtaccatacttaatgatccagacttggcgccattcagagcatcaccagaattcaaggaacttcaagaagaggctttgcgtggtggagaagatattggttctggtttccgaagagacctgaaactcattagtgaagtacaagcaccattccgtggtgttcgaagattcttctatgtagctttgacagcagcagctggaatttcaacattctttaccattccccgacttgtactagcagttcgagggggtgatggcgcccctgatcttctggaaactgctggaaatgctgccatcaatattggaggtattgttgttctggtagctttgtatttctgggaaaacaagaaagaagagaagcagatcacacaaatttctcgtaatgaaaccctttcaagattacctgtgcgcctgtcaaccaatcgcattattgaacttgttcaactccgggacatcactaggcctgtgatattggcaggttcaaaagcatctgttactcgggcattgcaaagagctgagaggtatcggactgaactgctcaaacgaggcgttcttctaattcctgtgatctttggtgcttctcagaaagaccaaaccaaaccaaggggttttggtgcaagaagagctgctgcatcagttccttctgttgggggtgactttgaaaagcgtactgaatctattgcagcaaaatcacggttgaagactgaggttcggtttaaggctgatattgtttccccagaacaatgggaaagttggatacgagaccagcaagtgtctgaaggtgtcactcctggtgaggatgtctacataatccttcgtctcgatggacgtgtcagaagatctggaataggcatgccaaactggaatgacatattacaggaactgccacgacttgaagatctgatgagcaaacttgaacggtgaaaaaggtgtgggagcagctaaagttttaccattactctttttcccccattccattcgccttgcccttatctgctgaaacttgaagctggaccatcgtagttcttgtataatatagtgaaattctgctattttgttt

SEQ ID NO: 616 - DNA, 1584 bp, Hordeum vulgare subsp. vulgare
gaatgtggaagacgaccacctcaccatccctccgtactccatagtcgcaatggcggccgcggcactccgaacccacctttcccttctctcggccggcggcggaatccccaacccggcgctccaaactctatccttcgttgcccccctcctcctccgccgccgctgccgccgccgcagcagcgtcgttctctccaacgcgtcctcgtcgcccccgtctccccctccttcgccggagaaggcggtcgaggcggctccgacggcggagtcgtgcgtcaacctcggcctcgagttcttctccaagggcagggtgaaggacgcacttgaacaatttgacaaggccctagagctgaatccaaatcctaccgaagcccaagcagcgttctataacaaggcatgctgccatgcatacagggaagaaagcaaaaaagctgcagattgcttgagaatagctttgcgagattacaatctcaaatttggcacagtacttaatgatccagacatggcgccattcagggcatcaccagaatttaaggaacttcaagaggaggcattgcgtggtggagaagatattggttctggattccgaagagatctaaagcttattagtgaagtacaagcaccatttcgtggtgtccggaggttcttttatgtggcgttcattgcagcggctggaatttcaacattctttaccattcccagacttatacttgcacttcaaggtggtgatggtgctccagattttctggaaacggctgggaatgctgccattaatattggaggtattgttgtgctcgtggctttatttgtctgggaaaacaagaaagaagaagagcagattacaaatatctctcgtaatgaaaccctttcaaggttacctgtgcgtctgtcaaccaatcgcataactgaacttgtgcaactccgggacattactaggccagttatattggcaggttcaaaagcatctgttactcaagcaatgcaaagagctgagaggtaccgaactgaactgctcaaacgaggcgttcttctaattcctgtgatctttggtgcttcacaaaaagtccaaggcaaaccaaaaggcttcggtactacaagatctgctgcatcagctccttcaattgggggcgactttgaaaaacgtactgaatctattgcggcaaaatcacgactcagagccgaggttcgatttaaagccgatattgtctctccagaacaatgggaaagttggatacgtgatcagcaagaatcggaaggtgtcactcctggtgaagatgtctacataattctccgtcttgatggtcgtgtgagaagatccggaagaggcatgccaaactggaatgatattttgaaggaattgccacgtcttgaagatttgctcagcaaacttgaacgatgaaaactatgtgtatatgggtttcgttttcttccccacgccctttatctttgtgaaggccgagccactatttcgttgcacagagattgaccatcatgttgagtgatatttcgatgtagctttttttcagttcttatgcaaaaacagaggtgaaggtcttatttctctaagaagtgaggtctttgtgtgcg

SEQ ID NO: 617 - DNA, 1273 bp, Sorghum bicolor
agtgcaaagcacctgtgtctcttgctccatcagcttagccgagatcaggcttcaggaaagaaaaatgaagctctcggcggcagtcctctgcgcccttgtggctgtccaggcggcggcgctcctcctcgccaccgtgccgtcggcgcaggccaaagagctggaggtcggctactacggcaagaagtgcaagggcgtggagaacgtggtgaagtggcatgtcatcaaggctatcaaggccaaccgccgcaccggcgccgcactcgtccgcctcctcttccatgactgcttcgtcagggggtgtgatggttctgtcctcctggacgcttcctccgacaaccctcacccggagaaggaggcgccggtgaacatcggcctcgccgccttcgacgtcctggaggagatcaaggccgccgtcgagaagaggtgccccggcgtggtctcctgctccgacatcctcatctacgccgcccgcgacgcggccagcgccctgagcaacggccacgtccacttcgccgtccccgccgggcgcctggacggcttcgtctccaaggccgatgaggcccaggcggagctcccggactccacccacgacgtgcagcagctcatcgacaacttcgccaggaagaacttcaccgtggaggagctggtcatcctcaccggcgcgcactccatcggccagggccactgctcctccttcagaggccgcctctccgagccgtcgagccagatcaccccggcgtaccgcgacctgctcaactacaagtgctcccagggatcgaacccgcccgtggacaacaacgtccgcgacgaggactacgacgtggtggccaagttcgtggcggggttcaccagccgggtgcgcaagatcccggacttcctggacaactccttctaccacaacaacctcgccaagatcgtcaccttccactccgactggacgctgctcacgcacaaggaggcgctcggccacgtcgtcgagtacgccgagaacggcacgctgtgggacgaggacttctccgagtcgctgctcaagctcagcaagctgcccatgccagcaggaagcaagggagagatcaggaagaagtgcagcgtcgtcaaccaccgcctgtactgagcacgcaacacgtacttgttcatagatgaagatgagccataaggttgcgcttttttcgtttcatccattcttttgattctcattcgttgtactactcatctttttgtgtatttcacatgtctgccaaactctgcaataaaacactaaaacttttgttcc

SEQ ID NO: 618 - DNA, 1047 bp, Sorghum bicolor
atgaagctctcggcggcagtcctcttcgcgcttgtggctgtccaggcggcggtgctcctcgccaccgtgccgtcggcgcaggccagcgagctggaggtcgggtactacagcaagaaatgcaagggcgtggagaacgtggtgaagtggcacgttatcagggcgatcaaggccaaccgccgcaccggcgccgccctcgtccgccttctcttccatgactgcttcgtcagggggtgtgatggttctgtcctcctggacgcttcctccgacaaccctcacccggagaaggaggcgcgggtgaacatcggtctggccgccttcgacgtcctggaggagatcaaggccgccgtcgagaagaggtgccccggcgtggtctcctgctccgacatcctcatctacgccgcccgcgacgcggccagcgccctcagcaacggccacgtccacttcgccgtcccggccggccgcctggacggcttcgtctccaaggccgatgaggcgcaggcggagctcccggactccacccacgacgtgcagcagctcatcgacaacttcgccaggaagaacttcaccgtggaggagctggtcatcctcaccggggcgcactccatcggccagggccactgctcctccttcagaggccgcctctccgagccgtcgagccagatcaccccggcgtaccgcgacctgctcaactacaagtgctcccagggatcgaacccgcccgtggacaacaacgtccgcgacgaggactacgacgtggtggccaagttcgtggcggggttcaccagccgggtgcgcaagatcccggacttcctggacaactccttctaccacaacaacctcgccaagatcgtcaccttccactccgactggacgctgctcacgcacaaggaggcgctcggccacgtcgtcgagtacgccgagaacggcacgctatgggacgaggacttctccgagtcgctgttgaagctcagcaagctgcccatgccagccggaagcaagggcgagatcaggaagaagtgcagcgtcgtcaaccaccggctatactaa

SEQ ID NO: 619 - DNA, 1341 bp, Zea mays
gtgcctgttcctgagccagcagcatctgtctcttgcttcatcagctaggcgcccggccgcgcggaccaggctccaggagaccaaaaatgaagctctcggtggcagtcctctgcgcgcttctggctgtccaggcggcggtgctcctcgccaccgtgccgacgtcgcaggccagcgagctggaggtcgggtactacagcaagaaatgcaagggcgtggagaacgtggtgaagtggcacgtgatcaaggcgctcaaggccagccgccgcaccggcgccgctctcgtccgccttctcttccatgactgcttcgtcaggggatgcgatggttctgtcctcctggacgcttcctacgacaaccctcatccggagaaggaggcgccggtgaacatcggcctcgccgccttcgacctcctggaggagatcaaggccgctgtcgagaagaggtgccccggcgtcgtctcctgctcggacatcctcatctacgcggcccgcgacgcggccagcgtcctcagcaacggccacgtccacttcgccgtccccgccggccgcctggacggcttcgtctccaaggccgaggaggcccaggcggagctcccggactccaaccaagacgtgcagcagctcatcgacaacttcgccaggaagaacttcacggtggaggagctcgtcatcctcaccggggcgcactccatcggccagggccactgctcgtccttcaccggccgcctctccgagccatcgcagcagatcaccccggcgtaccgcgacctgctcaactacaagtgctcccaggggtccaacccgcccgtggacaacaacgtccgcgacgaggactacgacgtggtggcgaggttcatgccggggttcaccagccgggtgcgcaagatccccgacttcctggacaactccttctaccacaacaacctggccaagatcgtcaccttccactccgactggacgctgctcacgcacaaggaggcgttcggccacgtcgtggagtacgccgagaacgccacgctatgggacgaggacttctcggactcgctgctcaagctcagcaagctgcccatgccgaaaggaagcaagggagagatcaggaagaagtgcagcgtcgttaaccaccgcttatactaagcctgccagatgccgtggaaatcgaagaaagaggtcgtgccagcacaacacatatatatcaaccatcggagatcagaaagccataaggttgcgcttttttgtttcatccattcttttgattatcattcgtttgtgctacactcatctttttgtgtatttctcatgcatatctgtcaaactgcaataaaactttgttcctgatatgtgc

SEQ ID NO: 620 - DNA, 1321 bp, Zea mays
gtccgtctcttgctcatcagcatcagctagccacccgaccaggcttcagaaaacaaaaaaatgaagctctcggcggcagtcctctgcgcgcttgtggctgttcaggcggcggtgcttctcgccaccgtgccgacggcgcaggccagcgagctggaggtcgggtactacagcaagaaatgcaagggcgtggagaacgtggtgaagtggcacgtcatcaaggcgatcaaggccaaccgccgcaccggcgccgctctcgtccgccttatcttccatgactgcttcgtcaggggttgcgacggttctgtccttctggacgcttcctacgacaaccctcacccggagaaggaggcgccggtgaacatcgggctcgcagccttcgacgtactggaggagatcaaggccgctgtcgagaagaggtgccccggcgtggtctcctgctccgacatcctcatctacgccgcccgcgacgccgccagcatcctcagcaacggccacgtccacttcgccgtccccgcaggccgcctggacggcttcgtctccaaggccgaggaggcccaggcggagctcccggactccacccacgacgtgcagcagctcatcgacaacttcgccaggaagaacttcaccgtggaggagctcgtcatcctcaccggggcgcactccatcggccagggccactgctcgtccttcactggccgcctctccgagccacccagccagatcaacccggcgtaccgcgacctgctcaactacaagtgcccccaggggtccaaccctcccgtggccaacaacgtccgcgacgaggactacggcgtggtggcgaggtacatgccggggttcaccagccgggtgcgcaagatccccgacttcctggacaactccttctaccacaacaacctcgccaagatcgtcaccttccactccgactggacgctgctcaccaacaaggaggcgttcggccacgtcgtggagtacgccgagaacgccacactgtgggacgaggacttctccgactcgctgctcaagctcagcaagctgcccatgccagcgggaagcacgggcgagatcaggaacaagtgcagcgtcgtcaaccaccgcctatactaagccagctcccgtacctgcaacaatggaaatcgaagaaagaggtcgatcgtgtccgcacaaccacatatcaaacattgtaaatcaaaatgagccataagatttttgttgtttttgtttcatccattcttttgattctcattcgttttactacacactcatctttttttttgtgtatctctcgtatctgtcaaactgcaataaaactttgttactg

SEQ ID NO: 621 - DNA, 1369 bp, Zea mays
agagcccagcgtccgtctcttgctcatcagcatcagctagccacccgaccaggcttcagaaaacaaaaaaatgaagctctctgcggcagtcctctgcgcgcttgtggctgttcaggcggcggtgcttctcgccaccgtgccgacggcgcaggccagcgagctggaggtcgggtactacagcaagaaatgcaagggcgtggagaacgtggtgaagtggcacgtcatcaaggcgatcaaggccaaccgccgcaccggcgccgctctcgtccgccttatcttccatgactgcttcgtcaggggttgcgacggttctgtccttctggacgcttcctacgacaaccctcacccggagaaggaggcgccggtgaacatcgggctcgcagccttcgacgtactggaggagatcaaggccgctgtcgagaagaggtgccccggcgtggtctcctgctccgacatcctcatctacgccgcccgcgacgccgccagcatcctcagcaacggccacgtccacttcgccgtccccgcaggccgcctggacggcttcgtctccaaggccgaggaggcccaggcggagctcccggactccacccacgacgtgcagcagctcatcgacaacttcgccaggaagaacttcaccgtggaggagctcgtcatcctcaccggggcgcactccatcggccagggccactgctcgtccttcactggccgcctctccgagccacccagccagatcaacccggcgtaccgcgacctgctcaactacaagtgcccccaggggtccaaccctcccgtggccaacaacgtccgcgacgaggactacggcgtggtggcgaggtacatgccggggttcaccagccgggtgcgcaagatccccgacttcctggacaactccttctaccacaacaacctcgccaagatcgtcaccttccactccgactggacgctgctcaccaacaaggaggcgttcggccacgtcgtggagtacgccgagaacgccacactgtgggacgaggacttctccgactcgctgctcaagctcagcaagctgcccatgccagcgggaagcacgggcgagatcaggaacaagtgcagcgtcgtcaacccccgcctatactaagccagctcccgtacctgcaacaatggaaatcgaagaaagaggtcgatcgtgtccgcacaaccacatatcaaacattgtaaatcaaaatgagccataagatttttgttgtttttgtttcatccattcttttgattctcattcgttttactacacactcatctttttttttgtgtatctctcgtatctgtcaaactgcaataaaactttgttactgaaaaaaaaaaaaaaaaaaaaataaaaaaaaaaaaaaaa

SEQ ID NO: 622 - DNA, 1344 bp, Oryza sativa Japonica Group
gctcgcagctcaagcacctctctcaagccgctttcctctacaggaccggttgcttggtcacataagcttttgggggaaacatgaggctgtcggtggccatcctctgcgccctcgtcgccgtgcaggcggcggcgctgctcctcgccggatcggcggccgcggccagcgagctcaaggtcgggtactaccacaagaagtgcaagggcgtcgagaacgtgatcaagtggcacgtcatcaaggctctcaagcagaaccgccgcaccggcgctgccctagtccgcctcctcttccacgactgcttcgtcaggggttgcgatgggtcagtcctgctggacaagtcgtacgagaacccacacccggagaaggaggcgccggtgaacatcgggctggcggcgttcgacctcctggaggagatcaaggcggccgtggagaagcggtgccccggcgtggtgtcctgctccgacatcctcatctacgcggcgcgcgacgccggcagcatcctcagcaacggccacgtccacttcgacgtccccgcgggccgcctcgacggcgtcgtctccagggccgacgaggcccaggcggagctcccggactccaccatgaccgtgcagcagctcaaggacaacttcgccgccaagggcttcgacaccgagcagctggtcatcctctccggcgcgcactccatcggccagggccactgctcctccttcaccggccgcctctccgagccgccgcagcagatcaccccggcgtaccgcgacctcctcaactacaagtgctcccaggccgccaacccggacgtcgtcaacaacgtccgcgacgaggacgcctccgtcgtcgccaggttcatgccgggcttcgtcagccgcgtccgcaagatcagcgacttcctcgacaacacctactaccacaacaacctcgccaagatcgtcaccttccactccgactggcagctgctcacggacgccacgtcgctctccaaggtccacgagtacgccgacaatgccaccctttgggactccgacttctccgactcgctgctcaagctcagccagctgcccatgccggaggggagcaagggggagatcaggaagaagtgcagcgccatcaaccacttgtactaaatgcattgcatgcatggacacaagacgaccacacagagacgatgatcaacgacgactatgcttgtagtagattgatttggctttcacacatccattcttttgatttccatttgttgtaatttgttctctgtaatttctcagccatgttaatctgttacataagttaatcatacaaatctggatataataaaaatataattaactgcgatgttaattaatc

SEQ ID NO: 623 - DNA, 1321 bp, Zea mays; identical to SEQ ID NO: 620

SEQ ID NO: 624 - DNA, 1369 bp, Zea mays; identical to SEQ ID NO: 621

SEQ ID NO: 625 - DNA, 1341 bp, Zea mays; identical to SEQ ID NO: 619

SEQ ID NO: 626 - DNA, 1047 bp, Sorghum bicolor; identical to SEQ ID NO: 618

SEQ ID NO: 627 - DNA, 1273 bp, Sorghum bicolor; identical to SEQ ID NO: 617

SEQ ID NO: 628 - DNA, 1344 bp, Oryza sativa Japonica Group; identical to SEQ ID NO: 622

SEQ ID NO: 629 - DNA, 1875 bp, Zea mays
gataccgtctccgacctcctcccttttgcgctagcttccagagcatcatcaccacctccacaccaccgccccagctcgcttccctccccgctacacggtcgctcaccagtcaccacccaccactgcttccatgctcctcgcctcgtttccagctcgcgaaacttagctccagatcctctcccccccatccaccgcgccgcattaacctcagatccacccggcgagctcatttcagatccatccatgcgcttcccgttccttttcgccctccagctggtcgccttggcggcggcagcgtcggcggccgaggtcgcggtgacggctcttcgaggatggtgcaccgtctgtcagacgaggcccggctggaggtaggcccgcgtgtggggtggtggccgcagcgaggaagcggggagtactaccgcgcgctagtgaggagcgatatccagcggcagaagcggcggctcgcggtcctctcgctctcaaagggcggcagcaccttctccccgggcaacgacttaggctggctatattacgcttgggtggatgttgggacgcctgctacctcctttttggttgcattggatactggtagtgaccttttctgggttccctgtgactgtatccagtgtgctcccttgtctggctaccgtggaaatctggatagagatcttagaatatacaggcctgctgaatcgacaacaagtcggcatcttccttgcagccatgagctatgccaatcggttccaggctgcacaaacccaaagcagccttgcccatacaacattgactacttttcagaaaatactaccagctctggtttgctaattgaggatacactacacttgaactacagggaggaccatgtacccgtgaatgcttcagttattattggctgtggtcaaaagcaaagtggtgattatctggatggtattgcaccggatggactccttggccttggaatggcagatatttcagttcctagtttccttgcgagagctggactagttcagaattccttctcgatgtgctttaaggaagatagttctgggagaattttctttggagaccaaggagtgccctctcaacagtctacaccgtttgttcctctgtatggcaaacttcaaacttatgctgttaatgtcgacaaatcttgtattggacataaatgtcttgagggtactagcttcaaggctttagtcgatagtggaacatcatttacttctcttcctctcgacgtttacaaggctttcacaatggagtttgacaaacaaatgaatgctacaagggtgccttatgaagacactacctggaaatattgctacagtgctagtcctcttgagatgcctgatgtgccaaccataaccctgacatttgctgcggacaagagcttgcaagctgttaatcctatcttgccatttaatgacaaacagggggcacttgccgggttctgcttagctgtgctgccatcaacagaacccattggaattattgcccagaatttcctggttggataccatgttgttttcgacagagaaagcatgaagctgggctggtaccgctccgaatgccacgacgttgaggacagcacgacggtgccgttgggcccatctcagcgcgacagtccagaggacccgttgccgtcgaacgagcagcagacttccccggccgtgacgcctgcgacggcaggcacggctccgctctcctgtgcgacgacgaatctgcagatgctccttgctagctcttacccattgctgttgctgacgatgtcgagtgtgttcttcgtctcgtgaacaaccgatatactactaatcgatagccttgtatattgtatgtgctttatttatggtgtttttttttgcaaaaaaaaaaaaaaaa

SEQ ID NO: 630 - DNA, 1926 bp, Zea mays
gccccagctcgcttccctccccgctacacggtcgctcaccagtcaccacccaccactgcttccatgctcctcgcctcgtttccagctcgcgaaacttagctccagatcctctccccccccccccccatccaccgcgccgcattaacctcagatccacccggcgagctcatttcagatccatccatgcgcttcccgttccttttcgccctccagctggtcgccttggcggcggcagcgtcggcggccgaggtcgcggtgacgcgctcttcgaggatggtgcaccgtctgtcagacgaggcccggctggaggtgggcccgcgtgtggggtggtggccgcagcgaggaagcggggagtactaccgcgcgctagtgaggagcgatatccagcggcagaagcggcggctcgcggtcctctcgctctcaaagggcggcagcaccttctccccgggcaacgacttaggctggctatattacgcttgggtggatgttgggacgcctgctacctcctttttggttgcattggatactggtagtgaccttttctgggttccctgtgactgtatccagtgtgctcccttgtctggctaccgtggaaatctggatagagatcttagaatatacaggcctgctgaatcgacaacaagtcggcatcttccttgcagccatgagctatgccaatcggttccaggctgcacaaacccaaagcagccttgcccatacaacattgactacttttcagaaaatactaccagctctggtttgctaattgaggatacactacacttgaactacagggaggaccatgtacccgtgaatgcttcagttattattggctgtggtcaaaagcaaagtggtgattatctggatggtattgcaccggatggactccttggccttggaatggcagatatttcagttcctagtttccttgctagagctggactagttcagaattccttctcgatgtgctttaaggaagatagttctgggagaattttctttggagaccaaggagtgccctctcaacagtctacaccgtttgttcctctgtatggcaaacttcaaacttatgctgttaatgtcgacaaatcttgtattggacataaatgtcttgagggtactagcttcaaggctttagtcgatagtggaacatcatttacttctcttcctttcgacgtttacaaggctttcacaatggagtttgacaaacaaatgaatgctacaagggtgccttatgaagacactacctggaaatattgctacagtgctagtcctcttgagatgcctgatgtgccaaccataaccctgacatttgctgcggacaagagcttgcaagctgttaatcctatcttgccatttaatgacaaacagggggcacttgccgggttctgcttagctgtgctgccatcaacagaacccattggaattattgcccagaatttcctggttggataccatgttgttttcgacagagaaagcatgaagctgggctggtaccgctccgaatgtcgctacgttgaggacagcacgacagtgccgttgggcccatcgcagcacgacagtccagaggacccgttgccgtcgaacgagcagcagacttccccggccgtgacgcctgcgacggcaggcacggctccgctctcctgtgcgacgacgaatctgcagatgctccttgctagctcttacccattgctgttgctgacgatgtcgagtgtgttcttcgtctcgtgaacaaccgatatactactaatcgatagccttgtatattgtatgtgctttatttatggtgtttttttctttatgtgttgctctagaggtttatagatcagctgtattttgcctccgttgttggtccctgggatagcctagcaatagcaatcccccgactcgaaatgcagaagtttcagaaatggtgcggaaacgagc

SEQ ID NO: 631 - DNA, 1904 bp, Zea mays
cagctcgcttccctccccgctacacggtcgctcaccagtcaccacccaccactgcttccatgctcctcgcctcgtttccagctcgcgaaacttagctccagatcctctcccccccccccccccatccaccgcgccgcattaacctcagatccacccggcgagctcatttcagatccatccatgcgcttcccgttccttttcgccctccagctggtcgccttggcggcggcagcgtcggcggccgaggtcgcggtgacgcgctcttcgaggatggtgcaccgtctgtcagacgaggcccggctggaggtgggcccgcgtgtggggtggtggccgcagcgaggaagcggggagtactaccgcgcgctagtgaggagcgatatccagcggcagaagcggcggctcgcggtcctctcgctctcaaagggcggcagcaccttctccccgggcaacgacttaggctggctatattacgcttgggtggatgttgggacgcctgctacctcctttttggttgcattggatactggtagtgaccttttctgggttccctgtgactgtatccagtgtgctcccttgtctggctaccgtggaaatctggatagagatcttagaatatacaggcctgctgaatcgacaacaagtcggcatcttccttgcagccatgagctatgccaatcggttccaggctgcacaaacccaaagcagccttgcccatacaacattgactacttttcagaaaatactaccagctctggtttgctaattgaggatacactacacttgaactacagggaggaccatgtacccgtgaatgcttcagttattattggctgtggtcaaaagcaaagtggtgattatctggatggtattgcaccggatggactccttgcccttggaatggcagatatttcagttcctagtttccttgctagagctggactagttcagaattccttctcgatgtgctttaaggaagatagttctgggagaattttctttggagaccaaggagtgccctctcaacagtctacaccgtttgttcctctgtatggcaaacttcaaacttatgctgttaatgtcgacaaatcttgtattggacataaatgtcttgagggtactagcttcaaggctttagtcgatagtggaacatcatttacttctcttcctttcgacgtttacaaggctttcacaatggagtttgacaaacaaatgaatgctacaagggtgccttatgaagacactacctggaaatattgctacagtgctagtcctcttgagatgcctgatgtgccaaccataaccctgacatttgctgcggacaagagcttgcaagctgttaatcctatcttgccatttaatgacaaacagggggcacttgccgggttctgcttagctgtgctgccatcaacagaacccattggaattattgcccagaatttcctggttggataccatgttgttttcgacagagaaagcatgaagctgggctggtaccgctccgaatgtcgctacgttgaggacagcacgacagtgccgttgggcccatcgcagcacgacagtccagaggacccgttgccgtcgaacgagcagcagacttccccggccgtgacgcctgcgacggcaggcacggctccgctctcctgtgcgacgacgaatctgcagatgctccttgctagctcttacccattgctgttgctgacgatgtcgagtgtgttcttcgtctcgtgaacaaccgatatactactaatcgatagccttgtatattgtatgtgctttatttatggtgtttttttctttatgtgttgctctagaggtttatagatcagctgtattttgcctccgttgttggtccctgggatagcctagcaatagcaatcccccgactcgaaatgcagaagtttcag

SEQ ID NO: 632 - DNA, 1875 bp, Zea mays
gtacagggtctttacaagaaaacgaccgataccgtctccgcctttccttccttttgcgctagcttccacagcatcaccaccgccgccccagctcgcttccctccccgctacacggacacggccgctcagcgctcaccaccgcttccatgctcctcgcctcgtctcccgctcgcgagacgtagctccagatcctctcccccacccacggcagcaccgcattaccctcagatccacccccgcgagcctcatttcagatccacccatgcgcctcccggtccttttcgccctgcagctggtcgccttggcggcggcagcttcggcggccgaggccgcggcgacgttctcctcgaggatggtgcaccgtctgtccgacgaggcccggctggaagcgggcccgcgcatggggttgtggccgcagcgcggaagcgggggctactaccgcgcgctgctgaggagcgatctccagcggcagaagcggcggctcgcgggcaagaaccagctcctctcgctctcaaagggcggcagcaccttctcccccggcaacgacttaggctggttatactacgcttgggtggatgttgggacgcctactacctcctttttggttgcattggatactggaagtgacctgttctgggtaccctgtgactgtattcagtgtgcccctttgtctagctaccgtggaaatctggatagagatcttggaatatacaagcctgccgaatcaacaacaagtcggcatcttccttgcagccacgagctatgtcaaccgggttcaggctgcacaaacccaaagcaaccttgcacatacaatattgactacttttcagaaaatactaccagctctggtttgctaattgaggattccctacacttgaactccagggagggccatgcaccagtaaatgcttcagttattattggctgtggtcgaaagcaaagtggtgactatctggatggcattgcaccggatggactccttggccttggaatggcagacatttcagttcccagtttccttgcaagagctggactagttcggaattccttctcgatgtgcttcaaggaagatagttctgggagaattttctttggagatcaaggagtgtcctctcaacaatccacaccgtttgttcctctgtatggcaaacttcaaacttatgctgttaatgtcgacaaatcttgtattggacataaatgtcttgagggttctagcttccaggctttagtcgatagtggaacatcatttacttctcttcctcctgatgtttacaaggctttcacaacggagtttgacaaacaaattaatgcttcaagggtgccttacgaagacagtacctggaaatattgttacagtgctagtcctcttgagatgcctgatgtgccaaccataatcctggcattcgctgcaaacaagagcttccaggctgttaatcctatcttgccatttaatgacgaacagggagcgcttgccaggttctgcttagctgtactgccatcaacggaacctattggaattattggccagaatttcctggttggataccacgttgtcttcgacagagagagcatgaagttgggctggtaccgctctgaatgtcgcgacgttgacaacagcacgaccgtgccgctgggcccatcgcagcacggcagttcagaggacccgttgccgtcgaacgagcagcagacttccccgcccgtgacgcctgcaacgacaggcacggctcctccctccagtgcaacgacgaaccgacagatgctctttgctagctcttacccgttgctgtttctgacaatgtccactgtgttcttcatctcatgagcaactgataatctgatatgctggtaatcgatagcccaaaaaaaaaaaaaaaa

SEQ ID NO: 633 - DNA, 1894 bp, Oryza sativa Japonica Group
gctctcactcccacccgctcgaccaccaccaccgcctcctcctcctcacctcgcaccccgcaaaacctagccccaggtcctctcctcccctccgccttgccgcattacccccagatccaccgcctccggcccagatccacccatgcgcctcccggtgctactcccgctgctgctgctgctgctcgccgcggcagcggcggtggcggcggcggaagcggcgacgctttcggcgaggatggtgcaccggctgtccgacgaggctcggctcgcggcgggcgcgcgtggggggcggcgctggccccgtcgcgggagcggggattacttccgcgcgctggtgcggagcgacctccagcggcagaagcggcgggtcggcggcaagtaccagctcctctccctctcccagggcggcagtatcttcccctccggcaacgacttgggctggttatactacacttgggtggacgttgggacgccaaatacttccttcctggtcgcattggatactggaagtgacttgttttgggtgccttgtgattgtatccaatgtgcgccattgtccagctaccatggaagtttggatagagatcttgggatttacaagccatctgaatcaactacaagtcggcatctgccctgtagccatgagctttgctcaccggcttcaggttgcacaaacccgaagcagccttgtccatacaatattgactacttttcagaaaatacaaccagctccggtttgctaattgaggatatgttacacttggattctagggagggccatgcacctgtgaatgcttctgtcattataggctgtggtaaaaagcagagtggtagctatttggaaggtattgcaccagatggacttcttggtcttggaatggcagatatctcagtacctagtttccttgcaagagctggattagtacgaaattccttttcaatgtgtttcaagaaagatgattctgggagaattttctttggtgatcaaggagtacctacccaacagtctacaccatttgtcccgatgaatggcaagcttcagacttatgctgttaatgttgacaaatattgtattggacataagtgtacggagggagctggcttccaggcattagtagacactggaacatccttcaccagtcttcccctcgatgcctacaagagtatcactatggagttcgacaaacaaatcaatgcatcaagagcatcttctgatgattattctttcgaatattgctacagcaccggtcctcttgagatgcctgatgttccaactataactctgacttttgctgagaacaagagtttccaggctgttaatcctatacttccatttaatgacagacagggagaatttgctgtcttttgcttagcagtactaccatcacctgaacctgttgggattattgggcagaatttcatggttggctatcacgtagtttttgacagagaaaatatgaagctgggctggtaccgctctgaatgccatgatcttgacaacagcacgacggtgtccttaggtccatcacagcataacagtccagaggaccccctaccgtcaaacgagcagcagacctctccggctgtcacgccggctgtcgcaggcagggctccgtcctctggcggatcgacgactctgcagaacctacttgctaactctaacatgctgctcttactgactatgtccgtgttcttcatctcatgaacaactcgctgacaatgatctaacttatagtagctctgtaaattgtatgtgcctcgtatatgcctatatggtgtctttttgttgcttagagagctcagtaaatcagcagctgcatgcttctgggtgccgtgccgataagtcgtttcctgcgtgcactgcgtgcagctgtatgtaagtatatgtgtcgtg

SEQ ID NO: 634 - DNA, 2621 bp, Zea mays
ctgcttccatgctcctcgcctcgtttccagctcgcgaaacttagctccagatcctctcccccccccccccccatccaccgcgccgcattaacctcagatccacccggcgagctcatttcagatccatccatgcgcttcccgttccttttcgccctccagctggtcgccttggcggcggcagcgtcggcggccgaggtcgcggtgacgcgctcttcgaggatggtgcaccgtctgtcagacgaggcccggctggaggtgggcccgcgtgtggggtggtggccgcagcgaggaagcggggagtactaccgcgcgctagtgaggagcgatatccagcggcagaagcggcggctcgcggtcctctcgctctcaaagggcggcagcaccttctccccgggcaacgacttaggctggctatattacgcttgggtggatgttgggacgcctgctacctcctttttggttgcattggatactggtagtgaccttttctgggttccctgtgactgtatccagtgtgctcccttgtctggctaccgtggaaatctggtatgcacccccttagttcagtaactttgatgttaatatctgaagatgtcgtattgtcaagcggctgtcagcttgagttgggacctacgagaatcttttttttcccaaagacatatttgcttggttcatgccaaattactgatgcagatgatgacctgaatcttgacatttttattacctaagacacaaatcttggttgaagaaactaatacattgcatgcggtttgctctaattccattgactattggatatcgtaggaaaaaaaatgcaaactgatttctaaacttggaaagtggaaagtaacatgactgatctgtaaacttcccaccatgtctctgggtcattttcagtttaaatttcactataatcactgttcttggctgcgttcaagttgtggtgcaaagtatgtacaccattatgtgaccataaaatatcacacggacaagaacaatccatctatgttttgatggaaattaatttctccactgttcagctgcaattgtaagttgcacaggcacaccgcacacctacatttcattgtcatggcttgcaagtttgatactggccaggtttttatttaggagtacaagtggtggtgtcatgtgtgaactttggttctcttctgttttgttcattttaagtttcttctatttcttcctaacaagtgcagaataagaggaggctaccatgattttaagcagtttagtgcttatttccagtgattgattggcaggtgctccatcataaatggagcatctattatgcaggatagagatcttagaatatacaggcctgctgaatcgacaacaagtcggcatcttccttgcagccatgagctatgccaatcggttccaggctgcacaaacccaaagcagccttgcccatacaacattgactacttttcagaaaatactaccagctctggtttgctaattgaggatacactacacttgaactacagggaggaccatgtacccgtgaatgcttcagttattattggctgtggtcaaaagcaaagtggtgattatctggatggtattgcaccggatggactccttggccttggaatggcagatatttcagttcctagtttccttgctagagctggactagttcagaattccttctcgatgtgctttaaggaagatagttctgggagaattttctttggagaccaaggagtgccctctcaacagtctacaccgtttgttcctctgtatggcaaacttcaaacttatgctgttaatgtcgacaaatcttgtattggacataaatgtcttgagggtactagcttcaaggctttagtcgatagtggaacatcatttacttctcttcctttcgacgtttacaaggctttcacaatggagtttgacaaacaaatgaatgctacaagggtgccttatgaagacactacctggaaatattgctacagtgctagtcctcttgagatgcctgatgtgccaaccataaccctgacatttgctgcggacaagagcttgcaagctgttaatcctatcttgccatttaatgacaaacagggggcacttgccgggttctgcttagctgtgctgccatcaacagaacccattggaattattgcccagaatttcctggttggataccatgttgttttcgacagagaaagcatgaagctgggctggtaccgctccgaatgtcgctacgttgaggacagcacgacagtgccgttgggcccatcgcagcacgacagtccagaggacccgttgccgtcgaacgagcagcagacttccccggccgtgacgcctgcgacggcaggcacggctccgctctcctgtgcgacgacgaatctgcagatgctccttgctagctcttacccattgctgttgctgacgatgtcgagtgtgttcttcgtctcgtgaacaaccgatatactactaatcgatagccttgtatattgtatgtgctttatttatggtgtttttttctttatgtgttgctctagaggtttatagatcagctgtattttgcctccgttgttggtccctgggatagcctagcaatagcaatcccccgactcgaaatgcagaagtttcag

SEQ ID NO: 635 - DNA, 1742 bp, Hordeum vulgare subsp. vulgare
gaccgtcacgctccccacccacccccgccaccaccaccgccacctccccgctcctcgccgcccaccccgcaaaccctagccccaggctccctcctccggccacctccccgcattcccggcagatccgtcgtcggcagtccagatccacccatgcgcctcccgctcctcctcctcgccctgctcgccgcggcggcgccggcgccggctgcctcggcgacgctctcgacgaggatggttcaccggctctccgacgaggcgcggctggcggcggggccccacggggcgcggtggccgcggcacgggagcgggggctactaccgggcgctggtgcggagcgacctccagcggcagaagcgcaagcaccagctcctctccgtctccgaggccggcggcatcttctcccccggcaacgatttcggctggttgtattacacatgggtggatgtcgggacaccgaacacttcctttatggtcgcattggatactggaagtgatctgttctgggtaccctgtgattgtattgagtgcgctccattggctggctaccgtgaaactttggatagagatctcgggatttacaaaccagctgaatcaacaacgagtcggcatttgccctgcagccatgagctttgcccgccgggttcaggctgttcaagcccaaagcagccttgcccatacagtactgactatcttcaagaaaacacaaccagctcaggtttactaattgaggatattctacacttggactccagagagagccatgcaccagtgaaggcttcagtcgttataggttgtggtaggaagcaaagcggtagctatttggatggtattgcaccagatgggcttcttggacttgggatggcggatatctcagttcctagcttccttgcaagagctggattagttcgaaattccttctcgatgtgttttaaggaagattctgggagaattttcttcggtgatcaaggagtgtctatccaacagtcgacgccatttgttcctttatatggcaaatatcaaacttatgctgttaatgtcgacaaatcttgtgttggccataaatgttttgaggctactagcttcgaggccttagttgatagcggaacatcattcacagctcttcctctgaatgtttacaaggctgtcgctgtcgagtttgacaaacaagttcatgccccaagaataacccaggaagatgcttcttttgaatactgctacagtgctagtcctcttaagatgcctgacgtgccaactgtaactcttactttcgctgcaaacaagagctttcaggctgttaatcctacaattgtactcaaggacggggagggatcggttgctggcttttgcttagctcttcagaagtcaccagagcctattggaattattggacagaacttcctgactggataccacattgtctttgacaaagagaacatgaagctgggctggtaccgatctgaatgccatgatcctgacaacagcacgaccgtacccttgggcccgtcgcagcacaacagcccgggtgttccgctgccgtcgagcgagcaacagacctcccccaccgtgacgcctcccgccgtcgcgggcaaggcgccgacctcctcgagcgggccgccgtcgaacctacataggctgcttgctaactgttgctcgctcctgctactgactatctccaccgtgttcttcatctcatgaactagctactgagtaaacctaaccgatgatagccccctgtatattgc

SEQ ID NO: 636 - DNA, 2509 bp, Zea mays
cctcacactttccttctcccacggcaatggcggccgtagcggcggctccacggccgcagctccccatgctatctggcggcggcggcgcggcactttccagtctgaccctccaaacactggccttcatttcccccctccccatcagccgctgtcaccgctgtgtgctccgctccaacgcctcgtcgtccccgtctccgccgccgtcgcaggaggaggcagcggcagctgaggtggttccaacagctgagtcctgcgtcaatatcggtctccagctcttctccaaaggcagggtgaaggatgctcttgaacaatttgagaatgcattagagctgaatccaacatcaattgaggcccaggcagcgctatataacaaggcatgctgccatgcgtatagagaagaaagcaaaaaggctgcagaatgtttaagggaagctttgagagactacaatctcaaatttggtaccatacttaacgatccagacttggcgccattcagagcatcaccagaattcaaggaacttcaagaagaggctttgcgtggtggagaagatattggttctggtttccgaagagacctgaaactcattagtgaagtacaagcaccatttcgtggtgttcgaagattcttctatgtggctttgacagcagcagctggaatttcaacattctttaccattccccgacttgtactagcagttcgagggggtgatgacgcccctgatcttctggaaactgctggaaatgctgccatcaatattggagtatgccgcaggtattgttgtgctggtagctttgtatttctgggaaaacaagaaagaagagaagcagatcacacaaatttctcgtaatgaaaccctttcaagattacctgtgcgcctgtcaaccaatcgcattattgaacttgttcaactccgggacatcactaggcctgttagtataactttctcaaactttaatgtccactgtatgtttgctgaaaataattgtttctctcatttatttctgaaacctttattcagccacttgtcatttgaggtgtattttaggtgatattggcaggttcaaaagcatctgttactcgggcattgcaaagagctgagaggtatcggactgaactgctcaaacgaggcgttcttctaattcctgtgatctttggtgcttctcagaaagaccaaaccaaaccaaggggttttggtgcaagaagagcttctgcatcagttccttctgttggggttagaccaaccttacatattggctaaataccaaaaacctcacctgcctcttagtttgtgtgttttccatcaaaaacttggtccctttctttgataatttaatgcaatgttgattttgacagggtgactttgaaaaacgtactgaatctattgcagcaaaatcacggttgaagactgaggttcggtttaaggctgatattgtttcccctgaacaatgggaaaggtgcatttcctttgatgtatatgcattttgtcctatactctatatctaacttcaataagtagcaagattgtttttcacaagtacatatttttttctaacatagcacaataacataattaaggtacatagattgtgtagcagcacagaagggaaattattagacagatatataaacttacaatccaccctaaagtaaaggattatgatcttcccctctatagcacacaccatacttgaaacttgaaagccatattgctcactcaggtaaagaagtagggttttttttggggccaatgcagcattataatggaaatgttatctgtaaaaccacagaatattgaaaagatacagtgtcctttgattcttctcctcccataggccataggtatgattgcagaaaaaacatatccatatgtttaggttctgatatggcatctatcccttttactgcatccacatattgataggacctgaggtatgaaataatctgtctcaagtctaaatttcaagatatctttacttgttttgctcccatttctagtctgtgcctttacattacttctcttttctaaggaccgctacagaaatactacaagtgcagtcagtcctgttccttttctgttattattagcatggttctacatgcttgaatgtggtaatttactatcctgggttttgatatctacctgttctcattatggttcagttggatacgagaccagcaagtgtctgaaggtgtcactcctggtgaggatgtctacataatccttcgtctcgatggacgtgtcagaagatctggaataggcatgccaaactggaatgacatattacaggaactgccacgacttgaagatctgatgagcaaacttgaacggtgaaaaaggtgtgggagcagctaaagttttaccattactctttttcccccattccattcgccttgcccttatctgctgaaacttgaagctggaccatcgtagttcttgtataatatagtgaaattctgctattttgtttatagcttgccgaagtttttctgtcaaaaaaaaaaaaaaaa

SEQ ID NO: 637 - DNA, 1528 bp, Zea mays
cggcaatggcggccgtagcggcggctccacggccgcagctccccatgctatctggcggcggcggcgcggcactttccagtctcaccctccaaacactggccttcatttcccccctccccatcagccgctgtcaccgctgtgtgctccgctccaacgcctcgtcgtccccgtctccgccgccatcgcaggaggaggcagcggcggctgaggtggttccaacagctgagtcctgcgtcaatctcggtctccagctcttctccaaaggcagggtgaaggatgctcttgaacaatttgagaatgcattagagctgaatccaacatctattgaggcccaggcagcgctatataacaaggcatgctgccatgcgtatagagaagaaagcaaaaaggctgcagaatgtttaagggaagctttgagagactacaatctcaaatttggtaccatacttaatgatccagacttggcgccattcagagcatcaccagaattcaaggaacttcaagaagaggctttgcgtggtggagaagatattggttctggtttccgaagagacctgaaactcattagtgaagtacaagcaccattccgtggtgttcgaagattcttctatgtagctttgacagcagcagctggaatttcaacattctttaccattccccgacttgtactagcagttcgagggggtgatggcgcccctgatcttctggaaactgctggaaatgctgccatcaatattggagtatgccgcaggtattgttgttctggtagctttgtatttctgggaaaacaagaaagaagagaagcagatcacacaaatttctcgtaatgaaaccctttcaagattacctgtgcgcctgtcaaccaatcgcattattgaacttgttcaactccgggacatcactaggcctgtgatattggcaggttcaaaagcatctgttactcgggcattgcaaagagctgagaggtatcggactgaactgctcaaacgaggcgttcttctaattcctgtgatctttggtgcttctcagaaagaccaaaccaaaccaaggggttttggtgcaagaagagctgctgcatcagttccttctgttgggggtgactttgaaaagcgtactgaatctattgcagcaaaatcacggttgaagactgaggttcggtttaaggctgatattgtttccccagaacaatgggaaagttggatacgagaccagcaagtgtctgaaggtgtcactcctggtgaggatgtctacataatccttcgtctcgatggacgtgtcagaagatctggaataggcatgccaaactggaatgacatattacaggaactgccacgacttgaagatctgatgagcaaacttgaacggtgaaaaaggtgtgggagcagctaaagttttaccattactctttttcccccattccattcgccttgcccttatctgctgaaacttgaagctggaccatcgtagttcttgtataatatagtgaaattctgctattttgtttatagcttgccgaagtttttctgtc

SEQ ID NO: 638 - DNA, 1712 bp, Hordeum vulgare subsp. vulgare
gggaagacgaccacctcaccatccctccgtactccatagtcgcaatggcggccgcggcactccgaacccacctttcccttctctcggccggcggcggaatccccaacccggcgctccaaactctatccttcgttgcccccctcctcctccgccgccgctgccgccgccgcagcagcgtcgttctctccaacgcgtcctcgtcgcccccgtctccccctccttcgccggagaaggcggtcgaggcggctccgacggcggagtcgtgcgtcaacctcggcctcgagttcttctccaagggcagggtgaaggacgcacttgaacaatttgacaaggccctagagctgaatccaaatcctaccgaagcccaagcagcgttctataacaaggcatgctgccatgcatacagggaagaaagcaaaaaagctgcagattgcttgagaatagctttgcgagattacaatctcaaatttggcacagtacttaatgatccagacatggcgccattcagggcatcaccagaatttaaggaacttcaagaggaggcattgcgtggtggagaagatattggttctggattccgaagagatctaaagcttattagtgaagtacaagcaccatttcgtggtgtccggaggttcttttatgtggcgttcattgcagcggctggaatttcaacattctttaccattcccagacttatacttgcacttcaaggtggtgatggtgctccagattttctggaaacggctgggaatgctgccattaatattggaggtattgttgtgctcgtggctttatttgtctgggaaaacaagaaagaagaagagcagattacaaatatctctcgtaatgaaaccctttcaaggttacctgtgcgtctgtcaaccaatcgcataactgaacttgtgcaactccgggacattactaggccagttagtataattcttttagcatctttcatacttactacgccctctgttcacatatgtaagatgtcttggcagtttaaattgaactgccgaaacgtcttacatttgtgaacaaagggagtacatttcttttaaatttcatcaagtgaccggtggattaagtagtactgtaggttatattggcaggttcaaaagcatctgttactcaagcaatgcaaagagctgagaggtaccgaactgaactgctcaaacgaggcgttcttctaattcctgtgatctttggtgcttcacaaaaagtccaaggcaaaccaaaaggcttcggtactacaagatctgctgcatcagctccttcaattgggggcgactttgaaaaacgtactgaatctattgcggcaaaatcacgactcagagccgaggttcgatttaaagccgatattgtctctccagaacaatgggaaagttggatacgtgatcagcaagaatcggaaggtgtcactcctggtgaagatgtctacataattctccgtcttgatggtcgtggcatgccaaactggaatgatattttgaaggaattgccacgtcttgaagatttgctcagcaaacttgaacgatgaaaactatgtgtatatgggtttcgttttcttccccacgccctttatctttgtgaaggccgagccactatttcgttgcacagagattgaccatcatgttgagtgatatttcgatgtagcttttttttcagttcttatgcaaaaacagaggtgaaggtcttatttctctaag

SEQ ID NO: 639 - DNA, 1500 bp, Sorghum bicolor; identical to SEQ ID NO: 605

SEQ ID NO: 640 - DNA, 1853 bp, Zea mays; identical to SEQ ID NO: 603

SEQ ID NO: 641 - DNA, 1737 bp, Zea mays; identical to SEQ ID NO: 602

SEQ ID NO: 642 - DNA, 1702 bp, Zea mays; identical to SEQ ID NO: 604

SEQ ID NO: 643 - DNA, 1945 bp, Oryza sativa Japonica Group
attgcagttgcagttacaaccggcaaatctctcgcgaccctgcaccgtagcagcgtcgacgcgaggcggacagcctcttcttcctcctccctttccaccccccacagagatctcgcctctctcctcctccctttccctctccttccttccagatctctccacgcgccgccccgatctcttccccccacccccacctcgtcaccggcggggaggagggcccggccgccggcagccatgatctcctccagtaagctcaagtccgtcgacttctacaggaaaattcctagggatttgaccgaggcatcactatctggggctggattgtccattgtagcagcactagctatggtgtttttgtttggaatggaactgagtaattacttagcagtcaatactagcacatctgtgattgttgataggagttcagatggggagttcttacggatagattttaacttaagctttcctgcactttcatgcgaatttgcatcagttgatgtcagtgatgttctgggaacaaacagattgaacataacgaaaactgttcgcaaatattcaattgatcggaatttagtgcctactggatccgagttccacccaggacctattcctacggtcagcaaacatggagatgatgttgaagaaaaccatgatgatggttcagttcccttgtcctctcgcaattttgatagctattcacaccagtatcctgttttggttgttaatttttatgccccctggtgttactggagcaatcgattgaaaccttcgtgggagaagactgcaaaaataatgagggagagatatgatcctgaaatggatggcagaatcattcttgccaaggttgactgcactgaagaaattgacttgtgtaggaggcaccatatacaaggttatccatccattcgcattttccgtaaagggagtgatcttaaggaaaaccagggtcaccatgatcatgaatcatactacggcgatcgtgatactgagagtttagtagcggcaatggaaacttatgttgcaaacatcccaaaagatgcccatgttctagctttggaggacaaatccaataagactgttgatcctgcaaaacgccctgctccattgaccagtggatgcagaatagaaggttttgtgcgggtaaaaaaggtccctgggagtgttgtaatctcagctcgatctggttcccactcctttgatccatcccagataaatgtttcccactatgtaacacagttctcttttggcaaaaggctatcggcaaagatgtttaatgaactgaaaagactaactccctatgttggtggccaccatgatagattagctggtcaatcctacattgttaagcatggtgatgtcaatgccaacgttactattgagcattacctgcaaattgtgaaaactgagcttgttacactgagatcatcaaaggaattgaaactggttgaggagtatgaatacacagcgcacagcagcttggtgcacagcttctatgttcctgttgtgaaattccattttgaaccttctcccatgcaggtcttggtaactgaacttccaaaatccttctcccatttcatcacaaatgtttgtgctatcattggaggagttttcacggttgctggaatactggattccatcttccacaacaccttgcggctggttaagaaggtcgagcttgggaagaacatttgaacaacaagattattcttcagaagcagcctcaagcttagtggttgcactagttttagtcattattttgttataccagggtaggaattcttaatatatcaagatgtgaaagagggtagtgggttggcagaggaggagaagttggggtcatgatatatagtaatagtaggtagggacctcactgttttgctaaacgacttcgtaagaacaataagacagtggatccttgttaactataccctacgttaattcgtcc

SEQ ID NO: 644 - DNA, 1665 bp, Hordeum vulgare subsp. vulgare
gacataaatctcacctctttcctccccctccctccagatctctccgcaccggcagatccgaccccccggcgcgctgccacgccgtcatcatcggcagccatgatctcctcgagcaagctgaagtccgtcgacttctacaggaaaattcctagggatttgacggaggcatcactatctggcgctggattatccatatttgcagcactagcaatggtgtttttgtttggaatggagttgagtagttacttagcagtcaataccaccacatctgtaattgttgacaggagttcagatggggagttcctacggatggattttaacttgagctttcctgcgctttcatgtgaatttgcatcagttgatgtcagtgatgtgctgggaacaaacagactaaacataacgaaaactgttcgcaagttttcaattgatcggaatttagtacctactggatctgagttccacgctggacctatacccactgtcaacaaacatggagatgatgttgaagaataccatggtgatggttcagttgccttgtcctctcgcaattttgatagctattcccaccagtatcctgttttggttgtcaacttttatgccccctggtgttactggagcaatcgtctgaaaccttcatgggaaaaggccgctcaaataataagggagagatatgatcctgaaatggatggcagaattcttctcggcaaagttgactgcactgaggaagttgaactgtgtaagaggcaccatatacaaggttacccgtcaattcgcattttccataaagggagtgatatgaaggagaatcagggtcaccatgagcatgactcgtactatggggaacgtgatactgaaagtttagtcgcggctatggaaacatatgttgcaaatattccaaaagaggcccatgtgcttgctttggaagacaaatccaacaagactgttgatcctgcaaagcgtcctgctccaatgaccggcggctgcagaatagaaggttttgtgcgggttaaaaaggttcctggcagtgttgtaatatcggctcgatctggttcacactcatttgatccatctcagataaatgtttcccactacgtcacaacgttctcatttggcaaaaggctctcatcaaagatgtttaatgaactgaaaagactatttccctatgttggcggacaccatgatagattagctggtcagtcttacgtcgttaagcatggtgatgtcaatgcaaacgttactattgagcattaccttcaaattgtaaagaccgagctggttacgctgagatactcaaaggagttgaaagtgcttgaagaatatgaatacacagcacacagtagcttggtgcacagcttctatgttcctgttgtgaaattccattttgagccttctcccatgcaggtcctggtgactgaacttcccaaatcattctcccacttcatcacaaatgtctgtgctattattggtggagttttcacggtggccggaatacttgactccatcttgcacaacacgctaaggttggtgaagaaggttgagctaggaaaggacatttgaacaatatatagtagatcctcagaagcgctcgattccttgcggctgcactagttagtaatgatttttgtaccgttagcaattcttaatctattaattaacatatacagc

SEQ ID NO: 645 - DNA, 1883 bp, Zea mays
aggtctagagtagagaggtccaggccttcgcccgagccccgccagccactaccaacttgggacgggcaggccggccagtgtcacatacaggcccagaagccgtcagaagacatccggccctaggctaggcgcacgggaggcagacgaggcgagaagtggcaactggtacctttggggaggcgaggaaggacacgaggtcggcgcgttcgtgcgtgcctttctcactgcacgccgatccctctctccgaaccccgccgcccgccgcagatccgagggtcatcggcagccatgatctcgtccagcaagctcaagtctgtcgacttctacaggaaaatacctagggatttgaccgaggcatcactatctggcgctggattatccatcgtagcagcattagcaatggtttttttgtttggaatggagttgagcagttacttagcagtcaatactaccacatctgtgatcgttgataggagttcagatggggagtttttacggatagatttcaatatgagctttcctgcgctttcatgtgaatttgcatcagttgatgttagtgacgtgctgggaacaaacagattgaacataacgaaaactgttcgaaagtattcaattgatcggaatttagtaccaactggatcagaattccaccctgggcctatccccattctcaataagcatggagatgatgtcgaagaggatcacgtggatggtgcattttcattgtcatctcgcaattttgatagcttttcacaccaatatcctgttttggttgtcaacttctatgctccctggtgttactggagcaatcgactgaaaccttcatgggagaagacagcaaaaataatgagggagagatatgaccctgaaatggatggtagaatccttctaggcaaggttgactgcactgaggaagttgaattgtgtaggagaaaccacatacaaggatacccatccattcgtgttttccgtaaagggtctgatataaaggagaatcagggtcaccatgatcatgaatcatactatggggaacgtgatactgagagtttagtcgcggcaatggaaacatatgttgcaaacatcccaaaagaggctcatgcgcttgctttggaagacaaatccaataagactgttgatcctgcaaagcgccctgctccaatggccagtgggtgcagaatagaaggctttgtgcgtgtcaaaagggttccagggagtgttgttatctcagctcgatctggatctcactcgtttgatccatcccagataaatgtttcgcactatgtgacacagttctcatttggcaaaagactttccccaaggatgctgcatgaattcataagacttactccctatcttcgtggataccatgatagactagctggccagtcttatactgttaagcatggtgaggttaacgccaatgttactattgagcactacctacaagttgtaaagactgagcttgtaacacagaggtcctcaaaggaactgaaagtgcttgaggaatacgaatacacagcacacagcagcttggtgcacagcttctatgttcctgttgtgaaattccattttgagccttctcccatgcaggtcttggtaactgaagtcccgaaatccttctcccatttcatcacaaatgtctgcgctatcatcggtggggtcttcacggttgctggaatactggattccatctttcacaacacactcaggatggtgaagaagattgagctaggaaagaacatttaaatttcgacgccgctgcaagtttaggcggatgcactaggtagccattgttttgttataactaggtaatgactcatgaaaatcggtatatgaaagatggcttgctgaaaaaaaaaaaaaaagcaaaaaaaaaaaaaaaa

SEQ ID NO: 646 - DNA, 1897 bp, Zea mays
agaagtggcaactggcaactggtacctttggggaggcgaggaaggacacgaggtcggtgcgttcgtgcgtgcccttctcactgcacgccagtgagaattgagatcccagcaccgagacgacgacacaagtctcacctccatcctcctttactcctcatcctagatccctctctccgaaccccgccgcccgccgcagatccgaaggtcattggcagccatgatctcgtccagcaagctcaagtccgtcgacttctacaggaaaatacctagggatttgaccgaggcatcactatctggcgctggattatccattgtagcagcattagcaatggtttttttgtttggaatggagttgagcagttacttagcagtcaatactaccacatctgtgatcgttgataggagttcagatggggagtttttacggatagatttcaatatgagctttcctgcgctttcatgtgaatttgcatcagttgatgttagtgacgtgctgggaacaaacagattgaacataacgaaaactgttcgaaagtattcaattgatcggaatttagtaccaactggatcagaattccaccctggccctatccccattctcaataagcatggagatgatgttgaagaggatcacgtggatggtgcattttcattgtcatctcgcaattttgatagcttttcacaccaatatcctgttttggttgtcaacttctatgctccctggtgttactggagcaatcgactgaaaccttcatgggagaagacagcaaaaataatgagggagagatatgaccctgaaatggatggtagaatccttctaggcaaggttgactgcactgaggaagttgaattgtgtaggagaaaccacatacaaggatacccatccattcgtgttttccgtaaagggtctgatataaaggagaatcagggtcaccatgatcatgaatcatactatggtgaacgtgatactgagagtttagtcgcggcaatggaaacatatgttgcaaacatcccaaaagaggctcatgctttggaagacaaatccaataagactgttgatcctgcaaagcgccctgctccaatggccagtgggtgcagaatagaaggctttgtgcgtgtcaaaagggttccagggagtgttgttatctcagctcgatctggatctcactcgtttgatccatcccagataaatgtttcgcactatgtgacacagttctcatttggcaaaagactttccccaaggatgctgcatgaattcataagacttactccctatcttcgtggataccatgatagactagctggccagtcttatactgttaagcatggtgaggttaacgccaatgttactattgagcactacctacaagttgtaaagactgagcttgtaacacagaggtcctcaaaggaactgaaagtgcttgaggaatacgaatacacagcacacagcagcttggtgcacagcttctatgttcctgttgtgaaattccattttgagccttctcccatgcaggtcttggtaactgaagtcccgaaatccttctcccatttcatcacaaatgtctgcgctatcatcggtggggtcttcacggttgctggaatactggattccatctttcacaacacactcaggatggtgaagaagattgagctaggaaagaacatttaaatttcgacgccgctgcaagtttaggcggatgcactaggtagccattgttttgttataactaggtaatgactcatgaaaatcggtatatgaaagatggcgtgctgaattgacggttgaaattcggggggtcatgaaatcatcatataataactagggatctcactgtttcgctaaaccactcacaataagacagtggattgctgctaaaaaaaaaaaaaaaaaaaaaaa

SEQ ID NO: 647 - DNA, 1848 bp, Zea mays
cgaggcgagaagtggcaactggcaactggtacctttggggaggcgaggaaggacacgaggtcggtgcgttcgtgcgtgcccttctcactgcacgccagtgagaattgagatcccagcaccgagacgacgacacaagtctcacctccatcctcctttactcctcatcctagatccctctctccgaaccccgccgcccgccgcagatccgaaggtcattggcagccatgatctcgtccagcaagctcaagtccgtcgacttctacaggaaaatacctagggatttgaccgaggtatcactatctggcgctggattatccattgtagcagcattagcaatggtttttttgtttggaatggagttgagcagttacttagcagtcaatactaccacatctgtgatcgttgataggagttcagatggggagtttttacggatagatttcaatatgagctttcctgcgctttcatgtgaatttgcatcagttgatgttagtgacgtgctgggaacaaacagattgaacataacgaaaactgttcgaaagtattcaattgatcggaatttagtaccaactggatcagaattccaccctggccctatccccattctcaataagcatggagatgatgttgaagaggatcacgtggatggtgcattttcattgtcatctcgcaattttgatagcttttcacaccaatatcctgttttggttgtcaacttctatgctccctggtgttactggagcaatcgactgaaaccttcatgggagaagacagcaaaaataatgagggagagatatgaccctgaaatggatggtagaatccttctaggcaaggttgactgcactgaggaagttgaattgtgtaggagaaaccacatacaaggatacccatccattcgtgttttccgtaaagggtctgatataaaggagaatcagggtcaccatgatcatgaatcatactatggtgaacgtgatactgagagtttagtcgcggcaatggaaacatatgttgcaaacatcccaaaagaggctcatgctttggaagacaaatccaataagactgttgatcctgcaaagcgccctgctccaatggccagtgggtgcagaatagaaggctttgtgcgtgtcaaaagggttccagggagtgttgttatctcagctcgatctggatctcactcgtttgatccatcccagataaatgtttcgcactatgtgacacagttctcatttggcaaaagactttccccaaggatgctgcatgaattcataagacttactccctatcttcgtggataccatgatagactagctggccagtcttatactgttaagcatggtgaggttaacgccaatgttactattgagcactacctacaagttgtaaagactgagcttgtaacacagaggtcctcaaaggaactgaaagtgcttgaggaatacgaatacacagcacacagcagcttggtgcacagcttctatgttcctgttgtgaaattccattttgagccttctcccatgcaggtcttggtaactgaagtcccgaaatccttctcccatttcatcacaaatgtctgcgctatcatcggtggggtcttcacggttgctggaatactggattccatctttcacaacacactcaggatggtgaagaagattgagctaggaaagaacatttaaatttcgacgccgctgcaagtttaggcggatgcactaggtagccattgttttgttataactaggtaatgactcatgaaaatcggtatatgaaagatggcgtgctgaattgacggttgaaattcggggggtcatgaaatcatcatataataactagggatctcactgtttcgct

SEQ ID NO: 648 - DNA, 1437 bp, Ricinus communis
atgatttcttctagcaagctcaaatctgtcgatttttacaggaaaattccaagagacttgactgaagcatcattatcaggtgcaggattatccataattgcagctctctctatggtttttttatttggcatggaattgagtaattatttaacagtcaacacctctacgtctgttatcgttgacaagagttctgatggggacttcttacgtattgattttaatctaagctttcctgctctttcatgtgaattcgcatcagttgacgtaagcgacgtgttgggaactaacaggttgaatataaccaagacaatccgcaaattttcaatagatcatgatttaaaccctactggctctgagtttcaatcaggaccggtcttgcatcacattaagcatggagatgagattgaaggagaagtgggcgaagggtctgtatcactaaatagtcgtaattttgatcagtatgcacagcagtatccaatattagttgtcaacttttatgctccttggtgctactggagtaatcgtctgaaaccttcatgggaaagtgctgctaaaataatgagagaaagatatgatccagaaatggatggacgcattcttttggtgaatgttgactgcactgctgatgctgaattgtgtagaaggaatcacattcaagggtatccctccattcgtatttttcgtaaagggagtgatatcaaggatgaccatggacaccatgatcatgaatcttattatggagatcgagatacagagagcttggttaagacaatggaaagtctggttgcacctattcagctggaatctcttaaatctgaaaatgcgacgcagagtaccaaaagaccggcacctttgacagggggatgcagaattgaaggatatgtgcgcgtaaaaaaggttccaggaaacctcattatctcagctcgttcaggggcacattcttttgatccttctcaaatgaacatgtcacatgtcatatcccatctttcatttggcttgaaggtttcacccaaggtgatgaatgaagcaaagcgattggtaccttatattggtggaagtcatgacaagttaaatgggcggtcattcgttaatcaccgagatgtagatgccaatgttactatagagcattatcttcaaatagttaaaacagaggtggttacaagacgatcttctcgtgaacataaattactcgaggaatatgagtacacagcgcacagtagtttggtacagagcgtgtacatacctgcggcaaaattccattttgagctctctccaatgcaggtcctaatcacagaaaatcccaagtcattttcacattttataaccaatgtctgtgccataattggaggtgtcttcacggtagctgggatattggattcaattttgcaccacacagttagactgatgaagaaagttgaattaggaaaaaatttttga

SEQ ID NO: 649 - DNA, 1800 bp, Vitis vinifera
atggtttccaccagcaagatcaaatctgtggatttttacagaaaaattcctagggatttgacggaggcatcattatcgggtgcagggttatccgtaatagcagccttatccatgatgtttctatttggaatggaactgagtaattatttgtcagtgagcacctctacatctgttattgttgaccagagttctgatggggatttcttacgaattgaattcaatatcagttttcctgctctctcatgtgaatttgcatcagttgatgtgagtgatgtgctgggaacaaacaggctgaacataacaaaaactattcgtaagtattcaatagatccagatttaagacctactggcgctgagtttcattcaggaccagttgggaaagtcatcaagcatggagatgaaactgatgaagaatatagtgaaggttctgcttcactaacagctcagaatttttataaatattcacatcagcatgctattttggttgtcaatttctttgctccttggtgctattggagtactcgcctgaaaccttcatgggagaaggcggccaaaataataagagaaagatatgacccagaattggatgggcgaattgttatggcaaaggttgactgcactgaagaaggtgaattgtgtaggaggcatcacatacagggttatccgtctattcgtattttccgtaaaggaagtgatgtgagggacgatcacggacaccatgatcacgaatcctattatggagatcgagatacagataccctggttactacgatggaaactttggttgctccaattccactggagtctcagaggctagctttggagaataaatctgatagtacggcagaccatataaaacgtcctgcacccagaacaggtggatgcagaattgaaggttttgtgcgtgttaagaaggttccaggcaaccttgtcatttcagctcgctcgggatcccattcctttgatccctctcaaatgaacatgtcacatgttatttcccacctttcatttggcagaaagattgcaccaagggtgatgagtgatatgaaacgagtgctaccatatattggtggaagccatgatagattgaatggccggtcatatattagtcatcctagtgattcaaatgcaaatgttactatagagcattatcttcaagtagtgaaaacagaggtgataacaactcgtgatcataagttggtcgaggagtatgagtacacagcccacagtagtttggtgcagagtttatatatccctgttgcaaaattccatttcgagctatctcctatgcaggtcttagtgacagaaaataggaagtccttctggcactttattacaaatgtctgtgccatcattggaggtgttttcacggttgctgggatattggactcagttctgcacaacacaatgagactgatgaaaaagattgaactagggaaaaatttttgatgggaagatgaattattggcatatttctcacaccccatttgtctgtgtgacatggtctatgtaaaaagaagtgccaatgtgtatgcccctctcgaatatgcatgagaaaacataaacatattagccactctagttgctcatacaggaaatgattaaagaaagattttgggtaatgcatgcaaggatttatttttatcaccttcttttctcttctgggctatgttcgattcctgagaaagcagataatatgagtgaaccttcaaacttttcattgtcttggtccttgaaaacaggaaattgtgatcacaattgcttttccttcttttttctcagtttactcagcaatcaaag

SEQ ID NO: 650 - DNA, 1615 bp, Populus trichocarpa
atggtttcaacgaacaagctcaaatccgtcgatttttacaggaaaattcctagagatttgacagaggcatcgttatcaggtgcaggattatcgatagtagctgccctagctatggtgtttttgtttggaatggaacttaataattatttaactgtcaacacctctacatctgtgattgttgacaatagttctgatggagagttcttacgtattgatttcaatcttagctttccttcactctcatgtgaatttgcatcggttgacgtgagtgatgtgttaggaactaacaggttgaatataacaaaaacaatccgcaaattctcaattgatcatgatttgaagcccactggatctgagtttcactctggaccagttttgcatcacatcaatcatggagatgaagttcatgaagaaggcagtgaaggttctgtatcactcaaagctcataattttgatcaatacacgcatcagtatccaattttagttgtcaatttttatgctccttggtgctactggagtaatcgcctgaaaccttcatgggaaaaggcagctaaaataataagagaaaggtatgatccagaaatagatgggcggattctgttggctaaggttgactgcactgaagaaggtgatctgtgtaggaggaatcacatacaagggtatccatcaattcgtattttccgtaaaggaagtgatcttcgggatgaccatggacaccatgaccatgaatcttattatggagatcgagatacagacagcctggttaagacaatggaaggtttggttgcacctattgcaatggaatctcaaaggcatgctttggagcataaacctgaaaatgcaacagagcatgttaaaagaccagctccttcagccggaggatgtagaattgaaggatatgtgcgtgtaaagaaggttccaggcaacctcgtgatctcagctcgctcaggagcccattcctttgattctgctcaaatgaacttgtcacatgtcatatcccatttctcgtttggtatgaaggttttgcccagggtaatgagtgacgtgaagcgtttgatacctcacattggtcgaagtcatgacaagttgaatggccgatcatttattaatcatcgtgatgtaggggctaatgtcactatagagcattatctccaagttgttaaaactgaggtggttacaagaagatcttcagctgagcacaaattaattgaggagtatgaatatacagctcatagcagtttggcacagactgtctacatgccaactgcaaaattccattttgagctctctcccatgcaggttttgatcactgaaaatcccaagtctttttcgcattttatcactaatgtctgtgccataatcggaggtgtcttcacggtggctggtatattggattcaattttgcacaacacatttagaatgatgaaaaaagtagaactcggcaaaaatttttgataggaagatgaaatttgatgtataaattctgttctcatactcctttttatttagcaaggatttgattagaacaattactgtatttacctggttttgaattgttataagctattctaattgctaatacaagaaattttccatggctctctgcaactccaac

SEQ ID NO: 651 - DNA, 1455 bp, Populus trichocarpa
atggtttcgacgaacaagctcaaatccgtcgatttctacaggaaaattcctagagatttgacagaggcatcgttatcaggtgcaggattatcgatagtagctgctctagctatgatgtttttgtttggaatggaacttaataattatttaactgtcaacacctctacaactgtaattgttgacaatagttctgacggggagttcttacgtatcgatttcaatatcagctttccttcactctcatgtgaatttgcatcggttgacgtgagtgatgtgttaggaactaacaggttgaatataacaaaaacaatccgcaaattctcaatagatcatgatttgaagccgactggatctgaatttcactccggaccagttttgcatcaaatcaagcatggagatgaagttgatgaagaaggcggtgaaggatccgtatcactcaaagctcataattttgatcaatactcacatcagtatcccattttagttgttaatttttttgctccttggtgctactggagtaatcgcctgaaaccttcatgggaaaaggcagctaaaataataagagagaggtatgatccagaaatggatgggcggattctcttggctaaggtcgactgcactgaagaaggtgatctgtgcaggaggaatcacatacaagggtatccatccattcgtattttccgtaaaggaagtaatcttcgggaagaccatggacgccatgaccatgaatcttattatggagatcgagatacagaaagcttagttaagacaatggaagctttggttgcacctattgcaatggaatctcaaaggcaagctttggagcataaacctgaaaatgcaacacagcatgttaaaagaccagcgccttcagcaggaggatgcagaattgaaggatatgtgcgtgtaaagaaggttccgggaaacctcatgatctcagctctttcaggagcccattccttcgattctaaacaaatgaacctgtcacatgtcatatcccatttctcatttggtatgaaggttttgcccagggtaatgagtgatgtgaagcgcttgttaccttacattggtcgaagtcatgacaagttgaatggacgatcatttattaatcaccgtgatgtaggggctaatgtcactatagagcattatctccaagtagttaaaactgaggtggttacaagaagatcttcaagtgaacgtaaattaatcgaggagtatgaatatacagcccatagcagtttgtcacagactgtttacatgccgactgctaaattccattttgagctctctcctatgcaggttctgatcactgaaaattccaagtctttttctcattttatcaccaatgtctgtgccataattggaggtgtcttcacggtggctgggatattggattcaattttgcaccacacagttagaatgatgaaaaaagtagaacttggcaagaatttttga

SEQ ID NO: 652 - DNA, 1560 bp, Zea mays; identical to SEQ ID NO: 614

SEQ ID NO: 653 - DNA, 1486 bp, Zea mays; identical to SEQ ID NO: 615

SEQ ID NO: 654 - DNA, 1681 bp, Oryza sativa Japonica Group; identical to SEQ ID NO: 613

SEQ ID NO: 655 - DNA, 1584 bp, Hordeum vulgare subsp. vulgare; identical to SEQ ID NO: 616

SEQ ID NO: 656 - DNA, 2042 bp, Zea mays
gtcgcgctagaattcagtctcgtcttgctcgctcacgcagttggcactcgtcgcggcagtcggcgctgtcccctcccctcccctcccgccggtcgctgcagtcggcgcccaacccgtccctccgtccgccagagcacatctcacgctgcgggtcgaacagcccgaacgtcaatcaggtttcaggccgacggcggcacgatgacctgccccgccgccaccgccaccgccaccacggctcgcatcggggcgcggagaggaccgtgcctgtggaggagcgagaggagggccagcttcctcgtccgttccacgtccctgctcccggaccgcccggcccgggacacgagggcgcgcgccgcctcggagctgcagcaagcgcctcgaccagcctccgctaccgtccccgctcacaaggtcaccgtccacgaccgccagcgcggggtcatccacgaattcgtcgtgcccgaggaccagtacattctgcacacggcggaggcgcaggacatcaggctgccgttcgcgtgccgccacggtttatgcatccgggggctcaagttggatactcgacagcgggtgcacaaaccatatgactggggagaaaagaatgttctcctcatatgagaaaaaccaagatccccaacgagctatcacattcggggatggaaatcaaggtttggtcaaaggacttggtaaaattgctatatctcctgaccattctatttccaatgttttcttgttgattctttagattacaacttgctttctgtttctcaattatgtcaaataggctacaactgtctttttactgatgtaggtgtcactgtctttagaagaagtaatgattcaatagcatttaagggtgtgttagagggtcagctatacttagtagattttgatagagctgaactcgacacatgcttaattgctaagactaacatgggttggctctggcaccgccgactagcccatgttgggatgaagaatcttcataagcttctaaagggagaacacattttaggattaacaaatgttcattttgagaaagacaggatttgtagcgcatgtcaggcggggaagcaagttggagctcatcatccacacaagaacatcatgacgaccgacaggccactggagctcctacacatggatctattcggcccgattgcttacataagcatcggcgggagtaagtactgtctagttattgtggatgattattctcgcttcacttgggtattctttttacaggaaaaatctcaaacccaagagaccttgaagggattcttgagacgggctcaaaatgagttcggcttaaggatcaagaaaataagaagcgacaacgggacggagttcaagaactcacaaattgaaggctttcttgaggaggagggcatcaagcatgagttctcttctccctacacccctcaacaaaatggtgtagtggagaggaagaatcgaactctattggacatggcaagaaccatgcttgatgagtacaagacaccggaccggttttgggccgcagcggtcaacaccgcctgctacgccatcaaccggttatatcttcaccgaatcctcaagaagacatcatatgaactcctaaccggttgctgcacaagctgtgcagtccgaataaaatcaggacagataaggcagcctgaagcacttgggatatctgcagaactaaaagataagggctatgctttgttgtgtgttggtttcccatctggcgatgttgaagtcgagactcaagatgaagatgaggtatattggctccaattcgggagatactttgcacgagggccagtggaaagagatgattacgcgctagaacttgcaatgggagacgaatgagctgtgcctaagagaccttgccatctaaaatttgaataccatctcaaatttggacccatgtagttctgagtatgccggttatctttttgtggctccaaatctcactctcagccttctttccttcggctgttagcgtttagagtgacaaggacacttcctgagaggaggaataaagttctgctctgctctct

SEQ ID NO: 657 - DNA, 3200 bp, Zea mays
aggtttatgcatccgggggttcaagctggattatcgacagcggatgcacaaaccatatgacgggggagaagaagatgttcacctcctacgtcaagaataaagattcccaagattcaattatattcggtgatgggaatcaaggcaaggtaaaaggtttaggtaaaattgcaatttcaaatgagcactctatttctaatgtgtttttagtagagtctcttggatataacttgctatctgttagtcaattatgcaatatggggtataactgtctattcacaaatatagatgtgtctgtctttagaaggtgtgatggttcactagcatttaagggtgtattagacggcaaactttacttagttgattttgcaaaagaggaggccggtctagatgcatgcttaattgctaagactagcatgggctggctgtggcatcgccgcttagcacatgtggggatgaagaaccttcacaagcttctaaagggagaacatgtaataggtctaactaatgttcaattcgaaaaagatagaccttgtgcagcttgtcaagcagggaaacaagtgggaggctctcatcacaccaaaaatgtgatgacgacatcaagacccttggagatgctgcatatggacctcttcggacccgtcgcctatctgagcataggaggaagtaagtatggtctagttattgtagatgatttttcccgcttcacttgggtgttctttttgcaggaaaaatccgaaacccaagggaccctcaaacgcttcctcaggagagctcaaaatgagtttgagctcaaagtgaagaagataaggagcgacaacgggtccgagttcaagaaccttcaagtggaggagttccttgaagaggaagggatcaagcacgagttctccgctccctacacaccacagcaaaatggtgtggtagagaggaagaacaggacgctcatcgacatggcgaggacgatgctaggagagttcaagacccctgagtgcttttggacggaagccgtgaacacggcttgccacgccatcaacagggtctaccttcatcgcatcctcaagaatacgtcgtatgagctactaaccggtaacaaacccaatgtatcgtactttcgtgtatttgggagtaagtgctacattctagtaaagaagggtagaaattctaagtttgctcccaaagctgtagaagggtttttattaggttatgactcaaatacaaaggcgtatagagtcttcaacaaatcatcgggtttggttgaagtctctggcgacgttgtatttgatgagactaatggctctccaagagagcaagtggttgattgtgatgatgtagatgaagaagacattccaacggccgcaatacgcaccatggcaattggagaagtgcggccacaggaacaagatgaacgagaacaaccttctccctcaactatggtgcatcccccaactcaagacgatgaacaggttcatcaacaggaggtgtgtgatcaagggggagcacaagatgatcatgtgttggaggaagaagcgcaaccggcacctccaacccaagttcgtgcgatgattcaaagagatcatcccgtcgaccaaattttgggtgacatcagcaagggagtaactactcgatctcgattagttaatttttgtgagcataactcctttgtctcttctattgagcctttcagggtagaagaggccttgctagatccggactgggtgttggccatgcaagaggagctcaacaacttcaagaggaatgaagtttggacactggtgcctcgtcccaagcagaatgttgtgggaaccaagtgggtgttccgcaacaaacaggacgagcgcggggtggtaacgagaaacaaggctcgacttgtggcaaaaggttatgcccaagtcgcaggtttggatttcgaggagacttttgctcctgtggctaggctagaatcaattcgtatcttgctagcatatgccgctcaccattctttcaggttgtaccaaatggatgtgaagagcgctttcctcaacgggcctataaaggaggaggtgtacgtagagcaaccccctggcttcgaggatgaacggtaccccgaccacgtgtgtaagctctctaaggcgctctatggacttaagcaagccccaagagcatggtatgaatgccttagagatttcttaattgctaatgcgttcaaggttgggaaagccgatccaactcttttcactaagacatgtgatggtgatttgtttgtgtgccaaatttatgtcgatgacataatatttggttctactaatcaaaagtcttgtgaagagtttagcagggtgatgacgcagaaattcgagatgtcgatgatgggcgagttgaactacttccttgggttccaagtgaagcaactcaaggacggcactttcatctcccaaacgaagtatacgcaagatctgctaaagcggtttgggatgaaggacgccaagcccgcaaagactccgatgggaaccgacggacacaccgacctcaacaaaggaggtaagtccgttgatcaaaaagcataccggtcaatgatagggtctttactttatttatgtgctagtagaccggatattatgcttagcgtatgcatgtgtgctagatttcaatccgatcctaaggagtgtcacttagtggcggtgaagcggattcttagatatttggttgctacgccttgcttcgggctctggtatccaaaggggtctacctttgacttggttggatactcagactccgactatgctggatgtaaggtcgataggaagagtacatcggggacgtgccaattcttaggaaggtccctggtgtcgtggaactctaagaaacaaacttctgttgccctatccaccgctgaggccgagtatgttgccgcaggacagtgttgcgcgcaactactttggatgaggcaaaccctcagggactttggctacaatctgagcaaagtcccactcctatgtgataatgagagtgctatccgtatggcggaaaatcctgttgagcacagccgcacaaagcacatagacatccggcatcactttttgagagaccaccagcaaaagggagatatcgaagtgtttcatgttagcaccgagaaccagctagccgatatctttaccaagcctctagatgagaagaccttttgcaggctgcgtagtgagctaaatgtcttagattcgcggaacttggat

SEQ ID NO: 658 - DNA, 896 bp, Sorghum bicolor
ctagcaatccaaagaaaccaacacagcgacaagcaaagcagcgatccgagatccgccagcggcagcgagagcgagagatggacgcgaggatgttcggtctcgagaccccgctgatggtggcgctgcagcacctgctggacgtgcccgacggcgacgccggcgcggcgggcggcgacaaggcgggcgccggcgcgggcggcggggccacgcgcacctacgtccgcgacgcgcgcgccatggcggccaccccggccgacgtcaaggagcttccgggcgcgtacgcgttcgtggtggacatgccggggctgggcacgggcgacatcaaggtgcaggtggaggacgaccgggtgctggtgatcagcggcgagcggcgccgggaggagcgcgaggacgccaagtacctgcgcatggagcggcggatgggcaagttcatgcgcaagttcgtgctcccggacaacgccgacatggacaagatctcggccgtgtgcagggacggcgtgctcacggtcaccgtcgacaagctgcccccgcctgagcccaagaagcccaagaccatcgaggtcaaggtcgcctgagctgagcggaccgtcgacagaaaccgaagtttggaagatatcggagcagtgccagtgagctgagaacctgtgcgtttctgtccctggatgtgatgaggaagaggaataatccgttgcactggtagtaagtggtagctgtagtagtgtgcttctgaagttgtgtgtgttttgcttccttcggtcgcgcggtgtctatctaccgatcctatctgatgtatcgactttggtttagtttcgtcttgaaccatgctgggtttgaagctttgtaatgcaaaaggagaatgttccgatgctttctcgataataaatctctgttcatct

SEQ ID NO: 659 - DNA, 611 bp, Triticum aestivum
cgcggccgcgagaatggagggcaggatgttcggactggagaccccgctgatgacggcgctgcagcacctgctggacgtaccggacggcgaggccggcggacccggcaatgccgccggcgagaagcagggcccgacgcgcgcctacgtccgcgacgcgcgcgccatggcggccaccccggccgacgtgaaggagctgccgggcgcgtacgcgttcgtggtggacatgccggggctggggtccggcgacatcaaggtgcaggtggaggacgagcgcgtgttggtgatcagcggcgagcggcggagggaggagaaggaggacgccaagtacctgcggatggagcgccgcatgggcaagatgatgcgcaagttcgtgctccccgagaacgccgacatggagaagatctccgccgtgtgccgcgacggcgtgctcaccgtctccttggagaagctgccgccgcccgaaaccaagaagcccaagaccatccaggtccaggtcgcctgagatgtatcgtgtgcgcgtcgaatcgaagcagagagtagcgagtttcctgtgatgagcgatggtctgtctgtcttttggtttcgttaatggaaatggggatgcggccgcg

SEQ ID NO: 660 - DNA, 782 bp, Hordeum vulgare subsp. vulgare
ggcatcatcaccaaggcattccacaaaaatcagcaaacaatccaacgcagtccaatcggaggagatccatcgatcagcaagcgaggatggagggcaggatgtttgggctggagaccccgctgatgacggcgctgcagcacctgctggacatcccggacggcgaggccggcggacctggccacgccggcggcgagaagcagggcccgacccgcgcctacgtccgcgacgcgcgcgccatggcggccacccccgccgacgtgaaggagctgccgggcgcgtacttgttcgtggtggacatgccggggctcgggtccggcgacatcaaggtgcaggtggaggacgagcgggtgctggtcatcagcggcgagcgcaggagggaggagaaggaggacgccaggtacctgcggatggagcgccgcatgggcaagctgatgcgcaagttcgtggtccccgacaacgccgacacggagaagatctccgccgtttgccgcgacggcgtgctcaccgtcaccgtcgacaagctgccgccgcccgagcccaagaagcccaagaccatccaggtccaggtcgcctgagagatggattggacgaccgaaccagagagaggtcctttgcctgcacgccggatcgaagctgagtgggtagtgatcgtctgatcgatgattagggagtgagtttcctgagatgcgtgatgtgtgtgtgttttctatctctgctcgtatggtgtccgagtgttgtgtgactagttttcgcttttagtgcaatttcaatcacatttcggg

SEQ ID NO: 661 - DNA, 982 bp, Zea mays
cggcggcgtgcagaggcgccgttgctagcttggattctgacttagaggcgttcagtcataatccggcacacggtagcttcgcgccactggcttttcaaccaagcgcgatgaccaattgtgtgaatcaacggttcctctcgtactaggttgaattactatcgcggcgcggtcatcagtagggtaaaactaacctgaaaccaacacagcaacaagcaaagcagcgatccgacatccgagagatggacgcggtgatgttcgggctggagactcccctgatggcggcgctgcagcacctgctggacgtgcccgacggcgacgccggcgcgggtggcgacaacaagacgggcagcggcggcagcgccacgcgcacctacgtccgcgacgcgcgcgccatggcggccaccccggccgacgtgaaggagctgcccggcgcgtacgcgttcgtggtggacatgccggggctgggcacgggcgacatccgggtgcaggtggaggacgagcgggtgctggtggtcagcggcgagcggcgccgggaggagcgcgaggacgacgccaagtacctgcgcatggagcggcggatgggcaagttcatgcgcaagttcgtgctgccggacaacgccgacgtcgacaaggtcgccgccgtgtgcagggacggcgtgctcacggtgaccgttgagaagctgcccccgccggagcccaagaagcccaagaccatcgaggtcaaggtcgcctgagggagcaagcagtagctgtgcttctgaaactttgtgtgtttgtgtttgcttcctttggtatcaccaatcatcctatctgatatatcgactggggttttcgctgggtttgaagctttgtgacgcaaagctgaatgccctgatgctgtctccatagaataaatatctacatgtctcttgtaaccttttctagtgaagatcgtgtcgccatgaatctatggtaccgtttgtttccttttaaaaaaaaaaaa

SEQ ID NO: 662 - DNA, 483 bp, Triticum turgidum subsp. dicoccon
atggcgggcatggtgttcggcttggagaacccgatgatgacggcgctgcagcacctgctggacatcccagacggcgaggccggcaacaccgccggcggcgagaagcagggcccgacgcgcgcttacgtccgtgacgcgcgagccatggcggcaacccccgccgacgtgaaggagctgccgggcgcgtacgcgtttgtggtggacatgccaggtctcgggtccggcgacatcaaggtgcaggtggaggacgagcgggtgctggtgatcagcggcgagcgcaggagggaggagaaggaagacgccaagtacctgcggatggagcgccgcatgggcaagctgatgcgcaagttcgtgctccccgagaacgccgacatggagaagatctccgccgtgtgccgcgacggcgtgctcaccgtgaccgtcgacaagctgcccccgcccgagcccaagaagcccaagaccatccaggtccaggtcgcctga

SEQ ID NO: 663 - DNA, 746 bp, Hordeum vulgare subsp. vulgare
aaaagcattccacaaaattcaacaagcaatccaacgcagtccaacccgaggagattgatcaagctcgagatcagccagcaagaatggcgggcatggtgttcggcttggagaccccggtgatgaccgccctgcagcacctgctggacatcccagacggcgaggctggtgccgccggcggcgagaagcagggcccgacgcgcgcctatgtccgcgacgcgcgcgccatggcggccaccccagccgacgtgaaggagctgccgggcgcgtacgcgttcgtggtggacatgccgggcctcgggtccggcgacatcaatgtgcaggtggaggacgagcgggtgctggtcatcagcggcgagcgccggagggaggagaaggaggacgccaagtacgtgcggatggagcgtcgcatgggcaagatgatgcgcaagttcgtgctccccgagaacgccgacatggagaagatctccgccgcgtgccgcaacggcgtgctcaccgtcaccgtcgagaagctgccgccgcccgagcccaagaagcccaagacaatccaggtccaggtcgcctgagacgcatcgtgtgcgcgtcgaatcgaagcagagtgtgataaagtggtggagtgcctgtctcctgatttcgtctgctagtagcatggttatctgagagagagggtgtgtactgtctgttcgtgatgttccgttaatggaagtcgagatgttctcctgctttgcctgaataagaactgtattgcc

SEQ ID NO: 664 - DNA, 480 bp, Triticum turgidum subsp. dicoccoides
atggcgggcatggtgttcggcttggagaacccaatgatgacggcgctgcagcacctgctggacatcccagatggcgaaaccggtgcccccggcggcgagaagcagggcccgacgcgcgcctacgtccgcgacgcgcgcgccatggcggccacccccgccgacgtgaaggagctgccgggcgcgtacgctttcgtggtggacatgccggggctgggttccggcgacatccaggtgcaggtggaggacgagcgggtgctggtcatcagcggcgagcgcaggagggaggagaaggaggacaccaagtacctgcggatggagcgccgcatgggcaagctgatgcgcaagttcgtgctccccgagaacgccgacatggagaagatctccgccgtgtgccgcgacggcgtgctcaccgtgaccgtcgacaagctgcccccgcccgagcccaagaagcccaagaccatccaggtccaggtcgcctga

SEQ ID NO: 665 - DNA, 483 bp, Triticum turgidum subsp. durum
atggcgggcatggtgttcggcttggagaacccgatgatgacggcgctgcagcacctgctggacatcccagacggcgaggccggcaacaccgccggcggcgagaagcagggcccgacgcgcgcttacgtccgtgacgcgcgagccatggcggcaacccccgccgacgtgaaggagctgccgggcgcgtacgcgtttgtggtggacatgccaggtctcgggtccggcgacatcaaggtgcaggtggaggacgagcgggtgctggtgatcagcggcgagcgcaggagggaggagaaggaagacgccaagtacctgcggatggagcgccgcatgggcaagctgatgcgcaagttcgtgctccccgagaacgccgacatggaggagatctccgccgtgtgccgcgacggcgtgctcaccgtgaccgtcgacaagctgcccccgcccgagcccaagaagcccaagaccatccaggtccaggtcgcctga

SEQ ID NO: 666 - DNA, 1384 bp, Zea mays
acaccaagaatcacatcacacagcgaaccgagaaaccaacacagcaacaagcaaagcagcgatccgacatccgacatccgagagatggacgcggtgatgttcgggctggagactccccttatggcggcgctgcagcacctgctggacgtgcccgacggcgacgccggcgcgggcggcgacagcgacaacaagacgggcggcggcgccacgcgcacctacgtccgcgacgcgcgcgccatggcggccaccccggccgacgtgaaggagctgcccggcgcgtacgcgttcgtggtggacatgccggggctgggcacgggcgacatccgggtgcaggtggaggacgagcgggtgctggtggtcagcggcgagcggcgccgggaggagcgcgaggacgacgccaagtacctgcgcatggagcggcggatgggcaagttcatgcgcaagttcgtgctgccggacaacgccgacgtcgacaaggtcgccgccgtgtgcagggacggcgtgctcacggtgaccgtcgagaagctgcccccgccggagcccaagaagcccaagaccatcgaggtcaaggtcgcctgagggagcaagcagtagctgtgcttctgaaactttgtgtgtttgtgtttgcttccccaagcctccgacgcccaagccgaccccgccgacgtacactccaagccccaagcctcccacacacccgacgcccaagccgaccccaccgacgtacaccccttccccaaagcctccgacacctaagccgaccccgccgacgtacacgccttcccccaagcctccgacacccaagccgaccccaccgacgtacactccaagccccaagccaccggctaccaagcctcccacgcccaagccgaccccaccgacgtacactcccacaccgaagccgccggccaccaagccgcccacctacactccgacgccgccggtgtctcacacccccagcccgccgccaccttactactagaaaccgatgcctaccataccacactgctgtcagtctctggagcatttaggtggtctcgatcgatggaagaattgtgtcctagccagccggcaaaggtgacctgctgatgatgatgatgagaggcgagtcctacgccctagtcctactactaccctctttgtgtgctgccatccatccgtccccgctagacgatcgaggagagaataacgcagagctctgtgctcccggcctctgtcttctgccgtcccggccgtttaatttatagtctctactgtgtgttcgtcccatgtgtttagcagcagcagcaggtgtattgtgcgggtatgtaatggtattgcaactatattgggtgtaaaaccataataaatgtggaaaaaatgcaaggcaaaaaaaaaaaaaaaa

SEQ ID NO: 667 - DNA, 797 bp, Hordeum vulgare subsp. vulgare
ggaaaactccacaaatattcaacaagcaatccaaacttccaaactccaaaacagcccaaccggaggagatcgatcgagctcgagatcagccagcgagaaatggcgggcatggtgttcggcttggaggccccgatgatgacagccctgcagcacctgctggacaccccggacggtgagtccggtgccgccgccggcgagaagcagggcccgacgcgcgcctacgtccgcgacgcgcgcgccatggcggccacccctgccgacgtgaaggagctgccaggcgcgtacgcgttcgtggtggacatgccggggctcgggtccggcgacatcaaggtgcaggtggaggacgagcgggtgctggtcatcagcggcgagcgccggagggaggagaaggaggacgccaggtacgtgcggatggagcgccgcatgggcaagatgatgcgcaagttcgtgctccccgagaacgccgacatggagaagatctccgccgcgtgccgcgatggcgtgctcaccgtcaccgtcgagaagctgccgccgcccgagcctaagaagcccaagaccatccaggtccaggtcgcctgaaaatgagatgcatggtgtgcgcgtcgaatcgaagcagagtatgagtcggtagcgtgtttgctgtgatgagtggtggagtgtcagtcttttcgtttcgtctgctagacgagggtgtgccgtgtcggttcgtgcgcaggtggtgatggtttgatgtttcgttaatggtaatggggatgttctccggataattctgaataaaacatgcgaatcccttggcc

SEQ ID NO: 668 - DNA, 1429 bp, Sorghum bicolor
cacttctcctcgcctcaaaaaacacaaaacccccgaccgccgccggcggccatgctcctccaccaccgcctcctccctcgcctactcgttccttccacccacacatccacactcctccgcccctcccgtttgccgctccgtctctctctctcgccgcgcttctccgcgctgtcccacctcgcggcaccgcagaccgtcgaccagtccgacgacgaaggggcgccccaggggaaggtgcaggtccagctcccgctcgaccgcctcttcgtgccgcccggggcaaccgtggatgcgggggaccaggacgccgtgagcgcacgggtccttaagggctccaacatcgtgctgggcccatacgcgcgcggtgacgcacaggtggtcaacgcagattttgtgaagagcagcgtgcgtcccgatgactgccctcgggacggcctaccggagttcgcactcgttggccggtcgaacgtcggcaaatcgtcgctgctcaactcgcttgtccgccgcaagcgccttgcactcacctccaagaagcctgggaagacccaatgtatcaatcatttcaaagtaaatgacagctggtatcttgtcgacttgcctggttatggatatgcttctgcaccacaggaagctcgtaccaattgggatgaatttactagaaattactttctcagtagggagaatttggtatctgtttttctccttatagatgcaagtatacctgccaagaagattgatcttgactatgctagttggcttggtcaaaacaaggttcccatgacccttgtgttcacaaaatgtgacaaacgcaagaagaagaagaatggcggcaggagacccgaagaaaacgtggaaactttccagagcctaatccgtgaatacttcgaggctgcgcctccttggatcatgacaagcagcgtgaccaaccagggccgcgatgagatactcctgcacatgtctcagcttaggaattattggctcaagcattgagatgcaatgataactaaactggatcgaagcaaccgaaacaacatacagagcactgtctctcattgatgcatgagtagtcggcacctccgcaatcaggcctttgcaccaactaatccgccttttgagctgtttgctgtccaatatgacccctatacatgattatccaatcaacactctgggaatacagacaaggtgctaaaatcagctgatcctggttttttctattgtgtacacgtacaatcccaatgttttccccttgttcccttctgattataggtttgtgcatgctctggggttaaatgattaataaaccctggtgtcagctaatcatcagcgggaatctgacttttttttgtttgttacttatgtgctcccttggaccctgcagcatacaaatggcaggaggtgcatgaacttgacctgttaagaaatggctttg

SEQ ID NO: 669 - DNA, 1339 bp, Zea mays
ccaaaaactcagaaaaccctgaccgccggcggcggccatgcttctccaccaccgcctcctccctcgcctacttcttgttccttccacacatacctccacactcctctgcccctcccgtttgccgcgccgcctctccctctcgccacgcttctacgcgctgccccacctcgcggcaccccagaccgtcgaccactccgacgatgagggggcaccccagggggaggggcagatcaagctcccgctcgaccatctcttcgtgccgcccggggcaacaatggatgcgggggaccaggaggccgtgagcgcacgggtgcttaagggctccaacatcgtgctgggcccatacgcgcgcggcgacgcacaggtggtcaacgcagattttgtaaagagcagcgtgcgtcccgatgactgccctcgggacggccttccggagtttgcactcgttggccggtccaacgtcggcaaatcgtcgctgctcaactcgcttgtccgccgcaagcgccttgcccttacctccaagaagcctgggaagacccaatgtatcaatcatttcaaagtaaatgacagctggtatcttgttgacttgcctggttatggatatgcttctgcaccacaggaagctcgtaccaattgggatgaatttactagaaattactttctcagtcgggagaatttggtatctgtttttcttcttatagatgcaagtatacctgccaagaagattgatcttgactatgctagttggcttggccaaaacaaggttcccatgacccttgtgttcacaaaatgtgacaagcgcaagaagaagaagaacggcggcaggaaacctgaagaaaacgtggaaactttccagggcctaatccgcgaatacttcgaggccgcgcctccttggatcatgacgagcagcgtgaccaaccagggccgcgacgagatactcctgcacatgtctcagcttaggaattattggctcaagcattgagatgcaatgataaccaaaccagggcgaagcaactagaacagcatgcaaagcactgtcgtccattgatgcatggacattcagcagtcggcgcctccgcaatcaggcgttcgcaccaactaatccagccttttgagctgttgactgtccaatatggccccctgtacatgattacccaatcaacactctggggatgcggacaaggtgctaaaatcagctgatcatggtttttttctttatttctattgtgtacacgtacaatcccaaccaacgttttccccttgttcccatctgattataggcttgtgtatactgtggggttaaatgattaataaattctggtgttagctaatcaccagcggg

SEQ ID NO: 670 - DNA, 1449 bp, Zea mays
ccaaaaactcagaaaaccctgaccgccggcggcggccatgcttctccaccaccgcctcctccctcgcctacttcttgttccttccacacatacctccacactcctctgcccctcccgtttgccgcgccgcctctccctctcgccacgcttctacgcgctgccccacctcgcggcaccccagaccgtcgaccactccgacgatgagggggcaccccagggggaggggcagatcaagctcccgctcgaccatctcttcgtgccgcccggggcaacaatggatgcgggggaccaggaggccgtgagcgcacgggtgcttaagggctccaacatcgtgctgggcccatacgcgcgcggcgacgcacaggtggtcaacgcagattttgtaaagagcagcgtgcgtcccgatgactgccctcgggacggccttccggagtttgcactcgttggccggtccaacgtcggcaaatcgtcgctgctcaactcgcttgtccgccgcaagcgccttgcccttacctccaagaagcctgggaagacccaatgtatcaatcatttcaaagtaaatgacagctggtatcttgttgacttgcctggttatggtcctgcccgtccatttcttggagaaatagagggggagagcagagcgttgctactgcaaatattactggaatggatctggcaacaaagtccaacacatggtctgtccaagaaactagtaagaatatatgcttctgcaccacaggaagctcgtaccaattgggatgaatttactagaaattactttctcagtcgggagaatttggtatctgtttttcttcttatagatgcaagtatacctgccaagaagattgatcttgactatgctagttggcttggccaaaacaaggttcccatgacccttgtgttcacaaaatgtgacaagcgcaagaagaagaagaacggcggcaggaaacctgaagaaaacgtggaaactttccagggcctaatccgcgaatacttcgaggccgcgcctccttggatcatgacgagcagcgtgaccaaccagggccgcgacgagatactcctgcacatgtctcagcttaggaattattggctcaagcattgagatgcaatgataaccaaaccagggcgaagcaactagaacagcatgcaaagcactgtcgtccattgatgcatggacattcagcagtcggcgcctccgcaatcaggcgttcgcaccaactaatccagccttttgagctgttgactgtccaatatggccccctgtacatgattacccaatcaacactctggggatgcggacaaggtgctaaaatcagctgatcatggtttttttctttatttctattgtgtacacgtacaatcccaaccaacgttttccccttgttcccatctgattataggcttgtgtatactgtggggttaaatgattaataaattctggtgttagct

SEQ ID NO: 671 - DNA, 1612 bp, Oryza sativa Japonica Group
gtactccccattccgtccgtgcctccccctaaccccaacccgcctccagcttcgcgccgcctccaaacccccacagtccgccgccggcggccatgctcctccaccaccgcctcctacctcgcctcctcctttccccctcgaccccggtcaccaccaccctgctcgtccaccgcacctccctcttcccgacccgccgcatcctctcgccctgctgctccgcgctctcccaagtggcggcggcgccggaaaccgtcgaccactccgacggcgacgagccccagggggatgtgcaggttcagctacctctcgaccggctcttcgtgccgcccggggcgagcgtgtccgcgggggacgccgaggcggtgaccgcgcgggtcctcaagggctccaacatcgtgctgggcccgtacgcgcgcggcgacgcgaacgtgatcgccgcggacttcgtgaagagcagcgtccgccccgatgactgccccagggacgggctaccggagttcgcccttgttggccggtccaacgtcggcaagtcgtcgctgctcaactcgctcgtccggcgcaagcgcctcgcgctcacttccaagaagcctgggaagacacaatgtatcaaccatttcaaagtaaacgacagttggtaccttgttgatttgcctggttatgggtatgctgctgcaccacaagaagctcgcacgaattgggatgaatttactagaaattacttcctcggcagggagaatttggtatcagtttttctcctagtagatgcaagtattccagctaagaagattgatcttgactatgctagctggcttggtcaaaacaaggtccccatgacgctagtgttcacaaaatgtgacaaacgcaagaagaagaaaaacggtggcaaaagaccggaagaaaatgtagaaaacttccagagcttgatccgtgaatattttgaggcagcacccccttggatcatgacgagcagtgtcaccaatcaaggccgagacgagatacttctgcacatgtctcagctcaggaactattggctcaagcattaagatgaaataaaaatactaatactagaactcaagcagcagcaacgcatgcaaaccctgttgctcattgatgcctcggcaattcagcacctttgcaatcaggccttcaccaactgacttgccttttgagctgttgattgtaaactattgcctctgtacatgattactcaatcaacagattggagaattggggaatacaaacaagctgctacatcaactaccctaggttcaagacctttcaaggaacggtttctgtgatgggcagaatgcatggaacaggccacattattgggatccatcatacaatggtttcttttatcacatgcttaatcaagtgcgtgctggcacaagtccgcctggagaatggagatagaaaaatgctcaggtaattgcaggctagtttgatagtactagtaaactgttcttattagtaggatcccatgctgatgtgtgtttcgtttgttaggcctctctcctttcttaggtttgcccttcccatctgtcctcagttctgtcttactgctaacaaaatacttaacacctgtatgtttgtctttataaggtcagatctt

SEQ ID NO: 672 - DNA, 1269 bp, Sorghum bicolor
atggggcctaccgtcggcgctggcgaggacaaggccatatcagagctccgggaacaacatcgtgtggacctagagaggctaacaattacatcacgaccattcaagacattggcattctttgtgttagccattgctcagagtttggaaagaacatgttcatctgttctgaaaaaaggttatcggttaaaaatcgcaatgcctttggttgctgttacttgggttctgctcttgttcactgatggcctgcatgaaaagcatctacaggagctactttggtatgtcaggtttggattgtggtggatcatactaggggtcgcttcatcgattggattaggttctggtttgcacactttcataatgtatttaggcccccatgttgccctgtttactatcaaagcagttcagtgtggtagggttgatttaaaaagtgctccttatgacactattctccttaaaaggagtccatcctggttggagaaagactgtctgcagtttggacccccaatttatcatgaaacaattccattcagcaaaatactgcaagaagtttgtctcgaagctgttctttggggcattggaactgcacttggagagcttcctccatattttctctcaagagcagctagcatgtcaggccgcttaattgatgagttagaagatttggatgcttccattccagaaggttttctatcatcaactttacgtcaggccaaacgatggctcatgtctcattcacaacatttaagcttcaccctaatattgctacttgcttcggttccaaaccctctatttgatcttgccggtatgttgtgtggacaattcaacatccctttctggaagttttttctagcaactttgattggaaaggctattgttaaagtttgtatccagactacgttggttattactctctgcaacaaccaacttcttgatttggtggagaaaaggcttatatgggcatttagcaatgttcctggagtggcatctgtccttccatctttagtttccaagctgaagatggccaaaaataagtttttatcagcccatgttgctgcatcagcttctagttctgttaagggaaagaagtggactctgtcattctcattggtctggaataccctggtgtggctcatggttgtaaacttcattatccagatagttacttctacagcacagggttatctcaggacacaacaggagcaagagatcagtaaaaagttggagaccgaactttctacctctgaaccttcttctggcttaccaaaatga

SEQ ID NO: 673 - DNA, 1950 bp, Zea mays
cttgcgccttgcgttcgcggaaaaggctcatcttttcaggtggaaggagcgattcgtctgtgcctgcgcctcgccgggctcgtgccgctgtaccctccttctccaggagacctgtacggtgaaggggcgttcccgcgccaaacgggaagcaaagctcgctcgcgccctttttttcggatcatataacgccggcgcctagctcaaacaccacagctcgctgcctagatctacgcggcagcggcggcggcagaggagagggacccggagctgcgccatgggtcctaccgccggctccggcgaggacaaggctatgttagagctccggaaaaaacatcgtgtggacctagagagactaacaattacatcgcgaccattcaagacattgtcattctttgtgttagccattgctcagaatttggaaagaacatgttcatctgttctgaaaaaaggttaccagttaaaaaccgcaatgcttttggttgttgctacttggcttctgctcatgttcactgatggcctgaatgaaaagcatctgcaggagctattttggtatgtcaggtttggattgtggtggattatactaggggttgcttcatccattggattaggttctggtttgcacactttcataatgtatttggctccccatgttgccctgttcactatcaaagcggttcagtgtggtagggttgatttgaaaagtgctccttatgacactattctccttgaaaggagaccatcctggttagagaaagactgtctgcaatttggacccccaatttatcatgaaacaattccattcagcaaaatactgcaagaagtttatcttgaagctattctttggggcattggaactgcacttggagagcttcctccatattttctctcaagaacagctagcatgtcaggccgcataattgatgaattagaagatttggatgcttccatttcagaaggctttctatcatcagctttacgtcaggccaaacgatggctcatgtctcattcacagtatttaagcttcactctaatattgctacttgcttcggtgccaaaccctctatttgatcttgccggtatcttgtgtggacaatttaacatccctttctggaagttttttctagcaactttgattggaaaggctattgttaaagtttgtatccagactacattggtgattactctctgcaataaccaacttcttgatttggtggagaaaaggcttatatgggcatttagcaatgttcctggagtggcatctgtccttccatcttttgtttccaaactgaagatggacaaaaataagtttttatcagcccatgttgctgcatcagcttctacttctgttaagggaaagaagtggaatctgtcattctctttggtctggaataccctggtgtggctcatggttgcaaacttcattatccagatagttacttctacagcacagggttatctcaggacacaacaggagcgagagatcagtaaaaagttggaaaccgagctttctgcctcttaacgttcttctgcgcaccaaaatgattcgccctgggtaccgatctggtttcttcaatcttttacatacttatatcgagtttagagaggaatattaacatgaataatgtggtaactgactgggaaattcaaaccgtgttcaccaactatttgccgctactgttcttcaggaaagtccaatacattgtacataaccatgcatcaaccatcagctcaagactaaaggctctcctgcagtattgtggtgcactgactattggtctatttctttcgaaagagagagagaggaaagctattagctagtgctagaaatataatggtgccccacttacaattgtaagtttgtggccttgtacatagcaacaaatattattaggggacaaaaatatctaatgatacaagttaatacctgattttgtctccgcattggcaatg

SEQ ID NO: 674 - DNA, 1985 bp, Hordeum vulgare subsp. vulgare
gagctttccgggggggaaagaaaggagcgattccgtctgcaccctccgactcgccgagctcgtgaccccgcctccccgccggaccctgagaagcggccaggcgtttccgcgccaaccgccaaacgagctgcggagctcgcaccttctctttccacccttggtttaagtagccgtggcggcctgctccgaccggtgcgtgctgctcagatctaccgcggcagagggggaagcccgaggttcatgatggagcacaccgccttcggcgaggatcaggccatatccgaccttcgcgataagcatcgcttggacctggagagtttaacgctgacatcacggccattcaaaacacttgcattatttgtgctagccattggacagagtataagaagcacatgttcctgtgttctgaaagaaggttctcggttgaaattcatagttctgttgcttggtgccacctgtgtgcttctcttggtaactaatggcccgcatgagaagcatatgcaggaattgcttcggtatgccagatttggattatggtgggtcatactaggggtggcttcatcgattggattaggctctggcttgcacacgtttgtattgtatttagggcctcatatcgctcttttcacaatgaaagcggttcagtgtggccgggttgatttaaagagtgctccttatgacaccattcttcttaaaaggaggccttcgtggttggagaaagattgtctggattttggacctccaatatatcaggaaacaatcccatttagcaaaatactgcatgaagttcatcttgaagctgttctttggggcattggaactgcacttggcgagcttcctccatattttatttccagagcagctagcatgtcaggccaaaaagtagaagagttggcagaattggatgcttctatctcaaaagaaggttttctatcatcaactctacatcgggccaagcgctggcttatgtctcactcacagtatcttaacttcccgacaatactgctacttgcttcggtgccaaaccctctgtttgatcttgctggcattttgtgtggacaatttaacgtccccttctggaagttctttctggccactttaattgggaaggccattatcaaggtttatatgcagacaacattggtaattactctctgcaacaaccaacttcttgaattggtggaggaaaggcttgtatgggtgcttagcaattttcctggagtatcatctatgcttccctctttagtcaccaagttgaagacagccaaggataagtttttaatggccagtgttgctgcatcagcttctagtgctgcgaaggggaataagtggaatctgtcgttctctttgatctggaatacggtggtgtggctcatgatcgtgaatttcctcgttcagataatcacttccacagcacagaattatctcaagaaacaacaagagcttgagatcagcatgaagtcatcggctacaataagttccgcatctgaacctgctgccagaatatcaaattaatcgagccagggcatttcatccagccagatcgtagaggaacacattcaatttatattcatgccatcacttcctgcatgagactgatttgggagttcgaaatctgatcatttaccggatagctggcatcttctccaagaaatcacattgatagtgtatatataacctaccccatcaagccaccatttatacagttattgatctacttagtagaaatccacaaaaaggagaggagaaagaaaaaaaggcttgactagtgcgcaagtgtaatgttggccttgtacatagcaaccaagatattgccatcaattgtacaataagcattaagtttgtgcctaccatcttgattgttgtcgtttttgtctccgcattggcaatgatccgtcaagatccgccatttgctcctgatggctacgcgttgagaaaattcatgctcctgtctagtgtcaatgtagatgccagatggcattcag

SEQ ID NO: 675 - DNA, 3947 bp, Zea mays
cttcgttcaacgatcaagctggagctgcttcggacccgaagctggtgctcccaatcacaggtggttcatcctcagagccagctaacaagaaacaaaagaaggaagcacagagaagggtacaacatgttggggtgcaaggacccttcatcaagtcaagatggtctcacattcctattaccttctcccaagaggaccttcagctcaaggattacccacacaacgatgccatggttatctcttgtgttatcaaaggatttctggtccacaatgtcttggttgacacaggcagtgcagctgacatcatatttgctaaggccttcagacaaatgcaagagctagaagataagattcatgatgctacccatcctctctgtggcttcggaggaagacaaattgtagcactgggcaagattaccatgtcagtgacctttgggttcatcaacaacactagaactgagcaagttgtgtttgacattgttgacatggaatacccttacaatgcaattattggtcgtggcaccctcaatgcttttgaggcaattcttcaccctgcctatctttgcatgaagatgccttcggatcaaggacccatcgctattcatggaagccaggaagctgccagaagggccgaaggaaactggactgattcaaaagcaatccataacatagatggagctgaagcttgtgaatagtacaaattcagaagggagaaagcagcttcagcagatcagccgaagcccatgctcttatgtgaggatatagcagagcagaaggtgctgttgggctctcagttatccgaagaacaagagaaaaccttgataaggtttttgttcaacaacaaagatgtttttgcatggtcagccaatgatctctgtggagttaatagggatgttattgagcattcgctcaatgtcgatccatccttcagacccagaaagcaaaggcttcggaaaatgtcagatgataaggccgaaggtgctcgcaacgaagtcaaaagactcctcagtgcaggagttatcagagaagtaaagtacccagaatggttagctaatactgttatggtaaaaaaggccaatggcaagtggcgaatgtgtatcgattttacagaccttaacaaggcttgtccaaaggatgaattcccattgccaaggatagactctttagttgatgcaacagcttcttcagagctcatgagtctgttagactgttattcaggctatcatcaaatctggatgaagagggaagatgagccaaagactagcttcataactccaagtggcacatattgttatcttcggatgcctgaggggctcaaaaacgctggaggaagtttcagcagaatgactgcgaaggttctccagtctcagataggcagaaatgtgctaacttatgttgatgacatcattgtgaaaagcacgaagcaggagaatcatattgctgacttgcaggagaccttcgccagtttcagacaagctggcttaaagttgaatccagaaaaatgcgtcttcggagtaaagaaggggaaatttctaggatgcttggtttcaacaaagggaattgaagctaatccaagtaagattgaagctatacttcggatggagccaccaactacaaaaaagggggctcaaagattgacaggaaggttggcatctcttaatagattcatatccagatcagcagagagaaacttaccattcttcgaagtgctgaagtcagccgaagtctttcaatggggaccaatccagcagaaggccttcgaagagctgaagcagtatttaatagatctaacagcactaactccacctatgccaggggctcctttattattatatgtggcagcttcgcactcagcggtaagtgcagcacttgtccaggagaagcttgatggccaaaccaggaaacaggtcccagtatattttgtatctgaagttcttagtatatcaaagaaaaactacacagaattagaaaaggtgttatatgttgttttgatggcatccaggaagcttcggcactattttcaagcttacaacataattgttccttcttcacaacctctgaaggatattatgaggaaccgagaagctactggaaggattggaaaatgggctgcagagctcaatgaattttgtattgaatatgttcatagatcttcgattcagtctcaggcgttagcagacttcattgctgactggacgccaggggctcaggaggaagaagcaaataaagacaccgaagcatggacagtgttttgcgatgggtcctggggaaccttcggagcgggagcggctgctgtgttggtttcaccttccaaagttaaaacttgttatgtggcaaagcttgattttagttgcacaaacaacattgccgagtacgaagccctgcttctgggtcttcggaagctaaaagcaatgggaatcagaagggctgttcttaaaactgattcccaagttgtttcgggtcatatcgacaagagttgcaaggctaaagatccgaagcttgaaaagtatctggacatggttcggagagttgaagcttcctttgagggattttctgtcaaaaatatccctcggggacaaaatgagcatgctgatttgctagctaagtcagcagcacaggggctgcccttaccttcggatgtcttcttcgaaacaataaaagcaccttcggtggaacttcttgaaagagcagtcctcaatatatctcctgtttatagcgaagattggaggactgagataatctcttatcttcagggtaaattcctttcagatgacgaagcctataacaggaggatagaggcaagagctcgtccatatgtcatgatagaaggagagttgtacaagcatggagtttgtgctccgctactcaagtgtttatccagaaccgaaggtatagagttgatgaaagaaatacatgcaggcctgtgtggatctcacattggatctaggccgttacttggaaaaattttccgccaaggattttattggccgaaggcagcttcggatgcagcggaattagtccaaaagtgcgaaggttgtcagaaatgtgcacgagatcaaaaacaaccttcgtctttaacacagctcatacaacccatttggccattgcaaaggtggggccttgacttgttaggtccattaccaccggcccaagggaacctaagatatgttgtagtggcggtggaatatttttctaaatggattgaggcaaagcctttagctacaataacttcggccaccgtccaaaagtttttctggcagaatattgtttgtcgtttcggggtaccaaaggctatcactgtggataatggaacacagtttgactccgaagcttttagggatttctgtgatcaaattggtacgaagatccattttgcatcagtcagacatccggagtcaaatggactcgttgaaagagccaatggtattataatgacaggaataatgaagtcaatcttcaatcaaccaaggggaaagtggccagatcagttaaccaaagtggtgtggagccataatacaacaacatcaaggtctacaggctttaccccattcaagttattattcggtgacgaagcaataactccagaagaagctaaaaccggatcaataagggtagtagcttcggcagcatcaggttctgaagctgattattctgtggaaaaagatgctttagaagggatcaggttgcaagccgtggaaaacatcaacaaatatcaagccgaaacaattaaatggcgagatagaaaggttcggctaaagaatattgagccggacacttggtgcttcaggagagtggccaacccagaaacagtgggcaagttacagttgaaatgggatggacctttcttagtagcatcttcgtcaagacccggttcatacagattgaaggatatggacggcaacgacattcctagatcttggaatgcggatgagcttcggcgatattatgta

SEQ ID NO: 676 - DNA, 1436 bp, Zea mays
gaattcccgttgccaaggatagactctctagtcgatgcagcagcttcttcagagctcatgagtctcttggactgttactcaggatatcatcaaatctggatgaaaaaggaagatgagccgaaaactagcttcataactccaagtggcacgtattgctatcttcggatgcctgaagggctcaaaaacgctggaggaagtttcagcagaatgactgcgaaggttcttcagtctcaaataggcagaaatgtgttgacctatgttgatgacattatcgtcaaaagcacgaagcaggaaaatcatattgctgatctgcaggagaccttcgccagcttcagacaagctggtttgaagctgaatccagagaaatgtgtcttcggagtaaagaagggtaaatttcttggatgcttggtttcaacaaagggaatcgaagctaatccaaataaaatcgaagctatacttcgaatggagccaccaactacaagaaaaggggcccaaagattgacaggaaggctggcatctctcaacagatttatatccagatcacgagaaagaaacttaccatttttcgaggtgctgaagtcagccaaagtctttcaatggggcccaagtcaacaaaaagccttcgaagagttgaagcaatacttgatagatctcacaacattaactccaccaatgccaggggctcctctgttgttatatgtggcagcttcgcactcagcagtaagtgcggcacttgtccaggagaagcttgatggccagctcaagaagcttgtcccagtgtattttgtatctgaggtccttagtgtctcaaagaaaaattatacagagctggagaaggtattatatgccgttttaatggcatccaggaagcttcggcattattttcaggcatacaatatcattgttccttcttcgcagccgttgaaggatataatgagaaatagagaagctactggacggattgggaaatgggctgcagagctcaacgaattttacattgattatgtgcatagatcttcgatccagtctcaagcattggcagatttcattgccgtctggacgccaggggctcaggatgaagaagcaaataaagatgccgaggtgtggacagtattttgtgatggatcttggggaatcttcggagcaggtgcagctgctgtgttggtttcaccatccaaggtaaaaacttgttatgcagcaagacttgatttcagctgcacaaacaatattgctgagtacgaagccctgcttctgggccttcggaaattaaaggcaatgggaatcagaagggcaattcttaaaactgattcccaggtggtttcgggtcatgttgacaaaagttgcaaggctaaagatccgaagcttgaaaaatacctagatacggtccgaaggatcgaagcatccttcgaaggattctctgtcaagaatatccctcg

SEQ ID NO: 677 - DNA, 1323 bp, Sorghum bicolor
ggcacaagccagaagccacaccaatcgcttcgtccccgcgtctcgcccggccgcgtaggcgccacagaaactcccacgccacccacgccgtccgtcgccgtcgccgtcgagtccaatccatggctccacccgcggccccgaccgcgctgcaccaccgcacgcccctcctcctcccccgccgcgccaccgccgccccgggtgccaccgccaccgccaccgcgcgcgccgccagagccgcttctctagccgtcgtcagggcccagccggacaccaccgccgcgacctccgcccccgagccgccgacgccggagttcaagccgccgccggggttcaaggtgcccgagcccaagaggttcgaggtcaagcccggccagcagaacagcgtcctcggcgcctcgctcgccatcccgctccgcctcggcaccggcgtcttcgtcctcgggtactcgccatcacttgtttctccgtcagagataccatcagatcaatatgcactggaattcggagcttggaaggtgaaggaggaatcaaaaataggacagtgcaaacgaccggaaaagcctatcgagatatatgaatttgaaggttgtccattttgtcgaaaggtcagagagatggtatcagttttggacctagacgtattgttttacccctgtcctcaaaaaggcccaacattccgacctaaagtcctcgagatgggtggaaagaaacagtttccttacatggtggatccaaacacaggggtcgccatgtatgaatcagatgacatcataaaatacctagctgacacatacggcgatggaactgttccaattatgctatcacttggtctgttaacaacaatcacagcagggcttgctactcttggtcgttttggaaagggaaattcctatactgcttcaaaagttccaccacagccaatagagatatgggcatatgagggatctcccttctgtagattagtacgagagacgcttgttgagttggaattgccacatctgctgcacagctgcgcacgtggcagccccaaacgacaagaattcttgaagaaaaagggagttttccaggcgccttacattgaagatccgaacaccggagtccagatgttcgaaagcgctgaaatcatagactacctgaaggcaacatatgccctgtacccaagctcatagtggcatatctcaaatatgaaatgcccatttgtaatgttgtgtagagcgtgtaaattcaattctttccagtaaaggaaaagaaatagcaaaccatatattctgtatgatgcacagccgattttatctacgctggtctgaacttcgaagttactgc

SEQ ID NO: 678 - DNA, 1269 bp, Zea mays
cgccgcgtagcggcgtaggcgccacagaaactcgcacgccgctccccgccgtccggcccgagtcgccgtcgctgccgaatccaatccatggctccgcccgccgcacccaccgcgctgcaccaccgcacgcccctcctccttccccgccgcaccgtcgccttgggtgccaccgccaccgcgcgcgccgccagggccgcttctctcgccgtcagggcccagccggacaccaccgccgcagccgtctccacctccgcgcctgagccggcgcccgagttcaagcctccgccggggttcaaggcgcccgagcccaagaggtacgaggtcaagtccggccaggtgggcagcgtcctcggcgcctcgctcgccatcccccttcgcctcggcaccggcgtcttcgtcctcgggtactcgccatctcttgtttctccatcagagataccatcagaccagtatgcactggaatttggagcttggaaggtgaaagaggaatcaaaaataggacagtgcaaacgaccagaaaagcctatcgagatatatgaatttgaaggttgtccattttgtcggaaggtcagagagatggtaacagtcttggacctagatgtattattttacccctgtcctcaaaaaggcccaacattccgacctaaagtcctcgaaatgggtggaaagaaacaattcccttacatggtagatccaaacacaggggtcgccatgtatgaatccgatgacatcataaaatatctagctgatacatatggcgatggaactgttccaattatgctatcacttggtctgttgacagcaattacagcagggcttgctactcttggtcgtattggaaagggaaattcctacattgcttcaaaagtcccaccgcagcccatagagatatgggcatgtgagggatctcccttctgtaaattagtacgagagacacttgtcgagttggaattgccacatctgctacacagctgcgcacgaggcagccccaaacgacaagaatttttcaagaaaaaggggcttttccaggcgccgtacatcgaagatcctaacacgggagtccagatgtttgaaagcgctgaaatcatagactacctgaaggcaacatatgccctgtacccaagctcgtagtgatgtatcagaaatggtcattgtaatgttgcgtgtagattcagttcttcccggtaataaaaggaaaagaaatagtgggccacgcattctgtatgatgcacagccgattttgtctatgcagatctaaactttgaagtt

SEQ ID NO: 679 - DNA, 1278 bp, Zea mays
ctccacttgcactagcagcaggtacaccaatcgcttcgtccccgcgtctcgccgcgtaggcgccacagaaactcgcacgccgctccccgccgtccggcccgagtcgccgtcgccgccgaatccaatccatggctccgcccgccgcactgcaccaccgcacgcccctcctcctcccccgccgcaccgtcgccttgggtgccaccgccaccgcgcgcgccgccagggccgcttctctcgccgtcagggcccagccggacaccaccgccgcagccgtctccaccaccgcgcctgagccgacgcccgagttcaagcctccgccggggttcaaggcgcccgagcccaagaggttcgaggtcaagtccggccagctgggcagcgtcctcggcgcctcgctcgccatccccctccgcctcggcaccggcgtcttcgtcctcgggtactcgccatctcttgtttctgcatcagagataccatcagaccagtatgcactggaattcggagcttggaaggtgaaagaggaatcaaaaataggacagtgcaaacgaccagaaaagcctatcgagatatatgaatttgaaggttgtccattttgtcggaaggtcagagagatggtaacagtcttggacctagatgtattattttacccctgtcctaaaaaaggcccaacattccgacctaaagtcctcgaaatgggtggaaagaaacaattcccttacatggtggatccaaacacaggggtcgccatgtatgaatccgatgacatcataaaatatctagctgatacatatggcgatggaactgttccaattatgctatcacttggtctgttgacagcaattacagcagggcttgctactcttggtcgtattggaaagggaaattcctacattgcttcaaaagtcccaccgcagcccatagagatatgggcatatgagggatctcccttctgtaaattagtacgagagacgcttgtcgagttggaattaccacatctgctacacagctgcgcacgtggcagccccaaacgacaagaatttttcaagaaaaaggggcttttccaggcgccgtacatcgaagatcctaacacgggagtccagatgtttgaaagcgctgaaatcatagactacctgaaggcaacatatgccctgtacccaagctcgtagtgatgtatcagaaatggtgattgtaatgttgcgtgtagattcagttatttccggtaataaaaggaaaagaaatagtgggccacgcattctgtatgatgcacagccgattttgtct

SEQ ID NO: 680 - DNA, 1430 bp, Zea mays
ctagagcgtaagcgtagaagcaggcagccaggcaacgatggagatgcgggttgttcttctgctttgccaggtgatatgtatgcaggcggcggtcatcggcgccgtcgccgccgccgccggcgctcggccaccggcgatgtacgtgttcgggtcgtcgatactggacgtgggcaacaacaactacctgcgggggccggccgtcggcagggccaacagtccctacaacggcgtcgacttcccgggctccatccccaccggaaggttcagcaacggctacaacatcgccgactacgtcgcaaagagcatgggattcgcgtgcagccctcctccctacctgtcgctagcacaggcaccggcaccggcaccggcacagagctccggccctgacctggcccagacggctctcaccattggcatcaactatgcttctggaggagcaggcatccttgactccactaacgccgggaacacgatcccgttgtcggaggaggtgaagtacttcggcgccaccaaggccaagatggtcgccgcagcgggccccagcgcggtgaacccactgatctccaggtccatcttcctcatcggcatgggcaacaacgacctgtacgtcttcggggcttcggagcgggcgcggaacaggtcagacgcagagcagcggagggacgccgccgccgcgctctacgccagcctcgtctccaactactccgccgccgtgacggagctgtactcgttgtcgttgggcgccaggaagttcgccgtcatcaacgtgtggccgctaggatgcgtgccgggggagcgcgtgctcagcccgacgggcgcgtgctccggcgtcctcaacgacgtcgccggcggcttcaacgacgccctgcgctccctgctcatcggcctcgccgagaggctgccgggcctcgtctacgccctcgccgactccttcggcttcacgctggacgtcctggcggacccgcgcgcgtcagggtacaccgacgtcgcaagcacgtgctgcggcggcgggcggcggctgggcgcggaggcctggtgcacgcgcagctccacgctctgcgtcgaccgtgaccgccatgtcttctgggaccgtgtccatccgtcccagcggactgcgtttctcttggcgcaagcgttctacgacggaccgcccaagtacaccactcctatcaacttcatgcagctcgcccactcaagctagtgatgatatggttcatgcatatctgatactacttaacaatacatcggtcactttgtagagaaagggcgcgccgcctgctactagcagagaaaggcaattattagccgttaatataagggcctatgtgttcacgaccgacataatcttgggtgtcatccagcatagccactttccaccgaatcggccagaccggatttgcaaatgttatcaaatcttataatttgagttc

SEQ ID NO: 681 - DNA, 1315 bp, Sorghum bicolor
atgaggataggggttcttctgctgccgtgccttgggatatgtatgcaggtggcgctcatcggcggcaccaccgtcgccagcggcggcggcggcgttcgggcaccggcgatgttcgtgttcgggtcgtcgatactggacgtcggcaacaacaactacctccagggggcaaccgtcggcagggccaacagcccctacaacggcgtcgacttcccgggctccgtccccaccggaaggttcagcaacggctacaacatcgccgactacgtcgcaaagaacatgggattcgcgtgtagccctcctccttatctgtcgatggtgcagagctcatccggccctctggtccagaccgctctcaccagtggtatcaactatgcttctggaggagctgggatccttgactccaccaacgccggaagcaccatcccgttgtcgaaggaggtgaagtacttcggcgccaccaaggccaagatggtcgccgcagtgggacccaacacggcgaacccagcaatctctcagtccatcttcctcatcggcatgggcaacaacgacctctacgtcttcgcggcatcggagcgggcgcggaacaggtccgccgccgacgacgagcggagcgacgccgccgccgccgcgctctacgccggcctcatctccaactactccgccgccgtgacggagctctacacgctgggcgcccggaagttcgccgtcatcaacgtctggccgctcggatgcgtgccggggcagcgcgtgctgagcccgacgggcgcgtgctcggacaccctcaacgaggtcgccgccggcttcaacgcggcgctgggttccctgctcgtcgacctcgccgcgaggctgccgggcctcgtctactccctcggcgacgccttcggattcacggaggacgtgttggcggacccggcggcgtcagggtacaccgacgtcgcgggcacgtgctgcggcggcgggcggctgggcgccgaggcgtggtgctcgcgcaactccacgctctgcgtcaaccgtgaccagcatgtcttctgggaccgcgtccatccgtcccagcggacggcgtttctcatcgccagagcgctctatgatggaccgtccaagtacaccactcctatcaacttcatgcaactcgccaagtcaaattaattagtgatactgctgatacgtactgtcaaggaccctagaacaaatttgacagtgcatctcttttgtaaaagcatgttgtcgcctactaacgggaacgaaattagtcattcgcaaaaaggaaggacgataattagtcattgtttagatgcttttaaaattctaaaagttt

SEQ ID NO: 682 - DNA, 1718 bp, Sorghum bicolor
cgcaaccgcatctctctctctctctctcgctcgctctctctcggcttctggccccttcctagttcctaaccaccacgccaccactaccgccgtcccaaatccgcaaaccctagccctcgtcgccggcgggccatggccgagaccgtcgacgacaaggtcagctacttccaggccgtcaccggcatctccgacgcggacctctgcacggagatcctagccgcgcacaactgggacctgcagctcgcggtgtcctccatcaccgccaacccctcgccctccgcctcggcttccacctcctcacgcggggacccggccccttccgccccgctgtcggctgatgcggagttcgtcgcgcccccgcccccgccgccgatgcagctgccgctgccgccccagcagcagcagccggggatcgcgtggaggctggtgacgctccccttctacgtggtctcgggcggggtgggcctcgttgccggcaccttccgcctaggcgcctgggtcgccgggggcgtgctgtcccgctccctctccctcctcggcctcgcggggcaggccggcagcggcgaccgcctgctggagttgccgccgtcagctgccgaggcggccgacttcgtcgctgagttcgcgcgcgagttcggcgctggccgcggcccgagcttcgtggcagaggggttcgctgatgcgctgcagcgagcgcagcgggagttcaagcttctgttcgtgtacctccactcccctgatcacccggatacccctgccttctgcggtggctgcctctgtgctgagcccgtcgcggcctttatagatgagaacttcgttgcgtggggtggtagcatcagaaggactgaagggttcaagatgagcaacagcctgaatgcgtccaggttcccgttttgtgctgtggtcatggcttctaccaaccagagaatcatgctattgcagcaggttgaagggcccaaatcacctgaagagatgataacaattcttcaacgtgttgttgaagaatgcactacatcactcgttgctgccaggattgaagctgaagagagactaaacaaccaacgtttgcgtgaggaacaagatgctgcttacagagctgcacttgaagctgaccaggccagggaacgtgaaaggatagaggaactggaaagacgtgaaagagaggctgcagaggctgagagaaagcgcaaggaagatgaggaagctttagcaagggcagcccaagaagcagctgaaaaggaagccgctcttgcaaggaggaggcaagagaaggccatggctcttggagctgaacctgagaaaggaccaggtgttactcgggttctcataagattcccaactggagagcgcaaagagcggagattccacagttctacaaccgtcacttccctctatgactatgttgattctttagattgcttgaaagcagagaagtacagcctagtttcgaatttcccacgtgtcacatatggtccagagaagcactccctgacactggaggaagcaggcttgcatccgcaggcgagcctgtttatcgagatagaacaatgatgctgtaagttgagataaccgaaactcaaaagtataggtgctcccttttcgaatttgttcagcaacagttaaggatttccagatgtattacaccacaggtgcatccttcttctgtacttgttcatgaaataaaattcgccttcaccaagatcagttgactgcatcca

SEQ ID NO: 683 - DNA, 1879 bp, Zea mays
gaagacgtcagcactcagcagttcagcactgacccgtcggccgtcgccctcccggctcgcaaccgcatctctctcggcttctggcctcttcctagttcctaactaccaccgccacctctaccactggcctcaatctgcaaaccctagccctcgtcgccggcggccatggccgagaccgtcgacgacaaggtcagctactttcaggccgtcaccggcatctccaacacggacctctgcacggagatcctcgccgcgcacaactgggacctgcagctcgcggtgtccaccatcaccgccaacccctcctcgccctccgcttcggcctccacctcctcgcgtgacccggccccttccgctccgttggcggtagatgcggagtacgtcgcgcccccgccgccgctgccgctgccgctgccgccccagcagcagccggggatcgcgtggaagctggtgacgctccccttccacgtggtctcgggtggggtcggcctcgtcgccggcacgttccgccttggcgcctgggtagccgggggcgtgctgtcccgctccctctccctcctcggcctcgcggggcaagccggcagcggtgaccgcctgctagagttgccgccgtcagctgccgaggcggccgacttcgtcgctgagttcgagcgcgagttcggcgctggccgcggcccgcgcttcgtggccgaggggttcgctgatgcgctgaagcgagcgcagcgggaattcaagcttctgttcgtgtacctccactcccctgatcacccggatacccctgccttctgcggtggctgcctctgcgctgaacccgtcgcggcctttatagatgagaacttcgttgcctggggcggtagcatcagaaggactgaaggattcaagatgagcaacagcctgaatgcgtcgagatttccgttttgtgctgtggtcatggcttctacaaaccagagaatcgtgctattgcagcaggttgaagggcccaaatcacctgaagagatgataacagttcttcaacgtgttgttgaagaatgtgctacatcacttgttgctgctaggattgaagctgaagagagactaaacaaccagcgattgcgtgaggaacaagatgctgcttacagagctgcacttgaagctgatcaggccagggaacgtgaaaggttagaggaactgaaaagacgtgaaagagaggctgcagaggctgagaaaaagcgtaaagaagaggaggaagctgtagcaagggcatcccaagaagcagctgagaaggaagctgctcttgcaaggaggaggcaagagaaggccatggctcttggagctgaacctgagaaaggaccaggtgttactcgggttctcataagattcccaactggagagcgcagagagcggagattctacagttctgcaaccgtcgcttccctctatgactatgtcgattctctagactgcatgaaagcggagaagtacaccctagtttcgaatttcccacgcgttacatatggtccagaaaagcaatccctgacgctggaggaagcaggcttgcatctgcaggcgagcttgtttatcgagatagaacaatgatgctgtaagctaaagaaaagccgaaactaaagtacagacgctcctttttcgaagttgttcagcgacagttaaggatttccagatggtaatacaccacaggtgcatgcttcttgtgtacttttgtcatgaactaaaattcgcttccaccaatatcagttggctgcagccaggtcttgtaatatgttgtgtgacttacgtttctcagccactatactgcagtgcttcagggaggtaggcaaaactggaaggcttgtagccacaccgccatacatatgatttgctcccgttgtcgttgagcagccgg

SEQ ID NO: 684 - DNA, 1698 bp, Zea mays
actcgcgcacttcagcactcagccactcagcacagccactgacccgtcgcctccccggctcgcgaccgcatctctctcgccccttccaagttcctaatcgccaccgctgtccccaaccagcaaaccctagccctcatcgccggcggccatggccgagaccgtcgacgacaagatcagttacttccaggctgtcaccggcatctccgacacggacctctgcacggaaatcctcgccgcgcacaactgggacctgcagctcgcggtgtcctccatcaccgccaacccctcctcgccctccgccccggtttccacctcctcacgcgacccggccccttccgcccctttggcagatgcggagttcgtcgcgccaccgccgccgataccgccgccgcctcagcagcagccggggatcgcgtggaagctggtgacgctccccttctacgtggtctcgggtggggccagcctcgtcgccggctccttccgccttggcgcctgggtcgccgggggcgtgctgtcccgctccctctccctcctcggcctcgcggggcaggccggcagcggcgaccgcctgctagagctgccgccgtcagctgccgaggcggctgacttcgtcgccgagttcgagcgcgagtgcggcgctggccgcggcccgcgcttcgtggccgaggggttcgctgatgcgctgcagcgagcgcagcgggaattcaagcttctgttcgtgtacctccactcccctgatcacccggatacccctgccttctgcggcggctgcctctgtgctgaaccggtcgcggcctttatagatgagaacttcgttgcgtggggtggtagtatcagaaggaccgaagggttcaagatgagcaacagcctgaatgcgtcgagattcccgttttgtgctgtggtcatggcttctacaaaccagagaatcgtgctattgcagcaggttgaagggcccaaatcacctgaagagatgataacaattcttcaacgtgttgttgaagaatgtgctacatcactcgttgctgccaggattgaagctgaagagagactaaacaaccagcgtttgcgtgaggaacaagatgctgcttacagagctgcacttgaagctgaccaggccagggaacgtgaaaggatagaggaacaggaaagacgtgaaagggaggctgtagaggctgagaaaaagcgtaaagaagaggaggaagctgtagcaagggcagcccaagaagcagctgaaaaggaagctgctcttgcaaggaggaggcaagagaaggccatggctcttggagctgaacctgagaaaggaccaggtgttactcgggttctcataagattcccaacgggagagcgcaaagagcggagattccatagttctgcaaccgtcacttccctctatgactacgtcgattctttagactgcatgaaagcagagaattacagcctagtttcaaatttcccacgggtcacatatggtccagagaagcactccctgacactggaggaggcaggcttgcatccgcaggcgagcctgtttatcgagatagagcaatgatgctatagaaaaaccggaacttggaagtataggtgctcctttttccgaatttgtccagtaacagttaaggatttccagatgtattacacaccacaggtgcatgcttgttcatgaaataaaattcgccctcaccaaaaaaaaaaaaaaaa

SEQ ID NO: 685 - DNA, 1687 bp, Hordeum vulgare subsp. vulgare
gaagagttgagactactcttcgcatctcctcttcctctctagtcccaaccacctaaccgcccccaaatctccaaaccctagctctaccccacccccaccacgcagccggccgccatggccgagaccgtcgacgacaaggttgcatacttccaggccgtcacaggcatccccgaccctgacctctgctcccagattctcgccgccaacaactgggacctccagctcgccgtctcctccatgaccggcgacccctcctcgcccgagccgtccacttacgccccgccgcccccgcctccgctggagtccgattctatcgcctatcagccccctgcgccggcccctcagcagcagcagcagcggcagcagccggggatcgcgtggaggctagtgaccctccctttctacgtggtctccggtggggtcggcctcgtcaccggttccatccgcctcggtgtctgggtcgcgagcggcgtgctgtcccgatccctctccctcctcggcctcgcgcagggcggcgctgaccgcttgcttgagctgcccccgtccgccgcggaggcggttggcttcctggccgagttcgagcacgagtttggggctggccgtggcccgcgcttcgtcgctgagggattttctgacgcgctgcagcgtgcgcagcgtgagtacaagcttctcttcgtgtacctccactcccctgaccacccggacaccccggcattctgcggtggctgcctctgctccgagccggtggccgccttcatagatgagaacttcgttgcatggggtggtagcatcaggaggactgaagggttcaagatgagcaacagtctgaatgcatcacgcttccccttttgtgcgctagtcatggcatctacgaaccagagaatcgtgctgttgcagcaggttgaggggcccaaatcacctgaagagatgataacaattcttcaaagagttgttgaagagtgcactgcgtcccttgttgctgccaggattgaagctgaagaaagactaaacaatcaacgtttgcgtgaggaacaagatgctgcttacagagctgcccttgaagctgatcaggccagggaacgccaaaggagagaggaacaagaaatacttgaaagagaggctgcggaggctgagaggaagcgtatagaagacgaggaagcacaagccagggcagtccaagaagcagctgaaaaggaagccgctcttgcaaggagacgtcaagagaaggcaatggctcttggcgctgagcctgagaaagggcctgacgttactcgggttcttataagatttccaactggagagcgcaaagaaaggagattccacagttccgccaccattacctccatatatgactatgttgattctttggattgcttgaaagcggagaagtacagcctagtttctaattttccgcgggtaacatacggtcccgaaaagaactcccaaacgctcgtggaagcaggtttgcacccacaagcaagcctatttatcgagatagaacaatgaatgtccccaattttccaagttatatgtactgaaacttgcaagtataggtgctccttttttactctatttgacaaacagtggggaacttccagctgtatggcaatatacttagacttgacttttgtcgaaatgctgctcttgtggttatcattcgttaaataaattcaccttctgccggatc

SEQ ID NO: 686 - DNA, 3979 bp, Oryza sativa Japonica Group
gagaccgtcgacgacaaggtcagctacttccaggcggtcaccggcatctccgaccacgacctctgcaccgagatcctcgccgcccacaactgggacctccagctcgccgtctcctccatcaccgccaacccctcctcccccgacccggccccctccgcgcccctgcccccgctggcaccgagggaggcggatttggtcgcgccgcacctgcctccgcctccgcagcagcagcagcagcagcagcagccggggatcgcgtggaagctcgtgacgctccccttctacgtggtctccggtggggttgggctcatcgccggttcgatccgtctcggtgcctgggtcgccggaggtgtgctgtctcgctccctctccatcctcggcctcgcgcagggcgggggcggaggaggcgaccggcttctcgagctgcccccgtcggcggccgaggcggctgacttcgtggcggagttcgagcgcgagttcggcgccggccgtggcccccacttcgtcgccgagggcttcgcggatgcgttgcagcgtgcgcagcgcgagtacaagcttctcttcgtgtacctgcactcccctgatcacccggacacccctgccttctgcggtggctgcctctgcgctgagccagtcgcggccttcatagatgagaacttcgttgcgtggggtggtagcatcaggaggactgaagggttcaagatgagcaacagcctgaatgcatcgaggttccctttctgcgcggtggtcatggcgtctacgaaccagagaattgtgttgttgcggcaggtatggtgttgatgtgctatttataatgtctgagaaatatgttggatttgttatctaagatcagctgctgtgctccttagtttatgtggtttctgactgtggattatcacattgactatagtgtagagaggcgtttgtgtgaaacaattcaatttgttgggggtttagtccggcaatgctttccattattagatcaacttgttatgcaccatttgttacaaagttctcatctgtattaattacgatgttttatttggttacgacatgccattcctgcgctttgagaacattgagatgcagttgcgagagttaggccattgttatgcatacagacccggttgccatttacagtaggattaactttgagtatagttgcttcctatatcatagttgtttcagcttattgttttcgaagtgtttatgttgttataacttaaaatccattttgtggatttggtatgtctgcaatatgctttcttaaattagatgtgtcatatgttctgtaagtgattttgtttcatgaattagagttgttgtgactttgggagctgattttgtttctcattgatttgcttggttaggatgagatttagatgggagtcttagtggaattgttttatatatactcaaattcctagtccccaaactattttatgggattaaatggtgagagttgggcattcaaatttctaagccaaaatcccctcactttaagaactacaatcccttatctcattcccacccaccaactatcatgtgcaaaacatgatataggacactctgtcatttactcatttacatcatccttgataattgcattagctggaattttgtgcaatactcatggatttcagcaactactgctgatgatactagaaatttggtaattatcttttcctcttaaagtaccctagaaaactaagttaatacatatcccaaactggagttttatctgaattgaatgtgtgaagggtgctttggggaaaaaatgttttaccaatgagcaagacaaattccaaattttcatcattaccttttcattttagattttttaggcattctcctttatgttcttttaaatttgtacacattcacaaaactttcctgtagataaaatttcacacataatattatggcagtatcgaattctgtttgcttgactactgcactgtgttgaaactagcaggtgatatattttgttgttctagattgttacgttgataggtgagagtaaaagatcaggttttgttcactgtgctgtttaacaaatatatgcattgttattaaaacttgacttgctgtacttgcttttctctgataccccattttatttaatattgtagtccatagaattcgtagtgcgtgtattctctatcaacaatacattgtgcaataatataatcatccagcttctgtcaaggcagtgttgctgcttactcgcaagtaatcctactgtttgttagcaccactcattagtatttgaatgctattgccaggacttatgttaagtccttaacgatgttttattctagatcaaaatcgtgcaaacatcttgtttccttcccagcatttgtgcatcatgcgtgattatatttatacccctagagctcatcagctcaaggcagttactatgccccacatcgttactggcataacattagtcattaatggatccaaagctctgtactcttttttcttgtcgtttcaaagtaccttagtattttttttctgctaccgtacagttatatagttgatcaatattgctcatgcattttcattttgtgttccgaagattgaggggcccaaatcacctgaagagatgataacaactcttcaaggggcagttgaagaatgcagtgcatcactcgttgctgctaggattgatgctgaagagaggctaaacaatcaacgcttgcgtgaggaacaagatgctgcttatagagctgcacttgaagctgatcaggtatgctaaactctggaggccatttctgttcttatattattgatgcgctttagtacaagagtatgcatgctgtgtaatatgggttcaacgatagggtctggggtagttacatgacaatggggaactaatttatctatatattacaccttgttttcattttcttcagctaagggcattgtaccgttctaaggacagtatttgtgcatggtaatgggcacactaatacattagttagtgaactgattaaagcagaccatagaacggtgcatacagattttctgccagtatttgaatgttttgaagcaccaacttattgagcaattccttctctctttttttttggtaaaattaccagtctaggggaaaacgattttggttggtcctaatggatgttgttgtaccaggccagggaacgccaacggagagaggagcaggaaaagcgtgaaagagaggctgcagaggctgagagaaagcgcaaagaagaagaggaggctcaagaaagggctgcccaagaagcagctgagaaagaagccgctcttgcaaggaggagacaagagaaggccatggctcttggagcagaacctgagaaaggaccagatgttactcgagtatgttcacattctttgtccatcttccttatcaacctgttatgatcttattctaggataatgtgctgacaagttacaaccacatttgtctacttttgatgactaaatacaatacagtagcagctatgctagattgcttttattagtgatgcagaaggcttcagtaagcttattcatctctgtggagctacatgatagctttgaacgcaacacatcatgactaattttttgatttgtaccttcacaaaccatgcattctacgtataggtggtttgtttagtagtaattttctttagatgttagcacagatatttctaaactgctgatgatctgcgttgtatctgcaaattctttggaactaataaaggaccgtgctgatgattttgtaggttcttataagatttccaactggagagcgcaaagaaaggagattcaacagttccactaccatcacttcactgtatgactatgttgattctttggactgcttgaaagcagagaagtacagcctagtttcgaacttcccgagggtgacatacggtccagaaaaactctcccaaacgctggaggaagcaggtttgcatccgcaggcgagcttgtttattgagatagaacaatg

SEQ ID NO: 687 - protein, 557 aa, Zea mays
MAPSNIVVQSSSTPPVAGGDEEFAPSVWGDFFVTYAPPVSQASEQRMSERAELLKAQVRQAFDAASMDVAGLVTYVDTLERLGLDNHFRDLIGAALERIGAEELPEHGGGLHIVALRFRLLRQHGIWVSTDVFDAFREDAGGFCSSLCSDDPRGLLSLYNAAHMAVPGEVVLDDAIAFARGRLLDIISKGEVRSPVSEQITRALDIPLPRFTRRLETMHYIAEYEHEEAHDGLLLELARLNFVLVRALHLRELKDLSLWWRDLYNTVKLPYARDRMVEIYFWTCGMLHEEEYSLARMFFAKTFGMVSLMDDTFDVHATLDECHKLKEAMQRWDESEVSILPEYLRLLYIKTLSNFKEFEEILEPNKKYRMAYTKEAYKLCSKNYLKEAIWSNQKYQPSFKEHEELSIMTSGLPMLTILTLMGFGDEATPEAFEWVSSVPEMVRAGSQVTRFLNDLSSYKLGKNKKDMPGSVETYMVENGLTGDEAAAAIAALLENRWRILNQTRMEIDHTLLPAAQVVVNMARANEIIYLHGRDAYTFGADLKDLVTTLFLKQVLPL

SEQ ID NO: 688 - protein, 557 aa, Zea mays
MAPSNIVVQSSSTPPVAGGDEEFAPSVWGDFFVTYATPVSQASEQRMSERAELLKAQVRQAFDAASMDVAGLITYVDTLERLGLDNHFRDLIGAALERIGAEELPEHGGGLHIVALRFRLLRQHGIWVSTDVFDAFREDAGGFCSSLCSDDPRGLLSLYNAAHMAVPGEVVLDDAIAFARGRLLDIISKGEVRSPVSEQITRALDIPLPRFTRRLETMHYIAEYEHEEAHDGLLLELARLNFVLVRALHLRELKDLSLWWRELYNTVKLPYARDRMVEIYFWTCGMLHEEEYSLAWMFFAKTFGMVSLMDDTFDVHATLDECHKLKEAMQRWDESEVSILPEYLRLLYIKTLSNFKEFEEILEPNKKYRMAYTKEAYKLCSKNYLKEAIWSNQKYQPSFKEHEELSIMTSGLPMLTILTLMGFGDEATPEAFEWVSSVPEMVRAGSQVTRFLNDLSSYKLGKNKKDMPGSVETYMVENGLTGDEAAAAIAALLENRWRILNQTRMEIDHTLLPAAQVVLNMARANEIIYLHGRDAYTFGADLKDLVTTLFLKQVLPL

SEQ ID NO: 689 - protein, 492 aa, Sorghum bicolor
MRERSEQLKGQVHQVFNASFDALDVADLVTYVDTLERLGLDNHFREVIGAALDRIRAEEPESNSLHIVALRFRLLRQHGIWVSADVFDKFRDDTGSFSSSLCSDPRGLLSLYNAAHMAVPGEVVLDEAIVFTRGQLEGIKSKVRSPISKQISRALDIALPRFTRRLETMHYITEYEHEEAHDSLILELARLNFILVRALHLRELKDLSIWWRDLYDTVKLPYARDRLVENYFWTSGVLHEEEYSLARMFFAKAFGMASPLDDTFDAHATLEECHKLQEAMQRWDESEASILPEYLSMLYIKTLRNFNEFEDILEPNKKYRMAIWSSKKYSPSLKEHEDLSIMTSGLPMLTIMTLMGYGDEATQEAFEWVSTVPEMVRASAHVTRLLNDLSSYKLGKRKKQDMPSAVETYMVEKGVTGEEAVKAIAALLENRWRILNQEIMDIDHTLLPAAQLVVNIARATEIIYVHGRDAYTSGEDLKDLVTTLFLKQVPLI

SEQ ID NO: 690 - protein, 408 aa, Sorghum bicolor
MLALLAAFAVACLLFVSRPCARDMRLFLASLCQQLLLSLLGLLAGLRLLGGVAAASHAGNTETMPLMPSFKRKRAAVTVENAEEAAGAAAGGEPSVLDLPELAIDCILERLQPAELRSMAAVCRSMRERCRSDHLWERHMTSKWGRVLGRAARDEWRTHVASASESGAVSGGGGGGKRRRWLAALSCVCPVVSWMRPRPDGGKSSAPVLDDSIMSWYLSMESGKFWFPAQVYNREHGHVGFMMSCYDAELSYDFHTDTFRARYPPHGRRTVVLEDGVHWDRIRAPPVDTLAHDLHTSDCLHELRPGDHIEIQWRRNKEFPYGWWYGVVGHLESCDGNEHFCRCHLSDTVVLEFNQYTPGSRWRQALVNRKEHREEGNEGDGFYGGVRKLRSKDDISKWRQLWPTDILE

SEQ ID NO: 691 - protein, 407 aa, Zea mays
  misc_feature (56)..(56): Xaa can be any naturally occurring amino acid
MLAPLLAAFAVVFLLLLSRPCARDMRLFLASLCQQLVLSLLGFLAGLRLLSGVAAXSAATETMPLMPSFKRKRASATVENAEEAAATAGGGETSVLDLPELAIDCILEKLRPAELRSMAAVCRSMRERCRGDHLWERHMTNRWGRVLGRAARDEWRTHLASASESRAAGGGGGGGKRRRWLAALSCVCPVVSWMRPRADGGKSSAPVLDDSIMSWYLSVESGKFWFPAQVYNREHGHVGFMMSCYDAALSYDLHTDTFRARYPPHGRRTVVLEDGVQWDRVRAPPVDTLAHYLHTSDCLHELRPGDHIEIQWRRNKEFPYGWWYGVVGHLESCDGSEHFCRCHLSDTVVLEFNQYTPGSRWRQALVKRKEHREEGNEGDGFYGGIRKLRGNDDISKWRQLWPTDVLE

SEQ ID NO: 692 - protein, 406 aa, Hordeum vulgare subsp. vulgare
MLALVATFVFSCLLFLSKPCARDMRLFLASISQQLALSLFGFLAGYRLLGGVASRATPADAMPLMPSFKRKRPAAKVESTDMTGEPSVLDLPELAIDCILAKLPPAELRNMAAVSRSMRERCRSDHLWESHMSNKWGSVLGTAARDEWRAYLSSSTAAGGGASGYCGSAASGKHRRWLAALSCVCPVVSWMRPRAEGGAGMSAGPVLDDSIMSCYLHMESGKFWFPAQVYNREHGHVGFMMSCYDAEVSYDFRTDTFHARYPPHGRRTVVLEDGVQWERVRAPPVETLAHDLHASDCLHELRPGDNIEIQWRRNKEFPYGWWYGVVGHLESCDGNEHFCRCHLSDIVVLEFNQYTPGSRWRQSLVNRKDHREEGNESDGFYGGIRKLQDKDEISKWKQLWPTDTLE

SEQ ID NO: 693 - protein, 415 aa, Oryza sativa Japonica Group
MLALVATFVLACLVFLSKPCAREMRLFLSTLCQELALALLGFLAGLRLLGGVGAGAAAETTMPLMPSFKRKRAAAVEEGGGGGGGGGGEEAGGEPSVLDLPELAIECILARLPPSELRNMAGVCRSMRERCRGDHLWERHMSEKWGGVLGHAAREEWRTYLASAADTGGAAASCSLAGGGRHRRWLAALSCVCPVVSWMRPRADGGSGGKSAGPVLDDSIMSWYLSMESGKFWFPAQVYNREHGHVGFMMSCYDAELSYDFHSDTFRARYPPHGRRTVVLEDGVHWDRVRAPPVDTHAHDLHASDCLHELRPGDNIEIQWRRNKEFPYGWWYGVVGHLESCDGSEHFCRCHLSDTVVLEFNQYTPGSRWRQALVNRKDHREEGNEGDGFYGGIRKLRSKDEISKWRQLWPTDILE

SEQ ID NO: 694 - protein, 382 aa, Oryza sativa Japonica Group
MRLFLSTLCQELALALLGFLAGLRLLGGVGAGAAAETTMPLMPSFKRKRAAAVEEGGGGGGGGGGEEAGGEPSVLDLPELAIECILARLPPSELRNMAGVCRSMRERCRGDHLWERHMSEKWGGVLGHAAREEWRTYLASAADTGGAAASCSLAGGGRHRRWLAALSCVCPVVSWMRPRADGGSGGKSAGPVLDDSIMSWYLSMESGKFWFPAQVYNREHGHVGFMMSCYDAELSYDFHSDTFRARYPPHGRRTVVLEDGVHWDRVRAPPVDTHAHDLHASDCLHELRPGDNIEIQWRRNKEFPYGWWYGVVGHLESCDGNTVVLEFNQYTPGSRWRQALVNRKDHREEGNEGDGFYGGIRKLRSKDEISKWRQLWPTDILE

SEQ ID NO: 695 - protein, 382 aa, Oryza sativa Indica Group
MRLFLSTLCQELALALLGFLAGLRLLGGVGAGAAAETTMPLMPSFKRKRAAAVEEGGGGGGGGGGEEAGGETSVLDLPELAIECILARLPPSELRNMAGVCRSMRERCRGDHLWERHMSEKWGGVLGHAAREEWRTYLASAADTGGAAASCSLAGGGRHRRWLAALSCVCPVVSWMRPRADGGSGGKSAGPVLDDSIMSWYLSMESGKFWFPAQVYNREHGHVGFMMSCYDAELSYDFHSDTFRARYPPHGRRTVVLEDGVHWDRVRAPPVDTHAHDLHASDCLHELRPGDNIEIQWRRNKEFPYGWWYGVVGHLESCDGNTVVLEFNQYTPGSRWRQALVNRKDHREEGNEGDGFYGGIRKLRSKDEISKWRQLWPTDILE

SEQ ID NO: 696 - protein, 535 aa, Sorghum bicolor
MAAAAAATAPSRKTETYTDTKRRDDVRGANIAAARAVADAVRTSLGPRGMDKMISSGDQAQEVIITNDGATILSRMALLQPAARMLAELSRSQDAAAGDGTTTVVVLAGSLLRRAQSLLSAGAHPTAAADALHRLATRAVEILHAMAIPIELSDRESLVKSASTALNSKVVSQYSTLLSPLAVDAALSVVDPAHPDLLDLRDIRIVKKLGGTVDDTELVRGLIFDKKASHAAGGPSRVENAKIAVIQFQISPPKTDIEQSVIVSDYAQMDRILREERNYILGMVKKIKAAGCNVLLIQKSILRDAVTDLSLHYLAKAKILVVKDVERDEIEFITKTLNCLPIANIEHFRTDKLGYADVVEEISVGEGKVVKITGIRDMGRTATVLVRGSNQLVIDEAERSLHDALCVIRCLVNKRFLIAGGGAPEIEMSMQLAAWAKELRGMESYCIKEFAEALEVIPYTLAENAGLNPISIVTELRNRHARGEKNAGINVRKGQITNILEENVVQPLLVSTSAITLACECVRMILKIDDIVTVR

SEQ ID NO: 697 - protein, 535 aa, Zea mays
MAAAAAAAAPSRKTETYTDTKRRDDVRGANIAAARAVADAVRTSLGPRGMDKMICSGDQAQEVIITNDGATILSRMALLQPAARMLAELSRSQDAAAGDGTTTVVVLAGSLLRRAQSLLSAGAHPTAAADALHRLATRAVEILHGMAIPIELSDRESLVKSASTALNSKVVSQYSTLLSPLAVDAALSVVDPAHPDLLDLRDIRIIKKLGGTVDDTELVTGLIFDKKASHAAGGPTRVENAKIAVIQFQISPPKTDIEQSVIVSDYAQMDRILREERNYILGMVKKIKAAGCNVLLIQKSILRDAVTDLSLHYLAKAKILVVKDVERDEMEFITKTLNCLPIANIEHFRTDKLGYADVVEEISVGEGKVVKITGIRDMGRTATVVVRGSNQLVIDEAERSLHDALCVIRCLVNKRFLIAGGGAPEIEMSMQLAAWAKELRGMESYCIKEFADALEVIPYTLAENAGLNPISIVTELRNRHARGEKNAGINVRKGQITNILEENVVQPLLVSTSAITLACECVRMILKIDDIVTVR

SEQ ID NO: 698 - protein, 535 aa, Zea mays
MAAAVAAPAPSRKTETYTDTKRRDDVRGANIAAARAVADAVRTSLGPRGMDKMIASGDQAQEVIITNDGATILSRMALLQPAARMLAELSRSQDAAAGDGTTTVVVLAGSLLRRAQSLLSAGAHPTAAADALHRLATRAVEILHAMAIPIELSDRESLVKSASTALNSKVVSQYSTLLSPLAVDAALSVVDPAHPDLLDLRDIRIVKKLGGTVDDTELIPGLIFDKKASHAAGGPTRMENAKIAVIQFQISPPKTDIEQSVIVSDYAQMDRILREERNYILGMVKKIKAAGCNVLLIQKSILRDAVTDLSLHYLAKAKILVVKDVERDEMEFITKTLNCLPIANIEHFRTDKFGYADVVEEVSVGEGKVVKITGIKDMGRTATVLVRGSNQLVIDEAERSLHDALCVIRCLVSKRFLIAGGGAPEIEMSMQLAAWAKELRGMESYCIKEFAEALEVIPYTLAENAGLNPISIVTELRNRHARGEKNTGINVRKGQITNILEENVVQPLLVSTSAITLACECVRMILKIDDIVTVR

SEQ ID NO: 699 - protein, 534 aa, Oryza sativa Japonica Group
MATAVAASPAQSRKTETYTDTKRRDDVRGLNIAAARAVADAVRTSLGPRGMDKMISSGEQEVIITNDGATILSRMSLLQPAARMLAELSRSQDAAAGDGTTTVVVLAGSLLRRAQSLLSAGAHPTAAADALHRLATRAVEVLHAMAIPIELSDRDSLVKSASTALNSKVVSQYSSLLSPLAVDAALSVVDPAHPDLLDLRDIRVVKKLGGTVDDTELIRGLIFDKKASHAAGGPTRVENAKIAVIQFQVSPPKTDIEQSVIVSDYAQMDRILREERNYILGMVKKIKASGCNVLLIQKSILRDAVTDLSLHYLAKAKILVVKDVERDEIEFITKTLNCLPIANIEHFREDKLGYADLVEEVSVGESKIVKIMGIKDMGRTATVLVRGSNQLVIDEAERSLHDALCVIRCLVNKRFLIAGGGAPEIEMSMQLAAWAKELQGMESYCIKEFAEALEVIPYTLAENAGLNPISIVTELRNRHAKGEKNAGINVRKGQITNILEENVVQPLLVSTSAITLACECVRMILKIDDIVTVR

SEQ ID NO: 700 - protein, 550 aa, Oryza sativa Indica Group
MATAVAASPAQSRKTETYTDTKRRDDVRGLNIAAARAVADAVRTSLGPRGMDKMISSGEQEVIITNDGATILSRMSLLQPAARMLAELSRSQDAAAGDGTTTVVVLAGSLLRRAQSLLSAGAHPTAAADALHRLATRAVEVLHAMAIPIELSDRDSLVKSASTALNSKVVSQYSSLLSPLAVDAALSVVDPAHPDLLDLRDIRVVKKLGGTVDDTELIRGLIFDKKASHAAGGPTRVENAKIAVIQFQVSPPKTDIEQSVIVSDYAQMDRILREERNYILGMVKKIKASGCNVLLIQKSILRDAVTDLSLHYLAKAKILVVKDVERDEIEFITKTLNCLPIANIEHFREDKLGYADLVEEVSVGESKIVKIMGIKDMGRTATVLVRGSNQLVIDEAERSLHDALCVIRLVSGLINELQRVNWLRCLVNKRFLIAGGGAPEIEMSMQLAAWAKELQGMESYCIKEFAEALEVIPYTLAENAGLNPISIVTELRNRHAKGEKNAGINVRKGQITNILEENVVQPLLVSTSAITLACECVRMILKIDDIVTVR

SEQ ID NO: 701 - protein, 534 aa, Hordeum vulgare subsp. vulgare
MAAAAVAAAPSARKGETYTDTKRRDDVRGANIAAARAVADAVRTSLGPRGMDKMISSGDQEVIITNDGATILSRMSLLQPAARMLAELSRSQDAAAGDGTTTVVVLAGALLRRAQSLLAAGAHPTAAADSLHRLAARAVQVLEGMAIPIELTDRDSLVKSASTALNSKVVSQYSSLLAPLAVDAALSVVDPAHPELLDLRDIRIIKKLGGTVDDTELVRGLIFDKKASHAAGGPSRIENAKIAVIQFQISPPKTDIEQSVIVSDYAQMDRILREERNYILGMVKKIKASGCNVLLIQKSILRDAVTELSLHYLAKAKILVVKDVERDEIEFITKTLNCLPIANIEHFREDKLGYADVVEEVSAGDGKIVKITGIRDMGRTATVLVRGSNQLVIDEADRSLHDALCVIRCLVNKRFLIAGGGAPEIEMSMQLAAWSKELHGMESYCIKEFADALEVIPYTLAENAGLNPIAIVTELRNRHAKGEKNTGINVRKGQITNILEENVVQPLLVSTSAISLACECVRMILKIDDIVTVR

SEQ ID NO: 702 - protein, 541 aa, Oryza sativa Japonica Group
MAAAVAASPAQSRKTETYTDTKRRDDVRGLNIAAGRAVAAAARTSLGPRGMDKMISSSSSGGDQAVIITNDGATILSRMPLLQPAARMLADLSRSQDAAAGDGTTTVVVLAGSLLRRAQSLLSAGAHPTAAADALHLLAARAVEVLHGMAIPVELSDRDALVKSASTALNSKVVSQYSTLLSPLAVDAALAVVDPAHPYLLDLRDIRVVKKLGCTVDDTELIRGLVLNKKASHVAGGPTRIGDAKIAVIQFQVSPPKTDIEHSVVVSDYAQMDRILREERNYILGMVKKIKASGCNVLLIQKSILRDSVTDLSLHYLAKAKIMVVKDVERDEIEFITKTLNCMPIASIEHLREDKLGHAHLVEEISVGDGNNNKIVKITGIKNMGRTATVLVRGSNQMVIDEAQRSLHDAFCVIRCLVNKRFLIAGGGAPEIEMSMQLAAWAKELRGMESYCVREFAEALEVIPYTLAENAGLDPISTVTELRNRHAKGEKNAGINVRKGRITNILEENVVQPLLVSTSAVTLACECVRMILKIDDIVTVR

SEQ ID NO: 703 - protein, 533 aa, Populus trichocarpa
MALVAKSAPRSSKTESYVDNKRKEDIRHANIKSACAVADAVRTSLGPKGMDKMISTASGEVIITNDGATILNKMEVLQPAAKMLVELSKSQDTAAGDGTTTVVVIAGSLLKQCLSLLSSGIHPTVISDSLHKASIKAVDVLTAMAVPLELTDRDSLVKSASTSLNSKVVSQYSSLLAPLAVDAVLTVVDPEKPDLVDLRDIKIVKKLGGTVDDTEMVRGLVFDKKVSHAAGGLTRVENAKIAVIQFQISPPKTDIEQSIVVSDYAQMDRILKEERNYILGMIKKIRATGCNVLLIQKSILRDAVTDLSLHYLAKAKILVIKDVERDEIEFITKTLNCLPIANIEHFKEEKLGYADLVEEVSLGDGKIVKITGIKDMGRTTCVLVRGSNQLVLDEAERSLHDALCVIRCLVNKQFLIAGGGAPEIELSRQLGAWAKVLHGMEGYCVKSFAEALEVIPYTLAENAGLNPITIVTELRNRHAQGEINAGINVRKGQITNILEENVVQPLLVSTSSITLAAECVRMILKIDDIVTVR

SEQ ID NO: 704 - protein, 531 aa, Populus trichocarpa
MAAVSAPRSSKTESYIDNKRKEDIRHANIKAACAVADAIRTSLGPKGMDKMISTASGEVIITNDGATIVNKMEVLQPAAKMLVELSKSQDTAAGDGTTTVVVIAGSLLKQCLTLLSSGIHPTVISDSLHKASIKAVDVLTAMAVPLELTDRDSLIKSASTSLNSKVVSQYSSLLAPLAVDAVLSVVDPAKPDLVDLRDIKIVKKLGGTVDDTEMVRGLVFDKKVSHAAGGPTRVENAKIAVIQFQISPPKTDIEQSIVVSDYAQMDRILKEERNYILGMIKKIKATGCNVLLIQKSILRDAVTDLSLHYLAKAKILVIKDVERDEIEFITKTLNCLPIANIEHFKEEKLGYANLVEEVSLGDGKIVKITGIKDMGRTTTVLVRGSNHLVLDEAERSLHDALCVVRCLVSKRFLIAGGGAPEIELSRQLGAWSKVLHGMEGYCVKSFAEALEVIPYTLAENAGLNPITIVTELRNRHAQGEINTGINVRKGQITNILEENVVQPLLVSTSAMTLATECVRMLLKIDDIVTVR

SEQ ID NO: 705 - protein, 533 aa, Vitis vinifera
MAAPVAPLARSSKTESYVDNKRKDDIRQANIVAARAVADAVRTSLGPKGMDKMISTASGEVIITNDGATILNKMEVLQPAAKMLVELSKSQDIVAGDGTTTVVVIAGALLKQCLSLLSHGIHPTIISDSLHKASIKAVDVLTAMAVPVELSDRESLIKSASTSLNSKVVSQYSTLLAPLAVDAVLSVVDPAKPDLVDLRDVKIVKKLGGTVDDTELVKGLVFDKKVSHTAGGPTRVENAKIAVIQFQISPPKTDIEQSIVVSDYTQMDRILKEERNYILGMIKKIKATGCNVLLIQKSILRDAVTDLSLHYLAKAKILVIKDVERDEIEFITKTLNCLPIANIEHFRAEKLGFADCVEEVSLGDGKIVKITGIKDMGRTTTVLVRGSNMLVLDEAERSLHDALCVVRCLVNKRFLIAGGGAPEIELSRQLGAWAKVLQGMESYCIRSFAEALEVIPYTLAENAGLNPISIVTELRNRHAQGEINAGINVRKGQITNILEENVVQPLLVSTSAITLATECVRMILKIDDIVTVR

SEQ ID NO: 706 - protein, 443 aa, Sorghum bicolor
MDVEGEVPAAAAAAVANGLGGAEEASAAPVSAEQLDVEAYAAQYSGRTRLARLLFIADRCGVEAMQLEALRMAYDEIKRGEDVQLHRDVAAKIGGRLGPRFGLDQAWVDTVTRRADQRKEKLENELNGYRTNLIKESIRMGYNDIGDFFYAHGQLSDAFKSYIRTRDYCTTSKHIVQMCMNVILVSIELGQYAHVSNYVSKAEQTPDSLDPVIVAKLKAAAGLANLETKKYKFAARKFVETGIELGNNYSEVIAPQDVAVYGALCALASFDRSDLKSKVIDNINFRNFLELVPEVRELVNDFYASRYGSCLGHLEKLKPNLLLDIHLHEHVETLYMDIRHKAIIQYTLPFISVDLNLMATAFKTSVSMLEKELAALITENKIQARIDSHNKILYARHADQRNATFQRVLQTGNDFERDVKSMLLRANLLKHDYIQKASGPRKM

SEQ ID NO: 707 - protein, 445 aa, Zea mays
MDVEGEVPAAAAAAVANGLGGAGAEEASPAPVSAEQLDVEAYAAQYSGRTRLVRLLFVADRCGVEAMQLEALRMAYDEIKRGEDVQLHRDVVTKIGGRLGPRYGLDQAWVFSVSRRADQRKEKLESELNGYRTNLIKESIRMGYNDIGDFFYAHGQLSDAFKSYIRTRDYCTTSKHIVQMCMNVILVSIELGQYAHVSNYVSKAEQTPDSLDPTIVAKLKAAAGLANLETKKYKFAARKFVETGIELGNNFSEVIAPQDVAVYGALCALASFDRSDLKSKVIDNINFRNFLDLVPEVRELVNDFYASRYGSCLGHLEKLKPNLLLDIHLHQHVETLYMEIRHKAIIQYTLPFISVDLNTMAAAFKTSVSMLQKELAALITEDKIQARIDSHNKILYARHADQRNATFQRVLQTGNDFERDVKSMLLRANLLKHDYIQKTSGPRKM

SEQ ID NO: 708 - protein, 441 aa, Oryza sativa Japonica Group
MDVEGEVPAAAAEAVANGLGGAEPSPAPVSAEQLDVEAYAAQYTGRTRLARLLFIAERCGVEAVELEALRMAYDEIKRGEDTMFHREVTNKINGRLGPKYALDQAWTDSVNRRAEQRKEKLESELNGYRTNLIKESIRMGYNDIGDFFYAHGHLSDAFKSYIRTRDYCTTSKHIVQMCMNVILVSIELGQFPHVSNYVSKAEQTPDTLDPIIVAKLRAAAGLAYLATKKYKLAARKFVETGHELGNNYSEVIAPQDVAVYGALCALASFDRSDLKSKVIDNSNFRNFLELVPEVRELVNDFYSSRYGSCLEHLEKLKTNLLLDIHLHDHVETLYMDIRHKAIIQYTLPFISVDLNTMAAAFMTSVSMLEKELAALITENKIQARIDSHNKILYARHADQRNATFQRVLQTGNEFERDVKSLLLRANLIKHDFNQRAGQRKM

SEQ ID NO: 709 - protein, 441 aa, Oryza sativa Indica Group
MDVEGEVPAAAAEAVANGLGGAEPSPAPVSAEQLDVEAYAAQYTGRTRLARLLFIAERCGVEAVELEALRMAYDEIKRGEDTMFHREVTNKINGRLGPKYALDQAWTDSVNRRAEQRKEKLESELNGYRTNLIKESIRMGYNDIGDFFYAHGHLSDAFKSYIRTRDYCTTSKHIVQMCMNVILVSIELGQFPHVSNYVSKAEQTPDTLDPIIVAKLRAAAGLAYLATKKYKLAARNFVETGHELGNNYSEVIAPQDVAVYGALCALASFDRSDLKSKVIDNSNFRNFLELVPEVRELVNDFYSSRYGSCLEHLEKLKTNLLLDIHLHDHVETLYMDIRHKAIIQYTLPFISVDLNTMAAAFMTSVSMLEKEVAALITENKIQARIDSHNKILYARHADQRNATFQRVLQTGNEFERDVKSLLLRANLIKHDFNQRAGQRKM

SEQ ID NO: 710 - protein, 441 aa, Oryza sativa Indica Group
MDVEGEVPAAAAEAVANGLGGAEPSPAPVSAEQLDVEAYAAQYTGRTRLARLLFIAERCGVEAVELEALRMAYDEIKRGEDTMFHREVTNKINGRLGPKYALDQAWTDSVNRRAEQRKEKLESELNGYRTNLIKESIRMGYNDIGDFFYAHGHLSDAFKSYIRTRVYCTTSKHIVQMCMNVILVSIELGQFPHVSNYVSKAEQTPDTLDPIIVAKLRAAAGLAYLATKKYKLAARNFVETGHELGNNYSEVIAPQDVAVYGALCALASFDRSDLKSKVIDNSNFRNFLELVPEVRELVNDFYSSRYGSCLEHLEKLKTNLLLDIHLHDHVETLYMDIRHKAIIQYTLPFISVDLNTMAAAFMTSVSMLEKEVAALITENKIQARIDSHNKILYARHADQRNATFQRVLQTGNEFERDVKSLLLRANLIKHDFNQRAGQRKM

SEQ ID NO: 711 - protein, 446 aa, Hordeum vulgare subsp. vulgare
MDVECEVSAAAAAAVTNGLGGGGQPSAAPVAAEQLDVEAYAAQYSGRTRVARLIFISERCGVEAVELEALRMAHDEARAREDTTLYLEAVAKINGRLAPRYRHDQAWVDSVNRRAEQRKEKLETELNGYRTNLIKESIRMGYNDIGDFFYGHGHLSEAFKSYIRTRDYCTTSKHIVQMCMHVILVSIELGQFAHVINYVSKAEQTPDTLDAVIVAKLRAAAGLANLETKKYKLAARKFLETGPELGSNYSEVITPQDVAVYGVLCALASFDRSELKSKVIDNINFRNFLELVPEVRELVNDFYASRYGSCLEHLEKLKPNLLLDIHLREHLETLYNDIRHKAIVQYTIPFISVDLNTMASAFKSSVSMLEKELAALITENKIQARIDSHNKILYARHADQRNATFQRALQTGNEFERDIKAMLLRANIIKHDFTQKNWPGPRKMNL

SEQ ID NO: 712 - protein, 436 aa, Hordeum vulgare subsp. vulgare
MDVEDELPTAPAPADGGESSHALVSGDQFDVEAYAAQYSGRTRVARLLFIAEKCGSEQMRLDALRLAYDWALKGEDTALHRDISVRIAGRLGSRYAVDQAWSDAVERRALLRKDKLDSELNVYRTNLIKESIRMGYNDLGDFHYAQGHLSEAFKSYIRTRDYCTTSKHVVQMCLNVILVSIELGQFMHVSNYVIKAEQTPDDMDPITAAKLRSAAGLAYMETNKYKLAARKFIETGSELRTNYSEVIAPQDVAVYGALCALASFDRSELKSKVIDNYNFRNFLELVPEVRELVNDFYASRYGSCLGYLEKLKSNLLLDMHLHEHIETLYKDIRHKAIIQYTFPFISVDLNLMAVAFQTSVSLLEKELAALITDNKIQARIDSHNKILYASHADQRNATFQRALQTGNEFERDVKSMLLRANLLKHEYSQKAAEKKL

SEQ ID NO: 713 - protein, 441 aa, Vitis vinifera
MEGEEESSAGAMIDEIYSNGGDAKRNRPIISGEALDIEAYASLYSGRTKITRLLFIADRCENRQMQMEAYRMAYDEIKKGENTQLYREVVQKIDGRLGPQYGLDLVWTESVERRADQRKEKLENELNAYRTNLIKESIRMGYNDFGDFYYAHGLLADAFKNYVRTRDYCTTSKHIIHMCLNAILVSIEMGQFTHVTSYVSKAEQTPEALDPVTVAKLRCAAGLAHLEAKKYKLAARKFLETGAELGNNYTEVIAPQDVATYGGLCALASFDRTELKNKVIDNLNFRNFLELVPEVRELIHDFYSSHYASCLDYLGNLKTNLLLDIHLHDHVEMLYNQIRHKALIQYTHPFVSVDLRMMANAFKTSVAGLEKELEALITDNQIQARIDSHNKILYARHADQRNATFQRVLQTGNEFDRDVRAMLLRANLLKHEYNLRASRKP

SEQ ID NO: 714 - protein, 451 aa, Vitis vinifera
  misc_feature (24)..(24): Xaa can be any naturally occurring amino acid
MEGEEESSAGAMIDEIYSNGGDAXRNRPIISGEALDIEAYASLYSGRTKITRLLFIADRCENRQMQMEAYRMAYDEIKKGENTQLYREVVQKIDGRLGPQYGLDLVWTESVERRADQRKEKLENELNAYRTNLIKESIRMGYNDFGDFYYAHGLLADAFKNYVRTRDYCTTSKHIIHMCLNAILVSIEMGQFTHVTSYVSKAEQTPEALDPVTVAKLRCAAGLAHLEAKKYKLAARKFLETGAELGNNYTEVIAPQDVATYGGLCALASFDRTELKASIECFSFSINKVIDNLNFRNFLELVPEVRELIHDFYSSHYASCLDYLGNLKTNLLLDIHLHDHVEMLYNQIRHKALIQYTHPFVSVDLRMMANAFKTSVAGLEKELEALITDNQIQARIDSHNKILYARHADQRNATFQRVLQTGNEFDRDVRAMLLRANLLKHEYNLRASRKP

SEQ ID NO: 715 - protein, 491 aa, Sorghum bicolor
MAGGRSAEHQLLSRIAAGDGHGENSSYFDGWKAYDMNPFDLHRNRDGVIQMGLAENQLSLDLIEQWSMEHPEASICTAQGASEFRRIANFQDYHGLPEFREAMAKFMGQVRGGKVTFDPDRVVMSGGATGAQDTLAFCLADPGDAYLVPTPYYPAFDRDCCWRSGVKLLPIECHSSNNFTLTREALVWAYDDARRQGIRVRGILITNPSNPLGTTMDRATLAMLATFATEHRVHLICDEIYAGSVFAKPDFVSIAEVIEHDVPGCNRDLIHIAYSLSKDFGLPGFRVGIVYSYNDGVVACARKMSSFGLVSSQTQHFLAKMLSDGEFMARFLAESARRLAARHERFTEGLREVGIACLPGNAGLFSWMDLRGMLRDKTPDAELELWRVIIHEVKLNVSPGTSFHCNEPGWFRVCHANMDDDTMEVALRRIHHFVRQHQQQQQQQSKAKAERWAATRRLRLSLPRRGAASHLAISSPLALLSSPQSPMVHAS

SEQ ID NO: 716 - protein, 487 aa, Saccharum hybrid cultivar SP80-3280
MAGGSSAEHHLLSRIAAGDGHGENSSYFDGWKAYEMNRFDLRDNRDGIIQMGLAENQLSLDLIEQWIMEHPEASICTAQGASEFRRIANYQDYNGLPEFREAMAKFMGQVRGGKVTFDPDRVVMSGGATGAQDTLAFCLADPGDAYLVPTPYYPAFDRDCCWRSGVKLLPIECHSANNFTLTQEALVSAYDDARRQGIRVKGILVTNPSNPLGTIMDRATLAMLATFATEHRVHLICDEIYAGSVFAKPDFVSIAEVIERDVPGCNRDLIHIAYSLSKDFGLPGFRVGIVYSYNDDVVACARKMSSFGLVSSQTQNFLAKMLSDAEFMARFLAESARRLAARHDRFIAGLREVGIACLPGNAGLFSWMDLRGMLRDKTHDAELELWRVIIHKVKLNVSPGTSFHCNEPGWFRVCHANMDDETMEVALDRIRCFVRQHQQSKAKAERWAATRPLRLSLPRRGGATPSHLAIPSPLALLSPQSPMVHAS

SEQ ID NO: 717 - protein, 485 aa, Zea mays
MAGGSSAEQLLSRIASGDGHGENSSYFDGWKAYDMDPFDLRHNRDGVIQMGLAENQLSLDLIEQWSMEHPEASICTAQGASQFRRIANFQDYHGLPEFREAMAKFMGQVRAGKVTFDPDRVVMCGGATGAQDTLAFCLADPGDAYLVPTPYYPAFDRDCCWRSGVKLLPIECHSSNNFTLTREALVSAYDGARRQGVRVKGVLITNPSNPLGTTMDRATLAMLARFATEHRVHLICDEIYAGSVFAKPDFVSIAEVIERDVPGCNRDLIHIAYSLSKDFGLPGFRVGIVYSYNDDVVACARKMSSFGLVSSQTQHFLAKMLSDAEFMARFLAESARRLAARHDRFVAGLREVGIACLPGNAGLFSWMDLRGMLRDKTHDAELELWRVIVHKVKLNVSPGTSFHCNEPGWFRVCHANMDDETMEVALDRIRRFVRQHQHKAKAERWAATRPMRLSLPRRGGATASHLPISSPMALLSPQSPMVHAS

SEQ ID NO: 718 - protein, 486 aa, Zea mays
MAGSSAEQLLSRIAAGDGHGENSSYFDGWKAYDMNPFDLRHNRDGVIQMGLAENQLSLDLIEQWSVDHPEASICTAQGAPQFRRIANFQDYHGLPEFREAMAKFMGQVRGGKVTFDPDRVVMCGGATGAQDTLAFCLADPGDAYLVPTPYYPAFDRDCCWRSGVKLLPIECHSSNNFTLTREALVSAYDGARRQGVRVRGILITNPSNPLGTTMDRGTLAMLAAFATERRVHLICDEIYAGSVFAKPGFVSIAEVIERGDAPGCNRDLVHIAYSLSKDFGLPGFRVGIVYSYNDDVVACARKMSSFGLVSSQTQHFLAMMLADAEFMARFLAESARRLAARHDRFVAGLREVGIACLPGNAGLFSWMDLRGMLREKTHDAELELWRVIVHRVKLNVSPGTSFHCNEPGWFRVCYANMDDDTMEVALDRIRRFVRQHQHSKAKAERWAATRPLRLSLPRRGATTASHLAISSPLALLSPQSPMVHAS

SEQ ID NO: 719 - protein, 486 aa, Zea mays
MAGSSAEQLLSRIAAGDGHGEISSYFDGWKAYDMNPFDLRHNRDGVIQMGLAENQLSLDLIEQWSVDHPEASICTAQGAPQFRRIANFQDYHGLPEFREAMAKFMGQVRGGKVTFDPDRVVMCGGATGAQDTLAFCLADPGDAYLVPTPYYPAFDRDCCWRSGVKLLPIECHSSNNFTLTREALVSAYDGARRQGVRVRGILITNPSNPLGTTMDRGTLAMLAAFATERRVHLICDEIYAGSVFAKPGFVSIAEVIERGDAPGCNRDLVHIAYSLSKDFGLPGFRVGIVYSYNDDVVACARKMSSFGLVSSQTQHFLAMMLADAEFMARFLAESARRLAARHDRFVAGLREVGIACLPGNAGLFSWMDLRGMLREKTHDAELELWRVIVHRVKLNVSPGTSFHCNEPGWFRVCYANMDDDTMEVALDRIRRFVRQHQHSKAKAERWAATRPLRLSLPRRGATTASHLAISSPLALLSPQSPMVHAS

SEQ ID NO: 720 - protein, 485 aa, Zea mays
MAGSSAEQLLSRIAAGDGHGENSSYFDGWKAYDTNPFDLRHNRDGVIQMGLAENQLSLDLIEQWSVDHPEASICTAQGAPQFRRIANFQDYHGLPEFREAMAKFMGQVRGRKVTFDPDRVVMCGGATGAQDTLAFCLADPGDAYLVPTPYYPAFDRDCCWRSGVKLLPIECHSSNNFTLTREALVSAYDGARRQGVRVRGILITNPSNPLGTTMDRGTLAMLAAFATERRVHLICDEIYAGSVFARPGFVSIAEVIERDAPGCNTDLVHIAYSLSKDFGLPGFRVGIVYSYNDDVVACARKMSSFGLVSSQTQHFLASMLSDAEFMARFLAESARRLAARHDRFVAGLREVGIACLPGNAGLFSWMDLRGMLRERTHDAELELWRVIVHRVKLNVSPGTSFHCNEPGWFRVCYANMDDDTMEVALDRIRRFVRQHQHSKAKAERWAATRPLRLSLPRRGATTASHLAIPSPLALLSPQSPMVHAS

SEQ ID NO: 721 - protein, 487 aa, Hordeum vulgare subsp. vulgare
MASKSAELLSRMAAGDGHGENSSYFDGWKAYDKNPFHLQDNPDGVIQMGLAENQLSLDLIEEWSKAHPEASICTAEGASQFKRIANFQDYHGLPEFRQAMAQFMGQVRGWKARFDPDRVVMSGGATGAQETLAFCLANPGEAFLVPTPYYPGFDRDCCWRSGVKLLPIECHSSNDFKITREAVVSAYESARSNGVRVKGILITNPSNPLGTTADRATLAMLATFATEHRVHLICDEIYAGSVFAKPEYVSIAEVIEHDVPGVVDRDLIHIAYSLSKDFGLPGFRVGIVYSYNDAVVSCARKMSSFGLVSSQTQLFLAKMLGDEEFMARFLGESARRLAARHELFTSGLREVGIGCLGGNAGLFTWMDLRGMLREKTAEAELELWRVIIRKVKLNVSPGTSFRCREPGWFRVCHANMDDETMGVALDRIRLFVRQHQQQKAKARRWAARGQLHLSLQRHGAMPSQYHALSSPMAALLSPQSPLVHAAS

SEQ ID NO: 722 - protein, 483 aa, Oryza sativa Japonica Group
MAYQGIDLLSTKAAGDDHGENSSYFDGWKAYDTNPFDLRHNRGGVIQMGLAENQLSLDLIEEWSKNHPEASICTPEGVSQFKRIANFQDYHGLPEFRKAMAQFMGQVRGGKATFDPDRVVMSGGATGAQETLAFCLANPGEAFLVPTPYYPAFDRDCCWRSGIKLLPIECHSFNDFRLTKEALVSAYDGARRQGISVKGILITNPSNPLGTITDRDTLAMLATFATEHRVHLVCDEIYAGSVFATPEYVSIAEVIERDVPWCNRDLIHVVYSLSKDFGLPGFRVGIIYSYNDAVVAAARRMSSFGLVSSQTQYFLARMLSDEEFIGRFLQESKCRLVARHERFTSGLREVGIGCLRGNAGLFSWMDLRRMLREKTAEAELELWRVIVHQVKLNVSPGTSFHCREPGWFRVCHANMDDETMEVALGRIHDFVRQHQQRRVKAERWAANRQLRLSLPHHHHLSPAHLSSPLALLSPQSPMVRATS

SEQ ID NO: 723 - protein, 483 aa, Oryza sativa Indica Group
MACQGIDLLSTKAAGDDHGENSSYFDGWKAYDTNPFDLRHNRGGVIQMGLAENQLSLDLIEEWSKNHPEASICTPEGVSQFKRIANFQDYHGLPEFRKAMAQFMGQVRGGKATFDPDRVVMSGGATGAQETLAFCLANPGEAFLVPTPYYPAFDRDCCWRSGIKLLPIECHSFNDFRLTKEALVSAYDGARRQGISVKGILITNPSNPLGTITDRDTLAMLATFATEHRVHLVCDEIYAGSVFATPEYVSIAEVIERDVPWCNRDLIHVVYSLSKDFGLPGFRVGIIYSYNDAVVAAARRMSSFGLVSSQTQYFLARMLSDEEFIGRFLQESKCRLVARHERFTSGLREVGIGCLRGNAGLFSWMDLRRMLREKTAEAELELWRVIVHQVKLNVSPGTSFHCREPGWFRVCHANMDDETMEVALGRIHDFVRQHQQRRVKAERWAANRQLRLSLPHHHHLSPAHLSSPLALLSPQSPMVRATS

SEQ ID NO: 724 - protein, 475 aa, Triticum aestivum
MAAGDGHGENSSYFDGWKAYDMNPFHPQDNRGGVIQMGLAENQLSLDLIEEWSKAHPEASICTAEGASQFKRIANFQDYHGLPEFRQAMAQFMGQVRGWKARFDPDRVVMSGGATGAQETLAFCLANPGEAFLVPTPYYPGFDRDCCWRSGVKLLPIECHSSNDFRITREAVVAAYEGARSSGVRVKGILITNPSNPLGTTADRATLAMLATFATEHRVHLICDEIYAGSVFAKPEYVSIAEVIEHDAPGADRDLIHIAYSLSKDFGLPGFRVGIVYSYNDAVVACARKMSSFGLVSSQTQLFLAKMLGDEEFMSRFLRESARRLAARHELFTSGLREVGIGCLGGNAGLFSWMDLRGMLREKTAEAELELWRVIIRKVKLNVSPGTSFHCGEPGWFRVCHANMDDETMGVALSRIRDFVRQHQQQKAKAQRWAARSHLHLSLQRHGPMASQYHALSSPMAALLSPQSPLVHAAS

SEQ ID NO: 725 - protein, 251 aa, Zea mays
MANEFPDEVLKSVFPLLDGKDLVFCMLVCRQWHEIARDDYFWKCICSRKWPSICKQPPSGANYKKLYLTFSKPREMQNLPVPRLTFEDIVFYIDMWLEGSLIFSQAVSGRTLRAGLQGAPPPGIPDILAAHLSSQDCILMLEVEPKLAVPMGPAITVSVLANRKDSNKMACIINKSTFDYIDSNAARALAYEYLRFSPRHPFTSDIRAWMSLLFLCKGANTIEVFGIELDFCDAAKSEKEILWLLDMLDWK

SEQ ID NO: 726 - protein, 251 aa, Zea mays
MANEFPDEVLKSVFPLLDGKDLVFCMLVCRQWHEIAKDDYFWKCICSRKWPSICKQPPSGANYKKLYLTFSKPREMQNLPVPRLTFEDIVFYIDMWLEGSLIFSQAVSGRTLRAGLQGAPPPGIPDILAAHLSSQDCILMLEVEPKLAVPMGPAITVSVLANRKDSNKMACIINKSTFDYIDSNAARALAYEYLRFSPRHPFTSDIRAWMSLLFLCKGANTIEVFGIELDFCDAAKSEKEILWLLDMLDWK

SEQ ID NO: 727 - protein, 251 aa, Zea mays
MANEFPDEVLKSVFPLLDGKDLVFCMLVCRQWHEIARDDYFWKCICSRKWPSICKQPPSGANYKKLYLTFSKPREMQNLPVPRLTFEDIVFYIDMWLEGSLIFSQAVSGRTLRAGLQGAPPPGIPDILAAHLSSQDCILMLEVEPKLAVPMGPAITVSVLANRKDSNKMACIINKSTFDYIDSNAARALAYEYLRFSPRHPFTSDIRAWMSLLFLCKGANTIEVFGIELDFCDAAKSEKEILCLLDMLDWK

SEQ ID NO: 728 - protein, 251 aa, Zea mays
MANEFPDEVLKSVFPLLDGKDLVFCMLVCRQWHEIARDDYFWKCICSRKWPSICKQPPSGANYKKLYLTFSKPREMQNLPVPRLTFEDIVFYIDMWLEGSLIFSQAVSGRTLRAGLQGAPPPGIPDILAAHLSSQDCILMLEVEPKLAVPMGPAITVSVLANRKDSNKMACIINKSTFDYIDSNAARALAYEYLRFSPRHPFTSDIRAWMSLLFLCKGANTIEVFGIELDFCDAAKSEKEILWLLDMLHRQ

SEQ ID NO: 729 - protein, 249 aa, Zea mays
MSFLMKFLKSVFPLLDGKDLVFCMLVCRQWHEIARDDYFWKCICSRKWPSICKQPPSGANYKKLYLTFSKPREMQNLPVPRLTFEDIVFYIDMWLEGSLIFSQAVSGRTLRAGLQGAPPPGIPDILAAHLSSQDCILMLEVEPKLAVPMGPAITVSVLANRKDSNKMACIINKSTFDYIDSNAARALAYEYLRFSPRHPFTSDIRAWMSLLFLCKGANTIEVFGIELDFCDAAKSEKEILWLLDMLDWK

SEQ ID NO: 730 - protein, 250 aa, Sorghum bicolor
MASEFPDEVLKSVFPLLDGKDLVFCMLVCRQWREVAKDDYFWKCICSRKWPSICKLPPSDTNYKKLYLTFSKPREMQNLPVPRLTFEDIVFYIDMWLEGSLIFSEAVSGSTLRAGLHCAPHGIPDILAAHLNSQDCILMLEVEPKLEIPLGPTITISVLAHRKDSNKMACIINKSTFDYIDSNASRSLAYEYLRFSPRHPFISDIRAWMSLLFLYKGANIIEVFGIELDFCDAARSENEILWLLDMLDWK

SEQ ID NO: 731 - protein, 250 aa, Oryza sativa Indica Group
MENGLSDEVLKAVFPLLDGKDLVFCMLVCRQWREIAKDDYFWKCICARKWPSICKQPPSDANYQKLYLTFSKPRTPQHLPVPKLTFEDLVFYIDMWLDGSLIFSQAVSGCILRGGLQNTPCGIPDVLVAHLTAPDCILMMEVEPKLEITMGPSITVSVLAHRKDTKKMACVINKSTFDYIDSNAARALAYEYLQFSPRYPFISDIRAWMSLLFLYKGTNVIEVFGIELDFCDAARSETEILWLLDMLDWK

SEQ ID NO: 732 - protein, 250 aa, Oryza sativa Japonica Group
MENGLSDEVLKAVFPLLDGQDLVFCMLVCRQWREIAKDDYFWKCICARKWPSICKQPPSDANYQKLYLTFSKPRTPQHLPVPKLTFEDLVFYIDMWLDGSLIFSQAVSGCILRGGLQNTPCGIPDVLVAHLTAPDCILMMEVEPKLEITMGPSITVSVLAHRKDTKKMACVINKSTFDYIDSNAARALAYEYLQFSPRYPFISDIRAWMSLLFLYKGTNVIEVFGIELDFCDAARSETEILWLLDMLDWK

SEQ ID NO: 733 - protein, 267 aa, Sorghum bicolor
MAAMTAYKYQAQAMMRDYLLADPLVPYTSVLIGVVLCKMAYDFTRILSSFYFKGYTSLTKIQRIEWNNRGMSSAHAIFITAVSLYLVMSTDLFSDRIKGPITFRNSIISTSALGVSVGYFITDLAMIFWLYPSLGGMEYVLHHTLSLVAIAYTMLSGEGQFYTYMVLISETTTPEINMRWFLDTAGLKKSNAYLVNGILMFVAWLVARIFLFMYVFYHIYLHYSQIMQMHAFGYYLTFVVPSVLFVMNTMWFMKILKGVMKTLAKWP

SEQ ID NO: 734 - protein, 267 aa, Zea mays
MAAMTAYKYQAQALMRDYLLADPLVPYTSVLIGIVLCKMAYDFTRILSSFYFKGYTLLTKIQRIEWNNRGMSSAHAIFITAVSLYLVMSTDLFSDRVKGPITFRYSIISTSALGVSVGYFITDLAMIFWLYPSLGGMEYVLHHTVSLVAIAYTMLSGEGQFYTYMVLISETTTPEINLRWFLDTAGLKKSSAYLVNGILMFVAWLVARIFLFMYVFYHIYLHYGQIMQMHAFGYYLTFVVPSVLFVMNTMWFMKILKGVMKTLAKWP

SEQ ID NO: 735 - protein, 268 aa, Zea mays
MKMATMTAYKYQAQALMRDYLLADLLVPYTSVLFGIVLCKAYDFTRILSSFYFKGYTLLTKIQRIEWNNRGMSSAHAIFITAVSLYIVTSTDLFSDCVKGPITFRNSIISTSALGVSVGYFITDLEMIFWLYPSLGGMEYVLHHTLSLVAIAYTMLSGEGQFYTYMVLISETTTPEINLRWFLDTAGLKKSSAYLVNGILMFVAWLVARIFLFMYVFYHIYLHYSQIMQMHAFGYYLTFVVPSVLFVMNTMWFMKILKGVMKTLAKWS

SEQ ID NO: 736 - protein, 266 aa, Oryza sativa Japonica Group
MAMTGYKYQAQELMRDYLLADPLVPYTSVLVGIALCKMAYDLTRVLSSFYFKGYSSLTKIQRVEWNNRGMSSAHAIFITAISLYLVMSTDLFSDRLKGPITFRNSIISTFALGVSVGYFIADLAMIFWLYPSLGGMEYIVHHTLSLVAIAYTMLSGEGQFYTYMVLISETTTPEINLRWFLDTAGLKKSSAYLVNGILMFVAWLVARILLFIYVFYHIYLHYSQVMQMHAFGYYLTFIVPSVLFVMNTMWFMKILKGVKKTLGKWS

SEQ ID NO: 737 - protein, 266 aa, Hordeum vulgare subsp. vulgare
MAMTAYSYQAQAMMRDYLLADPLVPYTSVLIGVFLCKMAYDLTRILSSFYFKGYSSLTKIQRVEWNNRGMSSAHAIFIAAVSVYLVASTDLFSDRLNGPITFRNSIISTSALGVSVGYFITDLAMIFWLYPSLGGMEYVLHHTLSLVAIAYTMLSGEGQFYTYMILISETTTPEINMRWFLDTAGLKKSSAYLINGILIFVVWLVARIFLFLYVFYHIYLHYSQIMKMHAFGYYLTLTVPSVLFVMNVMWFMKILKGVMKTLSKWS

SEQ ID NO: 738 - protein, 266 aa, Zea mays
MKMATMTAYKYQAQALMRDYLLADLLVPYTSVLFGIVLCKVAYDFTRILSSFYFKGYTLLTKIQRIEWNNRGMSSAHAIFITAVSLYIVTSTDLFSDCVKGPITFRNSIISTSALGVSVGYFITDLEMIFWLYPSLGGMEYVLHHTLSLVAIAYTMLSGEGQFYTYMVLISETTTPEINLRWFLDTAGLKKSSAYLVNGILMFVAWLVARIFLFMYVFYHIYLHYSQMHAFGYYLTFVVPSVLFVMNTMWFMKILKGVMKTLAKWS

SEQ ID NO: 739 - protein, 284 aa, Oryza sativa Japonica Group
MAMTGYKYQAQELMRDYLLADPLVPYTSVLVGIALCKMLNELVLTEEGKTRHKRYLAYDLTRVLSSFYFKGYSSLTKIQRVEWNNRGMSSAHAIFITAISLYLVMSTDLFSDRLKGPITFRNSIISTFALGVSVGYFIADLAMIFWLYPSLGGMEYIVHHTLSLVAIAYTMLSGEGQFYTYMVLISETTTPEINLRWFLDTAGLKKSSAYLVNGILMFVAWLVARILLFIYVFYHIYLHYSQVMQMHAFGYYLTFIVPSVLFVMNTMWFMKILKGVKKTLGKWS

SEQ ID NO: 740 - protein, 480 aa, Sorghum bicolor
MGQEGMGYSSKGGGGGGGGGAGGLPMTAPRPRGASPLHHHSRSRKIHRTFNNLKITVLCGLVTILVLRGTIGLNLSLPSQPSDADALADAKAVEDIDRILREIRSDSGPDPDDEGDFSAASGFNASALSATEADAAYAAAVGRYALGPKISDWDAQRRRWLARNPGFPATVAGGKPRIMLVTGSQPGPCDNPLGDHYLLKTTKNKIDYCRIHGIQIVHNLAHLDNELAGYWAKLPLLRRLMLSHPEVEWIWWMDSDALFTDMAFELPLSRYDGHNLIIHGYQDLLFEKHSWIALNTGSFLFRNCQWSLDLLDAWAPMGPKGFIRDQAGKVLTANLKGRPAFEADDQSALIYLLLSQKDKWMDKVFIENSYYLHGFWAGLVDKYEEMMENHHPGLGDERWPFVTHFVGCKPCGSYGDYPVERCLRSMERAFNFADNQVLRLYGFSHKGLESPKIKRTRDQTTRPINDVENLDMKAKISTVS

SEQ ID NO: 741 - protein, 478 aa, Zea mays
MGQEGMGYNSKGGGGGGGGGGGLPMTAPRPRGASPLHHSRSRKIHRTFNNLKITVLCGLVTILVLRGTIGLNLSLPSQPSDAEALADAKAVEDIDRILREIRSDSGPDPDDEGDFGAASGFNATALSATEAAAAYAAAVGKYALGPKISDWDAQRRRWLAQNPGFPATLAGGKPRIMLVTGSQPGPCDNPLGDHYLLKTTKNKIDYCRLHGIEIVHNLAHLDNELAGYWAKLPLLRRLMLSHPEVEWIWWIDSDALFTDMSFELPLSRYDGHNLIIHGYQDLLFEKHSWIALNTGSFLFRNCQWSLDLLDAWAPMGPKGFIRDQAGKVLTANLKGRPAFEADDQSALIYLLLSQKDKWMDKVFIENSYYLHGFWAGLVDKYEEMMENHHPGLGDERWPFVTHFVGCKPCGSYGDYPVERCLRSMERAFNFADNQVLRLYGFSHKGLESPKIKRFRDQTTRPINDVENLDMKAKISTIS

SEQ ID NO: 742 - protein, 478 aa, Hordeum vulgare subsp. vulgare
MGQEGMGYNSGKAGGGGGGALPMTAARARGASPLNTHHRSRKISRTFNNVKITVLCGLVTILVLRGTIGLNLSLPSQPSEADALAGAKAVEDIDRILREIRSDSDPSDPTDSELDSSSVLSNATALNTSEAAVAYAAAVGNYALGPNVSGWDEQRRRWLTQNQGFPATVPGGKPRILLVTGSQPGPCDNPLGDHYLLKSTKNKIDYCRFHDIEIVHNLAHLDKELAGYWAKLPLLRRLMLSHPEVEWIWWMDSDALFTDMAFELPLSRYDNHNLIIHGYQDLLVEKHSWIALNTGSFLFRNCQWSLDLLDAWAPMGPKGFIREEAGKILTAYLKGRPAFEADDQSALIYLLLSQKEKWMDKVYIENSYYLHGFWAGLVDKYEEMMENHHPGLGDERWPFVTHFVGCKPCGSYGDYPVDRCLKSMERAFNFADNQVLRLYGFAHKGLESPKIKRIRSQTTKPINDKENLDVKAKMPTTS

SEQ ID NO: 743 - protein, 480 aa, Oryza sativa Japonica Group
MGQEGMGYNNGKGGGGGGGGLPMTAPRPRGASPLSSHGHHHRSRKIHRTFNNVKITVLCGLVTILVLRGTIGLNLSLPNQPTDADALAGAKAVEDIDRILREIRSDGGADDDAAAAGDLAGSFNATALNATEAAAAYASAVERYALGPKISDWDGQRRRWLRQNPGFPSTVAGGKPRILLVTGSQPGPCDNPLGDHYLLKTTKNKIDYCRLHGIEIVHNLAHLDTELAGYWAKLPLLRRLMLSHPEVEWIWWMDSDALFTDMAFELPLSRYQDRNLIIHGYQDLLFEKHSWIALNTGSFLFRNCQWSLDLLDAWAPMGPKGFIRDEAGKILTANLKGRPAFEADDQSALIYLLLSQKEKWMNKVFIENSYYLHGFWAGLVDKYEEMMENHHPGLGDERWPFVTHFVGCKPCGSYGDYPVERCLRSMERAFNFADNQVLRLYGFAHKGLESPKIKRVRNQTTKPIDDKENLDVKAKISTTS

SEQ ID NO: 744 - protein, 361 aa, Zea mays
MQEALVSPANAGRLRFRSALELKPFAFGDQRLASPRYLNLNLNLGGADDALFRCSSPTFSPSFGFSSSPSPLATSSVSLSPTSSASLADDGCDGAGTDADADAATGHTLRLARLALQYQEVADRYELCLARLADAADDAAALRRENAELRNANADLTRRLALLSGIGKQVAAAAAAAEEARRLRFGEPKAVPAAKDCATEKPAVLPPKSISVRSIDFLLKMNQPKQVQPPATTPAASNRKHRASNPTKPSSRVYKGNGGEKKDEELPKEQHAAGGVELEVFNQGMLKTELCNKWEETGACPYGDQCQFAHGVAELRPVIRHPRYKTQVCRMVLAGEVCPYGHRCHFRHTLTPAERLHLACP

SEQ ID NO: 745 - protein, 351 aa, Zea mays
MQEALVSPANAGRLRSALELKPFAFGDQRLASPRYLNLASVAGGGGGDDALFRCSSPFSPSFGFSSPSPLATSSTISLSPSSSSSLVGDCDCDDDADADAATGHRLQLARLALQYQEVADRYELCLARLADAADEAAALRRENAELRVANGDLTRRLALLSGIGKQAAAAAIADEVRRLRFGEQKAAKERAPGKPAVLPKSISVRSNDYLKMNQPQQVQAPATPAEDNRKPRASNPTTNRSSRVYKGNGGDKRSEEPKEHRTAGGVELEVYNQGMLKTELCNKWEETGACPYGDQCQFAHGVAELRPVIRHPRYKTQVCRMVLAGEVCPYGHRCHFRHTLTPAERLHLPRP

SEQ ID NO: 746 - protein, 448 aa, Sorghum bicolor
MASLAIVLLLARISSSIAIPSNYISRSAEQQVIATVAPAIVPDIDGQSAQPFLTSPSGSYAAYLRRAVDGAAVGHGGDACYVQIQQAGASGSVWESDCTPVGGADACDLAFSPVGLELFAGGHSLWDTGVDADPGTLSLDDGGDMKIVSKEGVTVWTASGEPWTGQQCGAPLPPVSTAPSVEALPPPSTASASTKLVTPPAATLAGAGSTDFPVGDQPPPPPLDTLPDLPVQPPVDTAPEQPLPPPPASPDLPDLSMPPPPAYTTPDSPDQPLMAPPPADMLPDQPLYSSPPPAPATFGPQTPLLPPFGVPLAAPPTGDTIPGTTTTPSGEPGSPGSVPFSGPSPVGVPHPHGHPHQLPLGASPPLPDALAPGGVHGAGAGAGQPGAPFGHGQQQAGQGVFGQQPQLLNGEGQPLEDSAGGWSRTRSESGRVAACMALFALVTLGFGF

SEQ ID NO: 747 - protein, 448 aa, Zea mays
MAFLTILLLARISSSIAISSNYISRSAEQQVIATVAPAIVPDIDGQGAQPFLTSPSGSYAAYLRRAVDGAGGLGGDACYVQVQQDGASGSVWESDCTPVGGADACDLAFSPVGLELFAGGQSLWDTGVDADPGTLSLDDGGDMKIVSKEGVTVWTASSEPWTGQQCGAPLPVSTTAPSMEALPPPPSTATATASTKLVTPPAATLAGAGSAVSPYGDQPVVPPPVDTLPDFPGQPPVDTAPEQPLPPPPADASPALPDLSLPPPPAYTPPDSPDQPLLAPPPADMLPDEPLYSSPPPAPATFGPQTPLPPFGVPLAAPPTGDTVPDTATPSGEPGSPGRVPFSGPSPAGMPRQHGHPHQQPLVGSPPLPDALAPGVHGAGAGQPGTPFGHGQQQAGQGVFGQQPQLLNGEGQPLEDSAAGGWSRTRSESGRVAACVALFGLMTLGFAF

SEQ ID NO: 748 - protein, 579 aa, Sorghum bicolor
MASTFGATSTVGLMAAPAGKNVRLQRRANFRVKAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPVQITRGIEKTAKALVEELRKLSKDVEDSELADVAAVSAGNNYEIGNMIAEAMSKVGRKGVVTLEEGRSSENFLYVVEGMQFDRGYISPYFVTDSEKMSAEYENCKLLLVDKKITNARDLINVLEEAIRGAYPILIIAEDIEQEALATLVVNKLRGSLKIAAIKAPGFGERKTQYLDDIAILTGATVIRDEVGLSLDKADKSVLGTAAKVVLTKESTTIVGDGSTQEEVTKRVAQIKNLIEAAEQEYEKEKLNERIAKLAGGVAVIQVGAQTETELKEKKLRVEDALNATKAAVEEGIVVGGGCTLLRLAAKVDAIKDTLENDEQKVGAEIVRRALSYPLKLIAKNAGVNGSVVTEKVLSNDNFKYGYNAATGQHEDLMAAGIIDPTKVVRCCLEHAASVAKTFLTSDVVVVDIKEPEAAPLANPMDNSGYGY

SEQ ID NO: 749 - protein, 600 aa, Zea mays
MCLLRSFSHANVTPAAHAVEDMASTFGATSTVGLMAAPTGKNVRLQRRANFRVKAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPVQITRGIEKTAKALVEELRKLSKEVEDSELADVAAVSAGNNYEIGNMIAEAMSKVGRKGVVTLEEGKSSENFLYVVEGMQFDRGYISPYFVTDSEKMTAEYENCKLLLVDKKITNARDLINVLEEAIRGAYPILIIAEDIEQEALATLVVNKLRGSLKIAAIKAPGFGERKTQYLDDIAILTGATVIRDEVGLSLDKADKSVLGTAAKVVLTKESTTIVGDGSTQEEVTKRVAQIKNLIEAAEQEYEKEKLNERIAKLAGGVAVIQVGAQTETELKEKKLRVEDALNATKAAVEEGIVVGGGCTLLRLAAKVDAIKDTLENDEQKVGAEIVRRALSYPLKLIAKNAGVNGSVVTEKVLSNDNFKYGYNAATGQYEDLMAAGIIDPTKVVRCCLEHAASVAKTFLTSDVVVVDIKEPEAAPVANPMDNSGYGY

SEQ ID NO: 750 - protein, 579 aa, Zea mays
MASTFGATSTVGLMAAPTGKNVRLQRRANFRVKAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPVQITRGIEKTAKALVEELRKLSKEVEDSELADVAAVSAGNNYEIGNMIAEAMSKVGRKGVVTLEEGKSSENFLYVVEGMQFDRGYISPYFVTDSEKMTAEYENCKLLLVDKKITNARDLINVLEEAIRGAYPILIIAEDIEQEALATLVVNKLRGSLKIAAIKAPGFGERKTQYLDDIAILTGATVIRDEVGLSLDKADKSVLGTAAKVVLTKESTTIVGDGSTQEEVTKRVAQIKNLIEAAEQEYEKEKLNERIAKLAGGVAVIQVGAQTETELKEKKLRVEDALNATKAAVEEGIVVGGGCTLLRLAAKVDAIKDTLENDEQKVGAEIVRRALSYPLKLIAKNAGVNGSVVTEKVLSNDNFKYGYNAATGQYEDLMAAGIIDPTKVVRCCLEHAASVAKTFLTSDVVVVDIKEPEAAPVANPMDNSGYGY

SEQ ID NO: 751 - protein, 601 aa, Oryza sativa Japonica Group
MASTFGATSTVGLMAAPTGIVSDKKPSSLSSVSSVSVASRPRNARLQRKCNFRVKAAKELYFNKDGSAIKKLQTGVNKLADLVGVTLGPKGRNVVLESKYGSPRIVNDGVTVAREVELEDPVENIGAKLVRQAAAKTNDLAGDGTTTSVVLAQGLIAEGVKVVAAGANPVQITRGIEKTAKALVEELKKLSKEVEDSELADVAAVSAGNNYEIGNMIAEAMSKVGRKGVVTLEEGRSSENNLYVVEGMQFERGYISPYFVTDSEKMSAEYENCKLLLVDKKITNARDLINVLEEAIRGAYPILIIAEDIEQEALATLVVNKLRGSLKIAAIKAPGFGERKTQYLDDIAILTGATVIRDEVGLSLDKADKSVLGTAAKVVLNKESTTIVGDGSTQEEVTKRVAQIKNLIEAAEQEYEKEKLNERIAKLAGGVAVIQVGAQTETELKEKKLRVEDALNATKAAVEEGIVVGGGCTLLRLAARVDAIKDNLENDEQKVGAEIVRRALSYPLKLIAKNAGVNGSVVTEKVLSNDNFKFGYNAATGQYEDLMAAGIIDPTKVVRCCLEHAASVAKTFLTSDVVVVEIKEPEPAPVTNPMDNSGYGY

SEQ ID NO: 752 - protein, 588 aa, Oryza sativa Japonica Group
MASTFGATSTVGLMAAPTGIVSDKKPSSLSSVSSVSVASRPRNARLQRKCNFRVKAAKELYFNKDGSAIKKLQTGVNKLADLVGVTLGPKGRNVVLESKYGSPRIVNDGVTVAREVELEDPVENIGAKLVRQAAAKTNDLAGDGTTTSVVLAQGLIAEGVKVVAAGANPVQITRGIEKTAKALVEELKKLSKEVEDSELADVAAVSAGNNYEIGNMIAEAMSKVGRKGVVTLEEGRSSENNLYVVEGMQFERGYISPYFVTDSEKMSAEYENCKLLLVDKKITNARDLINVLEEAIRGAYPILIIAEDIEQEALATLVVNKLRGSLKIAAIKAPGFGERKTQYLDDIAILTGATVIRDEVGLSLDKADKSVLGTAAKVVLNKESTTIVGDGSTQEEAAEQEYEKEKLNERIAKLAGGVAVIQVGAQTETELKEKKLRVEDALNATKAAVEEGIVVGGGCTLLRLAARVDAIKDNLENDEQKVGAEIVRRALSYPLKLIAKNAGVNGSVVTEKVLSNDNFKFGYNAATGQYEDLMAAGIIDPTKVVRCCLEHAASVAKTFLTSDVVVVEIKEPEPAPVTNPMDNSGYGY

SEQ ID NO: 753 - protein, 598 aa, Oryza sativa Japonica Group
MASAFGSTSACGIKITPTAFATKKHLCLVPPPVVSLPRKNRPQRKCNFRVNAAKELYFNKDGLAIKKLQNGVNKLADLVGVTLGPKGRNVVLESKYGSPKIVNDGVTVAKEVELEDPVENIGAKLVRQAAAKTNDLAGDGTTTSVVLAQGMITEGVKVVAAGANPVQITRGIEKTAKALVSELQKMSKEVEDSELADVAAVSAGNNYEIGNMIAEAMNKVGRQGVVTLEEGKSAENNLYVVEGMQFDRGYISPYFVTDSEKMSVEYENCKLLLVDKKINNARDLITILEDAIRGGYPILIVTEDIEQEALATLVVNRLRGALKIAAIKAPGFGERKSQYLDDIATLTGGTVIREEVGLSLDKADRDVLGTAAKVVVTKDSTTIVGDGTTQDEVNKRVTQIKNQIEVAEQEYEKEKLNERIAKLSGGVAVIQVGAQTETELKEKKLRVEDALNATKAAVEEGIVVGGGCTLLRLASKVDAIIETLENDEQKVGAEIVRKSLSYPLKLIAKNAGVNGSVVTEKVLANDNFRYGYNAATGKYEDLMAAGIIDPTKVVRCCLEHAASVAKTFITSDAVVVDIKEPEKAAAAGNPMGGSGFGF

SEQ ID NO: 754 - protein, 608 aa, Vitis vinifera
MASAFTTMSSVGSLAAPGGRGMDKKLATSSDRLSSFASISSSSFGRRQNVVLRRTRSPRINAMAKDLYFNKDGSAIKKLQTGVNKLADLVGVTLGPKGRNVVLESKYGSPKIVNDGVTVAKEVELEDPVENIGAKLVRQAAAKTNDLAGDGTTTSVVLAQGLIAEGVKVVAAGANPVLITRGIEKTTKSLVAELKLISKEVEDSELADVAAVSAGNNHEVGNMIAEAMSKVGRKGVVTLEEGKSAENHLYVVEGMQFDRGYISPYFVTDSEKMAVEFENCKLLLVDKKITNARDLINVLEDAIRGGYPILIIAEDIEQEALATLVVNKLRGSLKIAALKAPGFGERKSQYLDDIAILTGGTVIRDEVGLTLDKAEKEVLGHAAKVVLTKDTTTIVGDGSTQEAVNKRVAQIRNLIEAAEQEYEKEKLNERIAKLSGGVAVIQVGAQTETELKEKKLRVEDALNATKAAVEEGIVVGGGCTLLRLASKVDAIKDTLDNDEEKVGADIVKRALSYPLKLIAKNAGVNGSVVSEKVLSSDNPKYGFNAATGKYEDLMAAGIIDPTKVVRCCLEHASSVAKTFLMSDCVVVEIKEPEPVVAGNPMDNSGYGY

SEQ ID NO: 755 - protein, 607 aa, Populus trichocarpa
MASTFTAMSSVGTLAAPNGRVMDKKFVFSSNKLSSFASISASRFGRPQNVVLPRSRPLKVNAAKELHFNKDGSAIKKLQTGVNKLADLVGVTLGPKGRNVVLESKYGSPKIVNDGVTVAKEVELEDPVENIGAKLVRQAAAKTNDLAGDGTTTSVVLAQGLIAEGVKVVAAGANPVLITRGIEKTTRALVNELKLMSKEVEDSELADVAAVSAGNNYEVGNMIAEAMSKVGRKGVVTLEEGKSADNSLYVVEGMQFDRGYISPYFVTDSEKMSVEYENCKLLLVDKKITNARDLISILEDAIRAGYPVLIIAEDIEQEALATLVVNKLRGALKIAALKAPGFGERKSQYLDDIAILTGGTVVREEVGLALDKVGKEVLGHASKVVLTKDTTTIVGDGSTQEAVNKRVAQIRNLIEAAEQDYEREKLNERIAKLSGGVAVIQVGAQTETELKEKKLRVEDALNATKAAVEEGIVVGGGCTLLRLASKVDAIKDSLENDEEKVGADIVKRALSYPLKLIAKNAGVNGSVVSEKVLSTDNPKFGYNAATGNYEDLMAAGIIDPTKVVRCCLEHASSVAKTFLMSDCVVVEIKEPESVPAGNPMDNSGYGY

SEQ ID NO: 756 - protein, 605 aa, Ricinus communis
MASTFTAMSSVGSLVAPNVDKKFASTSNRLSSFASISGSAFGRRQNVVLRRSRSPKICAMAKDLHFNKDGSAIKKLQTGVNKLADLVGVTLGPKGRNVVLESKYGSPKIVNDGVTVAKEVELEDPVENIGAKLVRQAAAKTNDLAGDGTTTSVVLAQGLIAEGVKVVAAGANPVLITRGIEKTSKALVTELKSMSKEVEDSELADVAAVSAGNNYEVGNMIAEAMSRVGRKGVVTLEEGKSAENSLYVVEGMQFDRGYISPYFVTDSEKMAVEYENCKLLLVDKKITNARDLINILEDAIRGGYPILVIAEDIEQEALATLVVNKLRGALKIAALKAPGFGERKSQYLDDIAILTGGTVVREEVGLSLDKVGKEILGNASKVVLTKDTTTIVGDGSTQEAVTKRVAQIRNLIEAAEQDYEKEKLNERIAKLSGGVAVIQVGAQTETELKEKKLRVEDALNATKAAVEEGIVVGGGCTLLRLASKVDAIKDSLDNDEEKVGADIVKRALSYPLKLIAKNAGVNGSVVSEKVLSSDNPRFGYNAATGNYEDLMAAGIIDPTKVVRCCLEHASSVAKTFLMSDCVVVEIKEPEAVPAGNPMDNSGYGY

SEQ ID NO: 757 - protein, 600 aa, Arabidopsis lyrata subsp. lyrata
MASTFTATSSIGSMVAPNGHKSDKKLMNKLSSSSFGRRQSVCPRPRRSGSAIVCAAKELHFNKDGTTIRKLQAGVNKLADLVGVTLGPKGRNVVLESKYGSPRIVNDGVTVAREVELEDPVENIGAKLVRQAAAKTNDLAGDGTTTSVVLAQGFIAEGVKVVAAGANPVLITRGIEKTAKALVTELKKMSKEVEDSELADVAAVSAGNNDEIGNMIAEAMSKVGRKGVVTLEEGKSAENNLYVVEGMQFDRGYISPYFVTDSEKMSVEFDNCKLLLVDKKITNARDLVGVLEDAIRGGYPILIIAEDIEQEALATLVVNKLRGTLKIAALRAPGFGERKSQYLDDIAILTGATVIREEVGLSLDKAGKEVLGNASKVVLTKETSTIVGDGSTQDAVKKRVTQIKNLIEQAEQDYEKEKLNERIAKLSGGVAVIQVGAQTETELKEKKLRVEDALNATKAAVEEGIVVGGGCTLLRLASKVDAIKATLDNDEEKVGADIVKRALSYPLKLIAKNAGVNGSVVSEKVLSNDNVKFGYNAATGKYEDLMAAGIIDPTKVVRCCLEHAASVAKTFLMSDCVVVEIKEPEPVPVGNPMDNSGYGY

SEQ ID NO: 758 - protein, 167 aa, Sorghum bicolor
MEAAGAASPPTEPPPTHPAVAPLAFLLGKWRGEGEGSFPTISSFRYGEELLFSHHPSKPVISYTQKTWKAASGEPMHAESGYWRPRPDGSVDVVIAQSTGLAEVQKGSYDAEKKTVTLQSELVGNASKVKQITRTFQVADGELSYVVQMATITTSLQPHLRALLKRI

SEQ ID NO: 759 - protein, 167 aa, Zea mays
MEATGAASQPSAPQTTHPAVAPLAFLLGKWRGEGEGSFPTISSFRYGEELLFSHHPSKPVISYTQKTWKTASGEPMHAESGYWRPRPDGSVDVVIAQSTGLAEVQKGSFDAEKKTVTLQSELVGNASKVKQITRTFQVADGELSYVVQMATITTSLQPHLKALLRRI

SEQ ID NO: 760 - protein, 179 aa, Oryza sativa Indica Group
MTSRNKSRNRNGDPEEMEGGGATAPTAPHPAVAPLAFLLGKWRGEGEGSFPTISPFRYGEELLFSHHPSKPVISYTQRTWKAASGEPMHAESGYWRPRPDGSVEVVISQSTGLAEVQKGSFDAEKKTVTLQSELVGNASKVKQITRVFQLVDGELSYVVQMATITTSLQPHLKALLKKI

SEQ ID NO: 761 - protein, 164 aa, Triticum aestivum
MEAAGPPTQPPAPHPLVAPLSFLLGKWRGEGEGTFPSIAPFRYGEEILFSHHPSKPVISYTQRTWKAASGDPMHAESGYWRPRPDGSVEVVIAQSTGLTEVQTGSYDSEKKTVTLQSELIGNAAKVKQITRAFQVVDGELSYVVQMATITNSLQPHLKALLKRI

SEQ ID NO: 762 - protein, 163 aa, Oryza sativa Japonica Group
MEGGGATAPAAPHPAVAPLAFLLGKWRGEGEGSFPTISPFRYGEELLFSHHPSKPVISYTQRTWKAASGEPMHAESGYWRPRPDGSVEVVISQSTGLAEVQKGSFDAEKKTVTLQSELVGNASKVKQITRAFQLVDGELSYVVQMATITTSLQPHLKALLKKI

SEQ ID NO: 763 - protein, 176 aa, Hordeum vulgare subsp. vulgare
DQSENPTGDFKEMEPAGPPAQPPAPHPLVAPLSFLLGKWRGEGEGTFPTIAPFRYGEEILFSHHPSKPVISYTQRTWKTASGDPMHAESGYWRPRPDGSVEVVIAQSTGLTEVQTGSYDTEKKTVTLQSELIGNASKVKQITRAFQVVDGELSYIVQMATITNSLQPHLKALLKRI

SEQ ID NO: 764 - protein, 176 aa, Oryza sativa Japonica Group
MTSRNKSRNRNGDPEEMEGGGATAPAAPHPAVAPLAFLLGKWRGEGEGSFPTISPFRYGEELLFSHHPSKPVISYTQRTWKAASGEPMHAESGYWRPRPDGSVEVVISQSTGLAEVQKGSFDAEKKTVTLQSELVGNASKITRAFQLVDGELSYVVQMATITTSLQPHLKALLKKI

SEQ ID NO: 765 - protein, 358 aa, Zea mays
MQQQQPSVRAVTIPFADLKDRGKDLGGFIEEGFGPQGLGIVSIAGVPGYPELRKRLLRLAPRIVSLPDDVKKQLEDPDSRYHFGWSRVEEKFESERWDTAKGSYFANPVFDVPTTDDELVTRYPSYCRPNIWPKDHLPELEIAFKGLGKLMLEVGLMLAHHCDRYVIQRGVGQYIGESLEKTLARSRCPKGRLLYYFPKSFSKQDEVSSWCGWHTDYGFLTGLTCGLFTRKSEEVPCPDIGTGLYVRTRDNQVVKVTLVDDELVYQIGETAEILSRGHLCATPHCVKAPSSEDASDVGRSTFVLFIQPNWDEPLKLPSEIRYHQECIPPTRTLAYGEYSERVLASFSGKSVEQTLMPQ

SEQ ID NO: 766 - protein, 358 aa, Zea mays
MQQQQPSVRAVTIPFADLKDRGKDLGGFIEEGFGPQGLGIVSIAGVPGYPELRKRLLRLAPRIVSLPDDVKKQLEDPDSRYHFGWSRVEEKFESERWDTAKGSYLANPVFDVPTTDDELVTRYPSYCRPNIWPKDHLPELEIAFKGLGKLMLEVGLMLAHHCDRYVIQRGVGQYIGESLEKTLARSRCPKGRLLYYFPKSFSKQDEVSSWCGWHTDYGFLTGLTCGLFTRKSEEVPCPDIGTGLYVRTRDNQVVKVTLVDDELVYQIGETAEILSRGHLCATPHCVKAPSSEDASDVGRSTFVLFIQPNWDEPLKLPSEIRYHQECIPPTRTLAYGEYSERVLASFSGKSVEQTLMPQ

SEQ ID NO: 767 - protein, 413 aa, Sorghum bicolor
MVVEVGTAVGTRTTSTWPAGPAARRSSRGQVVSFAFAFALAPESSRRVRVRVRCRAMQQEERRPPTVRAVTIPFADLRETDKDLGGKIEEGLGPHGLGIITIADIPEFPELRKRLLRLAPRIANLPEEVKKQLEDPDSRYNFGWSHGKEKLESGKLDTFKGSFYANPVLDVPTTDDVLVSRYPSYCRPNIWPNENLPELEIAFKALGKLMMEVGLMLAHHCDRYVMGQGVGSYDGDSLEQTIARSRCHKGRLLYYFPRQFSKQIDVESVSSWCGWHTDHGSLTGLTCGLFTKNSVEVPCPDSAAGLYIRTRDNQVVKVVFDEDQLAYQIGETTEILSRGYLCATPHCVQAPNSENASNVDRSTFALFMQPDWNEKLKFPSEIPYHQELIPPNGTLTFGEYSERLVNKYYQTTT

SEQ ID NO: 768 - protein, 360 aa, Zea mays
MQQHEEEQERPPTVRAVTIPFADLRVPDRDLGDKIEEGLGPHGLGIVTIADVPEFPELRKRLLRLAPRIANLPEEVKKQLEDPDSRYNFGWSHGKEKLESGKLDTFKGSFYANPVLDVPTTDDVLVSRYPSYCRPNIWPNDNLPELEIAFKDLGKLMMEVGLMLAHHCDRYVMRQGVGSYDGDSLEQTIARSRCHKGRLLYYFPRQFSKQTDFESVSSWCGWHTDHGSLTGLTCGLFTKNSMEVPCPDSAAGLYIRTRDNQVVKVVFDEDQLAYQIGETTEILSRGYLCATPHCVQAPSSENASNVDRSTFALFMQPDWNEKLKFPSEIPYHQELIPPNGTLTFGEYSERLVDKYYQTTT

SEQ ID NO: 769 - protein, 341 aa, Zea mays
  misc_feature (100)..(101): Xaa can be any naturally occurring amino acid
  misc_feature (103)..(103): Xaa can be any naturally occurring amino acid
  misc_feature (112)..(112): Xaa can be any naturally occurring amino acid
MASTAFAAAKYFPAHLDSSPRIAPRRAAPTASLSFSPLSASPSSLLRLRSPCPSGPGGRLPPPPPPRSYGGGGGSGGDAADSGGGRRGGGILGLFLAGGXXRXAADPQFPFXVLMEELVGVTACVLGDMASRPNFGLNELDFVFSTLVVGSILNFVLMYLLAPTAAASSAASALPSHMFEPGAFSLGSRVATLVSKGATFAVVGFAAGLAGTALSNGLMAMRKRMDPAFETPNKPPPTLLNAATWALHMAGSSNLRYQTLNGVEYMLGKVAPAPVFKASVVVLRCLNNVLGGVSFVLLARLTGAQKSDKPATVAEEKERLIAVGNAVADAIGEARDGEEGK

SEQ ID NO: 770 - protein, 342 aa, Zea mays
MATTAFAAARFFPAHLDSSPRIAPHRVGPTANLSFSPLSANSSSLRRLHSPCPSGPGGRLPPPPRSYGGAGGSGDAANSGGGEGRRGGILGLLLAGWAARVAADPQFPFKVLMEELVGVTACVLGDMASRPNFGLNELDFVFSTLVVGSILNFVLMYLLAPTAGVAAAASSAASALPSHMFEPGAYSLGSRVATIMSKGATFAVVGFAAGLTGTAISNGLIAMRKRMDPAFETPNKPPPTLLNAATWALHMGVSSNLRYQTLNGIEYLLGKVAPAPVFKVSVVALRCMNNVLGGMSFVLLARLTGAQKSDKPATVAEEKERLIAVGNAAADAINEARHGEGK

SEQ ID NO: 771 - protein, 280 aa, Sorghum bicolor
MSFVFRGSRADIEAGGFPGFAPERRAMRIHAGSRPVNSNSLAFLLTVLVLFMVLNSHQMSPNLLLWLVLGVFLMATSLRMYATCQQLAHAAAANNFLGHTELRVHVPPTIALATRGRLQSLRLQLALLDREFDDLDYDTLRALDADNSPHTPSMSEEEINSLPVFKYKVQAQQGNAPAQKSDGPSQLSVSSTGSGNEKKQDGLKSDGTSKTPEDELTCSVCLEQVAVGDLLRSLPCLHQFHVNCIDPWLRQQGTCPICKHQVSDGWHATGNGEEDASYMV

SEQ ID NO: 772 - protein, 280 aa, Zea mays
MSFVFRGSRTDIEAGGFPGFAPERRAMRIHAGSRPVNSNSLAFLLTVLVLFMVLNSHQISPNLLLWLVLGVFLMATSLRMYATCQQLAHAAAANSFLGHTELRVHVPPSITLATRGRLQSLRLQLALLDREFDDLDYDTLRALDADNSPHAPSMSEEEINSLPVFKYKVQAQQRHPPARKSDGPSQLSVSSTGSGNEEKQDGLKADGTSKPSEDELTCSVCLEQVTVGDLLRSLPCLHQFHVNCIDPWLRQQGTCPICKHQVSDGWHATGNGEEDASYMV

SEQ ID NO: 773 - protein, 280 aa, Zea mays
MSFVFRGSRADIEAGGFTGFAPERRTMRIHAGSRPVNSNSLVFLLTVFVLFMVLNSHQMSPNLLLWIVLGAFLMATSLRMYATCQQLAHAAAANSFLGHTELRVHVPPTIALATRGQLQSLRLQLALLDREFDDLDYDTLRALDADNSLHVPSMSEEEINSLPVFKYKVQAQQGNAPARKSDEASQLSVSSTGSGNEKKQDGLKADGTGKTPQDELTCSVCLEQVMVGDLLRSLPCLHQFHVNCIDPWLRQQGTCPICKHQVSDGWHATGNGEEDASYMV

SEQ ID NO: 774 - protein, 280 aa, Zea mays
MSFVFRGSRADIEAGGFTGFAPERRTMRIHAGSRPVNSNSLVFLLTVFVLFMVLNSHQMSPNLLLWIVLGVFLMATSLRMYATCQQLAHAAAANSFLGHTELRVHVPPTIALATRGQLQSLRLQLALLDREFDDLDYDTLKALDADNSLHVPSMSEEEINSLPVFKYKVQAQQGNAPARKSDEASQLSVSSTGSSNEKKQDGLKADGTGKTTQDELTCSVCLEQVMVGDLLRSLPCLHQFHVNCIDPWLRQQGTCPICKHQVSDGWHATGNGEEDASYMV

SEQ ID NO: 775 - protein, 280 aa, Oryza sativa Japonica Group
MSFVFRGSRGDIEAGGFPGFAPERRAMRIHAGGRPVNSNLAFLVTVLMLFMVLNSHQMSPNFLVWLVLGVFLMATSLRMYATCQQLQAQAQAHAAAANGFLGHTELRVHVPPTIALATRGRLQSLRLQLALLDREFDDLDYDALRALDADNSPHAPSMSEEEINALPVFKYKVQAHQGSASFRKSDGPSQPSVSSTESGNEKKQDRFKADATDNTLEDELTCSVCLEQVVVGDLLRSLPCLHQFHANCIDPWLRQQGTCPVCKHRVSDGWHGEADASNMV

SEQ ID NO: 776 - protein, 281 aa, Hordeum vulgare subsp. vulgare
MSFVFRGSRSDIEAGGFPGFATERRAMRIHAGGRPVNSNSLAFLVTVLVLFMVLSSHQMSPNFLLWMVLGVFLLATSLRMYATCQQLQAQAQAHAADANGFLGRTELRVHVPPTIALASRGRLQSLRLQLALLDREFDDLDYDALRALDTDNSPHAPSMTEEEINTLPVFRYKFQAQQRSTPSRKSSDGPSEPLVSSPESGKEKKQDADATSKMTEDELTCSVCLEQVVAGDLLRSLPCLHQFHVNCIDPWLRQQGTCPICKHQVSDVWRGAGSGELDAMV

SEQ ID NO: 777 - protein, 280 aa, Triticum aestivum
MSFVFRCSRADIEAGGFPGFAAERRSMRIHAGGRPVNSNSLAFLVTVLVLFMVLSSHQMSPNFLLWMVLGVFLLATSLRMYATCQQLQAQSQAHAADGNGFPGRTELRVHVPPTIAHASRGRLQSLRLQLALLDREFDDLDYDALRALDTDNSPHAPSMTEEEINTLPVFRYKFQAQQRSTPSRKSSGGPSEPLVSSPESGKEKKQDADATSKMTDDELTCSVCLEQVVAGDLLRSLPCLHRFHVNCIDPWLRQQGTCLICKHQVSNVWHGAGSEMDAMV

SEQ ID NO: 778 - protein, 207 aa, Zea mays
MATSLRMYATCQQLAHAAAANSFLGHTELRVHVPPTIALATRGQLQSLRLQLALLDREFDDLDYDTLRALDADNSLHVPSMSEEEINSLPVFKYKVQAQQGNAPARKSDEASQLSVSSTGSGNEKKQDGLKADGTGKTPQDELTCSVCLEQVMVGDLLRSLPCLHQFHVNCIDPWLRQQGTCPICKHQVSDGWHATGNGEEDASYMV

SEQ ID NO: 779 - protein, 233 aa, Oryza sativa Japonica Group
MLFMVLNSHQMSPNFLVWLVLGVFLMATSLRMYATCQQLQAQAQAHAAAANGFLGHTELRVHVPPTIALATRGRLQSLRLQLALLDREFDDLDYDALRALDADNSPHAPSMSEEEINALPVFKYKVQAHQGSASFRKSDGPSQPSVSSTESGNEKKQDRFKADATDNTLEDELTCSVCLEQVVVGDLLRSLPCLHQFHANCIDPWLRQQGTCPVCKHRVSDGWHGEADASNMV

SEQ ID NO: 780 - protein, 379 aa, Zea mays
MVGMLLNAGRSNGRGGRRTSIQSPPQVLSSVPLLVYEYEDPAVVHPAGSTPTAAAKMLMYSLPERSIVYTHDSRPQAMEGNFFSTPQGWLVILGQVTSEASMWHPLTGETITLPPIHDDHYIPTNCKCLLTHNSAAHPDCAVVLLDVADPLMWFCRVNGGADRRWGQHTYDIGDYEFLDEFRTPSTPTKKVIGSVAALKGKLHFCFMESHQNKMCVVDLDFPSDHGHPPTAEFHEFDVSPEFGIKFPDGICSIHLVESMDELFAVCVFYVGFDPTNVSAARIFKMEDSCSEETVAWHRVDDIGDRAFLLTGTNMATWCSASTNNLKGSTLYFFLDFLLGDRDLYIYDVQEQSMETVQVHDQLDSKVVHTEPYWINVPPF

SEQ ID NO: 781 - protein, 379 aa, Zea mays
MVGMLLNAGRSNGRGGRRTSIQSPPQVLSSVPLLVYEYEDPAVVHPAGSTPTAAAKMLMYSLPERSIVYTHDSRPQAMEGNFFSTPQGWLVILGQVTSEASMWHPLTGETITLPPIHDDHYIPTNCKCLLTHNSAAHPDCAVVLLDVADPLMWFCRVNGGADRRWGQHTYDIGDYEFLDEFRTPSTPTKKVIGSVAALKGKLHFCFMESHQNRMCVVDLDFPSDHGHPPTVEFHEFDVSPEFGIKFPDGICSIHLVESMDELFAVCVFYVGFDPTNVSAARIFKMEDSCGEETVAWHRVDDIGDRAFLLTGTNMATWCSASTNNLKGSTLYFFLDFLLGDRDLYIYDVQEQSMETVQVHDQLDSKVVHTEPYWINVPPF

SEQ ID NO: 782 - protein, 378 aa, Zea mays
MVGMLLNAGRSNGRGGRRTSIQSPPQVLSSVPLLVYEYEDPAGSTPTAAAKMLMYSLPERSIVYTHDSRPQAMEGNFFSTPQGWLVILGHGEVTSEASMWHPLTGETITLPPIHDDHHIPTNCKCLLTHNSAAHPDCAVVLLDVADPLMWFCRVNGGADRRWGQHTYDIGDYEFPDEFRTPSTPTKNVIRSVAALKGKLHFCFMESHQNKMCVVDLDFPSDHGHPPTAEFHEFDVSPEFGIKFPDGVCSASIHLVESMDELFAVCVFYVGFDPTNVSAAGIFKMEDSCGEETVAWHRVDDIGDRAFLLMGTNMATWCSASTNNLKGSTLYFFLHFLLGDRDLYIYDVQEQSLETVQVHDQLDLKVVHTEPYWINVPPF

SEQ ID NO: 783 - protein, 368 aa, Zea mays
MGMLMNNDDSSSSRTSMHPRPQVLASLPLLVYEYEDHPNATTRMLIYSLPERSIVYTHNSSRPQMMMMEGNLSFSTPQGWLVILGQASEASIWHPLTGETITLPPIHGDHRIPDSCKCLLTRSSVAHPDCAVVLLDVNDPLMWFCRVNGGADRMWVQHAYDIGDHYFPEEFRTPSTPTKNVVDDVAALGGKLYFRFTESDQDFMGVFDFDFHGHTPAVEFYEFDVSEEFNLKFPEGVCSASIHLVESMDELFAVCIFYVDFDPTNISAAHIFKMEEICDEEPVAWHRVDDIGDRAFLLTGTNMSTWCSASTNNLKGNSLYFLGHLVAGHRNLCIYDIQEQSMEIVQVHDQEDMEIVRTPPYWINVPPC

SEQ ID NO: 784 - protein, 447 aa, Sorghum bicolor
MASPAPASLKDTVGSLDRDGFVGLLSKLIGETAHLQNDPPTHRPQEERVAQHVVDVLRPVSADTGGGPLLVRKISYVEGRSNVIVEYPGTVPGRVVSFVGMHMDVVPANASEWDFDPFSLTFDSEDKDKLCGRGTTDCLGHVALVAQLMRRLGEVKPPLKHSVIAVFIANEENSSVTGIGVDGLVKDGLLDKLKTGPLFWIDTADKQPCIGTGGMIPWHLMATGKLFHSGLAHKAINAMEMNMEALKVIQKRFYTDFPPHEKEKLYKFATPSTMKPTKWSYPGGGLNQIPGECTISGDVRLTPFYSTSHVIEKLKEYVEDINQRFETILDTRGPVSKYILPDENLQGRLEITFDGDVMNGVACNLESRGYHALCKATKEIVGQVEPYSITGSLPLIRELQDEGFDVQTAGYGLLKTYHAKNEYCLFSDMAQGFEVFLSIISQLEEEV

SEQ ID NO: 785 - protein, 447 aa, Zea mays
MASPASASLKEAVGSLDRDGFVGLLSNLIGETAHLQNDPPTYRPQEERVAQHVVDVLRPVSADTGGGPLLVRKISYAEGRSNVIVEYPGTVPGRVVSFVGMHMDVVPANGSEWDFDPFSLTFDSEDKDKLRGRGTTDCLGHVALVAQLMRRLGEVKPPLKHSVIAVFIANEENSSVTGIGVDGLVKDGLLDKLKTGPLFWIDTADKQPCIGTGGMIPWHLKATGKLFHSGLAHKAINAMEMNMEALKVIQKRFYTDFPPHEKEKVYKFATPSTMKPTKWSYPGGGLNQIPGECTISGDVRLTPFYSTSHVMEKLKEYVEDINERFETVLDTRGPVSKYILPDENLQGRLEITFDGDVMNGVACNLESRGYHALCKATKEIVGHVEPYSITGSLPLIRELQDEGFDVQTAGYGLLKTYHAKNEYCLFSDMAQGFQVFLSIISQLEEEV

SEQ ID NO: 786 - protein, 443 aa, Oryza sativa Indica Group
MASPSLRDAVGGLDRDPFVSLLGKLIGESRRLQNDPPALVPQEDLVAQHVVDALLPVSTETGGGPLVVRKVSYAEGRSNVIVEYPGTVPGRAISFVGMHMDVVPANPDEWDFDPFSLTFDSEDKDKLRGRGTTDCLGHVALVAQLMRRLGEVKPVLKHSVIAVFIANEENSLITGIGVDGLVKDGLLDKLKNGPLFWIDTADKQPCIGTGGVITWHLKAIGKLFHSGLAHKAINAMELNMEALKEIQTMFYNDFPPHEKEKLYKFATPSTIKPTKWSYPGGGLNQIPGECTISGDIRLTPFYSTTSVVKKLQEYVHDINENIEKLPTRGPVSKYVLPDENLRGRLEITIDEDIMNGVACNLESRGFQALCKATEEIVGHVEPYSITGSLPLIRELQDEGFDVQTAGYGLLKTYHAKNEYCLFSDMAQGFQVFLSIISQLEADV

SEQ ID NO: 787 - protein, 443 aa, Oryza sativa Japonica Group
MASPSLRDAVGGLDRDPFVSLLGKLIGESRRLQNDPPALVPQEDLVAQHVVDALLPVSMETGGGPLVVRKVSYAEGRSNVIVEYPGTVPGRAISFVGMHMDVVPANPDEWDFDPFSLTFDSEDKDKLRGRGTTDCLGHVALVAQLMRRLGEVKPVLKHSVIAVFIANEENSLITGIGVDGLVKDGLLDKLKNGPLFWIDTADKQPCIGTGGVITWHLKAIGKLFHSGLAHKAINAMELNMEALKEIQTMFYNDFPPHEKEKLYKFATPSTIKPTKWSYPGGGLNQIPGECTISGDIRLTPFYSTTSVVKKLQEYVHDINENIEKLPTRGPVSKYVLPDENLRGRLEITIDEDIMNGVACNLESRGFQALCKATEEIVGHVEPYSITGSLPLIRELQDEGFDVQTAGYGLLKTYHAKNEYCLFSDMAQGFQVFLSIISQLEADV

SEQ ID NO: 788 - protein, 348 aa, Sorghum bicolor
MPALALPTMESELSALAWATLLAPACAVYARFAARRLRPGIPRLAALFPTFPVLVYMPWMFSSLHLRLFSSFFHTWLAVNKLVLLALDLGPLHPRLPLLPFVLCAGLPIKVCRLRQQSQQHPPGAEFLRPCARSALLLSCLAMAYPYTGWLPLYALHYLYCVQIFLTLDLVFSCVMLVSAALMGGASLERQFNAPLAVASLNGFWGRQWNLMAVDLLRESAYEPVRARWGRDAGVLAAFLMSGLLHELLYWYLTLQQPRGEMLLFFMFHAAFQIAERWARAAGLWRPPRAVAYLVVTAFMVVTVSEMFFGPFVRAGTDVRLKEETMAVVELIWGARKYLLRPFRVPSS

SEQ ID NO: 789 - protein, 355 aa, Zea mays
MQALALPTMESELRALAWATLLTPACAVYARFAARRLRPGVPRLAALFPTFPVFVYMPWMFNSLHLRLFSTFFHTWLAINRLVLLALDLGPLHPRLPLLPFVLCAGLPIKVRLQQPTKNQASSSSSSSSPPSAEFLRPCARSVLLLSCLAMAYPYTRWLPLYALHYLYCVQIFLTLDLVFSSIALVSAALMGASLERQFSTPLAVTSLNSFWGRQWNLMAVDLLRESVYAPVRARWGRDVGVLAAFLMSGLLHEFLYWYLTLQQPRGEMLLFFMFHAAFQIAERRARAAGIWRPPRPAAYLLVTAFMVVTISEMFFAPFVRAGTDVRLTEETTAMVELIWGTRKYLSHPFRVASS

SEQ ID NO: 790 - protein, 354 aa, Zea mays
MQALALPTMESELRALAWATLLTPACAVYARFAARRLRPGVPRLAALFPTFPVFVYMPCMFSSLHLRLFSTFFHTWLAINRLVLLALDLGPLHPRLPLLPFVLCAGLPIKVRLQQPTKNQASSSSSSPPPSAEFLRPCVRSVLLLSCLAMAYPYTRWLPLYALHYLYCVQIFLTLDLVFSSIALVSAALMDASLERQFSTPLAVTSLNSFWGQQWNLMAVDLLRESVYAPVRARWGRDVGVLAAFLMSGLLHEFLYWYLTLQQPRGEMLLFFVFHAAFQIAERRARAAGLWRPPRAAAYLLVTAFMVVTISEMFFAPFVRAGTDVRLTEETTAMVELIWGTRKYLLHPFRVASS

SEQ ID NO: 791 - protein, 348 aa, Oryza sativa Japonica Group
MASELRAMAWTVLLVPACAWYARSACRRLRPGLPRLAALAPTFPVFVYLPCLFNSLHFRLFSTFFHTWLAINKLVLLALGIGPLHPSLPLVPFVLCASLPIKLRLSQQPPAAKRSPSSPPPPPLADFLRPCARSFFFLSCLFVAYPHTGWLPVYAVHFLYCVQVFLTLDLVLSSVALASATVLDAGLERQFSTPLAVASLNDFWGRQWNLMAVDLLRASAYEPVRARWGRDAGVLAAFLMSGLLHELLYLYLTLRRPRGEMVLFFMLHGVSQIAERWARAAGLWRPPKVAAYLLVSAFMVVTISELFFGPFMRAGADVRLMEEAAAMLQLIMGVSRRLLRPFGVVSSL

SEQ ID NO: 792 - protein, 348 aa, Oryza sativa Indica Group
MASELRAMAWTVLLVPACAWYARSACRRLRPGLPRLAALAPTFPVFVYLPCLFNSLHFRLFSTFFHTWLAINKLVLLALGIGPLHPSLPLVPFVLCASLPIKLRLSQQPPAAKRSPSSPPPPPLADFLRPCARSFFFLSCLFVAYPHTGWLPVYAVHFLYCVQVFLTLDLVLSSVALASATVLDAGLERQFSTPLAVASLNDFWGRQWNLMAVDLLRASAYEPVRARWGRDAGVLAAFLMSGLLHELLYLYLTLRRPRGEMVLFFMLHGVSQIAERWARAAGLWRPSKVAAYLLVSAFMVVTISELFFGPFMRAGADVRLMEEAAAMLQLIMGVSRRLLRPFGVVSSL

SEQ ID NO: 793 - protein, 352 aa, Hordeum vulgare subsp. vulgare
MQALGHPTSASELRALAWTTVLVPMCTVYARSASRRLRPGWPRLAALLPTFPVFIYLPCMFNSLHLRLFSTFFHTWLAANKLVLLAFDLGPLHPSLPLLPFILCAGLPIKLRAGPQPTEQSAPPGPPVADFLVPCGRSVLFLTGLALLFPHTGSLPLYVVHYLYCAQIFLTLDLVFSSVGLVAAAVLGSAMERQFRAPLVVASVNDFWGRQWNLMAVDLLRASAYKPVGARWGRDAGVFAAFLMSGVLHELLYWYMTLEPPTGEMLLFFTLQAVFHVAERWARVAGLWRPPKAVAYLVGTTLMVVTISELFFGPFIRAGIDVRMIQEAAEAVELVRGVAKRLIVRLFGAGSN

SEQ ID NO: 794 - protein, 417 aa, Sorghum bicolor
MVDVEEVGNKMQSQMRLHAEPEDDAAADLPLPALFDRASRIHALASSSALDQDGIRTGVDLLRRCDEMVSKLGLFSPNETKEDVSTANLKYLLVPYYLAEMTEKIAQEDRIPVLKASQDHLKEFIALCEVLELIPEDELELSRQKQPDTMANRRAQKVARFKRQKAAETKLQEIRERKERRGRSLRAAALSAPIEAGEEDDLEDDGEEEREAWLATISLALCKAFDLLDMLKKEEEMLLAVKERKAKDGNAFAREMLDERTKKAEAWHHNAANRVVYSKPADPITCATFAQDVIEGRASVSQAHEHKHQPLIFGPASLVGGGLTSERERMAAQVFQPSYRMPTMSIEEAGLREMKIMEKWQERTAEIMKEANSAWHKDGTSSAQEDEDAEEAKARAWDDWKDDNPRGAGNKKLTPCG

SEQ ID NO: 795 - protein, 416 aa, Zea mays
MVDVEETGNKLQSQMRLHAEPEDDAADLPLPALFDRASRLHALASSSALDQDGIRTGVDLLRRCDDMVSKLGLFSPNETKEDVSTANLKYLLVPYYLAEMTEKIAQEDRIPVLKTSQDHLKEFIALCEVLELIPEDELELSRQKQPDTMTNRRAQKVARFKRQKAAETKLQEIRERKERRGRSLRAAALSAPIEAGEEDDLENDGEEEREAWLATISLALCKAFDLLDMLKKEEEMLQAVKERKAKDGNAFAREMLDERTKKAETWHHNAANRVAYSKPADPITCATFAQDVIEGRASVSQAHEHKHQPLIFGPASIVGGGLTSERERMTAQVFQPSYRMPTMSIEEAGLREMKMMEKWQERTAELMKESTSAWHKDGSSSAQEDEDAEEEKARAWDDWKDDNPRGAGNKKLTPCG

SEQ ID NO: 796 - protein, 416 aa, Zea mays
MVDVEETGNKLQSQMRLHAEPEDDAADLPLPALFDRASRLHALASSSALDQDGIRTGVDLLRRCDDMVSKLGLFSPNETKEDVSTANLKYLLVPYYLAEMTEKIAQEDRIPVLKTSQDHLKEFIALCEVLELIPEDELELSRQKQPDTLTNRRAQKVARFKRQKAAETKLQEIRERKERRGRSLRAAALSAPIEAGEEDDLENDGEEEREAWLATISLALCKAFDLLDMLKKEEEMLQAVKERKAKDGNAFAREMLDERTKKAETWHHNAANRVAYSKPADPITCATFAQDVIEGRASVSQAHEHKHQPLIFGPASIVGGGLTSERERMTAQVFQPSYRMPTMSIEEAGLREMKMMEKWQERTAEVMKESTSAWHKDGSSSAQEDEDAEEEKARAWDDWKDDNPRGAGNKKLTPCG

SEQ ID NO: 797 - protein, 423 aa, Zea mays
MVDVEEVGNKMQSQMRLHAEPDDAAADLPLPALFDRASRLHALASSSALDQDGIRTGVELLRRCDEMVGRLGLFSPNETKDDVSTANLKYLLVPYYLAEMTEKMAQEDRIPVLKASQDHLKEFIALCEVLELIPEDELELSRQKQSDTMANRRAQKVARFKRQKAAETKLQEIRERKERRGRSLRATALSAPVEAGEEDDLEDDGEEEREAWLATISLAICKAFDLLDMLKKEEEMLLAVKERKAKDGNAFAREMLDERTKKAEAWHHKAASRVAYSKPADPITCATFAQDVIEGRASVSQAHEHKHQPLIFGPASLVGGGLTSERERMAAQVFQPSYRMPTMSIEEAGLREMKMMERWQERTAEMMREANSAWHKGGDSSSSSMPQGEGGDEDAEEAKARAWDDWKDDNPRGAGNKKLTPCG

SEQ ID NO: 798 - protein, 418 aa, Oryza sativa Indica Group
MVEVEEVSNKMQAQMRLHPAAAAEEDDADLPLPALFDKASHLHSLASSSSLDQEGIRKGVDLLRRCDEMVSKLGLFSSNETKDDVSTANLKYLLVPYYLGEMTERVAQEDRIPVLKASQDHLKEFISICEALELISEDELELSRQKQPDTMANRRAQKVARFKRQKAAETKLVEIKERKERRRRSLRAAALSAPIEAGEEDAFEDDGEEEREAWLATISLALCKAFDLLDMLKKEEEMLLAVKERQAKDGNAFAREMLDERTKKAEAWHHNAANRAPYSKPADPITCATFAQDVIEGRASVSQAHEHKHQPLIFGPASLVGGGLTSERERMAAQVFQPSYRLPTMSIEEAGLREMKMMEKWQERTAKMIQESNSAWHKDGSRSAQEDEDAEEEKARAWDDWKDDNPRGAGNKKLTPCG

SEQ ID NO: 799 - protein, 418 aa, Oryza sativa Japonica Group
MVEVEEVSNKMQAQMRLHPAAAAEEEDADLPLPALFDKASHLHSLASSSSLDQEGIRKGVDLLRRCDEMVSKLGLFSSNETKDDVSTANLKYLLVPYYLGEMTERVAQEDRIPVLKASQDHLKEFISICEALELISEDELELSRQKQPDTMANRRAQKVARFKRQKAAETKLLEIKERKERRRRSLRAAALSAPIEAGEEDAFEDDGEEEREAWLATISLALCKAFDLLDMLKKEEEMLLAVKERQAKDGNAFAREMLDERTKKAEAWHHNAANRAPYSKPADPITCATFAQDVIEGRASVSQAHEHKHQPLIFGPASLVGGGLTSERERMAAQVFQPSYRLPTMSIEEAGLREMKMMEKWQERTAKMIQESNSAWHKDGSRSAQEDEDAEEEKARAWDDWKDDNPRGAGNKKLTPCG

SEQ ID NO: 800 - protein, 418 aa, Oryza sativa Japonica Group
MVEVEEVSNKMQAQMRLHPAAAAEEEDADLPLPALFDKASHLHSLASSSSLDQEGIRKGVDLLRRCDEMVSKLGLFSSNETKDDVSTANLKYLLVPYYLGEMTERVAQEDRIPVLKASQDHLKEFISICEALELISEDELELSRQKQPDTMANRRAQKVARFKRQKAAETKLLEIKERKERRRRSLRAAALSAPIEAGEEDAFEDDGEEEREAWLATISLALCKAFDLLDMLKKEEEMLLAVKERQAKDGNAFAREMLDERTKKAEAWHHNAGNRAPYSKPADPITCATFAQDVIEGRASVSQAHEHKHQPLIFGPASLVGGGLTSERERMAAQVFQPSYRLPTMSIEEAGLREMKMMEKWQERTAKMIQESNSAWHKDGSRSAQEDEDAEEEKARAWDDWKDDNPRGAGNKKLTPCG

SEQ ID NO: 801 - protein, 418 aa, Oryza sativa Japonica Group
MVEVEEVSNKMQAQMRLHPAAAAEEEDADLPLPALFDKASHLHSLASSSSLDQEGIRKGVDLLRRCDEMVSKLGLFSSNETKDDVSTANLKYLLVPYYLGEMTERVAQEDRIPVLKASQDHLKEFISICEALELISEDELELSRQKQPDTMANRRAQKAARFKRQKAAETKLLEIKERKERRRRSLRAAALSAPIEAGEEDAFEDDGEEEREAWLATISLALCKAFDLLDMLKKEEEMLLAVKERQAKDGNAFAREMLDERTKKAEAWHHNAANRAPYSKPADPITCATFAQDVIEGRASVSQAHEHKHQPLIFGPASLVGGGLTSERERMAAQVFQPSYRLPTMSIEEAGLREMKMMEKWQERTAKMIQESNSAWHKDGSRSAQEDEDAEEEKARAWDDWKDDNPRGAGNKKLTPCG

SEQ ID NO: 802 - protein, 418 aa, Oryza sativa Japonica Group
MVEVEEVSNKMQVQMRLHPAAAAEEEDADLPLPALFDKASHLHSLASSSSLDQEGIRKGVDLLRRCDEMVSKVGLFSSNETKDDISTANLKYLLVPYYLGEMTERVAQEDRIPVLKASQDHLKEFISICEALELISEDELEISRQKQPDTMANRRAQKVARFKRQKAAETKLLEIKERKERRRRSLRAAALSAPIEAGEEDAFEDDGEEEREAWLATISLALCKAFDLLDMLKKEEEMLPAVKERKAKDGNAFAREMLDERTKRAEAWHHNAANRAPYSKPADPITCATFAQDVIEGRASVSQAHEHKHQPLIFGPASLVGGGLTSERERMAAQVFQPSYRLPTMSIEEAGLREMKMMEKWQERTAKMIQESNSAWHKDGSRSAQEDEDAEEEKARGWDDWKDDNPRGAGNKKLTPCG

SEQ ID NO: 803 - protein, 423 aa, Zea mays
  misc_feature (85)..(85): Xaa can be any naturally occurring amino acid
  misc_feature (358)..(358): Xaa can be any naturally occurring amino acid
  misc_feature (364)..(364): Xaa can be any naturally occurring amino acid
  misc_feature (385)..(385): Xaa can be any naturally occurring amino acid
  misc_feature (390)..(390): Xaa can be any naturally occurring amino acid
MVDVEEVGNKMQSQMRLHADRMTPPPTSPSRRSSTGRRGFTPWPPAPPSTRMGSAPGLSCCGRCDEMVGRLGLFSPNETKDDVSXANLKYLLVPYYLAEMTEKMAQEDRIPVLKASQDHLKEFIALCEVLELIPEDELELSRQKQSDTMANRRAQKVARFKRQKAAETKLQEIRERKERRGRSLRATALSAPVEAGEEDDLEDDGEEEREAWLATISLAICKAFDLLDMLKKEEEMLLAVKERKAKDGNAFAREMLDERTKKAEAWHHKAASRVAYSKPADPITCATFAQDVIEGRASVSQAHEHKHQPLIFGPASLVGGGLTSERERMAAQVFQPSYRMPTMSIEEAGLREMKMMEXWQERTXEMMREANSAWHKGGDSSSSSXPQGEXGDEDAEEAKARAWDDWKDDNPRGAGNKKLTPCG

SEQ ID NO: 804 - protein, 357 aa, Sorghum bicolor
MASLTDLVNLDLSDCTDKIIAEYIWIGGSGIDLRSKARTVKGPITDPSQLPKWNYDGSSTGQAPGEDSEVILYPQAIFKDPFRKGDNILVMCDCYTPQGEPIPTNKRYNAAKVFSHPDVAAEVPWYGIEQEYTLLQKDVNWPLGWPVGGYPGPQGPYYCAAGADKAFGRDVVDAHYKACLYAGINISGINGEVMPGQWEFQVGPSVGISAGDEIWVARYILERITEIAGIVLSLDPKPIQGDWNGAGAHTNYSTKSMREAGGYEVIKKAIEKLGKRHTEHIAAYGEGNERRLTGRHETADINTFKWGVANRGASIRVGRDTEREGKGYFEDRRPASNMDPYVVTGMIAETTILWNGN

SEQ ID NO: 805 - protein, 357 aa, Saccharum officinarum
MASLTDLVNLDLSDCTDKIIAEYIWIGGSGIDLRSKARTVKGPITDPSQLPKWNYDGSSTGQAPGEDSEVILYPQAIFKDPFRKGDNILVMCDCYTPQGEPIPTNKRYNAAKVFSHPDVAAEVPWYGIEQEYTLLQKDVSWPLGWPVGGYPGPQGPYYCAAGADKAFGRDVVDAHYKACLYAGINISGINGEVMPGQWEFQVGPSVGISAGDEIWVARYILERITEIAGIVLSLDPKPIQGDWNGAGAHTNYSTKSMREPGGYEVIKKAIEKLGKRHKEHIAAYGEGNERRLTGRHETADINTFKWGVANRGASIRVGRDTEREGKGYLEDRRPAFNMDPYVVTGMIAETTILWKGN

SEQ ID NO: 806 - protein, 357 aa, Zea mays
MASLTDLVNLDLSDCTDRIIAEYIWIGGTGIDLRSKARTVKGPITDPSQLPKWNYDGSSTGQAPGEDSEVILYPQAIFKDPFRKGNHILVMCDCYTPQGEPIPTNKRYSAAKVFSHPDVAAEVPWYGIEQEYTLLQKDVSWPLGWPVGGYPGPQGPYYCAAGADKAFGRDVVDAHYKACLYAGINISGINGEVMPGQWEFQVGPSVGISAGDEIWVARYILERITEMAGIVLSLDPKPIKGDWNGAGAHTNYSTKSMREAGGYEVIKAAIDKLGKRHKEHIAAYGEGNERRLTGRHETADINTFKWGVANRGASIRVGRDTEREGKGYFEDRRPASNMDPYVVTGMIAETTILWNGN

SEQ ID NO: 807 - protein, 357 aa, Zea mays
MASLTDLVNLDLSDCTDRIIAEYIWIGGTGIDLRSKARTVKGPITDPIQLPKWNYDGSSTGQAPGEDSEVILYPQAIFKDPFRKGNHILVMCDCYTPQGEPIPTNKRYSAAKVFSHPDVAAEVPWYGIEQEYTLLQKDVSWPLGWPVGGYPGPQGPYYCAAGADKAFGRDVVDAHYKACLYAGINISGINGEVMPGQWEFQVGPSVGISAGDEIWVARYILERITEMAGIVLSLDPKPIKGDWNGAGAHTNYSTKSMREAGGYEVIKAAIDKLGKRHKEHIAAYGEGNERRLTGRHETADINTFKWGVANRGASIRVGRDTEREGKGYFEDRRPASNMDPYVVTGMIAETTILWNGN

SEQ ID NO: 808 - protein, 357 aa, Zea mays
MASLTDLVNLDLSDCTDKIIAEYIWVGGSGIDLRSKARTVKGPITDPSQLPKWNYDGSSTGQAPGEDSEVILYPQAIFKDPFRKGNNILVMCDCYTPQGEPIPSNKRYKAATVFSHPDVAAEVPWYGIEQEYTLLQKDLSWPLGWPVGGYPGPQGPYYCAAGADKAFGRDVVDAHYKACLYAGINISGINGEVMPGQWEFQVGPSVGISAGDEIWVARYILERITEMAGIVLSLDPKPIKGDWNGAGAHTNYSTKSMREAGGYEVIKEAIEKLGRRHREHIAAYGEGNERRLTGRHETADINTFKWGVANRGASIRVGRDTEKEGKGYFEDRRPASNMDPYVVTGMIADTTILWKGN

SEQ ID NO: 809 - protein, 357 aa, Zea mays
MASLTDLVNLDLSDCTDRIIAEYIWVGGSGIDLRSKARTVKGPITDPSQLPKWNYDGSSTGQAPGEDSEVILYPQAIFKDPFRKGNNILVMCDCYTPQGEPIPSNKRYKAATVFSHPDVAAEVPWYGIEQEYTLLQKDLSWPLGWPVGGYPGPQGPYYCAAGADKAFGRDVVDAHYKACLYAGINISGINGEVMPGQWEFQVGPSVGISAGDEIWVARYILERITEMAGIVLSLDPKPIKGDWNGAGAHTNYSTKSMREAGGYEVIKEAIEKLGRRHREHIAAYGEGNERRLTGRHETADINTFKWGVANRGASIRVGRDTEKEGKGYFEDRRPASNMDPYVVTGMIADTTILWKGN

SEQ ID NO: 810 - protein, 357 aa, Zea mays
MASLTDLVNLDLSDCTDRIIAEYIWVGGSGIDLRSKARTVKGPITDPSQLPKWNYDGSSTGQAPGEDSEVILYPQVIFKDPFRKCNNILVMCDCYTPQGEPIPSNKRYKAATVFSHPDVAAEVPWYGIEQEYTLLQKDVSWPLGWPVGGYPGPQGPYYCAAGADKAFGRDVVDAHYKACLYAGINISGINGEVMPGQWEFQVGPSVGISAGDEIWVARYILERITEMAGIVLSLDPKPIKGDWNGAGAHTNYSTKSMREAGGYEVIKEAIEKLGRRHREHIAAYGEGNERRLTGRHETADINTFKWGVANRGASIRVGRDTEKEGKGYFEDRRPASNMDPYVVTGMIADTTILWKGN

SEQ ID NO: 811 - protein, 357 aa, Oryza sativa Japonica Group
MANLTDLVNLNLSDCSDKIIAEYIWVGGSGIDLRSKARTVKGPITDVSQLPKWNYDGSSTGQAPGEDSEVILYPQAIFKDPFRRGDNILVMCDCYTPQGEPIPTNKRHSAAKIFSHPDVVAEVPWYGIEQEYTLLQKDVNWPLGWPVGGFPGPQGPYYCAAGAEKAFGRDIVDAHYKACIYAGINISGINGEVMPGQWEFQVGPSVGIAAADQVWVARYILERVTEVAGVVLSLDPKPIPGDWNGAGAHTNFSTKSMREPGGYEVIKKAIDKLALRHKEHIAAYGEGNERRLTGRHETADINTFKWGVANRGASIRVGRDTEKEGKGYFEDRRPASNMDPYVVTGMIAETTLLWKQN

SEQ ID NO: 812 - protein, 354 aa, Triticum aestivum
MASLADLVNLDLSDCTDKIIVEYLWVGGSGIDIRSKARTVNGPITDASQLPKWNYDGSSTGQAPGEDSEVILYPQAIFKDPFRRGDNLLVMCDCYTPQGVPIPTNKRHNAAKIFNTPKVAAEETWYGIEQEYTLLQKDVNWPLGWPIGGYPGPQGPYYCAAGADKAFGRDIVDAHYKACLYAGINISGINGEVMPGQWEFQVGPSVGIAASDQLWVARYILERITEVAGVVLSLDPKPIPGDWNGAGAHTNYSTKSMREAGGYEVIKTAIEKLGKRHAQHIAAYGEGNERRLTGHHETADINTFKWGVADRGASVRVGRDTEKDGKGYFEDRRPASNMDPYVVTSMIAETTLLL

SEQ ID NO: 813 - protein, 354 aa, Triticum aestivum
MASLADLVNLDLSDCTDKIIVEYLWVGGSGIDIRSKARTVNGPITDASQLPKWNYDGSSTGQAPGEDSEVILYPQAIFKDPFRRGDNLLVMCDCYTPQGVPIPTNKRHNAAKIFNTPNVAAEETWYGIEQEYTLLQKDVNWPLGWPIGGYPGPQGPYYCAAGADKAFGRDIVDAHYKACLYAGINISGINGEVMPGQWEFQVGPSVGIAASDQLWVARYILERITEVAGVVLSLDPKPIPGDWNGAGAHTNYSTKSMREAGGYGVIKTAIEKLGKRHAQHIAAYGEGNERRLTGHHETADINTFKWGVADRGASIRVGRDTEKDGKGYFEDRRPASNMDPYVVTSMIAETTLLL

SEQ ID NO: 814 - protein, 400 aa, Sorghum bicolor
MAFLGEYSSQELLQGQLLLWHQSLGFFKSLALAVAMDLRIADAIHRLGGAATLPQIIAEAGIKIDPRNNKLRDLRRVMRALTVSGIFTVQRPASAVVAAAADGGAEAEGPVYKLTAASRLLVVGEKKSSTTTTMPTPSLTVQLFLETCRGSAFSRGMRAWFRPQDEQHQHQEQPAGLSPFAMACGGQTIWERAERDADAFPFDDAMASDTAFLMPIVLRECGDEVFRGLTSLVDVAGGLGGAAANIAAAFPDLKCTVLDLPQVVAKAAAGSNEKVQYVGGDMFESIPPADAVLLKWILHDWSDDECVKILKKCKQAIPPRAAGGKVIIIDMVVGSADEPSPESDVRHVETQVLFDLLIMCINGVERDELEWKKIFSEAGFHDYRIIPVLGVRSIIELYPN

SEQ ID NO: 815 - protein, 417 aa, Zea mays
MALLGEYSSQELLQGQLQLWHQSLGFFKSLALAVAMDLRIADAIHRLGGAATLPQILAEAGIKIDPCNNKLRDLRRVMRALTVSGIFTVVQRPASSSDGGGRRGAEAEGPVYKLTAASRLLVVGEKESSTTATTRQLPPPPSLTVYVQLLLETCRGSAFSRAVREWFQFQQPPQDDGQHQQPAGRLSSPFALACGGQTIWERAERDAHAFPFDDAMASDTAFLMPIVLRECGDEVFGRGLTSLVDVAGGLGGAAATIAAAFPDLSCTVLDLPHVVAKAAAGTTDSNVQYVAGDMFQCIPPADAVLLKWILHDWSDDECVRILKNCKQAIPPRAAGGKVIIIDMVVAGPGSGSADDEPSESDLRHVETQILFDLLMMCVNGVERDEQEWKKIFSEAGFQDYRIMPLLGVRSIIELYPN

SEQ ID NO: 816 - protein, 391 aa, Sorghum bicolor
MAFLGEYSSQELLQGQLLLWHQSLSFFKPVALAVAKDLRIADAIHRLGGAATLPQIIAEAGINPCKLRALRRVMRVLTVSGIFTAVQQPATATAAAASGGGGTEGPVYKLTAASSLLVVGEKSSTAAAAATTKSQLPPSLSVQVQLFLDPCRGSAFSSGIRAWFRQDEHQQPAGLSPFALACDGQTIWERAERDADVFPFDDAMASDNAFLMPIVLKECGDVFRGLTSLVDVAGGLGGAASTIAAAFPDLKCTVLDLPQVIAKAPSAAGTSVQYVAGDMFQSIPPADAVFLKWILHDWNDDDCVKILKNCKQAIPPRDVGGKVIIIDMVVGSESSDNRHVETQVLFDLLVMTIDGAERDEQEWKKIFLEAGFEDYKIIPVLGVRSIIELYP

SEQ ID NO: 817 - protein, 372 aa, Sorghum bicolor
MALLDEYSSDELLQAQLQLWHQALGFFKSVALAVALDLGIPDAIHRLGGAATLPQILAEAGVNPRKLRNLRRIMRVLTLSGIFSIKQAATAASDGEGPVYKLTTASRLLVKDESLTRSQQLPPVLYTHLMLTPCRESTAGMGINAWFRQEQDQPQPAAGPFALEYNGQTVWERAEHDATTFPFDDAMASDTAFLMPIVLKECSEVFHGLTSLVDVAGGLGGAAATIVAAFPDLKCTVLDLPHVVAKAPTDTNVHYVAGDIFQSIPPANAVFLKWILHDWHDDECVKILKNCKQAIPPRDAGGKIIIIDMVVGSEPSDLKHIETQVLFDLMMMNVNGVERDENEWKNIFFEAGFKDYKIIPLLGVRSIIELYP

SEQ ID NO: 818 - protein, 382 aa, Sorghum bicolor
MALLDEYSSQELLQAQLQLWHQALGIFKPVALALALDLQIPDTIHRLGGAATLPQILLEAGINPCKLHDLRRIMRVLTFSGIFSVKQAATVASDDNDRHDGEGPVYKLTTASRLLVRDKSLTTTQQLPALMYVQLMLSPSRESPLGKGLYAWFRQDQDQPQPAGLSPFALSYSGQTIWERAERDATTFPFDDAMASDTAFLMPIVLKECGEVFHGLTSLVDVAGGLGGAATTIAAAFPDLKCTVLDLPQVVAKAPTDTNVQYIAGDMFQSIPPANAVFLKLVLHDWNDDECVKILKNCKKAIPSRDAGGKIIIIDMVVGSESSDPSDIKHIETQILKDLMMMNINGVERDEQEWKKISFEAGFKDYKIIPLLGVRSIIELYP

SEQ ID NO: 819 - protein, 383 aa, Sorghum bicolor
MALLDEYNSQELLQAQLQLWHQALGIFKPVALALALDLHIPDAIHRLGGAATLPQILLEAGINPCKLHDLCRIMRVLTFSGIFSVKQAATVTSDDDDRHDGEGPVYKLTTASRLLVRDESLTTTQQLPALMYVQLMLSPSRESPLCKGLHAWFRQDHQDQPQPAGLSPFALSYSGQTIWERAERDATAFPFDDAMASDTAFLMPIVLKECGEVFHGLTSLVDVAGGLGGAAATIAAAFPDLKCTVLDLPQVVAKAPTDTNVHYVAGDMFQSIPPANAVFLKLVLHDWNDDECVKILKNCKKAIPPRDAGGKIIIIDMVVGSEPSEPSDIKHIETQILKDLMMMNINGLERDEQEWKKISFKAGFKDYKIIPLLGVRSIIELYP

SEQ ID NO: 820 - protein, 595 aa, Sorghum bicolor
MAMEETSKITGRKKGGLRTMPFIFANEVAEKLAVVGFSTNMLTYLTTQLHMPLAKAATTLTNFGGTSAATPLIGAFLADACIGRFWTIAAASVVYQVGMALLTVSAALPQFRPPPCKPGGAVTCQEAAPWQLAVLYVSLLLNAVGAGGYRPCIVAFGADQFDESRAAERARSWGFFNWYYFCNGASMLLAVTAVVYVQDNVGWGWGLGVPAFCMGVSVAAFVAGYPMYRRLEPAGSPFTRLAQVVVAAVKKRRLPAADVVPARLYENDDLDAPISMYGKLVHTDQLSFFDRAAIVTDGDMVTQTDADSGKPSAAPVPNPWRLSTVHRVEELKSVIRMGPIWAAGILVITGSSTQHTFSLQQASTMDRRLAPGLSTFQIPAGSMTVFALLAMLLTLFLYDRVLVRVARRFTGLDRGISFLHRMGVGFAISVVATLVAGFVERHRRDAAAAVAGATDAGTSPLSAYWLVPQYALHGVAEAFTSVGHLEFMYDQAPESMRSTATALFWLSISLGSYASTLLVDAVHHWSAGPGGANWLPDNINHGRLDYFYWVVTMLQVMNLIYYAICAKRFRYKPVQLHKKEEEESGKALVELQEKV

SEQ ID NO: 821 - protein, 594 aa, Zea mays
MAMEEAGKMTCRKKGGLRTMPFIFANEVAEKLAVVGFSTNMLTYLTTQLHMPLAKAATTLTNFGGTSAATPLIGAFLADACIGRFWTIAAASVVYQAGMALLTVSAALPRFRPAPCKPGGAVACQEAAPWQLAVLYVSLLLNAVGAGGYRPCIVAFGADQFDESRAAERARSWGFFNWYYFCNGASMLLAVTAVVYVQDNVGWGWGLGVPAFCMGVSVAAFVAGYPMYRRLEPAGSPFTRLAQVVVAAVKKRRLPAADVDPALLYEDDELDAPISMYGKLVHTDQLSFFDRAAIVTDGDLVTLTDADSGKPSTAPVPDLWRLSTVHRVEELKSVIRMGPIWAAGILVITGSSTQNTFSLQQASTMDRRLAPGLSTFEIPAGSMTVFGLLAMLFTLFVYDRALIRVARRFTGLDRGISFLHRMGVGFAISVLATLVAGFVERHRRDAAAAAGATDAGTSPLSAYWLVPQYALHGVAEAFTSVGHLEFMYDQAPESMRSTATALFWLSISLGSYASTLLVDAVHRWSAGPGGANWLPDNINHGKLDYFYWVVTVLQVMNLVYYAICAKRFTFKPVQLHKKEEEEGGKALVELQEKV

SEQ ID NO: 822 - protein, 617 aa, Hordeum vulgare subsp. vulgare
MQRGVAACSTTECTTAPLPPQAQTMAVEAAMDGKKSKRKGGLRTMPFIFANEVAEKLAVVGFSTNMLTYLTQQMHMPLAKAATTLTNFGGTSAMTPLIGAYLADACIGRFWTIAGASVVYQFGMALLTVSAALPQFRPAPCKAAEAAGGACEQALPWQLAVLYVSLLLNAVGAGGYRPCIVAFGADQFDESQTAERARTWGFFNWYYFCNGASQLVAVTAVVYVQDNVGWGWGLGVPAFCMGVSVVAFVGGYPMYRRLDPAGSPFTRLAQVVAAAVRKRRVHRVDDPGRLYENDDMDAPISMYGKLVHTTQLSFFDRAAIVSDGDLLTADASSGKQPPSQVPNLWRLSTVHRVEELKSVVRMGPIWAAGILVITASSQQHTFSLQQASTMDRRIAPHSSFEIPAGSMTVFTMLAMLATLFVYDRALVPLARRRTGLDRGISFLHRMGVGFTISVAASLVAGFVERHRREAAAAGGTTDAGTAPLSVYWLVPQYALHGVAEAFNSVGHLEFMYDQAPESMRSTATALFWLSISLGSYVSTLLITIVHRWSAGSDGSNWLPDNINRGKLDYFYWVVTLLQVMNLVYYLICARQYTYKPVQLYKEEDGEDKSMVELQQKV

SEQ ID NO: 823 - protein, 597 aa, Oryza sativa Japonica Group
MAEEEEAKKSKMRKKGGFRTMPFIFANEVAEKLAVLGFTTNMLMYLTRQLHMPLAKAATTLTNFGGVSAMTPLIGAFLADSLVGRFWTIAAASLIYQVGMLLLTVSAAMPVFRPPPCSGAGGAGACDEAAPWQLAVLYAALLLNALGAGGYRPCVVAFGADQFDESEAAERARTWGFFNWYYFCNGASQLVAVTAVVYVQDNVGWGWGLGVPTFCMAVSVVAFVAGYPLYRRLHPSGSPFTRLAQVVVAAVRKRRVPTDADDAAALYENDDMDAPISLYGKLVHTEQLSFFDRAAIVTDGDLTTDTSNGKPSLSPIPKPWRLSTVHRVEELKSLLRMGPIWAAGILVITAYSQQHTFALQQASTMDRRLAPGLSSFQIPAGSMTVFTLLAMLTTLLAYDRVLVPLARRVTGLDRGISYLHRMGVGFAISVAATLVAGFVERHRRESAAAAGTTDAGTSPLSAYWLVPQYALHGMAEAFNSVGHLEFMYDQSPESMRSMATALFWLSISLGSYVSTMLISAVHRWSAGADGSNWLPDNINRGRLDYFYWIVALLQVLNLAYYAICARCYLFKPLQLREVDDDAKPQIELQEKASPLSH

SEQ ID NO: 824 - protein, 555 aa, Sorghum bicolor
MSPPVAGAAATSGDGSPRELYTIPASSGWFRWDGIHETERQALPEFFGGAGGAGFGTATRNPRIYREYRDFIIAKYREDPARRLTFTEVRRALVGDVTLLRKLFAFLDSSGLINFSASSSSSGPASRKQEVGVVVEAPVGLQVTPRPPASYFAEEKRGAVGGEKENGFRLPPLTSYSDVFGEWAPGKAPICGFCGEECNGAKVETLQDGFKVCSKCSKSNNDNNKEEANKCPGDKKESMEKSSGAWTDAETLLLLEGVLKHGDDWDLIAQHVRTKNKSECIARLIQLPFGEHMLGTINGKSASRLHINQATDGKTNQHIMKEPSSHTTEMADGMQIDGNEDSADKSVEEYPTKRRRLFSSMDATTSLMEQLALLTTTASPDVVAAAADAAIKAFSNENPQAKKAFRLSEREYKTKAFGSNHVQQIDRKIGDKDVKMHGQPGSDKQEKKFIANAYQLRAAVATAVGVAAARAKMLADQEEREMELLMASVIETQLRKMQYKIKHFEELESVMDQEYTTIQQMKGSLMNEWLKVLEHAFRAGVSLPRDELLTKLFLN

SEQ ID NO: 825 - protein, 557 aa, Zea mays
MSPPAAGAAANSGDGTPPSPRELYTIPASSGWFRWDGIHETERRALPEFFGGAGGAGFGTATRNPRIYREYRDFIIAKYREDPARRLTFTEVRRALVGDVTLLRKLFAFLDSSGLINFSASSSSVPASRQQEVGVVVEAPVGLQVTPRPPASYFAEEKRVAAGGEKENEFRLPPLTSYSDVFGEWAPGKAPICGFCGEECNGADVETLQDGFKVCSKCSKSNNDNIKEEANKCPGDKKENMENHASSAWTDTETLLLLEGVLKHGDDWDLIAQHVRTKNKSECIAMLIQLPFGEHMLGTINGKFVSRLHINQADDGKTNQHIMESSSHSTEMADGMQIDGSEDSADKSVEEYPTKRRRLFFSMDATTSLMEQLAILTTAASPDVAAAAADAAIKAFGNENPQARKAFRLNEQEYKTKAFASNHVQQIDHKVGNKDTAMHGQSGSDKQEKKFIASAYQLRAAVATAVGVAAARAKMLADQEEREMELLMASVIETQLRKMQYKIKHFEELDSLMDQEYTAIQQMKGSLMNEWIKVLEHAFRAGVSLPRDELLTKLLLN

SEQ ID NO: 826 - protein, 560 aa, Oryza sativa Japonica Group
MSPPVAGAASSGDGPPGRPPRELYTIPASSGWFQWDEIHETERRALPEFFGGAGGSGFGTASRNPRIYREYRDYIISRYREDTSRRLTFTEVRKALVGDVTLLRKLFAFLDSSGLINFSASPSRPEAQQQQRQTEAEAVVEAPVGLQVTPRPPPSYFAEEKGGGGNENGFRLPPLTSYSDVFGEWAPGMAPICGLCGMECRDGNAQILKDGFKVCSKCYANNDNKGEANIHPGDKKERIDNHSSSAWTDAETLLLLEGVLKHGDDWDLIAQHVRTKNKSECIARLIQLPFGEHMLGTVNGKLDNRLHKIQTTDGKVNKSTVKESSSQPTETVDDMQIDGNEDGADKSVEEHPTKHRRLFSSIDITVSLMEQLAHLTTSTSPDVVAAAADAAIKALGNENPQARRAFQLSEKEYQTRAFSSNHARQSDDVGGGDRDVEMHGHPDKKQGKMFISTTYQVRAAVATSIGVAAARAKMLADQEEREMELLMASIIETQLKKIQYKIKHFEELELIMDQEYATLQQMKSSLVDEWQKVLKRAFETGVPISRDEVLIKLFQNKPNL

SEQ ID NO: 827 - protein, 564 aa, Oryza sativa Indica Group
MSPPVAGAASSGDGPPGRPPRELYTIPASSGWFQWDEIHETERRALPEFFGGAGGSGFGTASRNPRIYREYRDYIISRYREDTSRRLTFTEVRKALVGDVTLLRKLFAFLDSSGLINFSASPSRPEAQQQQRQTEAEAVVEAPVGLQVTPRPPPSYFAEEKGGGGNENGFRLPPLTSYSDVFGEWAPGMAPICGLCGMECRDGNAQILKDGFKVCSKCYANNDNKGEANIHPGDKKERIDNHSSSAWTDAETLLLLEGVLKHGDDWDLIAQHVRTKNKSECIARLIQLPFGEHMLGTVNGKLDNRLHKIQTTDGKVNKSTVKESSSQPTETVDDMQIDGNEDGADKSVEEHPTKHRRLFSSIDTTVSLMEQLAHLTTSTSPDVVAAAADAAIKALGNENPQARRAFQLSEKEYQTRAFSSNHARQRDYCSDDVGGGDRDVEMHGHPDKKQGKMFISTTYQVRAAVATSIGVAAARAKMLADQEEREMELLMASIIETQLKKIQYKIKHFEELELIMDQEYATLQQMKSSLVDEWQKVLKRAFETGVPISRDEVLIKLFQNKPNL

SEQ ID NO: 828 - protein, 548 aa, Oryza sativa Indica Group
MSPPVAGAASSGDGPPGRPPRELYTIPASSGWFQWDEIHETERRALPEFFGGAGGSGFGTASRNPRIYREYRDYIISRYREDTSRRVTFTEVRKALVGDVTLLRKLFAFLDSSGLINFSASPSRPEAQQQQRQTEAEAVVEAPVGLQVTPRPPPSYFAEEKGGGGNENGFRLPPLTSYSDVFGEWAPGMAPICGLCGMECRDGNTQILKGEANIHPGDKKERIDNHSSSAWTDAETLLLLEGVLKHGDDWDLIAQHVRTKNKSECIARLIQLPFGEHMLGTVNGKLDNRLHKIQTTDGKVNKSTVKESSSQPTETVDDMQIDGNEDGADKSVEEHPTKHRRLFSSIDTTVSLMEQLAHLTTSTSPDVVAAAADAAIKALGNENPQARRAFQLSEKEYQTRAFSSNHARQRDYCSDDVGGGDRDVEMHGHPDKKQGKMFISTTYQVRAAVATSIGVAAARAKRLADQEEREMELLMASIIETQLKKIQYKIKHFEELELIMDQEYATLQQMKSSLVDEWQKVLKRAFETGVPISRDEVLIKLFQNKPNL

SEQ ID NO: 829 - protein, 341 aa, Zea mays
MVMETGDPGKLLRGHSLSRVPPASPFPRLRPQGDLVRAGDERARASGMPGEEDVRKVSREDIQLVQNLIERCLQLYMNQKEVVDTLSFQAKIEPSFTEIVWQRLEEENRDFFKAYYARLMLMNQIVSFNKLLEQQHQIMNKDHHYGMPAMPSTAPNGSNSNMLNQAVPFLPDTIPSTAMQDNLWSNGSSSSIVNGAPSDDQCGYSGKVAHGLPGVMDASSSLLAAHKSTVGQFNGHDGTTTKTESDYSSNSDFGFGNETVFLEQSVGDISGGSFSSSELNGQPVGSSSYGFLSQIPCNFSLSDWTDCFSQSSEIFENYGGSPFIPSDANNIPESSARENTG

SEQ ID NO: 830 - protein, 435 aa, Zea mays
MMTGRLNVATSSSPGGDDFLFMPMQQHQPPPPPPPPYVGFEHGHGVAGGGSQRVAGGVQHHLYDGLDFAAAALQFQQQAEAPHLHQQQLLTLPSSLGPMAPPPPPPPPLPMPMPVPGMPGDHVYPALGMVKREGGGADGRIGLNLGRRTYFSPGDMMAVDRLLMRSRLGGGGGAFGLGFGFGFGGAHHQAPPARCQAEGCKADLSGAKHYHRRHKVCEYHAKASVVATGGKQQRFCQQCSRFHVLSEFDEVKRSCRKRLAEHNRRRRKPPTTASSKDAASPPANKKPNCGSITSSYSTDNKNLNTAKSTMSSNTGSVISCLDQAAGNKQLQARPTLTLGASPDKDQQQQQQLRAMLQAQAAAGGGHHHHHQEQHFITSLQVHNNDGCGGGNSSSNNNIILSCSSVCSSALPSANGEVSDQNNAGGMHNLFEVDFM

SEQ ID NO: 831 - protein, 444 aa, Sorghum bicolor
MMSGRLNVATSASPGDDFPFASMQQQQQPPPPPPPPPYVGFEHGVAGGGGGQRGAGGMGMQQQQHLYDGLDFAAALQFQQEAPHHHHHQLLTLPSSLGPMAPPPLPMPMPMPLQMPMPMPGMPGGDHVYQALGMVKREGGGGGGADAGRIGLNLGRRTYFSPGDMLAVDRLLMRSRLGGVFGLGFGGAHHQPPRCQAEGCKADLSGAKHYHRRHKVCEYHAKASVVAAGGKQQRFCQQCSRFHVLSEFDEVKRSCRKRLAEHNRRRRKPATTASSKDAASPPANKKPNGGSITSSYSTDNKNLSTAKSTMSSNTSSVISCLDQAGNKQQQLARPTLTLGASQDNKDQHQHQQQLSTMLQVQAAGGGHHQEQHFLTSLQVHNNGGCGGGNNNNILSCSSVCSSGALPSSANGEVSDQNTTTTTTNNGNGGSSNNNLHNLFEVDFM

SEQ ID NO: 832 - protein, 424 aa, Zea mays
MMSGRLNAATPASPGDDFSFAPMQMPPPPPYVGFEHGGGGQRGAGAMQAQQHHLYDGLDFASALQFQQEASSHSHHHQLLTLPSSLGPMAPPMPMPMPMPLPMQMPVPGDHVYHPALGTMVKREGGGADGGRIGLNLGRRTYFSPGDMLAVDRLLMRSRLGGVFGLGFGGAHQHQVPRCQAEGCKADLSGAKHYHRRHKVCEYHAKASVVAANGKQQRFCQQCSRFHVLSEFDEVKRSCRKRLAEHNRRRRKPATTASSKDAASPPAANKKTNGGSITCSYSTENKNDDLSCRAKSTMSSNTSSVISCQLDQPGNKHQLARPTLTLGASQDNKDHQQQLSTMLHVQAAGGYHHQEQQHFITSLQVHNNGGSGNNNNNNIILSCSSVCSSLPPPPSAPNGEVSDQNTAANNGNGNMHNLFEVDFM

SEQ ID NO: 833 - protein, 424 aa, Zea mays
MMSGRLNAATPASPGDDFSFAPMQMPPPPPYVGFEHGGGGQRGAGAMQAQQHHLYDGLDFASALQFQQEASSHSHHHQLLTLPSSLGPMAPSMPMPMPMPLPMQMPVPGDHVYHPALGTMVKREGGGADGGRIGLNLGRRTYFSPGDMLAVDRLLMRSRLGGVFGLGFGGAHQHQVPRCQAEGCKADLSGAKHYHRRHKVCEYHAKASVVAANGKQQRFCQQCSRFHVLSEFDEVKRSCRKRLAEHNRRRRKPATTASSKDAASPPAANKKTNGGSITCSYSTENKNDDLSCRAKSTMSSNTSSVISCQLDQPGNKHQLARPTLTLGASQDNKDHQQQLSTMLHVQAAGGYHHQEQQHFITSLQVHNNGGSGNNNNNNIILSCSSVCSSLPPPPSAPNGEVSDQNTAANNGNGNMHNLFEVDFM

SEQ ID NO: 834 - protein, 578 aa, Zea mays
MRRLAKSLLLASLSRTLRHRPQLPLLHPWPPQPRRPEPRLLPFSTQTLAPGPAPPPALVAASTGEPTGLALLESAELHESEGDHQEALGLALKALAPLQASHGGWSLPVARALRLAGAAATRAGSLSDGLESLGAAADIVDYLAPARRKGVPAEVAVVGAAVYEQLARAKMAIGRRWDAVGDLQRALDLKTLFLEAGSAELGNAYRDVAEAYAGVLDFDKALPLCSKALGIAERRFGEDSAEVAKLRRLLMSVYTGLGRHEEALAQIELAKVVYERLGLNVELSQAEIDGANIRILLGRSEEALNNIKRVMQRADKESEERALAYVTMAKILMSEDTVLDSKRCLEIAQGIIDAKDSIDPGRFAEAYAEISMLYESLANFETSSGSFEMASNLMKKTLAILESAKEMHHIEGSISARLGWLLLYIKNVDESVQYLERAVDKLKNCFGPRHFGLGFAYRNLGQAYLEMNQHQSAVEFFKLALDIIEATFGPLHDDTIDTKQCIANAYGLMKSYKLAMEFQEQVMDAYSRCGHGALDDFKEAERLLEQIKMKAQGLRHAVFPANSLPDSALALAQRNKDD

SEQ ID NO: 835 - protein, 572 aa, Sorghum bicolor
MRRLPKSLLLACLSRPLRHRPPLPLLHPSPPQPPRPGARLLPFSTQTLAPAPPPPPAPDAASTAEPAGLALLEAAERRESEGDHQEALALALKALAPLQASHGGWSLPVARALRLAGTAATRAGSLSDALESLGAAAEIVDYLAPARREGVPKEVAAVGATVYEQLARAKTAMGHRWDAVGDLQRALDLKLQCLEGGSAELGDAYRDVAEAYAGVLDFDKALPLCSTALGIAEGRFGEDSAEVAKLRRLLMAVYTGLGRHVEALEQIDLAKMVYERLGLNVELSQAEIDGANIRILLGRSEEAMNDIKRVMQRSDKESEERALAYVTMAKILISEERVSDSKRCLEIARGIIDAMDSIDPGRFAEVYAEMSMLYESMTQFEMPLSALDMSLSLMKKTLAVLESAKEMHHIEGSISARMGWLLLHTQKADESVPYLERAVDKLKNCFGPRHFGLGFAYKNLGQAYLEMDQHQSAVKFYKLANDIIEAAFGLTHEDSIDTKQSLANAYGLMGSYKLAIDFQEQVVDAYSRCGSGAFEDLREANRLLEQLKKKAQGLPHAVFPAYSLPVLPENND

SEQ ID NO: 836 - protein, 368 aa, Sorghum bicolor
MEALWKQASRLKDQVARQGVFKQFGYGNSDNAFTDESEVKLHQRLEKLYLSTRAAKHFQRDIVRGVEGYIVTGSKQVEIGNKLSDDSQKYGVENTCTSGDTLSKAATYFGKARSQMEKERGNMLKAFGTQVAEPLRAMVMGAPLEDARHLAQRYDRMRQEAEAQVVEVSRRQNRVRESAGNGDMISKLEAAEYKLEELKSNMVGLGREAIAAMSAVETQQQRLTLQRLIALVEAERAYHKRVLEILDQLEQEMVSERQKIEAPPTPAAENYMPPPPPPSYDEVNGAFASTSVNESVQSVDFFLGEAPESLKAERECERALSAGDTVSVREGSSNGWAEGECKGKAGWFPHAYIERQERVLASKVPHIF

SEQ ID NO: 837 - protein, 368 aa, Zea mays
MEALWKQASRLKDQVSRQGVFKQFGYGNSDNAFTDESEVKLHQRLEKLYLSTRAAKHFQRDIVRGVEGYIVTGSKQVEIGNKLSDDSQKYGVGNTCTSGDTLSKAATYFGKARSQMEKERGNMLKAFGTQVAEPLRAMVMGAPLEDARHMAQRYDRTRQEAEAQAVEVSRRQNRVRESTGNGDMVSKLEAAEYKLEELKSNMVGLGKEAIAAMSAVEAQQQRLTLQRLIALVEAERTYHQRVLEILDKLEEEMVSERQKIEAPPTPAAENYIPPPAPPSYDEINGAFASTSVNESVQSVDFFLGEALDSFNAESEFELTLSAGDIVIVRKISSNGWAEGECKGKAGWFPHAYIERQERVLASKVPHIF

SEQ ID NO: 838 - protein, 368 aa, Hordeum vulgare subsp. vulgare
MEALWKQASRLKEQVARQGVFKQFGAGGNSDNAFTDESEVKLHQRLEKLYLSTRAAKHFQRDVVRGVEGYIVTGSKQIEIGNKLSDDSQKYGSENTCTSGNTLSRAATYYGKARSLIEKERGNMLKAFGTQVAEPLRAMVMGAPLEDARHLAQRYDRIRQEADAQVVEVSRRQSRVRESAGNSDVISKLEAAEYKLEELKSNMVGLGKEAVSAMAAVEGQQQRLTLQRLIAMVEAERTYHQKVLEILDHLEEEMVSERQKIEAPPPPAAESYTSPPPPSYDEVNGMFASTSADQAVNSVDLFLGEALDSFKAESEFELNLSVGDIVIVRKISSNGWAEGECKGKAGWFPHAYVERRERVLASKVPHIF

SEQ ID NO: 839 - protein, 369 aa, Oryza sativa Japonica Group
MEALWKQASRLKEQVSRQGVFKPFGAAYGNSENAFTDESEVNLHQRLEKLYLSTRAAKHFQRDIVRGVEGYIVTGSKQVDIGNKLSDDSQKYGTGNTCTSDNTLSKAAMYYGKARSLMEKERGNMLRAFGTQVAEPLRAMVMGAPLEDARHLAQRYDRMRQEAEAQAVEVSRRQNRVRESAPNGDVITKLEAAEYKLEELKSSMVGLGKEAVAAMAAVEAQQQRLTLQRLIAMVEAERAYHQRVLEILDHLEQEMVSERQKIEAPPTPSAENYMAQPPPSYDEVNGMFASSSVDDSVTSVDFFLGEALDSFKAESESELNLSAGDIVIVRKISTNGWAEGECKGKAGWFPHGYIERRERVLASKVPHIF

SEQ ID NO: 840 - protein, 334 aa, Zea mays
MRLQMSQRLNCIRDWKSFTYRLVLLKDIVRGVEGYIVTGSKQVEIGNKLSDDSQKYGVGNTCTSGDTLSKAATYFGKARSQMEKERGNMLKAFGTQVAEPLRAMVMGAPLEDARHMAQRYDRTRQEAEAQAVEVSRRQNRVRESTGNGDMVSKLEAAEYKLEELKSNMVGLGKEAIAAMSAVEAQQQRLTLQRLIALVEAERTYHQRVLEILDKLEEEMVSERQKIEAPPTPAAENYIPPPAPPSYDEINGAFASTSVNESVQSVDFFLGEALDSFNAESEFELTLSAGDIVIVRKISSNGWAEGECKGKAGWFPHAYIERQERVLASKVPHIF

SEQ ID NO: 841 - protein, 370 aa, Oryza sativa Japonica Group
MEAIRKQASKLREQVARQQQAVMKQFGGGYGADGAFADEAEAQQHSKLEKLYISTRAAKHFQRDIVRGVEGYIVTGSKQVEIGNKLCEDGKKYGAENTCTSGSTLSKAALCFAKARSLMEKERGNLLKALGTQVAEPLRAMVMGAPLEDARHLAQRYDRMRQEAEAQAIEVSKRQMKLRETSGNGDMISRLEAAESKLQELKSNMGVLGKEAVASMTAVEAQQQRLTLQRLIAMVESERSYHQRVLQILDQLEREMVSERQRIEGAPPPAVESSMPPPPSYEEINGVFMRNPTVAELVETVEFFLAEAIQSYRAESETELNLAAGDYIVVRKVSNNGWAEGECRGKAGWFPYDYIEKRDRVLASKVAQVF

SEQ ID NO: 842 - protein, 369 aa, Hordeum vulgare subsp. vulgare
MEAIRKQASKLREQVARQQQAVLKQFGGGYADSVFADEGEAQQHSKLEKLYISTRAAKHFQRDIVRGVEGYIVTGSKQVELGNKLCEDGKKYGVENTCTSGSTLSRAALSFAKARSLMEKERGNLLKAFGTQVAEPLRAMVMGAPLEDARHLAQRYDRMRQEAEAQAIEVSKRQMKLRETSGNGDMISRLEAAESKLQELKSNMGTLGKEAVAAMTAVEAQQQRLTLQRLIAMVESERSYHQRVLQILDQLEREMVAERQRIEGAPPPVIENSMPPPPSYEEVNSIFMRTPTVAELVETVEHFLAEAIQSYRAETETELNLATGDYIVVRKVSNNGWAEGECRGKAGWFPYEFIEKRDRVLASKVAQVF

SEQ ID NO: 843 - protein, 369 aa, Zea mays
MEAIRKQASKLREQVARQQQAVMKQFGGGYGADGVFADEAEAHQHSKLEKLYISTRAAKHFQRDIVRGVEGYIVTGSKQVEIGNKLCEDGKKYGTENTCTSGSTLSKAALSFAKARSMMEKERGNLLKALGTQVAEPLRAMVMGAPLEDARHLAQRYDRMRQESEAQAIEVSKRQMKLREASGNSDMISRLEAAESKLQELKSNMGGLGKEALAAMTAVEGQQQRLTLQRLIALVESERNYHQKVLQILDQLEREMVSERQRIEGAPPPVVESSMPPPPAYEEVNGIFMRNTVAELVETVEYFLAEAIQSYRAESDTELNLSAGDYIVVRKVSNNGWAEGECRGRAGWFPYDYIEKRERVLASKVAQVF

SEQ ID NO: 844 - protein, 369 aa, Zea mays
MEAIRKQASKLREQVARQQQAVMKQFGGGYGADGVFADEAEAQQHSKLEKLYISTRAAKHFQRDIVRGVEGYIVTGSKQVEIGNKLCEDGKKYGTENTCTSGSTLSKAALSFAKARSMMEKERGNLLKALGTQVAEPLRAMVMGAPLEDARHLAQRYDRMRQEAEAQAIEVSKRQMKLREASGNSDMISRLEAAESKLQELKSNMGVLGKEALAAMTAVEGQQQRLTLQRLIALVESERNYHQKVLQILDQLEREMVSERQRIEGAPPPVVESSMPPPPAYEEVNGIFMRNTVAELVETVEYFLAEAIQSYRAESDTELNLSAGDYIVVRKVSNNGWAEGECRGRAGWFPYDYIEKRERVLASKVAQVF

SEQ ID NO: 845 - protein, 369 aa, Sorghum bicolor
MEAIRKQASKLREQVARQQQAVMKQFGGGYGADGVFADEAEAQQHSKLEKLYISTRAAKHFQRDIVRGVEGYIVTGSKQVEIGNKLCEDGKKYGTENTCTSGSTLSKAALSFAKARSMMEKERGNLLKALGTQVAEPLRAMVMGAPLEDARHLAQRYDRMRQEAEAQAIEVSKRQMKLREASGNSDMVARLEAAESKLQELKSNMGVLGKEAVAAMTAVEAQQQRLTLQRLIALVESERNYHQKVLQVLDQLEREMVFERQRIEGAPPPVVESSMPPPPAYEEVNGIFMRNTVAELVETVEYFLAEAIQSYRAESDTELNLSAGDYIVVRKVSNNGWAEGECRGKAGWFPYDYIEKRERVLASKVAQVF

SEQ ID NO: 846 - protein, 885 aa, Sorghum bicolor
MAGWGSSRVAACGPWGRGAALERELSRDGSHYSISSGILPSLGARSNRRVKLRPFIVSPYDRRYRCWETFLIILVVYSAWVSPFEFGFIRKPTGALAAVDNVVNAFFAVDIILTFFVAYLDRMTYLLEDDPKRIAWRYTTSWFVLDVASTIPSEFARRILPPNLRSYGFFNMLRLWRLRRVSSLFARLEKDRHFNYFWVRCAKLICVTLFAVHCSACFYYLLADRYPVPTDTWIGNSMPDFHQRGLWIRYVISVYWSITTLTTVGYGDLHAENTREMIFNIFYMLFNLGLTAYLIGNMTNLVVHGTSRTRKYRDTIQAATSFALRNQLPSRLQDQMISHLSLKFRTDSEGLQQQETLDALPKAIRSSISQYLFFNLVQKVYLFEGVSNDLIFQLVSEMKAEYFPPREDVILQNEAPTDFYILVTGSAELVELRNGGEQIAGVAKAGDVVGEIGVLCYRPQLFTVRTKSLCQLLRMNRTAFLSLVQSNVADGTIIMNNLMQLLKEQKDNSVMAGVLKEIENMLARGRLDLPVTLCFAVNKGDDFMLHQLLKRGLDPNESDNNGHTALHIAASKGDEQCVKLLLDYGADPNARDSEGKVPLWEALCEKHNAVIELLVESGAELSSGDTALYACIAVEENDAELLENIIRYGGNINSSTKDGTTPLHRAVCDGNVQMVELLLEHGADINKQDNNGWSARDLADQQGHDDIQVLFKSRKAHRQHASNGRVAPMLIGRFNSEPSMPNMNHEDAEVRSKVVPQKLLRKRVSFQNSLFGVISSSQARQDTGGLLSKGLAGTGGPSCHHDSLIRVTISCPEKGNAAGKLVRLPRSMTELLELGAKKFDFKPTKVLTVGGAEIDEVELIRDGDHIVLVSSDWVPDVAQIRPNDQ

SEQ ID NO: 847 - protein, 885 aa, Zea mays
MAGCAPSRVASCGPWGDRAALESELSWDGSHYSISSGILPSLGARSNRRVKLRPFIVSPYDRRYRCWETFLIILVVYSAWVSPFEFGFIQKPTGALAAVDNVVNAFFAVDIILTFFVAYLDRMTYLLEDDPKRIAWRYTTSWFVLDVASTIPSEFARKILPPDLRSYGFFNMLRLWRLRRVSSLFARLEKDRHFNYFWVRCAKLICVTLFAVHCSACFYYLLADMYPTPTDTWIGNSMPDFHERGLWICYVVSVYWSITTLTTVGYGDLHAENTREMIFNIFYMLFNLGLTAYLIGNMTNLVVHGTSRTRKYRDTIQAATSFALRNQLPSRLQDQMISHLCLKFRTDSEGLQQQETLDVLPKAIRSSISQYLFFNLVQKVYLFEGVSNDLIFQLVSEMKAEYFPPREDVILQNEAPTDFYILVTGSAELIELQNGGEQMVGVAKAGDVVGEIGVLCYRPQLFTVRTKSLCQLLRMNRTAFLSLVQSNVADGTIIMNNLIRLLKQQNDNSVMMGVLKEIENMLARGRLDLPVTLCFAVNKGDDFMLHQLLKRGLDPNESDNNGHTALHIAASKGDEQCVKLLLDYGADPNARDSEGKVPLWEALCEKHNAVVELLVESGAELSSGDTALYACIAVEENDAELLENVIRYGGNINNPTKDGTTPLHRAVCDGNVQMVELLLEHGADVDKQDSNGWSPRDLADQQGHDDIQALFKSRKAHRKHASNGRVAPMLIGRFNSEPSMPDMSHENARVRSEVVPQKLLRKRVSFQNSLFGVISSSHAHQDTGRLLSKGLAGTEGPSCRHDSLIRVTISCPEKGGNAAGKLVRLPRSMAELLELGAKKFGIKPGKVLTVGGAEIDEVELIRDGDHILLVSDEWVPDVEQIRPKQ

SEQ ID NO: 848 - protein, 887 aa, Zea mays
MAGCAPSRVASCGPWGGRAALESELSWDGSHYSISSGILPSLGARSNRRVKLRPFIVSPYADRYRCWETFLIILVVYSAWVSPFEFGFIQKPTGALAAVDNVVNAFFAVDIILTFFVAYLDRMTYLLEDDPKRIAWRYTTSWFVLDVASTIPSEFARKILPPDLRSYGFFNMLRLWRLRRVSSLFARLEKDRHFNYFWVRCAKLICVTLFAVHCSACFYYLLADMYPTPTDTWIGNSMPDFHQRGLWIRYVVSVYWSITTLTTVGYGDLHAENTREMIFNILYMLFNLGLTAYLIGNMTNLVVHGTSRTRKYRDTIQAATSFALRNQLPSRLQDQMMSHLCLKFRTDSEGLQQQETLDVLPKAIRSSISQYLFFNLVQKVYLFEGVSNDLIFQLVSEMKAEYFPPREDVILQNEAPTDFYILVIGSAELIELQNGGEQMVGVAKAGDVVGEIGVLCYRPQLFTVRTKSLCQLLRMNRTAFLSLVQSNVADGTIIMNNLIRLLKQQNDNSVMMGVLKEYENMLARGRLDLPVTLCFAVNKGDDFMLHQLLKRGLDPNESDNNGHTALHIAASKGDEQCVKLLLEHGADPNARDSEGKVPLWEALCEKQNPVVELLVQSGAGLSSGDVALYSCVAVEENDPELLENIIRYGGNVNSSMKDGTTPLHRAVCDGNVQMVELLLEHGADIDKQDNNGWSARALADQQGHDDIHSLSRSRKAHRQQHASKGTVAPVPIWRFNSEPTMPNIKHEEDAELRGKVVPQKLLRKRVSFQNSLFGVISSSHARQDTGRLLSKGLAGPGSPGCSHGSLVRVTIGCPEKGNAAGKLVLLPRSMTEVLELGARKFGFKPTKVLTTGGAEIDEVELIRDGDHVVLVSDDWAPDVAQLRPNDK

SEQ ID NO: 849 - protein, 935 aa, Oryza sativa Japonica Group
MARWGAARMAACGPWGRNRRVGAGDAFEASEVRRDGRSRMMPACGPWGAGHGGGDPALERELSRDGSHYSISSAILPSLGARSNRRIKLRRFIISPYDRRYRIWETFLIVLVVYSAWVSPFEFGFIPKPTGALATADNVVNAFFAVDIILTFFVAYLDKMSYMLEDDPKKIAWRYSTTWLVLDVASTIPSEFARRILPSKLRSYGFFNMLRLWRLRRVSSLFSRLEKDRHFNYFWVRCAKLICVTLFAVHCAACFYYLLADRYPVPTSTWIGNYMADFHERSLWIRYVTSVYWSITTLTTVGYGDLHAENTREMIFNIFYMLFNLGLTAYLIGNMTNLVVHGTSRTRNYRDTIQAATSFGVRNQLPPRLQDQMISHISLKYRTDSEGLQQQEILDSLPKAIKSSISQYLFFHLVQNVYLFQGVSNDLIFQLVSEMKAEYFPPREDVILQNEAPTDFYILVSGSVELVEQQNGADQVIQVATSGEVVGEIGVLCYRPQLFTVRTRSLCQLLRLNRTAFLSIVQSNVGDGTIIMNNLIQFLKEQKENSVMAGVVKEIESMLARGNLDLPITLCFAVTRGDDFLLHQLLKRGMDPNESDNDGHTALHIAASKGNEQCVRLLLEYGADPNARDSEGKVPLWEALCEKHAAVVQLLVEGGADLSSGDTGLYACIAVEESDTELLNDIIHYGGDVNRARRDGTTALHRAVCDGNVQMAELLLEHGADIDKQDGNGWTPRALAEQQGHDDIQLLFRSRKAATASGHHHVPSSTTTRVAPAAAAASLIGRFNSEPMMKNMIHEDADLPSRVLPEKLRRKRVTFQNSLFGVISSSQAQRETDHPLSRGGLAATGSPNPSSGSRNAVIRVTISCPEKGNTAGKLVLLPQTLDMLLELGAKKFDFAPTKVLTVEGAEVDEVELIRDGDHLVLVSNEWDAEKMKGKS

SEQ ID NO: 850 - protein, 935 aa, Oryza sativa
MARWGAARMAACGPWGRNRRVGAGDAFEASEVRRDGRSRMMPACGPWGAGHGGGDPALERELSRDGSHYSISSAILPSLGARSNRRIKLRRFIISPYDRRYRIWETFLIVLVVYSAWVSPFEFGFIPKPTGALATADNVVNAFFAVDIILTFFVAYLDKMSYMLEDDPKKIAWRYSTTWLVLDVASTIPSEFARRILPSKLRSYGFFNMLRLWRLRRVSSLFSRLEKDRHFNYFWVRCAKLICVTLFAVHCAACFYYLLADRYPVPTSTWIGNYMADFHERSLWIRYVTSVYWSITTLTTVGYGDLHAENTREMIFNIFYMLFNLGLTAYLIGNMTNLVVHGTSRTRNYRDTIQAATSFGVRNQLPPRLQDQMISHISLKYRTDSEGLQQQEILDSLPKAIKSSISQYLFFHLVQNVYLFQGVSNDLIFQLVSEMKAEYFPPREDVILQNEAPTDFYILVSGSVELVEQQNGADQVIQVATSGEVVGEIGVLCYRPQLFTVRTRSLCQLLRLNRTAFLSIVQSNVGDGTIIMNNLIQFLKEQKENSVMAGVVKEIESMLARGNLDLPITLCFAVTRGDDFLLHQLLKRGMDPNESDNDGHTALHIAASKGNEQCVRLLLEYGADPNARDSEGKVPLWEALCEKHAAVVQLLVEGGADLSSGDTGLYACIAVEESDTELLNDIIHYGGDVNRARRDGTTALHRAVCDGNVQMAELLLEHGADIDKQDGNGWTPRALAEQQGHDDIQLLFRSRKAATASGHHHVPSSTTTRVAPAAAAASLIGRFNSEPMMKNMIHEDADLPSRVLPEKLRRKRVTFQNSLFGVISSSQAQRETDHPLSRGGLAATGSPNPSSGSRNAVIRVTISCPEKGNTAGKLVLLPQTLDMLLELGAKKFDFAPTKVLTVEGAEVDEVELIRDGDHLVLVSDEWDAEKMKGKS

SEQ ID NO: 851 - protein, 898 aa, Hordeum vulgare
MSSRSGAARMRACGPWGEASGSGAVGDAHALEREMSRDGSHYSLSSGILPSLGARSNRRVKLRPFIISPYDRRYRLWETFLIVLVVYSAWISPFEFGFIRIPTGGLAATDNAVNAIFAIDIILTFFVAYLDRLTYLLEDDPKRIAWRYATSWLVLDVASTIPSEIARRMLPSKLRSYGFFNMLRLWRLRRVSSLFARLEKDRHFNYFWVRCAKLICVTLFAVHCAACFYYLLADRYPNPQETWIGNTMPDFHSKGLWIRYVTSVYWSITTLTTVGYGDYHAENIREMIFNIFYMFFNLGLTAYLIGNMTNLVVHGTSRTRKYRDTIQAATSFALRNQLPPRLQDQMISHLSLKFRTDSEGLQQQETLDALPKAIRSSISQYLFLNLVQNIYLFQGVSNDLIFQLVSEMKAEYFPPREDVILQNEAPTDFYILVSGSVELVEVPNGAEHGAEQVVGVAKSGDVIGEIGVLCYRPQLFTVRTRSLCQLLRMNRTAFLSIVQSNVGDGTIIMNNLIQLLKEQKDGVMVGVLKEIESMLARGRLDLPITLGFAVTRGDDHLLHQLLKRNLDPNESDQDGRTALHIAASKGNEQCVKLLLDYGADPNARDSEGKVPLWEAVYAKHDTVVQLLIKGGAELSAGDTSLYACTAVEQNDIELLKQILKHVIDVNRPSKDGNIPLHRAVCDGNVEMVELLLRHGADIDKQDSNGWTPRALAEQQGHEEIQNLFRSVVAPRKYTSNGRVTPMLLGRFSSDPSMQKVIREDAEQQPSKVLPQRRKVSFHNSLFGVISSSHPRRETDHLLSRGLAATGGPSYPQAHHRPLIRVTIGCPEKGNTAGKLVILPGSMKELLQLGAKKFDMMPTKVLTIEGAEVDEVELIRDGDHLVLASDDWVPDDTQIRGEN

SEQ ID NO: 852 - protein, 897 aa, Triticum aestivum
MSSRSGAARMRACGPWGEGGSGVVGDAHALEREMSRDGSHYSLSSGILPSLGARSNRRVKLRRFIISPYDRRYRLWETFLIVLVVYSAWVSPFEFGFIRIPTGGLAATDNAVNAIFAVDIILTFFVAYLDRLTYLLEDDPKRIAWRYATSWLVLDVASTIPSEIARRMLPSKLRSYGFFNMLRLWRLRRVSSLFARLEKDRHFNYFWVRCAKLICVTLFAVHCAACFYYLLADRYPDPKETWIGNTMPDFHSKGLWIRYVTSVYWSITTLTTVGYGDYHAENIREMIFNIFYMFFNLGLTAYLIGNMTNLVVHGTSRTRKYRDTIQAATSFALRNQLPPRLQDQMISHLSLKFRTDSEGLQQQETLDALPKAIRSSISQYLFLNLVQNIYLFQGVSNDLIFQLVSEMKAEYFPPREDVILQNEAPTDFYILVSGSVELVEVPNGAEHGAEQVVGVAKSGEVIGEIGVLCYRPQLFTVRTRSLCQLLRMNRTAFLSIVQSNVGDGTIIMNNLIQLLKEQTDGVMVGVLKEIESMLARGRLDLPITLCFAVTRGDDHLLHQLLKRNLDPNESDQDGRTALHIAASKGNEQCVKLLLEYGADPNARDSEGKVPLWEAVYAKHDTVVQLLVKGGAELSSGDTSLYACTAVEQNNIELLKQILKHVIDVNRPSKDGNIPLHRAVCDGNVEMVELLLRHGADIDKQDSNGWTPRALAEQQGHEEIQNLFRSVIAPRKYTSNGRVTPMLLGRFSSDPSMQKVIHEDVEQQPSKVLPQRRKVSFHNSLFGVISSAHPRRETDHLLSRGLAATGGPTYPQAHHNPLIRVTISCPEMGNTAGKLVILPGSIKELLQLGAKKFDMMPTKVLTIEGAEVDEVELIRDGDHLVLASDDWVPDDTQIRGKN

SEQ ID NO: 853 - protein, 860 aa, Oryza sativa
LPSLGARSNRRIKLRRFIISPYDRRYRIWETFLIVLVVYSAWVSPFEFGFIPKPTGALATADNVVNAFFAVDIILTFFVAYLDKMSYMLEDDPKKIAWRYSTTWLVLDVASTIPSEFARRILPSKLRSYGFFNMLRLWRLRRVSSLFSRLEKDRHFNYFWVRCAKLICVTLFAVHCAACFYYLLADRYPVPTSTWIGNYMADFHERSLWIRYVTSVYWSITTLTTVGYGDLHAENTREMIFNIFYMLFNLGLTAYLIGNMTNLVVHGTSRTRNYRDTIQAATSFGVRNQLPPRLQDQMISHISLKYRTDSEGLQQQEILDSLPKAIKSSISQYLFFHLVQNVYLFQGVSNDLIFQLVSEMKAEYFPPREDVILQNEAPTDFYILVSGSVELVEQQNGADQVIQVATSGEVVGEIGVLCYRPQLFTVRTRSLCQLLRLNRTAFLSIVQSNVGDGTIIMNNLIQFLKEQKENSVMAGVVKEIESMLARGNLDLPITLCFAVTRGDDFLLHQLLKRGMDPNESDNDGHTALHIAASKGNEQCVRLLLEYGADPNARDSEGKVPLWEALCEKHAAVVQLLVEGGADLSSGDTGLYACIAVEESDTELLNDIIHYGGDVNRARRDGTTALHRAVCDGNVQMAELLLEHGADIDKQDGNGWTPRALAEQQGHDDIQLLFRSRKAATASGHHHVPSSTTTRVAPAAAAASLIGRFNSEPMMKNMIHEDADLPSRVLPEKLRRKRVTFQNSLFGVISSSQAQRETDHPLSRGGLAATGSPNPSSGSRNAVIRVTISCPEKGNTAGKLVLLPQTLDMLLELGAKKFDFAPTKVLTVEGAEVDEVELIRDGDHLVLVSDEWDAEKMKGKS

SEQ ID NO: 854 - protein, 897 aa, Puccinellia tenuiflora
MARFGATRMRACGPWGEGGGSGAVGGALEREMSRDGSQYSLSSGILPSLGARSNRRAKLRRFIISPYDRKYRLWEIFLIVLVVYSAWVSPFEFGFIRIPTGALAATDNAVNAIFAVDIILTFFVAYLDRLTYLLEDDLKRIAWRYTTSWFILDVASTIPSEIARRMLPSKLRSYGFFNMLRLWRLRRVSSLFARLEKDRHFNYFWVRYAKLICVTLFAVHCAACFYYLIADRYPNPKETWIGSTMEDFHQQGLWVRYVTSVYWSITTLTTVGYGDYHAENIREMIFNVFYMFFNLGLIAYLIGNMTNLVVHGTNRTRTYRDTIQAASSFAIRNQLPHRLQDQMISHLSLKFRTDSEGLQQQETLDVLPKAIRSSISHYLFLHLVQNIYLFKGVSNDLIFQLVSEMKAEYFPPREDVILQNEAPTDFYILVSGSVELLELQNGAEHGAEQVVGVAKSGDVVGEIGVLCYRPQLFTVRTKSLCQLLRMNRTAFLSIVQSNVGDGTIIMNNLIQLLKDQKDNGVMVSVLKEIENMLARGRLDLPITLSFAVTRGDDHLVHQLLKRNLDPNESDQDGRTALHIAASTGNEQCVKLLLDYGADPNARDSEGKVPLWEAMYAKHDTVVQLLVKGGADLSLGDTGLYCCLAIEQNNIELLEEILNRIHDANMPSKDGNIPLHRAVCDGNVEMVALLLKHRADIDKMDSNGWTPRALAEQQGHEEIQALFKPLTPPIKYISNGRATPMLLGRFSSDPSMRNVIREDTELPSKVLPQKLGRRKVSFQNSLFGVISSSHPHPHRDTDQLLSRGLAATGAPSYRQDHHKPLVRVIISCPEKGNTAGKLAVLPRSMQELLQLGAKKFDMMPTKVLTIEGAEVDEVELIRDGDHLVLASNDWVPDVMQTR

SEQ ID NO: 855 - protein, 884 aa, Oryza sativa Japonica Group
MARWGAARMAACGPWGRNRRVGAGDAFEASEVRRDGRSRMMPACGPWGAGHGGGDPALERELSRDGSHYSISSAILPSLGARSNRRIKLRRFIISPYDRRYRIWETFLIVLVVYSAWVSPFEFGFIPKPTGALATADNVVNAFFAVDIILTFFVAYLDKMSYMLEDDPKKIAWRYSTTWLVLDVASTIPSEFARRILPSKLRSYGFFNMLRLWRLRRVSSLFSRLEKDRHFNYFWVRCAKLICVTLFAVHCAACFYYLLADRYPVPTSTWIGNYMADFHERSLWIRYVTSVYWSITTLTTVGYGDLHAENTREMIFNIFYMLFNLGLTAYLIGNMTNLVVHGTSRTRNYRDTIQAATSFGVRNQLPPRLQDQMISHISLKYRTDSEGLQQQEILDSLPKAIKSSISQYLFFHLVQNVYLFQGVSNDLIFQLVSEMKAEYFPPREDVILQNEAPTDFYILVSGSVELVEQQNGADQVIQVATSGEVVGEIGVLCYRPQLFTVRTRSLCQLLRLNRTAFLSIVQSNVGDGTIIMNNLIQFLKEQKENSVMAGVVKEIEITRGDDFLLHQLLKRGMDPNESDNDGHTALHIAASKGNEQCVRLLLEYGADPNARDSEGKVPLWEALCEKHAAVVQLLVEGGADLSSGDTGLYACIAVEESDTELLNDIIHYGGDVNRARRDGTTALHRAVCDGNVQMAELLLEHGADIDKQDGNGWTPRALAEQQGHDDIQLLFRSRKAATGEWPPSDADLPSRVLPEKLRRKRVTFQNSLFGVISSSQAQRETDHPLSRGGLAATGSPNPSSGSRNAVIRVTISCPEKGNTAGKLVLLPQTLDMLLELGAKKFDFAPTKVLTVEGAEVDEVELIRDGDHLVLVSNEWDAEKMKGKS

SEQ ID NO: 856 - protein, 448 aa, Zea mays; identical to SEQ ID NO: 747

SEQ ID NO: 857 - protein, 448 aa, Sorghum bicolor; identical to SEQ ID NO: 746

SEQ ID NO: 858 - protein, 316 aa, Sorghum bicolor
MASLTLPPAPPNPRQDAIDLHKAFKGFGCDSTAVINILTHRDSVQRGLIQQEYRAMYHEELFHRISSELSGNHKKAMSLWILDPAGRDATVLREALSGDTMDLRAATEIICSRTPSQLQIMKQTYYARFGTYLEHDIGHHTSGDHQKLLLAYVGIPRYEGPEVDPTIVTHDAKDLYKAGEKRLGTDEKTFIRVFTERSWAHLASVSSAYHHMYDRKLEKVVKSETSGNFEFALLTILRCAENPAKYFAKLLRKAMKGLGTDEKTLTRVVVTRTEIDMQYIKAEYFKKYKKPLAEAINSETSGNYRAFLLSLVGHGH

SEQ ID NO: 859 - protein, 316 aa, Zea mays
MASLTLPPAPPNPRQDAIDLHKAFKGFGCDSTTVINILTHRDSVQRGLIQQEYRAMYHEELSHRISSELSGNHKKAMSLWILDPAGRDATVLREALNGDTMDLRAATEIICSRTPSQLQIMKQTYYARFGTYLEHDIAHHTSGDHQKLLLAYMGIPRYEGPEVDPTIVTHDAKDLYKAGEKRLGTDEKIFIRVFTERSWAHLASVSSAYHHMYDRKLEKVIKSETSGNFEFALLTILRCAENPAKYFAKLLRKAMKGLGTDDMTLIRVVVTRTEIDMQYIKAEYLKKYKKPLAEAINSETSGNYRTFLLSLVGHGH

SEQ ID NO: 860 - protein, 316 aa, Zea mays
  misc_feature (244)..(244): Xaa can be any naturally occurring amino acid
  misc_feature (259)..(259): Xaa can be any naturally occurring amino acid
  misc_feature (269)..(269): Xaa can be any naturally occurring amino acid
  misc_feature (288)..(288): Xaa can be any naturally occurring amino acid
MASLTLPPAPPNPRQDAIDLHKAFKGFGCDSTTVINILTHRDSVQRGLIQQEYRAMYHEELSHRISSELSGNHKKAMSLWILDPAGRDATVLREALNGDTMDLRAATEIICSRTPSQLQIMKQTYYARFGTYLEHDIAHHTSGDHQKLLLAYMGIPRYEGPEVDPTIVTHDAKDLYKAGEKRLGTDEKIFIRVFTERSWAHLASVSSAYHHMYDRKLEKVIKSETSGNFEFALLTILRCAENPXKYFAKLLRKAMKGLXTDDMTLIRVXVTRTEIDMQYIKAEYLKKXKKPLAEAINSETSGNYRTFLLSLVGHGH

SEQ ID NO: 861 - protein, 315 aa, Oryza sativa Japonica Group
MASLTLPPAPTNPRQDAIDLHKAFKGFGCDSTTVINILTHRDSMQRALIQQEYRTMYSEDLSRRISSELSGHHKKAMLLWILDPAGRDATVLREALSGDTIDLRAATEIICSRTPSQLQIMKQTYHAKFGTYLEHDIGQRTSGDHQKLLLAYVGIPRYEGPEVDPTIVTHDAKDLYKAGEKRLGTDEKTFIRIFTERSWAHMASVASAYHHMYDRSLEKVVKSETSGNFELALLTILRCAENPAKYFAKVLRKSMKGMGTDDSTLIRVVVTRTEIDMQYIKAEYYKKYKKSLAEAIHSETSGNYRTFLLSLVGSH

SEQ ID NO: 862 - protein, 349 aa, Oryza sativa Indica Group
MASLTLPPAPTNPRQDAIDLHKAFKGRTVVVGVLDCQMLKTWTGRAEVGNGAAFKGSSGGFGCDSTTVINILTHRDSMQRALIQQEYRTMYSEDLSRRISSELSGHHKKAMLLWILDPAGRDATVLREALSGDTIDLRAATEIICSRTPSQLQIMKQTYHAKFGTYLEHDIGQRTSGDHQKLLLAYVGIPRYEGPEVDPTIVTHDAKDLYKAGEKRLGTDEKTFIRIFTERSWAHMASVASAYHHMYDRSLEKVVKSETSGNFELALLTILRCAENPAKYFAKVLRKSMKGMGTDDSTLIRVVVTRTEIDMQYIKAEYYKKYKKSLAEAIHSETSGNYRTFLLSLVGSH

SEQ ID NO: 863 - protein, 284 aa, Zea mays
MASLTLPPAPPNPRQDAIDLQKAFKGFGCDSTTVINILTHRDSVQRGLIQQEYRAMYHEELSHRISSELNGNHKKAMLLWILDPAGRDATVLREALSVDTMDLRAATDIICSRTPSQLQIMKQTYYARFGTYLEHDIGHHTSGDHQKLLLAYVGIPRYEGPEVDPTIVTHDAKDLYKAGEKRLGTDEKTFIRVFTERSWAHLASVSSAYHYMYDRKLEKVIKSETSGNFEFALLAILRCAENPAKYFAKAEYFKKYKKPLAEAIHSETSGNYRTFLLSLVGPGH

SEQ ID NO: 864 - protein, 316 aa, Hordeum vulgare subsp. vulgare
MASLSVPPVLTPPREDAIALHKAFKGLGCDTTMVINILAHRDTAQRVLIQQEYKAIYHEDLYHRLATELSGNHKNAMLLWVLDPVGRDATILNQALNGDITDLRAATEVICSRTPSQLQIMKQTYRARFGCYLEHDITERTYGDHQKLLLAYLGVPRNEGPEVDPSVVTDDARELYRTGEKRVGTDERAFIRIFSERSWAHLASVAKAYQHMYARSLEKAVKSETAGNFQFGLLTILRCADTPAKYFAKVLHKAMKGLGTSNAALIRVVVTRTEVDMKYIKVEYHNKYKGSLAEAIHSETSGNYRTFLLSLVGQDR

SEQ ID NO: 865 - protein, 317 aa, Zea mays
MASLTMPPVPAWPRQDAIDLHKAFRGFGCDSTTVTNILAHRDATQRSLIQQEYRAVFNQDLARRIASELSGHHKRAMLLWILDPATRDATILKQALTGDITNLRAATEIVCSRTPSQLQIMRQTYRARFGCYVEHDVTERTSGDHQRLLLAYLAIPRAEGHEVDPSTVTLDARDLYKAGERRLGTDERAFIRIFSQRSWAHMAAVARAYHHMYDRPLERAVKSETSGNFGFGLLTVLRCADSPARYFAKELHRAMKGLGTSDSVLIRVVVTRAEIDMQYIKAEYHSMYKRSLADAIHAETSGNYRTFLLSLVGRDRT

SEQ ID NO: 866 - protein, 316 aa, Triticum aestivum
MASLSVPPVLTPPRDDAVALHKAFKGFGCDSTTVTNILAHRDSAQRALILHEYKAMYHQDLYHRLATELSGNHKNAMLLWVLDPAGRDATILNQALNGDITDLRAATEVICSRTPSQLQIMKQAYRARFGCYLEHDITERTYGDHQKLLLAYLGVRRNEGPEVDPSAVTDDARELYQAGEKRVGTDERAFIRIFSERSWAHMVSVANAYQHMYARSLEKAVKSETTGNFQFGLLTILRCADTPAKYFAKVLHKAMKGLGTSNAALTRVAVTRTEVDMKYIKAEYHNKYKGSLAEAIHSETSGNYRTFLLSLVGRDR

SEQ ID NO: 867 - protein, 316 aa, Elaeis guineensis
MSTWSIPPVLSSPRQDAIDLYKAFKGFGCDSAAVVNILAHRDATQRALIQQEYRAMYSEELIKRLSSELSGNLKRAMLLWVLDPPGRDATILRQALSGDVIDLQAATEVICSRTPSMIQIIKQAYYAKFGSYLEHDIHRQTSGDHQKLLLACVSMPRYEGPEVDSIMVANDAKVLFKAGEKRLGTDEKAFIRIFSERSSAHLAAVSSCYSHTYGSSLEKAVKSETSGYFEVALLAILRVAENPAKYFAKVLRKAMKGLGTNDTTLIRVVVSRTEIDMQYIKAEYRKKYNKPLKDAIHSETSGHYRTFLLSLVGPNN

SEQ ID NO: 868 - protein, 377 aa, Zea mays
MATKVVVDLRSDTVTKPSEAMRASMAAADVDYDVRGADPTARRFQEKMAELMGKEAALFVPSGTMGNLVSVLAHCDVRGSEVILGDDSHIHLYENGGISTLGGVHPKTVRNNSDGTMDIDSIVAAIRPPGGGLYYPTTRLICLENTHGNSGGKCLSAEYTEKVGEIAKSHGLKLHIDGARIFNASVALGVPVDRLVRAADSVSVCISKGLGAPVGSVIVGSKAFIDKAKILRKTLGGGMRQVGVLCAAAHVAVHDNVGKLADDHRKAKALADGLNKIEQFRVDSASVQTNMVFLDIVDSRISSNKLCQVLGTHNVLASPRSPKSVRLVLHYQISDDDVQYALTCFKKAAEQLLMGSTELEHLAEQLLMGTTKNSYGQ

SEQ ID NO: 869 - protein, 377 aa, Zea mays
MATKVVVDLRSDTVTKPSEAMRASMAAADVDDDVRGADPTARRFQEEMAALMGKEAALFVPSGTMGNLVSVLAHCDVRGSEVILGDDSHIHLYENGGISTLGGVHPKTVRNNSDGTMDIDSIVAAIRPPGGGLYYPTTRLICLENTHGNSGGKCLSAEYTEKVGEIAKSHGLKLHIDGARIFNASVALGVPVDRLVRAADSVSVCISKGLGAPVGSVIVGSKAFIDKAKILRKTLGGGMRQVGVLCAAAHVAVRDNVGKLADDHRKAKALADGLNKIEQFRVDSASVQTNMVFLDIVDSRISSNKLCQVLGTHNVLASPRSPKSVRLVLHYQISDDDVQYALTCFKKAAEQLLMGSTELEHLAEQLLMGTTKNSYGQ

SEQ ID NO: 870 - protein, 375 aa, Zea mays
MATKVVVDLRSDTVTKPSEAMRASMAAADVDDDVRGADPTARRFQEEMAALMGKEAALFVPSGTMGNLVSVLAHCDVRGSEVILGDDSHIHLYENGGISTLGGVHPKTVRNNSDGTMDIDSIVAAIRPPGGGLYYPTTRLICLENTHGNSGGKCLSAEYTEKVGEIAKSHGLKLHIDGARIFNASVALGVPVDRLVRAADSVSVCISKGLGAPVGSVIVGSKAFIDKAKILRKTLGGGMRQVGVLCAAAHVAVRDNVGKLADDHRKAKALADGLNKIEQFRVDSASVQTNMVFLDIVDSRISSNKLCQVLGTHNVLASPRSPKRLVLHYQISDDDVQYALTCFKKAAEQLLMGSTELEHLAEQLLMGTTKNSYGQ

SEQ ID NO: 871 - protein, 372 aa, Oryza sativa Japonica Group
MVTNVVDLRSDTVTKPSDAMRAAMAAADVDDDVLGADPTAHRFEMEMARITGKEAALFVPSGTMANLISVLVHCDTRGSEVILGDNSHIHIYENGGISTIGGVHPKTVRNNPDGTMDIDKIVVAIRHPDGALYYPTTRLICLENTHANCGGKCLSAEYTDEVGEVAKSHGLKLHIDGARIFNASVALGVPVHRLVKAADSVSVCISKGLGAPVGSVIVGSTAFIEKAKILRKTLGGGMRQVGILCAAAYVAVRDTVGKLADDHRRAKVLADGLKKIKHFRVDTTSVETNMVFFDIVDSRISPDKLCQVLEQRNVLAMPAGSKSMRLVIHYQISDSDVQYALTCVEKAAEEILTGSKKFEHLTNGTTRNSYGH

SEQ ID NO: 872 - protein, 349 aa, Oryza sativa Japonica Group
MAAADVDDDVLGADPTAHRFEMEMARITGKEAALFVPSGTMANLISVLVHCDTRGSEVILGDNSHIHIYENGGISTIGGVHPKTVRNNPDGTMDIDKIVVAIRHPDGALYYPTTRLICLENTHANCGGKCLSAEYTDEVGEVAKSHGLKLHIDGARIFNASVALGVPVHRLVKAADSVSVCISKGLGAPVGSVIVGSTAFIEKAKILRKTLGGGMRQVGILCAAAYVAVRDTVGKLADDHRRAKVLADGLKKIKHFRVDTTSVETNMVFFDIVDSRISPDKLCQVLEQRNVLAMPAGSKSMRLVIHYQISDSDVQYALTCVEKAAEEILTGSKKFEHLTNGTTRNSYGH

SEQ ID NO: 873 - protein, 372 aa, Sorghum bicolor
MVTKVVDLRSDTVTKPSDAMRAAMAAADVDDDVLGADPTARRFEGEMAALTGKDAALFVPSGTMANLISVLVHCDVRGSEVILGDNSHIHVYENGGISTIGGVHPRTVPNNPDGTMDVDKILAAIRNPDGALLYPTTRLICLENTHANCGGKCLSVEYTDKVGQIAVNHGLKLHIDGARIFNASVALGVPVHRLVKAADSVSICLSKGLGAPIGSVIVGSKAFIDKAKILRKTLGGGMRQVGVLCAAAYVAVRDTVGKLADDHRKAKALAEGLKKIKQFTVDSSSVETNMVFFDIVDPRISPNKLCQVLEQRNVLAMPASSKSVRFVVHYQISDSDVQYALTCVEKAVEELLKGGTKLEHLTNGTVKNAYWH

SEQ ID NO: 874 - protein, 370 aa, Zea mays
MASKVVDLRSDTVTKPSEAMRAAMAAADVDDDVLGADPTAHRFEAEMAAVMGKEAALFVPSGTMGNLISVLVHCDVRGSEAILGDNSHIHVYENGGISTIGGVHPRTVKNNPDGTMDIDKIVAAIRHPDLHYPTTRLICLENTHGNTGGKCLSVEYTDKVGEIAKSHGLKLHIDGARIFNASVALGVPVDRLVKAADSVSVCLSKGLGAPVGSVIVGSKAFIDKARILRKTLGGGMRQVGVLCAAAHVAVRDTMGKLADDHRKAKALAVGLKKIEQITVDPASVETNMVFFEVMDPRISPDKLCQVLEQHNVLAMPANSKSIRFVVHYQISDADVRYALACVQKAIKELLEGSTELGHSINGATKSSYGH

SEQ ID NO: 875 - protein, 374 aa, Hordeum vulgare subsp. vulgare
MVTKVVDLRSDTVTKPSEAMRAAMAAAEVDDDVLGADPTAQRFEAEMARITGKEAALFVPSGTMGNLVSVLTHCDTRGSEVILGDSSHIHMCENGGISTIGGVHSMPVVNNPDGTMDIDKIVAAIRHRVGAGALHYPTTRLICLENTHGRSGGKCLSAEYIDKVGEVAQSHGLKLHIDGARIFNASVALGVPVDRLVRAADSVSVCLSKGLGAPVGSVIVGSKAFIDQARILRKTLGGGMRQVGVLCAAAYVAVRDNVGKLADDHRKAKVLADGLKKIKQFTVDLTSVETNMVFFDIADPRITSDKLCQLLERRNVLAMPGTSKSVRLVIHYQISDSDVQYTLTCIEKAVEEILSGSAKFEHLTNGSTTNSYGH

SEQ ID NO: 876 - protein, 369 aa, Hordeum vulgare subsp. vulgare
MAAKVVDLRSDTVTKPSEAMRAAMAAADVDDDVLGADPTARRFEAEMARIMGKEAALFVPSGTMANLISVLAHCDARGSEVILGDDSHIHVYEHGGISTLGGVHPRTVPNNPDGTMDVDRIVAAIRSPDGALYYPTTRLICLENTHGNSGGKCLTVEYTDKVGEVAKAHGLKLHIDGARIFNASVALGVPVDTLVRAADSVSVCLSKGIGAPVGSVIVGSKAFINKTKILRKTLGGGMRQVGVLCAAAEVGVRDTIGKLTDDHRKAKVLADGLKKIEQFTVDLTSVETNMVFFHMADPRITPAKLCKVLEQRNVLAMPTSSKSVRLVVHYQISDSDVQYTLTCIEKAVGEILACDAKLERPTNGAAANS

SEQ ID NO: 877 - protein, 321 aa, Zea mays
MASKVVDLRSDTVTKPSEAMRAAMAAADVDDDVLGADPTAHRFEAEMAAVMGKEAALFVPSGTMGNLISVLVHCDVRGSEAILGDNSHIHVYENGGISTIGGVHPRTVKNNPDGTMDIDKIVAAIRHPDLHYPTTRLICLENTHGNTGGKCLSVEYTDKVGEIAKSHGLKLHIDGARIFNASVALGVPVDRLVKAADSVSVCLSKGLGAPVGSVIVGSKAFIDKARILRKTLGGGMRQVGVLCAAAHVAVRDTVGKLADDHRKAKALAEGLKKIEQITVDSASVETNMVFFEVMDPRISPDKLCQVLEQDNVLALPANSKR

SEQ ID NO: 878 - protein, 168 aa, Setaria italica
  misc_feature (159)..(159): Xaa can be any naturally occurring amino acid
MAAASSTTSVHDFTVKDASGKDVDLSTYKGKVLLIVNVASQCGLTNSNYTELAQLYEKYKDQGFEILAFPCNQFGGQEPGTNEEIVQFACTRFKAEYPIFDKVDVNGNNAAPIYKFLKSSKGGLFGDSIKWNFSKFLVDKEGRVVDRYAPTTSPLSIEXDIKKLLGSS

SEQ ID NO: 879 - protein, 168 aa, Sorghum bicolor
MAAASSATSVHDFTVKDASGKDVDLSTYKGKVLLIVNVASQCGLTNSNYTELAQLYEKYKDQGFEILAFPCNQFGGQEPGTNEEIVQFACTRFKAEYPIFDKVDVNGNNAAPIYKFLKSSKGGLFGDSIKWNFSKFLVDKEGRVVDRYAPTTSPLSIEKDIKKLLGSS

SEQ ID NO: 880 - protein, 168 aa, Zea mays
MAASSTATSVHDFIVKDASGKDVDLSTYKGKVLLIVNVASQCGLTNSNYTELAQLYEKYKDQGFEILAFPCNQFGGQEPGTNEEIVQFACTRFKAEYPIFDKVDVNGSNAAPIYKFLKSSKGGLFGDSIKWNFSKFLVDKEGRVVDRYAPTTSPLSIEKDIKKLLGSS

SEQ ID NO: 881 - protein, 168 aa, Zea mays
MAASSTATSVHDFIVKDASGKDVDLSTYKGKVLLIVNVASQCGLTNSNYTELAQLYEKYKDQGFEILAFPCNQFGGQEPGTNKEIVQFACTRFKAEYPIFDKVDVNGSNAAPIYKFLKSSKGGLFGDSIKWNFSKFLVDKEGRVVDRYAPTTSPLSIEKDIKKLLGSS

SEQ ID NO: 882 - protein, 168 aa, Oryza sativa Indica Group
MAAAPSATSVHDFTVKDASGKDVDLSTYKGKVLLIVNVASQCGLTNSNYTELSQLYEKYKVQGFEILAFPCNQFGGQEPGSNEEIVQFACTRFKAEYPIFDKVDVNGNNAAPLYKYLKSNKGGLFGDSIKWNFSKFLVDKEGRVVDRYAPTTSPLSIEKDIKKLLGSS

SEQ ID NO: 883 - protein, 168 aa, Zea mays
MAAASSATSVHDFTVKDSSGKDVDLSVYRGKVLLIVNVASQCGLTNSNYTQQAQLYEKYKNQGFEILAFPCNQFGGQEPGTNEEIAQFACTRFKADYPIFDKVDVNGNNAAPIYKFLKSSKGGLFGDSIKWNFSKFLVDKEGRVVDRYAPTTSPLSIEKDIKKLLGSS

SEQ ID NO: 884 - protein, 168 aa, Zea mays
MAAASSATSVHDFTVKDSSGKDVDLSVYRGKVLLIVNVASQCGLTNSNYTQQAQLYDKYKNQGFEILAFPCNQFGGQEPGTNEEIAQFACTRFKAEYPIFDKVDVNGNNAAPIYKFLKSSKGGLFGDSIKWNFSKFLVDKEGRVVDRYAPTTSPLSIEKDIKKLLGSS

SEQ ID NO: 885 - protein, 168 aa, Oryza sativa Japonica Group
MAAAPSATSVHDFTVKDASGKDVNLSTYKGKVLLIVNVASQCGLTNSNYTELSQLYEKYKVQGFEILAFPCNQFGGQEPGSNEEIVQFACTRFKAEYPIFDKVDVNGNNAAPLYKYLKSNKGGLFGDSIKWNFSKFLVDKEGRVVDRYAPTTSPLSIEKDIKKLLGSS

SEQ ID NO: 886 - protein, 168 aa, Zea mays
MAAASSATSVHDFTVKDASGKDVDLSTYKGKVLLIVNVASQCGLTNSNYTELSQLYEKYKDQGFEILAFPCNQFGGQEPGTNEEIVQFACTRFKAEYPIFDKVDVNGDNTAPIYKFLKSSKGSLFGDNIKWNFSKFLVDKEGHVVERYAPTTSPLSIEKDIKKLLGSY

SEQ ID NO: 887 - protein, 168 aa, Triticum monococcum
MAAASSATSVHDFTVKDSSGKDVDLSVYKGKVLLIVNVASQCGLTNSNYTELSQLYPKYKDQGFEILAFPCNQFGGQEPGTNDEIVQFACTRFKAEYPIFDKVDVNGNNVSPLYKFLKSSKGGLFGDSIKWNFSKFLVDKEGHVVDRYAPTTSPLSIEKDIKKLLGSS

SEQ ID NO: 888 - protein, 168 aa, Sorghum bicolor; identical to SEQ ID NO: 879

SEQ ID NO: 889 - protein, 168 aa, Setaria italica; identical to SEQ ID NO: 878
  misc_feature (159)..(159): Xaa can be any naturally occurring amino acid

SEQ ID NO: 890 - protein, 168 aa, Zea mays; identical to SEQ ID NO: 880

SEQ ID NO: 891 - protein, 168 aa, Zea mays; identical to SEQ ID NO: 881

SEQ ID NO: 892 - protein, 168 aa, Oryza sativa Indica Group; identical to SEQ ID NO: 882

SEQ ID NO: 893 - protein, 168 aa, Zea mays; identical to SEQ ID NO: 883

SEQ ID NO: 894 - protein, 168 aa, Zea mays; identical to SEQ ID NO: 884

SEQ ID NO: 895 - protein, 168 aa, Oryza sativa Japonica Group; identical to SEQ ID NO: 885

SEQ ID NO: 896 - protein, 168 aa, Zea mays; identical to SEQ ID NO: 886

SEQ ID NO: 897 - protein, 168 aa, Triticum monococcum; identical to SEQ ID NO: 887

SEQ ID NO: 898 - protein, 397 aa, Zea mays
MEVCQEDNGSIYKYYTSPMSGYMFTSKMETLHYLFSGVEERMLELQASAEDNELHESHTWLPRGWVIEVRAGGKKMDKMYKFYVHLPTGQRFLSKAEVLHFVNKGMVSTCDMDVLCDTSTDDNILAHVEFNPDGLPDGWVKETISRKFNDGIRKDQYYTDPVSHRVFRTLKSVLSYLGTGEISRHSYLPRRNVIDMYSFDKCADLPKSMVKRLKAKGQAKKKFMRAQVLDKDLSNGQTSNHCEGAIGLTQSDPEGDKFGSMEAACEKGTSSETMKQRIGRPKKILKQTNDSISDRDKGSHQEHIEAKEEVDICGGKDLTHLKTLERTEAQNSTMITKEVNNNDTAEKNLSKIEGDNSDLVTGTGLHKQENSRLTEVSEKATFSTGYKFYKRRSCNKT

SEQ ID NO: 899 - protein, 292 aa, Zea mays
MVSTCDMDVLCDTSTDDNILAHVEFNPDGLPDGWVKETISRKFNDGIRKDQYYTDPVSHRVFRTLKSVLSYLGTGEISRHSYLPRRNVIDMYSFDKCADLPKSMVKRLKAKGQAKKKFMRAQVLDKDLSNGQTSNHCEGAIGLTQSDPEGDKFGSMEAACEKGTSSETMKQRIGRPKKILKQTNDSISDRDKGSHQEHIEAKEEVDICGGKDLTHLKTLERTEAQNSTMITKEVNNNDTAEKNLSKIEGDNSDLVTGTGLHKQENSRLTEVSEKATFSTGYKFYKRRSCNKT

SEQ ID NO: 900 - protein, 627 aa, Sorghum bicolor
MGSRSAASAALRIWLLVSVALLLGCCQGRFVVEKNSLKVTAPDDLKGTYECAIGNFGVPQYGGTMVGFVAYPKANRKACKSFDDFDISYKAKPGAFPTFLLVDRGDCYFAKKAWNAQKAGAAAILVADDKDEPLITMDNPEESGNTDYLENITIPSALITKSFGDRLKKAIDKGDMVNVNLDWREALPHPDERVEYEFWTNSNDECGPKCDSQIDFVKSFKGAAQVLEKKGYTEFTPHYITWYCPEAFILSKQCKSQCINHGRYCAPDPEQDFSKGYDGKDVVVQNLRQVCVFKVAKEHKKPWLWWDYVTDFAIRCPMKEKKYTKECAEGVIKSLGLDHKAIDKCIGDPDADEENPVLKAEQDAQIGKGSRGDVTILPTLVINNRQYRGKLDKGAVLKALCAGFKETTEPAVCLSEDIQTNECLENNGGCWQDKAANITACKDTFRGRVCECPVVKGVKFVGDGYTHCEASGSGRCEINNGGCWKDTKNGRTYSACTDDGCKCPDGFKGDGKHKCEDIDECKEKTACQCKECKCKNTWGSYECGCSGGLLYMREHDTCISKNGGSEAGWGFLWVVFFGLVAAGIAGYAVYKYRIRRYMDSEIRAIMAQYMPLDNQGDVQSHSHHIEM

SEQ ID NO: 901 - protein, 728 aa, Oryza sativa Japonica Group
MEPWTRCSCCLTESGSLPSACFTNSRKSRPLPKSHQRVHPKSIHESLPHSNCLPPPSKSNLSSHLRRFRHAPSTPRSILSPPIRSNPQLGSTNCKGLGADWSMGLRSPNSMLWLVLLVWAALLCGSCHGRFVVEKNSLKVTSPSDMKGTYECAIGNFGVPQYGGTMVGVVAYPKANKKACKSFDDFDISYKAKPGSLPTFLLVDRGDCFFTKKAWNAQNAGAAAILVADDKTEPLITMDTPEESGNTDYLENITIPSALITKSFGDKLKKAIDNGDMVNVNLDWRESLPHPDERVEYEFWTNSNDECGPKCDSQIDFVKSFKGAAQVLEKKGYTQFTPHYITWYCPDSFILSKQCKSQCINHGRYCAPDPEQDFSKGYDGKDVVVQNLRQVCVYKVAKEHGKPWLWWDYVTDFAIRCPMKEKKYTKECADGVIKSLGLDHKAIDKCIADPDADKENPVLKAEQDAQIGKGSRGDVTILPTLVINNRQYRGKLDKGAVLKAICAGFRETTEPAVCLSEDIQTNECLENNGGCWQDKAANISACKDTFRGRVCECPVVKGVKFVGDGYTHCEASGSGHCEINNGGCWKDSRHGRTYSACTNDGCKCPDGFKGDGVHKCEDIDECKERTACQCKECKCKNTWGSYECGCSGGLLYMKEHDTCISKNAATEVGWNFLWVIFFGLVVAGIAGYAVYKYRIRRYMDSEIRAIMAQYMPLDNQGDVPNHSHHIEL

SEQ ID NO: 902 - protein, 626 aa, Oryza sativa Indica Group
MGLRSPNSMLWLVLLVWAALLCGSCHGRFVVEKNSLKVTSPSDMKGTYECAIGNFGVPQYGGTMVGVVAYPKANKKACKSFDDFDISYKAKPGSLPTFLLVDRGDCFFTKKAWNAQNAGAAAILVADDKTEPLITMDTPEENGNTDYLENITIPSALITKSFGDKLKKAIDNGDMVNVNLDWRESLPHPDERVEYEFWTNSNDECGPKCDSQIDFVKSFKGAAQVLEKKGYTQFTPHYITWYCPDSFILSKQCKSQCINHGRYCAPDPEQDFSKGYDGKDVVVQNLRQVCVYKVAKEHGKPWLWWDYVTDFAIRCPMKEKKYTKECADGVIKSLGLDHKAIDKCIGDPDADKENPVLKAEQDAQIGKGSRGDVTILPTLVINNRQYRGKLDKGAVLKAICAGFRETTEPAVCLSEDIQTNECLENNGGCWQDKAANISACKDTFRGRVCECPVVKGVKFVGDGYTHCEASGSGRCEINNGGCWKDSRHGRTYSACTNDGCKCPDGFKGDGVHKCEDIDECKERTACQCKECKCKNTWGSYECGCSGGLLYMKEHDTCISKNAATEVGWNFLWVIFFGLVVAGIAGYAVYKYRIRRYMDSEIRAIMAQYMPLDNQGDVPNHSHHIEL

SEQ ID NO: 903 - protein, 626 aa, Oryza sativa Japonica Group
MALRSPNSMLWLALLVWAALLCGSCHGRFVVEKNSLKVTSPSDMKGTYECAIGNFGVPQYGGTMVGVVAYPKANKKACKSFDDFDISYKAKPGSLPTFLLVDRGDCFFTKKAWNAQNAGAAAILVADDKTEPLITMDTPEESGNTDYLENITIPSALITKSFGDKLKKAIDNGDMVNVNLDWRESLPHPDERVEYEFWTNSNDECGPKCDSQIEFVKSFKGAAQVLEKKGYTQFTPHYITWYCPDSFILSKQCKSQCINHGRYCAPDPEQDFSKGYDGKDVVVQNLRQVCVYKVAKEHGKPWLWWDYVTDFAIRCPMKEKKYTKECADGVIKSLGLDHKAIDKCIGDPDADKENPVLKAEQDAQIGKGSRGDVTILPTLVINNRQYRGKLDKGAVLKAICAGFRETTEPAVCLSEDIQTNECLENNGGCWQDKAANISACKDTFRGRVCECPVVKGVKFVGDGYTHCEASGSGRCEINNGGCWKDSRHGRTYSACTNDGCKCPDGFKGDGVHKCEDIDECKERTACQCKECKCKNTWGSYECGCSGGLLYMKEHDTCISKNAATEVGWNFLWVIFFGLVVAGIAGYAVYKYRIRRYMDSEIRAIMAQYMPLDNQGDVPNHSHHIEL

SEQ ID NO: 904 - protein, 626 aa, Oryza sativa Indica Group
MALRSPNSMLWLALLVWAALLCGSCHGRFVVEKNSLKVTSPSDMKGTYECAIGNFGVPQYGGTMVGVVAYPKANKKACKSFDDFDISYKAKPGSLPTFLLVDRGDCFFTKKAWNAQNAGAAAILVADDKTEPLITMDTPEESGNTDYLENITIPSALITKSFGDKLKKAIDNGDMVNVNLDWRESLPHPDERVEYEFWTNSNDECGPKCDSQIEFVKSFKGAAQVLEKKGYTQFTPHYITWYCPDSFILSKQCKSQCINHGRYCAPDPEQDFSKGYDGKDVVVQNLRQVCVYKVAKEHGKPWLWWDYVTDFAIRCPMKEKKYTKECADGVIKSLGLDHKAIDECIGDPDADKENPVLKAEQDAQIGKGSRGDVTILPTLVINNRQYRGKLDKGAVLKAICAGFRETTEPAVCLSEDIQTNECLENNGGCWQDKAANISACKDTFRGRVCECPVVKGVKFVGDGYTHCEASGSGRCEINNGGCWKDSRHGRTYSACTNDGCKCPDGFKGDGVHKCEDIDECKERTACQCKECKCKNTWGSYECGCSGGLLYMKEHDTCISKNAATEVGWNFLWVIFFGLVVAGIAGYAVYKYRIRRYMDSEIRAIMAQYMPLDNQGDVPNHSHHIEL

SEQ ID NO: 905 - protein, 695 aa, Hordeum vulgare subsp. vulgare
GTSNHLLPQNLPNSSAHPNTINALQLLPPRPKVPVFPLNPAYPPAFPRPYSPQDRSFLEAQSPVWSMRLRSAPPAAPRLLLLLAVLLCGFCCCCEGRFVVEKNSLKVTAPDSLKGSYECAIGNFGVPQYGGTMVGVVAYPKANRKACKSFDDFDISYKAKPGSLPTFLLVDRGDCFFTKKAWNAQNAGVAAILVADDKDEPLITMDTPEESGRADYLENITIASALITKSFGDRLRKAVDSGHMVNVNLDWRESLPHPDERVEYEFWTNSNDECGPKCDSQIDFVKSFKGPAQILEKKGYTQFTPHYITWYCPEAFTLSKQCKSQCINHGRYCAPDPEQDFSKGYDGKDVVVQNLRQVCVYKVAKENKKPWLWWDYVTDFAIRCPMKEKKYTKECADGVIKSLGLDHKAIDKCIGDPNADEENPVLKAEQDAQIGKGARGDVTILPTLVINNRQYRGKLDKGAVLKALCAGFQETTEPAVCLSEDIQTNECLENNGGCWHDKATNISACKDTFRGRVCECPVVKGVKFVGDGYTHCEASGSGRCEINNGGCWKETRNGRTHSACTDGGCKCPDGFKGDGVHKCIDVDECKERTACQCKDCKCKNTWGSYECGCGGGLLYMKEHDTCISKDAGARVGWNFLWVVLFGLAAAGIAVYAVYKYRIRSYMDSEIRAIMAQYMPLDNQGEIPSHSHHIEM

SEQ ID NO: 906 - protein, 642 aa, Hordeum vulgare subsp. vulgare
TDRSIRALLRHRSCPRAMASPPPPLLLTLVWAAALLWCGGCDARFVVEKNSLRVTAPVALKGAYECAIGNFGVPQYGGTMVGVVAYPKANRKACKGFDDFDVSFKARPGALPTFLLVDRGDCYFTKKAWNAQNAGAAAILVADDRDEPLITMDTPEESGRVEYLENITIPSALISKSFGDRLKKAIDNGDMVNVNLDWRESLPHPDERVEYEFWTNSNDECGPKCDSQIDFVKSFKGAAQILEKQGYTQFTPHYITWYCPEAYTSSKQCKSQCINHGRYCAPDPEQDFSKGYDGKDVVIQNLRQVCVYKVAKESKKPWLWWDYVTDFAVRCPMKEKKYTKECADGVIKSLGLDHKAIDKCIGDPDADEENPILKAEQDAQIGKGSRGDVTILPTLVINNRQYRGKLDKGAILKALCAGFRETTEPTVCLSEDIQTNECLENNGGCWQDKAANITACKDTFLGKVCECPIVKGVKFIGDGYTHCEASGAGRCEINNGGCWKETMNGRTYSACTADGCKCPDGFKGDGIHKCEDIDECKERTACQCKECNCKNTWGSYECGCSGGLLYMKEHDTCISESAAAQVGWNFLWVIFFGLAAAGIAGYAVYKYRIRRYMDSEIRAIMAQYMPLENQGDIHSHPHQIEM

SEQ ID NO: 907 - protein, 624 aa, Vitis vinifera
MREKLGLLVCVWFVLWGSCVGRFVVEKNSLRVTSPESLKDVYECAIGNFGVPQYGGTMVGTVVYPKANQKACKSFEDVEISFKSKPGGLPTFLLADRGDCFFTLKAWNAQNAGAAAILVADDKIEPLITMDTPEEENAHADYLQNITIPSALISKSFGDSIKNALSKGDMVNINLDWRESLPHPDERVEYEFWTNSNDECGPKCESQIEFVKNFKGAAQIFERKGYTQFTPHYITWYCPDAFILSKQCKSQCINHGRYCAPDPEQDFSRGYDGKDVVVQNLRQACFFKVANESGKPWLWWDYVTDFAIRCPMKDKKYSKECADQVILSLGVDVKKIDQCIGDPEADVDNPVLKAEQDAQIGKGSRGDVTILPTLVINNRQYRGKLDKGAVLKAICAGFQETTEPTICLSDEVETNECLENNGGCWQDKAANITACKDTFRGRVCECPIVQGVKFTGDGYTNCEASGALRCEINNGGCWKDTKDGSTYSACVDDNSKGCQCPQGFKGDGVKTCEDVNECKDKVACNCPECKCKNTWGSYECSCSGNLLYMREHDACISKHVKTEVSWSFIWVIILGLAAAGVGGYALYKYRIRRYMDSEIRAIMAQYMPLDNQGEIPNHVPHGDI

SEQ ID NO: 908 - protein, 626 aa, Vitis vinifera
MREKLGLLVCVWFVLWGSCVGRFVVEKNSLRVTSPESLKDVYECAIGNFGVPQYGGTMVGTVVYPKANQKACKSFEDVEISFKSKPGGLPTFLLADRGDCFFTLKAWNAQNAGAAAILVADDKIEPLITMDTPEEENAHADYLQNITIPSALISKSFGDSIKNALSKGDMVNINLDWRESLPHPDERVEYEFWTNSNDECGPKCESQIEFVKNFKGAAQIFERKGYTQFTPHYITWYCPDAFILSKQCKSQCINHGRYCAPDPEQDFSRGYDGKDVVVQNLRQACFFKVANESGKPWLWWDYVTDFAIRCPMKDKKYSKECADQVILSLGVDVKKIDQCIGDPEADVDNPVLKAEQDAQIGKGSRGDVTILPTLVINNRQYRGKLDKGAVLKAICAGFQETTEPTICLSDEVETNECLENNGGCWQDKAANITACKDTFRGRVCECPIVQGVKFTGDGYTNCEASGALRCEINNGGCWKDTKDGSTYSACVDDNSKGCQCPQGFKGDGVKTCEDVNECKDKVACNCPECKCKNTWGSYECSCSGNLLYMREHDACINAGKHVKTEVSWSFIWVIILGLAAAGVGGYALYKYRIRRYMDSEIRAIMAQYMPLDNQGEIPNHVPHGDI

SEQ ID NO: 909 - protein, 625 aa, Populus trichocarpa
MREKLGFLVGVWLLLCGFCFGRFVVEKNNLKLTSPDSLKGVYECAIGNFGVPQYGGTLVGTVIYPKANQKACKGFDGVDISFKSRPGGLPTFVLVDRGDCYFTLKAWNAQNGGAAAILVADDKDEPLITMDTPEEENADADYLQNITIPSALISKSLGDSIKKAISNGEMVNMNLDWTEALPHPDERVEYEFWTNSNDECGPKCDSQIEFIKNFKGAAQILEQKGYTQFTPHYITWYCPEAFVLSKQCKSQCINHGRYCAPDPEQDFSKGYDGKDVVVQNLRQACFYKVANESKKPWLWWDYVTDFSIRCPMKEKKYTKECADQVIQSIGVDLKKIDICIGDHEADVENEVLKAEQHVQIGKGSRGDVTILPTLVINNRQYRGKLDKGAVLKAICAGFEETTEPAICLSEDVETNECLENNGGCWQDRAANLTACKDTFRGRVCECPMVQGVKFVGDGYTHCNASGSLRCEINNGGCWKKTQDGTTFSACVEDRSQGCKCPPGFKGDGVNSCEDVDECKDKVACQCPECKCKNTWGSYECSCSGGLLYMREHDTCISNAARAEYSWSFVWIIILGLATAGVAGYAIYKYRIRRYMDSEIRAIMAQYMPLDSQADIPVHHAPRGDI

SEQ ID NO: 910 - protein, 489 aa, Zea mays
MDYLAAAVPVTLALGVGAILLVLRWTYCRRRTSAEEARLPPGSRGLLFLGETLHYLAASSTPGVLPPFFQRRLERYGPIFRTNLVGEDLVVSLDAELNAHVLKQEERGFQIWYPPSFMRVFGADNITAKLGVLHRHMRTLVLRLFGHQTVRSVLLHDVQRSARDELRSWLGRPDVEVRTATSRMIFGVTANKLISHDDAASGGTLWRCFHDWTSGLLSFPVSIPGTTFYRCMQGRKKVMTMLKQQLVERRRNAAERETTEDFFDLVIDELNKPDPMMDESTALDLLFTMLFASHETTSMVLTVILKYLTDNPKALQELTEEHERILESRADPGSDLTWEEYRSMKFTSHVIHESLRLANIALAMFRKANQDVHINGYTIPKGSKIMMCALASHLNTEVYEDPSVFNPWRWKDIPEPVGTSKDFMAFGGGLRLCAGAEFSKMQMAMFLHYLVTNYSWKPVSGGTMLFYPGLQFPEGFHIQLLPKIPNVVP

SEQ ID NO: 911 - protein, 481 aa, Sorghum bicolor
MSMHYLVSVSVTCLALGVGAILVLRRRNGGRTCEGARLPPGSRGLPFIGETLHYLAASSTLGLLPPFFEKRLERYGPIFRTSLVGEDLVVSLDAELNAHILKQEERGFQIWYPPSFMRVFGADNITSKIGVLHRHMRTLVLRLFGHQTIRSVLLHDVQRSARDELRSWLDRPDVEVRTAISRMIFGVTAKKLISHDDAASGGRLWECFHDWTSGLLSFPVPIPGTTFYRCMQGRKNVMKVLKQQLGERRNAAERETVDFFDLVIDELNKPNPMMDKSTALDLLFAMLFASHETTSMVLTVILKYLTDNPKALQELTEEHERILERRVDRDSDITWEEYKSMKFTSHVIHESLRLANIALVMFRKADQDVHTNGYTIPKGSKIMICPLASHLNMKVYEDPSVFNPWRWKNIPEPVGASKDFMAFGGGLRLCAGADFSKMQMAMFLHYLVRNYRWKTVSGGTMVFYPGLQFPDGFHIQLLPKI

SEQ ID NO: 912 - protein, 482 aa, Sorghum bicolor
MSMHYLVAVSMTCLALGVGAILVLRWRNGGRTCEGGRLPPGSRGLPFIGETLQYFLAASSTLGLLPPFFKKRLERYGPIFRTSLVGEDLIVSLDAELNAHILKQEERGFQIWYPPSFMRVFGADNITSKIGVLHLHMRTLVLRLFGHQTIQSVLLHDVQRSARDELRSWLDRPDVEVRTAISRMIFGVTAKKLISHDDAASGGRLWECFHDWTSGLLSFPVPIPGTTFYKCMQGRKNVMKMLKQQLGERRNAAERETVDFFDLVIDELNKPNPMMDESTALDLLFMMLFGSHETTSMVLTVILKYLTDNRKALQELTEEHERILERRVDPDSDITWEEYKSMKFTSHVIHESLRLANIALVMFRKADQDVHTNGYTIPKGSKIMICPLASHLNMKVYENPSVFNPWRWKNIPEPVGASKDFMAFGGGLRLCAGADFSKMQMAMFLHYLVRNYRWKTVSGGIMVFYPGLQFPDGFHIQLLPKI

SEQ ID NO: 913 - protein, 481 aa, Sorghum bicolor
MSMHYLAALSVTLLGAILLRWAFKWMNYGRTGGEEGMLLPPGSRGLPFLGETLEFFAASPTLELVPFFKRRLERFGPIFRTNIVGEDMIVSLDPELNARVLQQEERGFQIWYPSSFMRILGADNMVSMLGPLHRHIRNLVLRLFGPEALRLVLLRDVQRSARDELRSWLDRPEVEVRTATSRMIFGVTAKKLISHDDVASGGSLWKCFDAWTKGLMSFPICVPGTAFYRCMQGRKNVMKVLKQQLDERRNGAERKTVDFFDLVIDELDKPNSIMSESIALNLLFLLLFASHETTSMGLTVILKFLTDNPKSLQELTEEHEKIMERRVDPDSDITWEEYKSMKFTSHVIHESLRLANIAPVVFRQANQDVHIKGYTIPEGSKIMICPSAAHLNSKVYEDPLAFNPWRWKDTPEPVGGSKDFMAFGGGLRLCVGAEFAKLQMAMFLHYLVTNYRWKALSKGTMMLYPGLRFPDGFHIQLHKKT

SEQ ID NO: 914 - protein, 653 aa, Sorghum bicolor
MGIVEAWVREKPIRTFLARLAQRRAEAAAAFLASPSATAVIDGEGGGDGSIPQLSSVANSVVSRCSRILALSIENLQQSFETDFPHNCNEANTYARDLLEYCCHKALHEVTTRPDYLADKNLRRLMFDMMLAWETPGAQDASVENEKGSIVRDSLEIEDEDEGSIFYANSTRLAVQVDDKKTVGLSAFARIAPSCPIIADLVTVHNLFDALTSSSGGRLHFLVYDKYLKSLDRELRSVKGIMQSSLASSFHLDAGECILAIDGDKPIHPVLQHIGISAWPGRLVLTTHALYFQSIRVGYGDKIVKYDLSTDSNQVIKRDLTGPLGVRLFDKAVMYKSSTLTEPIYFDFPELGGPSRRDYWLAITCEVLQVNRFIRKFNLGDVQRAEALSKAILGILRYSAVKEAFHIAPSHFKTTLTFSLAEKLPKGDMVLEALYNNYFQLLDSSLRHLAIDSAVDKMSENHSVPFSLYALSRMGFLLLKTKDETEKEMSFCAVCFGVTKYLQAALKESICYSERIESARATVDQVKVEGIDVNLALMQELLFPFIQVGKIVYSLSQWEDPFKSLLFLAFMLYVIQRGLVSYIVPFVFLTFAIIMIWHKYVGDGKLLEVLEVKPPPSKNAVEQILTLQEGISKLEEFLQAVMNVSLEVLRFWF

SEQ ID NO: 915 - protein, 731 aa, Zea mays
MGIVEAWMREKPIRTFLARLAQRRAAAAAAFLASPSATTVIDGEGGSDGSIPQLSSVANSVVSRCSRILALSIENLQRSFETDFPHSCNEANTYARDLLEYCCHKALHEVTTRPDYLADKNLRRLMFDMMLAWETPGAQDVSVDNGSIVRDSLEIEDEDEGSIFYANSTRLAAQVDDKKTVGLSAFARIAPSCPIIADLVTVRNLFDALTSSSGGRLHFLVYDKYLKSLDRELRSVKGIMQSSLASSFHLDAGECILAIDGDKPIQPVLQHIGISAWPGRLVLTTHALYFQSIRVGYGDKIVKYDLSTDSNQVIKRDLTGPLGVRLFDKAVMYKSSTLTEPIYFDFFELGGPSRRDYWLAITREVLQVNRFIRKFNLGDVQKAEALSKAILGILRYSAVKEAFHIAPSHFKTTLTFSLAEKLPKGDMVLEALYNNYFQLLDSSLRHLAIDSAVDRMSENHSIPFSLYALSRMGFLLLKTNDKSEKEMSFCAVCFGVTKSLEAALEESICYSERIESARATVDQVKVEGVDANLALMQELLFPLIQAGKIVYSLSQWEDPLKSLLFLAFMLYAIQRGLISYIAPFVFLTFAIIMLWHKYIGDGKLLEVLEVKPPPSKNAVEQILTLQEAISKLENFLQSANITLLKFRSVLFACVPKATEVVAAVLIVAAAFLVFLPSRPLIQMLVLEMYTREMPLRKQNTEKFRRRIREWWARIPAAPVQMIRPNESKKKR

SEQ ID NO: 916 - protein, 731 aa, Hordeum vulgare subsp. vulgare
MGIVETWVREKPIRTFLSRLSRQSAAAFVASTTSRSPAAADGEGGGADGGIPQLSSVANSVVSRCSRILAVATENLQQSYEADFPDNCKEPNTYARELLEYCCHKALHEVTTRPDYLADMNLRRLMFDMMLAWENPGSEEGLLKNNSTLCNPVDIEDEDEGSIFYTNSTSLAVQVNDMKTVGLSAFTRIAPSCPIIADLVTVHNLFDALTCSSGGRLHYFVYDKYLKSLDRVFRSIKGVMQSSLASSFNLDAGECILAIDGDKPIHPVLQHVGISAWPGTLILTTHALYFQSIRVGYGDKIVKYDLATDSNQVIKRDFTGPLGVRLFDKAMMYKSSTLTEPIYFDFPELGSPSRRNYWLAITREVMQVNKFIRKFNLEDIQRAEALSKAILGILRYSAVKEAFHIAPSHFKTTLTFSLAEKLPKGDMVLEALYNNYFQLLDTSLSHLATEPAVDKAAQTHSVPFSLYALSRMGFNLLKRKNETEKEISFCAVCVGVTKSLEAALQESFLYSERIEAARATVDQVKVEGLDANVALMQEILFSFIHAGKLIYSLTKWEDPLKSFLFLAFIFYVIQSGLVSYTVPSVFVVFAVVMLWHKYSEEGKMLEVLEVRPPPTKNPVEQILILQDAISKLEDTLQAVNIVLLKFRALLFAAVPKATEIVAVALLVAAAVVVFVPPKHLLLMAVLEVYTREMPLRKLHTEKFRRRIKEWWARIPAAPVQMIRPNEDKKKI

SEQ ID NO: 917 - protein, 734 aa, Oryza sativa Indica Group
MGIVETWMREKPIRTFLAQFSTRRAAAGAAALLASSSAAAASADGEPGDRSIPQLSSIANSVVSRCSRVLALATETLQQNFEVDYPDSCKESNTYAKEFLEYCCHKALHEVTTRPDHLADKNLRRLMFDMMLAWEHPGAVVEDELPENHSALRTTVDIEDDDEGSIFYANSTRLAVQVNDKKTVGLGAFARIAPSCPIIADLVTVHNLFDALTCSSGGRLHFFVFDKYIKSLDKVFRSVKGILQSPLASSFHLDAGECILAMDGDRPIHPVFQHIGISAWPGRLILTTHALYFQSIKVGYGDKIVKYDLATDSDQVIKRDFTGPLGVRLFDKAVMYKSSTLTEPIYFDFPELGGPSRRDYWLAIAREVLQVNKFIRKFNLENVQRAEALSKAILGILRYSAVKEAFHISPSHFKTTLTFSLAEKLPKGDMVLKALYDNYFQLLDTSLSHLVTESPVDNRLQNHSLPFSLYALSRMGFILLKRKDEAQSEISFCAVCFGVTKSLEAALEESICYSERIDAARATIDQVKVEGVDANLALMQELLFPFIQVVKLTYSLTKWEDPLKSFLFLAFTLYVIQRGFIAYMLPSFFLAFAVVMLWHKYNGREQLLGVLEVRTPPSKNPVEQILTLQDAISKLEETLQSVNIVLLKFRAVLFAAVPKTTEMVAVAFLAASAFLIFVPWRHLLLIAVLEVYTREMPLRKQNTEKFRRRIREWWARIPAAPVQMIKPNESKKKR

SEQ ID NO: 918 - protein, 734 aa, Oryza sativa Japonica Group
MGIVETWMREKPIRTFLAQLSTRRAAAGAAALLASSSAAAASADGEPGDRSIPQLSSIANSVVSRCSRVLALATETLQQNFEVDYPDSCKESNTYAKEFLEYCCHKALHEVTTRPDHLADKNLRRLMFDMMLAWEHPGAVVEDELSENHSALRTTVDIEDDDEGSIFYANSTRLAVQVNDKKTVGLGAFARIAPSCPIIADLVTVHNLFDALTCSSGGRLHFFVFDKYIKSLDKVFRSVKGILQSPLASSFHLDAGECILAMDGDRPIHPVFQHIGISAWPGRLILTTHALYFQSIKVGYGDKIVKYDLATDSDQVIKRDFTGPLGVRLFDKAVMYKSSTLTEPIYFDFPELGGPSRRDYWLAIAREVLQVNKFIRKFNLENVQRAEALSKAILGILRYSAVKEAFHISPSHFKTTLTFSLAEKLPKGDMVLKALYANYFQLLDTSLSHLVTESPVDNRLQNHSLPFSLYALSRMGFILLKRKDEAQSEISFCAVCFGVTKSLEAALEESICYSERIDAARATIDQVKVEGVDANLALMQELLFPFTQVVKLTYSLTKWEDPLKSFLFLAFTLYVIQRGFIAYMLPSFFLAFAVVMLWHKYNGREQLLGVLEVRTPPSKNPVEQILTLQDAISKLEETLQSVNIVLLKFRAVLFAAVPKTTEMVAVAFLAASAFLIFVPWRHLLLIAVLEVYTREMPLRKQNTEKFRRRIREWWARIPAAPVQMIKPNESKKKR

SEQ ID NO: 919 - protein, 630 aa, Zea mays
MDAWEATKAVFDRVRALDPDNASKIMGLLLIQDNSDKELIRLAFGPDHILHAFAAAARADLAAKPASPPSPVPGPLHQPASPWAPPSDHQQAPFAADHALGYDYDGADADTFFSDDYDCWSPAGATAHRRSFSLSDAELAAAAAGPGAWRPCMYFARGFCKNGSACRFLHGLPEPAPDAAEREMAVMRAKALAAAAARPQQQQQLMASAFPFSPSPSPPKGANLNLLLHHHYQQQSEPQRAGAAMLLQGGGGDDMHSSRFPLRSPGRMDRGELVSSPAARQIYLTFPADSTFGEDDVSNYFSMYGPVQDVRIPYQQKRMFGFVSFVYAETVRIILCKGNPHFVCDARVLVKPYKEKGKVPDRFRKLQHPHLGDFAGCTSPTGLLDSRDPFDLQQPQIGPRMMYGNIANHEAFLRRKLEEQQQAIELEGRRFMGLHLLDLKIRGHHLGSSPATTVVGQGEGGKGSGNGNAVQLEDVIVQDTPTKMNSNSLAMSAPAAAVSAAADAGGEHEEQQEAGHGEEGDGSPKQAVNLGEDEKTESGPVTAPPIVARGFQESGGVAVEHILPDSPFASTTNKEASAPTAQNGGISNGSPHHVASSPLFPPAPAIELPPYNSCFFQAPRFSPGHEAIGL

SEQ ID NO: 920 - protein, 605 aa, Zea mays
MGLLLIQDNSDKELVRLAFGPDHILHAFAAAARADLAAKPASPPSPVPGPLHQPASPWAPPSDHQQAPFAADHALGYDYDGADADTFFSDDYDCWSPAGATAHRRSFSLSDAELAAAAAGPGAWRPCMYFARGFCKNGSACRFLHGLPEPAPDAAEREMAVMRAKALAAAAARPQQQQQLMASAFPFSPSPSPPKGANLNLLLHHHYQQQSEPQRAGAAMLLQGGGGDDMHSSRFPLRSPGRMDRGELVSSPAARQIYLTFPADSTFGEDDVSNYFSMYGPVQDVRIPYQQKRMFGFVSFVYAETVRIILCKGNPHFVCDARVLVKPYKEKGKVPDRFRKLQHPHLGDFAGCTSPTGLLDSRDPFDLQQPQIGPRMMYGNIANHEAFLRRKLEEQQQAIELEGRRFMGLHLLDLKIRGHHLGSSPATTVVGQGEGGKGSGNGNAVQLEDVIVQDTPTKMNSNSLAMSAPAAAVSAAADAGGEHEEQQEAGHGEEGDGSPKQAVNLGEDEKTESGPVTAPPIVARGFQESGGVAVEHILPDSPFASTTNKEASAPTAQNGGISNGSPHHVASSPLFPPAPAIELPPYNSCFFQAPRFSPGHEAIGL

SEQ ID NO: 921 - protein, 629 aa, Zea mays
MDAWEATKAVFDRVRALDPDNASKIMGLLLIQDNSDKELIRLAFGPDHLLHAFVSAARADLAAKPASPPSPVLGPLHQTWGAPPHPSPTAGSDHQHQAPFAADLALGYDFDGAGAGADAFFPDDYDCWSPAGAAHRRSFSLSDAEATAAAAGGAAWRPCMYFARGFCKNGSSCRFLHGFPEDDDAAAEREMVVMRAKALAAAAARPQQQQQLMASAFPFSPSPPKGVNLNFLLHQHQQQNEPQRAAAAAAMLLQGGDDMHSRFPVRSPRMDRGELMSSPAARQIYLTFPADSTFSEEDVSIYFSMYGPVQDVRIPYQQKRMFGFVTFVYAETVKIILSKGNPHFVCDARVLVKPYKEKGKVPDRFRKLQHPHHGDFAGCTSPTGLLDSRDPFDLQQPQIGPRMMYGNVAGHEAFLRRKLEEQQQAAELQQAIELEGRRFMVLHLLDLKSRGHHHLGSSPAAMATTTLGQGDDGCKGRSANGNDNAVAFHLEDANIQDTPTKMNSNSLAMSGGPAAGAGGEHEEQQQDGDGDGSPKQAVNPGKEEKTESGPVTATPIVACGFQESGVVEHILPDSPFASPSKASTQNGSIISNAASSLFPPPASTMELPPYSSCFFQAPRFSPGHEAIGL

SEQ ID NO: 922 - protein, 637 aa, Sorghum bicolor
MDAWEATKAVFDRVRALDPDNASKIMGLLLIQDNSDKELIRLAFGPDHLLHAFVAAARADLAASSKPASPPSPVLGPLHQPASPWGPPPSDHHHQHQSPFSAADHALGYDYDGAAAAAAPASADAFFPDDYDCWSPAGGATAHRRSFSLSDAEVAGAAGAGAWRPCMYFARGFCKNGSSCRFLHGLPEDDDAATAEREMVVMRAKALAAARSQQQQQQLMASAFPFSPSPSPPKGVNLNFLLHHHNQQQQQNEPQRAAAAAAAAMLLQGGGGDDMHGRFPVRSPRMDRGELMSSPAARQIYLTFPADSTFSEEDVSNYFSMYGPVQDVRIPYQQKRMFGFVTFVYAETVKIILSKGNPHFVCDARVLVKPYKEKGKVPDRFRKLQHPHHGDFAGCTSPTGLLDSRDPFDLQQPQIGPRMMYGNIANHEAFLRRKLEEQHQAAELQQAIELEGRRFMGLHLLDLKSRGHHLGSSTAAMGQGEGGKGNGNAVQQEDANIQDTPTKTMNSNSLAMSAPAADAGGEHEEQQGEEDGDGDGGGSPKQAVNPGEEEKTESGPVTAATTPIVACGFQESGLVEHILPDSPFASPTKATSTDTAPAAQNGNISNGSPHHVASSLFPPASTIELPPYNSCFFQAPR

SEQ ID NO: 923 - protein, 533 aa, Zea mays
MGGGDADAGGEPADAQATLHIRCTNGSKFTVRTDLGATVGAFKAIVAHSCDVPAPQQRLIYKGRILKDEQTLASYGVETDHTIHMVRGAVLSPTSTAPAANQEPTTAAPASSPATGLGGLLQSLGTTGAAANSEGLFGSAPPGLDQMQQQLAENPNLMREMMNMPLMQNLMNNPELIRSIIMNNPQMRELIDRNPDLAHVLNDPSIMRQTFEAVRNPELMREMMRNTDRAMSNIESSPEGFNMLRRMYETVQEPFLNATTMGSEGDRNSNPFSALLGNQGSNQARDSAANGTTRASDPTSGSPAPNTNPLPNPWGSNAGSAQGAARSSPASNVRSTTASGLGGLGSADLGSTHGASGGGSDATLLTQVLQNPTMMQMMQNIMSNPQSMNQLLNMNPNVRNMMESNTQMREMIENPEFLRQLTSPETLQQLISFQQSLMSQLGQQQAGQERTQSGSGAGNVNLNTLMNMFSGLGAGGGLGVPNAPNAPPEELYATQLAQLQEMGFFDTQENIRALAATAGNVHAAVERLLGNMG

SEQ ID NO: 924 - protein, 538 aa, Sorghum bicolor
MGGGDGDADAGGEPAAAQATLHIRCTNGSKFAVRADLGTTVGAFKAIVAESCDVPAPQQRLIYKGRILKDDQTLASYGVETDHTIHMVRGAAPPPASTAPAANQEPTTAAPASSPAAGLGGLLQSLGATGAAANSGGSGLFGSGLPELDQMQQQLAENPNLMREIMNMPLMQNLMNSPELIRSIIMNNPQMRELIDRNPDLAHVLNDPSIMRQTFEAVRNPELMREMMRNTDRAMSNIESSPEGFNMLRRMYETVQEPFLNATTMGSEGDRNSNPFAALLGNQGSNQARDSAANGTTTASDPTSGSPAPNTNPLPNPWGPNAGSTQGAARSPPASNTRSTTASGLGGLGSADLGSMLGASGGGSDATFLTQVLQNPTMMQMMQNIMSNPQSMNQLLNMNPNVRNMMESNTQMREMIQNPEFLRQLTSPETLQQLISFQQSLMSQLGQQQAGQERTQSGSGAGNVNLNTLMNMFSGLGAGGGLGVPNAPNVPPEELYATQLAQLQEMGFFDTQENIRALAATAGNVHAAVERLLGNMGQ

SEQ ID NO: 925 - protein, 534 aa, Oryza sativa Japonica Group
MSGGDGEEAAAAAAAATLHIRCTNGSKLAVRADLGLSVGAFKAIVAESCDVPAPQQRLIYKGRILKDEQTLASYGVETDHTIHMVRGAAPPPASTAPPAANNVTPAINATTASNSPAVGFGGLLHGLGGSGSANSGGLGSFGSGLPELSQMQQQLSENPTLMREIMNMPLMQNILNSPDLIRNIIMNNPQMREIVDRNPDLAHVLNDPSILRQTVEAARNPELMREMMRNTDRAMSNIESSPEGFNMLRRMYETVQEPFLNATTMAGEGDRSSNPFSALLGNHGSNQARDPAANSPTTTSESTTGSPAPNTNPLPNPWSTTAGAAQGATRPSPVTNARSATAGGLGGLSSTDLGGMLGGGSDTSFLSQVLQNPTMMQMMQNIMSNPQSMNQLLNINPNVRNMMESNTQLREMFQNPEFVRQLTSPETLQQLISFQQSLMSQLGQQQAGPERTQSGAGAGNTNLNNLMSMFSGLGAGGGLGVPSAPNVPPEELYATQLAQLQEMGFFDTQENIRALIATAGNVHAAVERLLGNIG

SEQ ID NO: 926 - protein, 534 aa, Oryza sativa Indica Group
MGGGDGEEAAAAAAAATLHIRCTNGSKLAVRADLGLSVGAFKAIVAESCDVPAPQQRLIYKGRILKDEQTLASYGVETDHTIHMVRGAAPPPASTAPPAANNVTPAINATTATNSPAAGFGGLLHGLGGSGSANSGGLGSFGSGLPELSQMQQQLSENPTLMREIMNMPLMQNILNSPDLIRNIIMNNPQMREIVDRNPDLAHVLNDPSILRQTVEAARNPELMREMMRNTDRAMSNIESSPEGFNMLRRMYETVQEPFLNATTMAGEGDRSSNPFSALLGNHGSNQARDPAANSPTTTSESTTGSPAPNTNPLPNPWSTTAGAAQGATRPSPVTNARSAPAGGLGGLSSTDLGGMLGGGSDTSFLSQVLQNPTMMQMMQNIMSNPQSMNQFLNINPNVRNMMESNTQLREMFQNPEFVRQLTSPETLQQLISFQQSLMSQLGQQQAGPERTQSGAGAGNTNLNNLMSMFSGLGAGGGLGVPSAPNVPPEELYATQLAQLQEMGFFDTQENIRALIATAGNVHAAVERLLGNIG

SEQ ID NO: 927 - protein, 452 aa, Zea mays
MVRGAAPPPASTAPAANQEPTTAAPASSPAAGLGGLLQNLGATGAAANSGGLGLFGSGLPELDHMQQQLAENPNLMREIMNMPLMQNLMNSPELIRSIIMNNPQMRELIDRNPDLAHVLNDPSIMRQTFEAVRNPELMREMMRNTDRAMSNIESSPEGFNMLRRMYETVQEPFLNATTMGSEGDRNSNPFAALLGNQGSNQARDSAANGTTTASDTTSGAPAPNTNPLPNPWGPNAGSAQGAARSPPATNTRSTTAGGPGGLGSADFGSTLGASGGGSDATFLTQVLQNPTMMQMMQNIMSNPQSMNQLLNMNPNVRNMMESNTQMREMIQNPEFIRQLTSPETLQQLISFQQSLMSQLGQQQTGQERTQSASGAGNVNLNTLMNMFSGLGAGGGLGVPNAPNVPPEELYATQLAQLQEMGFFDTQENIRALAATAGNVHAAVERLLGNMGQ

SEQ ID NO: 928 - protein, 575 aa, Oryza sativa Indica Group
MGGGGGEAGGGDGGESSPAAAAAVAVAGAAALHIRCANGSKFTVRADLDATVGAFKEVVAGSCDVPAAQQRLIYKGRILKDEQTLESYGVETDHTIHMVRGAGPPAGSAAPAAASPQASAAPSSGPTDGLGSLFPGLGGTGTAGTRPSGLFGSGFPELDQMQQQLSQNPNLMREIMNMPMMQNLMNNPDLIRNMIMNNPQMRDIIDRNPDLAHVLNDPSVLRQTLEAARNPEIMREMMRNTDRAMSNIESSPEGFNMLRRMYETVQEPFLNATTMGGEGNTAPNPFSALLGNQGSNQPRDPATNAPNTGSESTTGTPAPNTNPLPNPWSSNAGGAQGATRAGSTGNARTGATGGLGGLGSADLSSLFGGLAGNTGTGATGGLGGLGSADLGSLLGGSPDSSSLSQILQNPVMMQMMQNIMSDPQSMNQLLNFNPNTRNLMESNTQLREMFQNPEFIRQLTSPETMQQLLSFQQTLLSQLGQNQPRQDGSQGGNATGMRGNVSLDTLMGMLSGLGAGGGIGVPNTSNVPPEELYATQLTQLREMGFIDTAENIQALVATAGNVNAAVERLLGNLGQ

SEQ ID NO: 929 - protein, 575 aa, Oryza sativa Japonica Group
MGGGGGEAGGGDGGESSPAAAAAAAVAGAAALHIRCANGSKFTVRADLDATVGAFKEVVAGSCDVPAAQQRLIYKGRILKDEQTLESYGVETDHTIHMVRGAGPPAGSAAPAAASPQASAAPSSGPTDGLGSLFPGLGGTGTAGTRPSGLFGSGFPELDQMQQQLSQNPNLMREIMNMPMMQNLMNNPDLIRNMIMNNPQMRDIIDRNPDLAHVLNDPSVLRQTLEAARNPEIMREMMRNTDRAMSNIESSPEGFNMLRRMYETVQEPFLNATTMGGEGNTAPNPFSALLGNQGSNQPRDPATNAPNTGSESTTGTPAPNTNPLPNPWSSNAGGAQGATRAGSTGNARTGATGGLGGLGSADLSSLFGGLAGNTGTGATGGLGGLGSADLGSLLGGSPDSSSLSQILQNPVMMQMMQNIMSDPQSMNQLLNFNPNTRNLMESNTQLREMFQNPEFIRQLTSPETMQQLLSFQQTLLSQLGQNQPRQDGSQGGNATGMRGNVSLDTLMGMLSGLGAGGGIGVPNTSNVPPEELYATQLTQLREMGFIDTAENIQALVATAGNVNAAVERLLGNLGQ

SEQ ID NO: 930 - protein, 581 aa, Oryza sativa Japonica Group
MTRIEPIPVMSRPPSTPCRRESSPAAAAAAAVAGAAALHIRCANGSKFTVRADLDATVGAFKEVVAGSCDVPAAQQRLIYKGRILKDEQTLESYGVETDHTIHMVRGAGPPAGSAAPAAASPQASAAPSSGPTDGLGSLFPGLGGTGTAGTRPSGLFGSGFPELDQMQQQLSQNPNLMREIMNMPMMQNLMNNPDLIRNMIMNNPQMRDIIDRNPDLAHVLNDPSVLRQTLEAARNPEIMREMMRNTDRAMSNIESSPEGFNMLRRMYETVQEPFLNATTMGGEGNTAPNPFSALLGNQGSNQPRDPATNAPNTGSESTTGTPAPNTNPLPNPWSSNAGGAQGATRAGSTGNARTGATGGLGGLGSADLSSLFGGLAGNTGTGATGGLGGLGSADLGSLLGGSPDSSSLSQILQNPVMMQMMQNIMSDPQSMNQLLNFNPNTRNLMESNTQLREMFQNPEFIRQLTSPETMQQLLSFQQTLLSQLGQNQPRQDGSQGGNATGMRGNVSLDTLMGMLSGLGAGGGIGVPNTSNVPPEELYATQLTQLREMGFIDTAENIQALVATAGNVNAAVERLLGNLGQ

SEQ ID NO: 931 - protein, 527 aa, Hordeum vulgare subsp. vulgare
MGGGEGEAGGEPAAAPATLHIRGTSGNKFAVRADLGATVGEFKALVAESCDVPAPQQRLIYKGRILKDDQTLASYGVETDHTIHMVRGAAPPATSATPAAANLGTSTMTPVNTPPAGLGGLFQGLGGTGTAGSGAFGLSGSGLPGLEQMQQQLTENPNLMREVLNTPAMQNIMNSPDLIRDLIMNNPQMRELVDRNPDLAHVLNDPSILRQTVEAARNPELMREMMRNTDRAMSNIESSPEGFNMLRRMYETVQEPFMNATTMGGEGGTNPNPFAALLGNQGSNQARDPTGDAPTTAPAPNTNPLPNPWGANAGAAQGAARPSGAAAARSATSGGLGGLGSADLGSMLGGGSDASLLNQVLQNPTMMQMMQNIISNPQTMNQLLNMDPNVRNMMESNTQMREMFQNPEFLRQLISPESLQQLDSFQQALTSQRGQQAAGQERTQAGATPGNVNLNSLMSMFSGLGAGGGLGGVPNIPTVPPEERYATQLAQLQEMGFFDPQENIRALLATNGNVHAAVERLLGNFGQ

SEQ ID NO: 932 - protein, 533 aa, Hordeum vulgare subsp. vulgare
MSSGEGEAGSEPTGAAPDVAPLAVLDIRDTSGNEFWVWADLGDTVGEFKVIVAGSCDVPAPQQRLIYKGRILKDDQTLASYGVETDHTIHMVRGAAPPATSATPAAANLGTSTMTPVNTPPAGLGGLFQGLGGTGTAGSGAFGLSGSGLPGLEQMQQQLTENPNLMREVLNTPAMQNIMNSPDLIRDLIMNNPQMRELVDRNPDLAHVLNDPSILRQTVEAARNPELMREMMRNTDRAMSNIESSPEGFNMLRRMYETVQEPFMNATTMGGEGGTNPNPFAALLGNQGSNQARDPTGDAPTTAPAPNTNPLPNPWGANAGAAQGAARPSGAAAARSATSGGLGGLGSADLGSMLGGGSDASLLNQVLQNPTMMQMMQNIISNPQTMNQLLNMDPNVRNMMESNTQMREMFQNPEFLRQLISPESLQQLDSFQQALTSQRGQQAAGQERTQAGATPGNVNLNSLMSMFSGLGAGGGLGGVPNIPTVPPEERYATQLAQLQEMGFFDPQENIRALLATNGNVHAAVERLLGNFGQ

SEQ ID NO: 933 - protein, 411 aa, Oryza sativa Japonica Group
MAQQLSAPFRAAAAAGSRASAAAADPAKVLRLRSAGSAQFTSIAASSSFARNIEPLRAIATQAPPAVPQYSSGEKTKVGINGFGRIGRLVLRIATSRDDIEVVAVNDPFIDAKYMAYMFKYDSTHGPFKGSIKVVDDSTLEINGKKVTITSKRDPADIPWGNFGAEYVVESSGVFTTTEKASAHLKGGAKKVVISAPSADAPMFVVGVNEKSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKAASEGALKGILGYTDEDVVSNDFVGDARSSIFDAKAGIGLSSSFMKLVSWYDNEWGYSNRVLDLIAHMALVNAKH

SEQ ID NO: 934 - protein, 411 aa, Zea mays
MAALSAPLRAVAAGSRVAASDPVKVSCVRSTGSAHFGCAFPYIRASSSAARNLEPLRAIATQAPPAMPQYSSGEKTKIGINGFGRIGRLVLRIATSRDDIEVVAVNDPFIDAKYMAYMFKYDSTHGPFKGSIRVVDDSTLEINGKKVTITSKRDPAEIPWGNFGAEYVVESSGVFTTTDKASAHLKGGAKKVVISAPSADAPMFVVGVNENSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKTASEGALKGILGYTDEDVVSNDFVGDSRSSIFDAKAGIGLSSSFMKLVSWYDNEWGYSNRVLDLIAHMALVSAKH

SEQ ID NO: 935 - protein, 411 aa, Zea mays
MAALSAPLRAVAAGSRVAASDPVKVSCVRSTGSAHFGCAFPYIRASSSAARNLEPLRAIATQAPPAMPQYSSGEKTKIGINGFGRIGRLVLRIATSRDDIEVVAVNDPFIDAKYMAYMFKYDSTHGPFKGSIRVVDDSTLEINGKKVTITSKRDPAEIPWGNFGAEYVVESSGAFTTTDKASAHLKGGAKKVVISAPSADAPMFVVGVNENSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKTASEGALKGILGYTDEDVVSNDFVGDSRSSIFDAKAGIGLSSSFMKLVSWYDNEWGYSNRVLDLIAHMALVSAKH

SEQ ID NO: 936 - protein, 413 aa, Sorghum bicolor
MAALSVPLRAAAVAAGSRAAGADPVKVLCVRSTGSAHFGCAFPSITASSSVARNIEPLRAIATQAPPAVPQYSSGEKTKIGINGFGRIGRLVLRIATSRDDIEVVAVNDPFVDAKYMAYMFKYDSTHGPFKGSIRVVDDSTLEINGKKVTITSKRDPTEIPWGNFGAEYVVESSGVFTTIDKASAHLKGGAKKVVISAPSADAPMFVVGVNEKSYDPKMNVVSNASCTTNCLAPLAKVVHEEFGIVEGLMTTVHATTATQKTVDGPSMKDWRGGRGAGQNIIPSSTGAAKAVGKVLPELNGKLTGMAFRVPTPNVSVVDLTCRIEKSASYDDVKAAIKAASEGALKGILGYTDEDVVSNDFVGDSRSSIFDAKAGIGLSSSFMKLVSWYDNEWGYSNRVLDLIAHMALVSAKH

SEQ ID NO: 937 - protein, 412 aa, Zea mays
MAALSVPLHAAAGSRAAAADPVKVPCVRSTGSAHFGRAFPSVAVSSLAARHIEPMRAIATQAPPAVPQYLSGEKTKIGINGFGRIGRLVLRIATSRDDIEVVAVNDPFVDAKYMAYMFKYDSTHGPFKGSICVVDDSTLEINGKKVTITSKRDPAEIPWGNFGAEYVVESSGVFTTTDKASAHLKGGAKKVVISAPSADAPMFVVGVNENSYDSKMNVVSNASCTTNCLAPLAKVVHEEFGIVEGLMTTVHATTATQKTVDGPSMKDWRGGRGAGQNIIPSSTGAAKAVGKVLPELNGKLTGMAFRVPTPNVSVVDLTCRIEKNASYDDVKAAIKAASEGALKGILGYTDEDVVSNDFVGDSRSSIFDAKAGIGLSSSFMKLVSWYDNEWGYSNRVLDLIAHMALVSAAAKL

SEQ ID NO: 938 - protein, 415 aa, Oryza sativa Japonica Group
MASLAVPLRASATPAIAGTGSGGGSRAADPVKVSCVRSKVTCGFPSVGASSSLASSVEPVRATATQAPLATHQSSSTEKTKVGINGFGRIGRLVLRIATNRDDIEVVAVNDPFIDAKYMAYMFKYDSTHGPFKGTIKVVDESTLEINGKKISVTSKRDPSDIPWGNFGAEYVVESSGVFTTTEKASAHLKGGARKVVISAPSADAPMFVVGVNEKNYNPSMNVVSNASCTTNCLAPLAKIVHEEFGIAEGLMTTVHATTATQKTVDGPSMKDWRGGRGASQNIIPSSTGAAKAVGKVLPALNGKLTGMAFRVPTPNVSVVDLTCRLEKSASYEDVKAAIKEASEGSLKGILGYTDEDVVSNDFIGDTRSSIFDAKAGIGLSSSFMKLVSWYDNEWGYSNRVLDLIGHMALVNAKP

SEQ ID NO: 939 - protein, 407 aa, Hordeum vulgare subsp. vulgare
MASLSLSLRASASASSAGSRAAAAIKASCVRSKVTCSFPSVGATSSPARSIEPVRATATQAPPATPSSSSGEKTKVGINGFGRIGRLVLRIAIDRDDIEVVAVNDPFIDAKYMAYMFKYDSTHGPFKGTITVLDESTLEINGKKVSVTSKRDPSDIPWGNFGAEYVVESSGVFTTVEKASAHLKGGAKKVVISAPSADAPMFVVGVNEKNYDPSMDVVSNASCTTNCLAPVAKVVHEEFGILEGLMTTVHATTATQKTVDGPSMKDWRGGRGAGQNIIPSSTGAAKAVGKVLPALNGKLTGMAFRVPTPNVSVVDLTCRLEKNASYEDVKAAIKEASEGPLKGILGYTDEDVVSNDFVGDTRSSIFDANAGMGLSSSFMKLVSWYDNEWGYSNRVLDLIGHMALVNA

SEQ ID NO: 940 - protein, 421 aa, Guzmania wittmackii x Guzmania lingulata
MAASSAVLRSATPHVLGGSRGGAGASEPIKISYVRSLSSAPNHSRVFGAAISTSSRKSGARSIQPIKATATAAPPSVPKLSSGGKTKVGINGFGRIGRLVLRIATARDDIEVVAVNDPFVDAKYMAYMLKYDSTHGLFKGTIRVVDESTLEINGKRISVTSKRDPAEIPWGNLGAEYVVESSGVFTTTDKASAHLKGGAKKVVISAPSADAPMFVVGVNEKAYQPSMNVVSNASCTTNCPAPLAKVVHEEFGIIEGLMTTVHATTATQKTVDGPSMKDWRGGRGASQNIIPSSTGAAKAVGKVLPELNGKLTGMAFRVPTPNVSVVDLTCRIEKNASYDDVKAAIKAASENALKGILGYTDEDVVSNDFVGDSRSSIFDAKAGIGLSKSFMKLVSWYDNEWGYSNRVLDLIGHMALVCARH

SEQ ID NO: 941 - protein, 419 aa, Capsicum annuum
MAFSSLLKPTASLVRPSHRSQASCVGLQHSSNSVKLQSAIFGDVVSIAQSSSLQNSGACSIQPIRATATELPPTVPKSQTGGKTRVGINGFGRIGRLVLRIATFRDDIEVVAVNDPFIDAKYMAYMLKYDSTHGVFRGSISVLDDTTLEINGKQIKVSSKRDPADIPWGDLGADYVVESSGIFTTVDRASGHKKGGAKKVVISAPSADAPMFVVGVNEKTYKANMDVVSNASCTTNCLAPLAKVVHEEFGIVEGLMTTVHATTATQKTVDGPSMKDWRGGRGAGQNIIPSSTGAAKAVGKVLPELNGKLTGMAFRVPTPNVSVVDLTCRLNKSASYDDVKAAIKYASEGPLKGILGYTNEDVVSNDFVGDSRSSIFDAKAGIGLSKSFMKLVSWYDNEWGYSTRVLDLIEHMALVAATS

SEQ ID NO: 942 - protein, 429 aa, Vitis vinifera
MALYSLFRSAPSAAAAAAATVVDSSRPSDRCKVSCIGFNSNADSLKVQTTIFGTPCIGNSSSLQKCSARSLQPIKATATELPPTVQKSWSSGQTKIGINGFGRIGRLVLRVATSRDDIDVVAVNDPFVDAKYMAYMFKYDSTHGVFKGTIKVLDESTLEINGKQIKVTSKRDPSEIPWGDYGIDYVVESSGVFTTTEKASAHIKGGAKKVVISAPSADAPMFVVGVNETSYKPSMNIVSNASCTTNCLAPLAKVVHEEFGIVEGLMTTVHATTATQKTVDGPSMKDWRGGRGASQNIIPSSTGAAKAVGKVLPELNGKLTGMAFRVPTPNVSVVDLTCRLKKSATYEDVKAAVKYASEGPLKGILGYTDEDVVSNDFVGDSRSSIFDAKAGIGLSASFMKLVAWYDNEWGYSNRVLDLIEHMALVAASK

SEQ ID NO: 943 - protein, 1694 aa, Zea mays
MSGDHAKKEMETGEKPTTSHGSTSSEESRTKREEKKKSSSNKGKEKKSSSHHKEKKEKSSSHKPHRSGDKQKRMRKVVYYETDTSSTSTSGSDAASVTSKRQERKKYSKIPLRYPRISKHTPLLSVPLGKPPTFDGEDYARWSDLMRFHLTSLHKSIWDVVEFGAQVPSVGDKDYDEDEVAQIEHFNSQATTILLASLSREEYNKVQGLKSAKEVWDVLKTAHEGDELTKITKRETIEGELGRFRLRKGEEPQHMYNRLKTLVNQVCNLESKKWDDHEMVKVILRSLIFLNPTQVQLIRGNPRYTKMTPEEVIGNFVSFECMIEGSRKINKLDDPSTSEAQPVAFKATEEKKEESTPSRQPIDASKLDNEEMALVIKSFRQILKQRRGKDYKSRSKKVCYKCGKPGHFIAKCPLSSDSDRDNDKKGKRREKKRYYKKKGGDAHVYREWDSDESSSDSSDDEDAANIAVTKGLLFPNVGHKCLMAKDGKRKKVKSRSSTKYETSSDDNASDEEDNLRILFANLNMEQKEKLNELISAIHEKDDLLDSQEDLLIKENKKHVKVKNAYALEIEKCEKLSNNNDDLLARIEELNISLASLRSENEKLITKAKDFDVCKVTISDLRDKNDILHAKIVELNSCKPSTSTIEHVTICTRCRDIDVDAIHDHMILIKQQNDHIAKLDAKIAEHNLENEKFKFARSMLYNGRRPGIKDGIGFQRGDNVKISAPPKRLSNFVKGKAPMPQDNEGYILYPAGYPENKIRKIHSRKSHSGSNHAFMYKSETSSSRQPTRAKLPKKKITIASNDHNISFKTFDASYVLTNKSGKVYASGGSSWILDSGCTNHMTGEKKMFSSYEKNQDSQRAITFGDGNQGLVKGLGKIAISPDHSISNVFLVDSLDYNLLSVSQLCQMGYNCLFTDVGVTVFRRSDDSIAFKGVLEGQLYLVDFDRAELDNCLIAKTNMGWLWHRRLAHVGMKNLHKLLKGEHILGLTNVHFEKDRICSACQAGKQVGAHHPHKNIMTTDRPLELLHMDLFGPIAYISIGGSKYCLVIVDDYSRFTWVFFLQEKSQTQETLKGFLRRTQNEFGLRIKKIRSDNGTEFKNSQIEGFLEEEGIKHEFSSPYTPQQNGVVERKNQTLLDMARTMLDEYKTSDRFWAEAVNTACYAINRGRKSKFAPKTVEGFLLGYDSNTRAYRVFNKSTGLVEVSCDVVFDETNGSQVEQVDLDEIGIEEAPCIALRNMSIGDVCPKESEEPPNAQDQPSSSTQASPPTQNEDEAQVDEVEDQANEPPQDDVNDQGGDANDQDKEDEEQRPPHPRVHQAIQRDHPVDTILGDIHKGVTTRSRVAHFCEHYSFVSSIEPHRVDEALQDSDWVVAMQEELNNFTRNEVWHLVPRPNQNVVGTKWVFRNKQDEHGVVTRNKARLVAKGYSQVEGLDFGETYAPVARLESIRILLAYATYHGFKLYQMDVKSAFLNGPIKEEVYVEQPPGFEDSEYPNHVYRLSKALYGLKQAPRAWYECLRDFLIANGFKVGKADPTLFTKTLDNDLFVCQIYVDDIIFGSTNESTCEEFSRIMTQKFEMSMMGELKYFLGFQVKQLQEGTFICQTKYTQDILTKFGMKDAKPIKTPMGTNGHLDLDTGGKSVDQKNISVYFVYVFGVMLISLYALCLFVLWRIEEPVAEDPGEQQVEVAEQELIEGKLCP

SEQ ID NO: 944 - protein, 1706 aa, Zea mays
MSGDHAKKEMETGEKPTTSHGSTSSEESRTKRKEKKKDSSQRKEKKSSSSHHKEKKEKSSSHKPHRKGDKHKRMRKVVYYETDTSSTSTSDSDAPSVTSKRQERKKYSKIPLHYPRISKHTPLLSVPLGKPPTFDGEDYARWSDLMRFHLISLHKSIWDVVEFGAQVPSVGDENYDEDEVAQIEHFNSQATTILLASLSREEYNKVQGLKSAKEIWDVLKTAHEGDELTKITKRETIEGELGRFRLRKGEEPQHMYNRLKTLVNQVRNLGSKKWDDHEVVNVILRSLIFLNPTQVQLIRGNPRYTKMTPEEVIGHFVSFECMIEGSRKINELGDPSEAQPVAFKATEEKKEESTPSRQPIDASKLDNEEMALVIKSFRQILKQRRGKDYKSRSKKVCYKCGKPGHFIAKCPISSDSDRGDDKKGRRKEKKRYYKKKGGDAHVCREWDSDESSSDSSDDEDAANIAVTKGLLFPNVGHKCLMAKDGKKKKVKSNSSTKYESSSDDNASDEEDNLRSLFANLNIAQKEKLNELVSAIHEKDDLLDAQEDCLIKENKKHVKVKNAYALEVEKCQKLSSELSTCREMIDNLRNENAILNAKVDSHVCNVSITNLRDDNVDLLAKIDELNVSLASLKLENEDLIAKAKDFDVCKVTISNLKDKNDILHAKIVELDSCKPSTSTIEHVTICARCRDIDVNAIHDHMILIKQQNDHIAKLDAKIAEHNLENEKFKFARSMLYNGRRPGIKDGIGFQRGDNVKISAPPKRLSNFVKGKAPMPQDNEGYILYPAGYPEDKIRKIHSRKSHSGPNHAFMYKGETSSSRQPTRAKLPRKKTPNASNDHAISFKTFDASYVLTNKSGKVYASGGSSWILDSGCTNHMTGEKKMFSSYEKNQDPQRAITFGDGNQGLVKDYNLLSVSQLCQMGYNCLFTDIGVTVFRRSDDSIAFKGVLEGQLYLVDFDRAELDTCLIAKTNMGWLWHRRLAHVGMKNLHKLLKGEHILGLTNVHFEKDRICSACQAGKQVGSHHPHKNIMTTNRPLELLHMDLFGPIAYISIGGSKYCLVIVDDYSRFTWEKSQTQETLKGFLRRAQNEFGLRIKKIRSDNGTEFKNSQIEGFLEEEGIKHEFSSPYTPQQNGVVERKNRTLLDMARTMLDEYKTSDRFWAEAVNTACYAINRLYLHRILKKTSYELLTGKKPNISYFRVFGSKCFILVKRGRKSKFAPKTVEGFLLGYDSNTRAYRVFNKSTGLVEVSCDVVFDETNGSQIEQVDLDEIGEEETPCIALRNMSIGDVCPKESEEPPIAQDQPSSSMQASPPTQNEDGAQVDEEEDQSNEPPQDDGNDQGGDANDQEKEDEEEPRPPHPRVHQAIQRDHPVDTILGDIHKGVTTRSRVAHFCEHYSFVSSIEPHRVEEALQDSDWVVAMQEELNNFTRNEVWHLVPRPNQNVVGTKWVFRNKQDEHGVVTRNKARLVAKGYSQVEGLDFGETYAPVARLESIRILLAYATYHGFKLYQMDVKSAFLNGPIKEEVYVEQPPGFEDSEYPNHVYKLSKALYGLKQAPRAWYECLRDFLIANGFKVGKADPTLFTKTLNNDLFVCQIYVDDIIFGSTNESTCEEFSRIMTQKFEMSMMGELKYFLGFQVEQLQEGTFISQTKYTQDILTKFGMKDAKPIKTPMGTNGHLDLDTGGKSVDQKGIHIRFNWLFGCRLGGVQNQ

SEQ ID NO: 945 - protein, 1892 aa, Zea mays
MSGDHAKKEMETGDDKPTTSQGSTSSSSEESRTKRREKKKKSSKRKEKRSSSSHHKEKKEKSSHKPHRSGDKHKRMRKVVFYETDTSSTSTSGSDAASVTSKRQERKKYSKIPLRYPRVPKHTPLLSVPLGKPPTFNGEDYAMWSNLMRFHLTSLHKRIWDVVEYGVQVPSIGDEDYDTDEVAQIEHFNSQAATILLASLSKEEYNKVQGLKNAKEIWDLLKTAHEGDELTKITKRETIEGELGRFHLRQGEEPQDMYNRLKTLVNQVRNLGSTKWDDHEVVKVILRALIFLNPTQVQLIRGNPRYPLMTPEEVIGNFVSFECMIKGSKKINELDEPSTSEAQPVAFKATEEKKEESTPSRQPIDASKLDNEEMALIIKSFRQILKQRKGKDYKPRSKKVCYKCGKPGHFIAKCPMSSDSDRGDDKKGRRKEKKRYYKKKGGDAHVCREWDSDESSSDSSDDEDAANIAVTKGLLFPNVGHKCLMAKDGKKKVKSKSSTKYETSSDEDDKNEEDNLRILFANLNMEQKEKLNELISAIHEKDDLLDSQEDFLIKENKKHVKVKNAYALEREKCEKLSSELSTCHEILDNLRNENANLLAKVDSHVCIDPRNDDVDLLARIDELNASIASLRNENEKLIAKAKDFDICNTTISDLRTKNDLLHAKVIELKSCKPSTSTIEHVSICTRCRDINVDAIHDHLALIKKQNDHIAQLNAKIREHDLENEKFKFARSMLYNGRRPGIKDGIGFQRGDNVKINAPPKNLSNFVKGKAPMPQDNEGYILYPAGYPENKSKKIHSRKSHSGPNYAFMYKGETSRSRQPTHAKLPRKKTINASNDHAISFKTFDASYVLTSKCGKVYASGGTSWILDSGCTNHMTGEKKMFSSYEKNKDPQRAITFGDGNQGLVKGVTVFRRSDDSIAFKGVLEGQLYLVVFDRAELDTCLIAKTNMGWLWHRRLAHVGMKNLHKLLKGEHILGLTNVHFEKDRICSACQAGKQVGTHHPHKNIMTTDRPLELLHMDLFGPIAYISIGGSKYCLVIVDDYSRFTWVFFLQEKSQTQETLKGFLRRAQNEFGLRIKKIRSDNGTEFKNSQIESFLEEEGIKHEFSSPYTPQQNGVVERKNRTLLDMARTMLDEYKTPDRFWAEAVNTACYAINRLYLHRILKKTSYELLTGKKPNISYFRVFGSKCFILIKRGRKSKFAPKTVEGFLLGYDSNTRAYRVFNKSTGLVEVSCDVVFDETNGSQVEQVDLDEIGEEQAPCIALRNMSIGDVCPKESEEPPSTQDQPPSSMQASPPTQNEDEAQNDEEQNQEVKPPQDKSNDQGGDTNDQEKEDEEEPRPPHPRVHQAIQRDHPVDTILGDIHKGVTTRSRVAHFCEHYSFVSSIEPHRVEEALQDSDWVVAMQEELNNFTRNEVWHLVPRPNQNVVGTKWVFRNKQDEHGVVTRNKARLVAKGYSQVEGLDFDETYAPVARLESIRILLAYATYHGFKLYQMDVKSAFLNGPIKEEVYVEQPPGFEDSEYPNHVYRLSKALYGLKQAPRAWYECLRDFLIANGFKVGKADPTLFTKTLENDLFVCQIYVDDIIFGSTNESTCEEFSRIMTQKFEMSMMGELKYFLGFQVKQLREGTFISQTKYTQDILAKFGMKDAKPIKTPMGTNGHLDLDTGGKSVDQKVYRSMIGSLLYLCASRPDIMLSVCMCARFQSDPKESHLTAVKRILRYLAYTPKFGLWYPRGSTFDLIGYSDADWAGCKINRKSTSGTCQFLGRSLVSWASKKQNSVALSTAEAEYIAAGHCCAQLLWMRQTLRDYGYKLTKVPLLCDNESAIKMADNPVEHSRTKHIAIRYHFLRDHQQKGDIEISYINTKDQLADIFTKPLDEQSFTRLRHELNILDSRNFFC

SEQ ID NO: 946 - protein, 1604 aa, Zea mays
MSGDHAKKEMETGEKPTTSHGSTSSEESRTKRKEKKKDSSKRKEKKSSSSHHKEKKEKSSSHKPHRRGDKHKRMRKVVYYETDTSSTSTSDSDAPSVTSKRQERKKYRDENYDEDEVAQIEHFNSQATTILLASLSREEYNKVQGLKSAKEIWDVLKTAHEGDELTKITKRETIEGELGRFRLRKGEEPQHMYNRLKTLVNQVRNLGSVKWDDHEMVKVILRSLIFLNPTQVQLIRGNPRYTKMTPEEVIGNFVSFECMIEGSRKINELDDATTSEAQPVAFKATEEKKEEATPSRQPIDASKLDNEEMALVIKSFRQILKQRRGKDYKSRSKKVCYKCGKPGHFIAKCPISSDSDRGDDKKGRRKEKKKYYKKKGGDAHVCREWDSDDSSSDSSDDEDAANIAVTKGLLFPNVGHKCLMAKDGKKKVKSKSSTKYESSSDDNASDEEDNLRSLFANLNIAQKEKLNELVSAIHEKDDLLDSQEDLLIKENKKHVKVKNAYSLQVEKCEKLSSELSTCREMIDNLRNENASLNAKVDSHVCNVSIPNPRDNNNDLLARIEELNISLASLRLENENLIAKAKDFDVCKVTIADLRDKNDILRAKIVELNSCKPSTSTIEHVIICTRCRNVDINAIHDHMALIKQQNDHIAKLDAKIAEHNLENEKFKFARSMLYNGRRPGMKDGIGFQRGDNVKLNAPPKNLSNFVKGKAPMPQDNEGYILYPAGYPESKIKKIHSRKSHSGPNHAFMYKSETSSSRQPTHAKLPRKKTPIASNDHTISFKTLDASYVLTSKSGKVYASGGSSWILDSGCTNHMTREKRMFSSYEKNQDPQRAITFEDGNQGVTVFRRSDDSIAFKGVLEGQLYLVDFDRAELDTCLIAKTNMGWLWHRRLAHVGMKNLHKLLKGEHILGLTNVHFEKDREKSQTQETLKGFLRRAQNEFGLRIKKIRSDNGTEFKNSQIEGFLEEEGIKHEFSSPYTPQQNGVVERKNRTLLDMARTMLDEYKTPDRFWAEAVNTACYAINRLYLHRILKKTSYELLTGKKPNISYFRVFGSKCFILVKRGRKSKFAPKTVEGFLLGYDPNTRAYRVFNKSTGLVEVSCDVVFDETNGSQVEQVDLDETGNDEAPCVALRNMSIGDVCPKESEELPSAQDQPSSSTQASPPTQNEDEAQVDEVEDQANEPPQDDGIDQGGDANDQDKEDEEQRPPHPRVHQAIQQDHPVDTILGDIHKGVTTRSRVAHFCEHYSFVSSIEPHRVEEALQDSDWVVAMQEELNNFTRNEVWHLVPRPNQNVVGTKWVFRNKQDEHGVVTRNKARLVAKGYSQVEGLDFGETYAPVARLESIRILLAYATYHGFKLYQMDVKSAFLNGPIKEEVYVEQPPGFEDSEYPNHVYKLSKALYGLKQAPRAWYECLRDFLIANGFKVGKADPTLFTKTLENDLFVCQIYVDDIIFGSTNESTCEEFSRIMTQKFEMSMMGELKYFLGFQVKQLQEGTFISQTKYTQDILSKFGMKDAKPIKTPMGTNGHLDLDTGGKSVDQKFHPIHPPSRRLSFAYMQSLGAAQGHAPPPPLFPAADPTEFTTPGQSAASNNPHASSSPSPNQSRCPPR

SEQ ID NO: 947 - protein, 1760 aa, Zea mays
MSGDHAKKEMETGEKPTTSHGSTSSEESRTKRKEKKKDSSKRKEKKSSSSHHKEKKEKSSSHKPHRRGDKHKRMRKVVYYETDTSSTSTSDSDAPSVTSKRQERKKYRDENYDEDEVAQIEHFNSQATTILLASLSREEYNKVQGLKSAKEIWDVLKTAHEGDELTKITKRETIEGELGRFRLRKGEEPQHMYNRLKTLVNQVRNLGSVKWDDHEMVKVILRSLIFLNPTQVQLIRGNPRYTKMTPEEVIGNFVSFECMIEGSRKINELDDATTSEAQPVAFKATEEKKEEATPSRQPIDASKLDNEEMALVIKSFRQILKQRRGKDYKSRSKKVCYKCGKPGHFIAKCPISSDSDRGDDKKGRRKEKKKYYKKKGGDAHVCREWDSDDSSSDSSDDEDAANIAVTKGLLFPNVGHKCLMAKDGKKKVKSKSSTKYESSSDDNASDEEDNLRSLFANLNIAQKEKLNELVSAIHEKDDLLDSQEDLLIKENKKHVKVKNAYSLQVEKCEKLSSELSTCREMIDNLRNENASLNAKVDSHVCNVSIPNPRDNNNDLLARIEELNISLASLRLENENLIAKAKDFDVCKVTIADLRDKNDILRAKIVELNSCKPSTSTIEHVIICTRCRNVDINAIHDHMALIKQQNDHIAKLDAKIAEHNLENEKFKFARSMLYNGRRPGMKDGIGFQRGDNVKLNAPPKNLSNFVKGKAPMPQDNEGYILYPAGYPESKIKKIHSRKSHSGPNHAFMYKSETSSSRQPTHAKLPRKKTPIASNDHTISFKTLDASYVLTSKSGKVYASGGSSWILDSGCTNHMTREKRMFSSYEKNQDPQRAITFEDGNQGVTVFRRSDDSIAFKGVLEGQLYLVDFDRAELDTCLIAKTNMGWLWHRRLAHVGMKNLHKLLKGEHILGLTNVHFEKDREKSQTQETLKGFLRRAQNEFGLRIKKIRSDNGTEFKNSQIEGFLEEEGIKHEFSSPYTPQQNGVVERKNRTLLDMARTMLDEYKTPDRFWAEAVNTACYAINRLYLHRILKKTSYELLTGKKPNISYFRVFGSKCFILVKRGRKSKFAPKTVEGFLLGYDPNTRAYRVFNKSTGLVEVSCDVVFDETNGSQVEQVDLDETGNDEAPCVALRNMSIGDVCPKESEELPSAQDQPSSSTQASPPTQNEDEAQVDEVEDQANEPPQDDGIDQGGDANDQDKEDEEQRPPHPRVHQAIQQDHPVDTILGDIHKGVTTRSRVAHFCEHYSFVSSIEPHRVEEALQDSDWVVAMQEELNNFTRNEVWHLVPRPNQNVVGTKWVFRNKQDEHGVVTRNKARLVAKGYSQVEGLDFGETYAPVARLESIRILLAYATYHGFKLYQMDVKSAFLNGPIKEEVYVEQPPGFEDSEYPNHVYKLSKALYGLKQAPRAWYECLRDFLIANGFKVGKADPTLFTKTLENDLFVCQIYVDDIIFGSTNESTCEEFSRIMTQKFEMSMMGELKYFLGFQVKQLQEGTFISQTKYTQDILSKFGMKDAKPIKTPMGTNGHLDLDTGGKSVDQKVYRSMIGSLLYLCASRPDIMLSVCMCARFQSDPKESHLTAVKRILRYLAYTPKFGLWYPRGSTFDLLGYSDADWAGCKINRKSTSGTCQFLGRSLVSWASKKQNSVALSTAEAEYIAAGHCCAQLLWMRQTLRDYGYKLTKVPLLCDNESAIKMADNPVEHSRTKHIAIRYHFLRDHQQKGDIEISYINTKDQLADIFTKPLDEQTFTKLRHELNILDSRNFFC

SEQ ID NO: 948 - protein, 529 aa, Sorghum bicolor
MGPPAMAFQALTLTPVPFSLHSSSRRVRVRVLAVAADQTPPPPAVPPSEPANSPSRLLRELAQRKKAVSPKKKHPPRRFILKPPLDDERLTRRFLSSPQLSLKALPLLSSCLPSAPLSTADRTWMDEYLLEAKQALGYPLAPSETLGEGDDCPARHFDVLLYLAFQHLDPSSERTRTRHVRNGHSRLWFLGQYVLELAFCEFFLQRYPRESPGPMRERVFALIGKKVLPRWLKAASLHNLVFPYDDLDKMIRKDREPPSKAVFWALFGAIYLCFGMPEVYRVLFEAFGMDPDDESCQPKLRRQLEDVDYVSVEFEKRQLTWQDVAAYRPPPDALFAHPRLFRACVPPGMHRFRGNIWDFDSRPKVMNTLGYPLPMNDRIPEITEARNIELGLGLQLCFLHPSKHKFEHPRFCYERLEYVGQKIQDLVMAERLLMKHLDAPGRWLAEKHRRTLMNKYCGRYLRDKHLQHYIIYGETVQDRFEHNRRLRNPSTTSVQQALHGLAYCVYGKPDVRRLMFEVFDFEQVQPKAV

SEQ ID NO: 949 - protein, 525 aa, Zea mays
MGPPAMAFQALTLTPLPFSLHSSSRRVRVLAVAADQTPPPAPPSEPANSPSRLLRELAQRKKAVSPKKKHPPRRFILKPPLDDERLTRRFLSSPQLSLKALPLLSSCLPSAPLSTADRTWMDEYLLEAKQALGYPLAPSETLGEGDDCPARHFDVLFYLAFQHLDPSSERTRMRHVRNGHSRLWFLGQYVLELAFCEFFLQRYPRESPGPMRERVFALIGKKVLPRWLKAASLHNLVFPYDDLDKMIRKDREPPSKAVFWAIFGAIYLCFGMPEVYRVLFEAFGMDPDDESCQPKLRRQLEDVDYVSVEFEKRQLTWQDVAAYRPPPDALFAHPRLFRACVPPGMHRFRGNIWDFDSRPKVMTTLGYPLPMNDRIPEITEARNIELGLGLQLCFLHPSKHKFEHPRFCYERLEYVGQKIQDLVMAERLLMKHLDAPGRWLAEKHRRTLMNKYCGRYLRDKHLQHYIIYGETVQDRFEHNRRLRNPSTTSVQQALHGLAYCVYGKPDVRRLMFEVFDFEQVQPKAV

SEQ ID NO: 950 - protein, 527 aa, Hordeum vulgare subsp. vulgare
MAPPAMAFQALAFSPLPLHLPATRRRVRVLAVAADQTPPPPQASPSEPANSPSRLLRELAQRKKAVSPKKKHPPRRFILKPPLDDERLTQRFLNSPQLSLKSLPLLSSCLPSAPLSAADRTWMDEYLLEAKQALGYPLAPSETLGEGDDCPARHFDVLLYLVFQHLDPSSERTRTRHVRNGHSRLWFLGQFVLELAFCEFFLQRYPRESPGPMRERVFALIGKKMLPKWIKAASLHNLVFPYDDLDKMLRKDREPPTKAVFWALFGAIYLCFGMPEVYRVLFEAFGMDPEEESCQPKLRRQLEDVDYVSVEFEKRQLAWQDVAAYRPPADALFAHPRLFRACVPPGMHRFRGNIWDFDNRPKVMNILGYPLPANDKIPEITEARNIELGLGLQLCFMHPSKYKFEHPRFCFERLEYVGQKIQDLVLAERLLMKHLDAPGRWLSEKHRRLLMNKYCGRYLRGKHLHHYIIYGETVQDRFEHNRRLRNPSTTAVQQAIHGLSYCVYGKPDVRRLMFEVFDFEQVQPKAV

SEQ ID NO: 951 - protein, 511 aa, Oryza sativa Japonica Group
MAPPAMAFQALALGPLPLPLPRRVAAAACESSPPSRLLRELAERKKAVSPKKKHPPRRFILKPPLDDERLTQRFLSSPQLSLKALPLLSSCLPSAPLSAADRTWMDEYLLEAKQALGYPLAPSETLGDGDDDGCPARHFDVLLYLAFQHLDTSCERTRTRHVRSGHSRLWFLGQYVLELAFCEFFLQRYPRESPGPMRERVFALIGKRAIPKWIKAASLHNLVFPYDDLDKMIRKDREPPAKAVFWALFGAIYLCFGMPEVYRVLFEAFGMDPEDESCQPKLRRQLEDVDYVSVEFEKRQLTWQDVAAYRPPPDALFAHPRLFRACVPPGMHRFRGNIWDFDNRPKVMNTLGYPLPMNDRIPEITEARNIELGLGLQLCFLHPSKHKFEHPRFCLERLEYVGQKIQDLVMAERLLMKHLDAPGRWLAEKHRRLLMNKYCGRYLRDKHLHHYIIYGESVQDRFEHNRRLRNPSTTAVQQAIHGLAYCVYGKPDVRRLMFEVFDFEQVQPKAV

SEQ ID NO: 952 - protein, 533 aa, Oryza sativa Japonica Group
MAPPAMAFQALALGPLPLPLPAARRRRRVRVLAVAADHTPPPPPSPSSPPEPANSPSRLLRELAERKKAVSPKKKHPPRRFILKPPLDDERLTQRFLSSPQLSLKALPLLSSCLPSAPLSAADRTWMDEYLLEAKQALGYPLAPSETLGDGDDDGCPARHFDVLLYLAFQHLDTSCERTRTRHVRSGHSRLWFLGQYVLELAFCEFFLQRYPRESPGPMRERVFALIGKRAIPKWIKAASLHNLVFPYDDLDKMIRKDREPPAKAVFWALFGAIYLCFGMPEVYRVLFEAFGMDPEDESCQPKLRRQLEDVDYVSVEFEKRQLTWQDVAAYRPPPDALFAHPRLFRACVPPGMHRFRGNIWDFDNRPKVMNTLGYPLPMNDRIPEITEARNIELGLGLQLCFLHPSKHKFEHPRFCLERLEYVGQKIQDLVMAERLLMKHLDAPGRWLAEKHRRLLMNKYCGRYLRDKHLHHYIIYGESVQDRFEHNRRLRNPSTTAVQQAIHGLAYCVYGKPDVRRLMFEVFDFEQVQPKAV

SEQ ID NO: 953 - protein, 559 aa, Oryza sativa Indica Group
MAPPAMAFQALALGPLPLPLPAARRRRRVRVLAVAADHTPPPPPSPSSPPEPANSPSRLLRELAERKKAVSPKKKHPPRRFILKPPLDDERLTQRFLSSPQLSLKALPLLSSCLPSAPLSAADRTWMDEYLLEAKQALGYPLAPSETLGDGDDDGCPARHFDVLLYLAFQHLDTSCERTRTRHVRSGHSRLWFLGQYVLELAFCEFFLQRYPRESPGPMRERVFALIGKRAIPKWIKAASLHNLVFPYDDLDKMIRKDREPPAKAVFWALFGAIYLCFGMPEVYRVLFEAFGMDPEDESCQPKLRRQLEDVDYVSVEFEKRQLTWQDVAAYRPPPDALFAHPRLFRACVPPGMHRFRGNIWDFDNRPKVMNTLGYPLPMNDRIPEITEARNIELGLGLQSPAILQVYRPKKSVMITNLPLNLRLILCFLHPSKHKFEHPRFCLERLEYVGQKIQDLVMAERLLMKHLDAPGRWLAEKHRRLLMNKYCGRYLRDKHLHHYIIYGESVQDRFEHNRRLRNPSTTAVQQAIHGLAYCVYGKPDVRRLMFEVFDFEQVQPKAV

SEQ ID NO: 954 - protein, 493 aa, Hordeum vulgare subsp. vulgare
MAPPAMAFQALAFSPLPLHLPATRRRVRVLAVAADQTPPPPQASPSEPANSPSRLLRELAQRKKAVSPKKKHPPRRFILKPPLDDERLTQRFLNSPQLSLKSLPLLSSCLPSAPLSAADRTWMDEYLLEAKQALGYPLAPSETLGEGDDCPARHFDVLLYLVFQHLDPSSERTRTRHVRNGHSRLWFLGQFVLELAFCEFFLQRYPRESPGPMRERVFALIGKKMLPKWIKAASLHNLVFPYDDLDKMLRKDREPPTKAVFWALFGAIYLCFGMPEVYRVLFEAFGMDPEEESCQPKLRRQLEDVDYVSVEFEKRQLAWQDVAAYRPPADALFAHPRLFRACVPPGMHRFRGNIWDFDNRPKVMNILGYPLPANDKIPEITEARNIELGLGLQLCFMHPSKYKFEHPRFCFERLEYVGQKIQDLVLAERLLMKHLDAPGRWLSEKHRRLLMNKYCGRYLRGKHLHHYIIYGETVQDRFEHNRRLRNPSTTAVQ

SEQ ID NO: 955 - protein, 532 aa, Ricinus communis
MELSSSFTHFTKISEISFTSSFSPFALQIHLKKPIKFPPNLRVLAVAIDPPQPQELPQNSPQRLLKELAERKKITSPKKKVPPKRFILKPPLDDKKLAQRFLNSPQLSLKQFPLLSSCLPSSRLNSVDKTWIDEYLLEAKQALGYSLEPSDNFGDDNPAKQFDTLLYLAFQHPSCERTNARHVKYGHSRLCFLGQYVLELAFCEFFLQRYPRESPAPMRERVFALIGKRNLPKWIKAASLQNLIFPYDDIDKLLRKDREPPVKSVFWALFGAIYLCFGMPEVYRVLFEVFGMDPEAEDCQPKLRRQLEDVDYVSVEFEGNKLSWQDVAAYKPPEDALFAHPRLFRACVPPGMHRFRGNIWDYDSRPKVMKTLGYPLAMSDRIPDITEARNIELGLGLQLCFLHPSKYKFEHPRFCYERLEFVGQKIQDLVLAERLLMKHLDAPGKWLQERHRRLLMNKFCGRYLRDKHLHHFIVYSEQVIDAYENNRRLRNPATTAVQQALHGLSYTVYGKPDVRRLMFEVFDFEQIQPKAV

SEQ ID NO: 956 - protein, 537 aa, Arabidopsis thaliana
MELCSSSPSSSLLRICSSSAPEISFSSSISQFPSKTQSILTKSRFQNLRICASVTAETQGLPRDSPQRLLKELAQRKTATGPKKKVPPKRFILRPPLDDKKLAERFLNSPQLSLKSFPLLSSCLPSSKLNNADKTWIDEYLLEVKQALGYSLEPSESLGDDNPAKHFDTLLYLAFQHPSCDRARARHVKNGHSRLWFLGQYVLELALTEFFLQRYPRESPGPMRERVFALIGKRYLPKWIKAASLQNLIFPYDDMDKLIRKEREPPVKSVFWALFGAIYLCFGMPEVYRVLFEVFGMDPDADECQPRSRRQLEDVDYVSVEFEGKKLGWQDIATYKPPEDALFAHPRLFRACVPPGMHRFRGNIWDFDSKPKVMQTLGYPLTMNDRIKEITEARNIELGLGLQLCFLHPSKHKFEHPRFCFERLEYVGQKIQDIAMAERLLMKHLDAPGKWLQEKHRRLLMNKFCGRYLREKRLHNFIIYSEEVHDRYEHNRRLRNPATTAVQQAIHGLAYTIYGKPDVRRLMFEVFDFEQIQPKAV

SEQ ID NO: 957 - protein, 537 aa, Arabidopsis lyrata subsp. lyrata
MELCSSSSSSSLLRICSSSAPEISFSSSISQFPSKIQSILTKPRFQNLRICASVAAETQGLPRDSPQRLLKELAQRKTATGPKKKVPPKRFILRPPLDDKKLAERFLNSPQLSLKSFPLLSSCLPSSKLNNADKTWIDEYLLEVKQALGYSLEPSESLGDDNPAKHFDTLLYLAFQHPSCDRARARHVKNGHSRLWFLGQYVLELALTEFFLQRYPRESPGPMRERVFALIGKRYLPKWIKAASLQNLIFPYDDMDKLIRKEREPPVKSVFWALFGAIYLCYGMPEVYRVLFEVFGMDPDADECQPRSRRQLEDVDYVSVEFEGKKLGWQDIATYKPPEDALFAHPRLFRACVPPGMHRFRGNIWDFDSKPKVMQTLGYPLPMNDRIKEITEARNIELGLGLQLCFLHPSKHKFEHPRFCFERLEYVGQKIQDIAMAERLLMKHLDAPGKWLQEKHRRLLMNKFCGRYLREKRLHNFITYSEEVHDRYEHNRRLRNPATTAVQQAIHGLAYTIYGKPDVRRLMFEVFDFEQIQPKAV

SEQ ID NO: 958 - protein, 665 aa, Zea mays
MASASRVRLGTLVPLTKDNAGSSNGSVSSIPIFQGPNVVGRDHLVVVDKRISRKHLSLHASTDGSIEVVVEGPNPIIVRSKGQRRKVCAKETAKIAHGDVLELIPGDYFVKYVDMGDEHVPMHLSDLMKGKRYSEEHGAAVKRIRQIMEDEALAKTLQESFAADDAAVSGMPSGQKISSHDSAGSSERNNDRTHSVGPLKDMLPLTFRLMHVQGLPSWTNTSSVTIQDVIQGEVLLAVLSNYMVDIDWLLTACPSLRKVPHVLVLHGQDGASLELMKKLKPANWILHRPPLPISFGTHHSKAMLLVYPQGIRIVVHTANLIHVDWNYKSQGLWMQDFPWKDTVDMNKKTAFENDLVDYLSALKWPEFRVNLPGVGDVNINAAFFRKFDYSNSMVRLIGSVPGYHVGSNIRKWGHMKLRNVLDEIMFNKQFCKSPLIYQFSSLGSLDEKWMSEFACSLSAGKSDDGSQLGIGKPLIVWPTVEDVRCSIEGYAAGSCIPSPQKNVERDFLKKYWSRWKADHVGRCRAMPHIKTFTRYSGQNIAWFLLTSANLSKAAWGALQKNNTQLMIRSYELGVLFLPQTLQSVPQFSCTEKSRSIRDGVALGKTIKTKLVTLCWKGDEEDPSIVRLPVPYQLPPQPYGTQDVPWSWDRRYTKKDVYGSVWPRYG

SEQ ID NO: 959 - protein, 689 aa, Sorghum bicolor
MASASRVRLGTLVPLTKDNAGSSNGSVSNIPIFQGSNVVGRDHLVVVDKRISRKHLSLHASTDGSIEVVVEGPNPIMVRSNGQRRKVCATGKAKIAHGDVLELIPGDYFVKYVDMGDEHKISVPMHLSDLKKGKRHSEEDSAAVKRNRQIMEDEALARTLQIGFPCVKSQCTIKLCCVLSKQESFAEDNTAVSGMTSGQKISSHDSAGSSGRNNERKHSIGPLKDMLPLTFRLMRVQGLPSWTNTSSVSIQDVIQGEVLLAVLSNYMVDIDWLLTACPSLKKVPHVLVLHGQDGASLELMKKLKPANWILHKPPLPISFGTHHSKAMLLVYPQGIRIVVHTANLIHVDWNYKSQGLWMQDFPWKDTNDMNNKVPFENDLVDYLSALKWPEFSVNLPEVGDVNINAAFFRKFDYRNSMVRLIGSVPGYHVGPNIRKWGHMKLRNVLDEITFNKQFCKSPLIYQFSSLGSLDEKWMSEFACSLSAGKSDDGSQLGIGKPLIVWPTVEDVRCSIEGYAAGSCIPSPQKNVEKDFLKKYWSRWKADHVGRCRAMPHIKTFTRYSGQNIAWFLLTSSNLSKAAWGALQKNNTQLMIRSYELGVLFLPQTLQSIPQFSCTEKSRSSRDGVAIGRTIKTKLVTLCWKGDEEDPSIVKLPVPYQLPPQPYGTQDVPWSWDRRYTKKDVYGSVWPRHG

SEQ ID NO: 960 - protein, 669 aa, Hordeum vulgare subsp. vulgare
MSSSSRVRVGTLVPFVEGKSGSPNASSLPMPSIPIFEGSNVVGRSNLVAVDKRVSRKHLSLRAVPDGSVEVVVEGTNPIVVRSEGQRRKVCAQQRAKIMPDDVLELIPGEYFMKYVNMSDERKISASVDSHDLKKGKRHSEEDSVAAKRNRQVMEDEALARTLQESFAEESASVTEVLSSLDSAGSSERNKERTHSVGPLKDVLPLSFRLMRVQGLPSWTNTSTVTIQDVIQGEVLLAVLSNYMVDMDWLLTACPSLRKVPHVLVLHGEDGASLERLKKTKPTNWILHKPPLPISFGTHHSKAMLLVYPQGIRVVVHTANLIHVDWNNKSQGLWAQDFPWKEANDMSTNIGFENDLVDYLRALKWPEFRVNLPVVGDVNINAAFFRKFDYSSSTVRLIGSVPGYHVGPNMKKWGHMKLRSVLEECVFEKQFCKSPLIYQFSSLGSLDEKWMSEFACSLSAGKADDGSQLGIGKPLIVWPTVEDVRCSIEGYAAGSCIPSPQKNVEKDFLRKYWSRWKADHVGRCRAMPHIKTFTRYNGQNIAWFLLTSSNLSKAAWGALQKNNTQLMIRSYELGVLFLPKTLQSVPQFSCTDKSRSNLDKLALGKNIKTKLVTLCWKGDEEKDPSAEVVRLPVPYQLPPQLYGPEDVPWSWDRRYTKKDVYGSVWSRHG

SEQ ID NO: 961 - protein, 843 aa, Oryza sativa Indica Group
MASSSRVRVGNLVPLNEGNASSSNGSVSSIPIYLGANVVGRNHLVVVDKRVSRKHLSLHASADGSIEAVVEGPNPIIVRSEGQRRKVCAQERVKIAHDDVLELIPGEYFVKYLNVGDNHKSSTSMGSSDFKKGKRLCEDDTVVIKRNRQIMEDEALARSLQKSFAEESSTISGLGCDQMLSSLDSAGSSERNNERIHSVDYLKDVLSLTFRLMRVQGLPSWTNTSSVTIQDVIQGEVLLAVLSNYMVDMEWLLTACPSLRKVRHVLVIHGEDGASVELLKKVKPANWILHKPPLPISFGTHHSKAMLLVYPQGIRVVVHTANLIHVDWNNKTQGLWMQDFPWKDAKDVNRIVSFENDLVDYLSAIKWPEFRVNLPVVGDVNINAAFFRKFDYKSSLVRLIGSVPGYHVGPNIKKWGHMKLRSVLEGCTFEQQFCKAPMIYQFSSLGSLDEKWMSEFACSLSAGKSDNGSPLGIGKPLIVWPTVEDVRTSIEGYAAGSCIPSPQKNVEKDFLRKYWARWKADHVGRCRAMPHIKTFTRYNGQDIAWFLLTSANLSKAAWGALQKNNTQLMIRSYELGVLFLPKTHQSVPQFSCTGKNNSNLNNLAPGKEIKTKLVTLCWKSDEEKEQSTEIIRLPVPYQLPPKPYGTEDDPWSWDKRYTKKDVYGSVWPRHGGIQAKKRESTKDTRLAEAERPPSRSISSGRVLGRSLPSSTSSSQVLGVACHFHQQSFMSDLDIQIPTAFDPFAEANAGDSGAAAGSKDYVHVRIQQRNGRKSLTTVQGLKKEFSYNKILKDLKKEFCCNGTVVQDPELGQVIQLQGDQRKNVSNFLVQAGIVKKEHIKIHGF

SEQ ID NO: 962 - protein, 671 aa, Oryza sativa Japonica Group
MTSSSRVRVGNLVPLNEGNASSSNGSVSSIPIYLGANVVGRNHLVVVDKRVSRKHLSLHASADGSIEAVVEGPNPIIVRSEGQRRKVCAQERVKIAHDDVLELIPGEYFVKYLNVGDNHKSSTSMGSSDFKKGKRLCEDDTVVIKRNRQIMEDEALARSLQKSFAEESSTISGLGCDQMLSSLDSAGFSERNNERIHSVDYLKDVLSLTFRLMRVQGLPSWTNTSSVTIQDVIQGEVLLAVLSNYMVDMEWLLTACPSLRKVRHVLVIHGEDGASVELLKKVKPANWILHKPPLPISFGTHHSKAMLLVYPQGIRVVVHTANLIHVDWNNKTQGLWMQDFPWKDAKDVNRSVSFENDLVDYLSAIKWPEFRVNLPVVGDVNINAAFFRKFDYKSSSVRLIGSVPGYHVGPNIKKWGHMKLRSVLEGCTFEQQFCKAPMIYQFSSLGSLDEKWMSEFAFSLSAGKSDNGSPLGIGKPLIVWPTVEDVRTSIEGYAAGSCIPSPQKNVEKDFLRKYWARWKADHVGRCRAMPHIKTFTRYNGQDIAWFLLTSANLSKAAWGALQKNNTQLMIRSYELGVLFLPKTHQSVPQFSCTGKNNSNLNNLAPGKEIKTKLVTLCWKSDEEKEQSTEIIRLPVPYQLPPKPYGTEDVPWSWDKRYTKKDVYGSVWPRHG

SEQ ID NO: 963 - protein, 371 aa, Zea mays
MERGAATAAAALGCALRSPSPSASPAPRWPPLHRCPRRGPPGPPRSLLPPARRFRPLDMKKGHSRNSPKTFSSSGHSGVRLNNEGLVNDRLLIDCGEDQDCVLGGIVALGKFDALHIGHRELAMHASKAGTPFLLSFVGMAEVLGWTYRPPIVAHCDRKRVLSSWAPYCRNVVPLEYQVEFSKVRSLSPRQFVERLSKDLRIKGVVAGENYRFGYKASGDATELVKLCEEFGLSAFIVRSVMDTAKRSLNGFSGAINSSDKGQVSSSRVRHALAMGDMEYVSELLGRKHRLLLMVNQHCLHEKKSIVLPNSCMLNMPPAEGLYENCDLVNGGYLGPCRVIINSDTIIIEMKDDNSLSLNPIQEVQLGIEFG

SEQ ID NO: 964 - protein, 391 aa, Oryza sativa Indica Group
MERGAAAAGALSCTFRSPSPSPTSPAAPHWRPLLGFRSRSRSRGRGWGQRAVVAGAPRLFLPPPCRRFRYCSQSKLLGMNKGQNRCSLATFSSFGQSGISLNNEDLVKDKLLIDCGEDQDCVIDGIVALGKFDALHIGHRELAMYASKAGTPFLLSFVGIAEVLGWEYRPPIVAQCDRKRVLTSWAPYCKNVVPIEYQVEFSKVRYLTPRQFVERLSRDLKIQGVVAGENYRFGYRASGDAAELVKLCEEFGLSAFIVRSVMDTARSYNGVTTSVNSSDKGQVSSSRVRHALAMGDMEYVSELLGRKHRLVLTVKENHLQERKRIMLPKSCMLNMPPADGLYENCDLVNGGHLGLCRVIINSETIEIEMKDENSLLPNTIQENQQLGIEFG

SEQ ID NO: 965 - protein, 388 aa, Oryza sativa Japonica Group
MERGAAAAGALSCTFRSPSPSPTSPAAPHWRPLLGFRSRSRSRGRGWGQRAVVAGAPRLFLPPPCRRFSQSKLLGTNKGQNRCSLATFSSFGQSGISLNNEDLVKDKLLIDCGEDQDCVIDGIVALGKFDALHIGHRELAMYASKAGTPFLLSFVGIAEVLGWEYRPPIVAQCDRKRVLTSWAPYCKNVVPIEYQVEFSKVRYLTPRQFVERLSRDLKIQGVVAGENYRFGYRASGDAAELVKLCEEFGLSAFIVRSVMDTARSYNGVTTSVNSSDKGQVSSSRVRHALAMGDMEYVSELLGRKHRLVLTVKENHLQERKRIMLPKSCMLNMPPADGLYENCDLLNGGHLGLCRVIINSETIVIEMKDENSLLPNTIQENQQLGIEFG

SEQ ID NO: 966 - protein, 391 aa, Oryza sativa Japonica Group
MERGAAAAGALSCTFRSPSPSPTSPAAPHWRPLLGFRSRSRSRGRGWGQRAVVAGAPRLFLPPPCRRFRYCSQSKLLGTNKGQNRCSLATFSSFGQSGISLNNEDLVKDKLLIDCGEDQDCVIDGIVALGKFDALHIGHRELAMYASKAGTPFLLSFVGIAEVLGWEYRPPIVAQCDRKRVLTSWAPYCKNVVPIEYQVEFSKVRYLTPRQFVERLSRDLKIQGVVAGENYRFGYRASGDAAELVKLCEEFGLSAFIVRSVMDTARSYNGVTTSVNSSDKGQVSSSRVRHALAMGDMEYVSELLGRKHRLVLTVKENHLQERKRIMLPKSCMLNMPPADGLYENCDLLNGGHLGLCRVIINSETIVIEMKDENSLLPNTIQENQQLGIEFG

SEQ ID NO: 967 - protein, 372 aa, Hordeum vulgare subsp. vulgare
MERGGTAALACTFRSSSSSSPVSHCSPLLRSRGRPPAPAGAPHLLLPTGRRFSQNRFLETSKGLKRYSLTTFSPFGRPTSLNDADLVKDKMLIDCGEEQDCVLDGIVALGKFDALHIGHRELAMHASKSGNPFLLSFVGMAEVLGWEYRPPIVAHCDRKRVLSSWAPYCRNVVPLEYQVEFSKVRYLTPRQFVEKLSTDLRIKGVVAGENYRFGYKASGDAAELVKLCEEFGLSAFIVRSVMDTAKGSYNGATPAVNSSDKGQVSSSRVRQALSVGDIEYVSKLLGRKHRLVLTVSECSIKERKNIIIPKSCMVNMPPADGFYENCELFNGGYLGLCRVVISTETIDIEMKDESSLSPDPFQEVQQLGIEFG

SEQ ID NO: 968 - protein, 372 aa, Hordeum vulgare subsp. vulgare
MERGGTAALACTFRSSSSSSPVSHCSPLLRSRGRPPAPAGAPHLLLPTGRRFSQNRFLETSKGLKRYSLTTFSPFGRPTSLNDADLVKDKMLIDCGEEQGCVLDGIVALGKFDALHIGHRELAMHASKSGNPFLLSFVGMAEVLGWEYRPPIVAHCDRKRVLSSWAPYCRNVVPLEYQVEFSKVRYLTPRQFVEKLSTDLRIKGVVAGENYRFGYKASGDAAELVKLCEEFGLSAFIVRSVMDTAKGSYNGATPAVNSSDKGQVSSSRVRQALSVGDIEYVSKLLGRKHRLVLTVSECSIKERKNIIIPKSCMVNMPPADGFYENCELFNGGYLGLCRVVISTETIDIEMKDESSLSPDPFQEVQQLGIEFG

SEQ ID NO: 969 - protein, 228 aa, Sorghum bicolor
MHKTAQAWFTGGTAASTGTAAESQPSLLADWNSYAATRSDASSSSPLPFDIEAAVRSANDTVSGTFSSVTKGVRELPGSFQSATSSFPSGKALMYFGLFLATGIFFVFIAFALFLPVMVLMPQKFAICFTLGCALIIASLFALKGPANQLAHMTSKERLPFSVGFIGCMVGTIYVSMVLHSYFLSVIFSVLQVLALAYYTISYFPGGSSGLKFISSGLLSSAASLFSR

SEQ ID NO: 970 - protein, 228 aa, Zea mays
MHKTAQAWFTGGTAASSGAAAESQPSLLADWNSYAATRSDASSSSPLPFDIEAAVRSANDTVSGTLSSVTKGVRELPGSFQSATSSFPSGKALMYFGLFLATGIFFVFIAFALFLPVMVLMPQKFAISFTLGCALIIASLFALKGPANQLAHMTSKERLPFSVGFIGCMVGTIYVSMVLHSYFLSVIFSVLQVLALAYYTISYFPGGSSGLKFISSGLLSSATSCFGR

SEQ ID NO: 971 - protein, 228 aa, Zea mays
MHKTAQAWFTGGTAASSGAAAESQPSLLADWNSYAPTRSDASSSSPLPFDIEAAVRSANDTVSGTLSSVTKGVRELPGSFQSATSSFPSGKALMYFGLFLATGIFFVFIAFALFLPVMVLMPQKFAISFTLGCALIIASLFALKGPANQLAHMTSKERLPFSVGFIGCMVGTIYVSMVLHSYFLSVIFSVLQVLALAYYTISYFPGGSSGLKFISSGLLSSATSCFGR

SEQ ID NO: 972 - protein, 226 aa, Hordeum vulgare subsp. vulgare
MQKTAQSWFTGGTASPSTAAESQPSLLADWNSYAATRPDASSSSPLPFDIEAAVRSANDTVSGTFNVVTKGVRELPGSFQGATSSFPSGKALMYFGLFLATGIFFVFIAFTLFLPVMVLMPQKFAICFTLGCALIIASLFALKGPANQLAHMTSKERLPFTVGFTGCMVGTIYVSMVLHSYFLSVIFSILQVLALAYYTISYFPGGSSGLKFLSSSLMSPVSRIFS

SEQ ID NO: 973 - protein, 226 aa, Hordeum vulgare subsp. vulgare
MQKTAQSWFTGGTASPSTAAESQPSLLADWKSYAATRPDASSSSPLPFDIEAAVRSANDTVSGTFNVVTKGVRELPGSFQGATSSFPSGKALMYFGLFLATGIFFVFIAFTLFLPVMVLMPQKFAICFTLGCALIIASLFALKGPANQLAHMTSKERLPFTVGFTGCMVGTIYVSMVLHSYFLSVIFSILQVLALAYYTISYFPGGSSGLKFLSSSLMSPVSRIFS

SEQ ID NO: 974 - protein, 228 aa, Oryza sativa Japonica Group
MHKTAQAWFTGGPAAPAASAGESQPSLLADWNSYAASRPDASSSSPLPFDIEAAVRSANDTVSGTFSVVTKGVRELPGSFQSATSSFPSGKALMYFGLFLATGIFFVFIAFALFLPVMVIMPQKFAICFTLGCGLIIASIFALKGPASQFAHMTSMERLPFTGALIGCMVGTIYVSMFLHSYFLSVIFSVLQVLSLAYYTISYFPGGSSGLKFISSSLLSSVTSCFGR

SEQ ID NO: 975 - protein, 231 aa, Ricinus communis
MQKMAQGWFSSSGTSGEDQQQKPQSSSSLLADWNSYAASQDADESSGLGIGFDLEAVVRSANDSVSGTFNVVSKGVRDIPGSFQSATSNIPSGKALMYFGLFLATGVFFVFIAFALFLPVIVLMPQKFAICFTLGCVFIIASFVALKGPKNQFAHMTSKERLPFTLGFIGSMAGTIYVSMVLHSYILSVLFSVIQVLALAYYAISYFPGGSAGMKFLSSSLISSVTRCFGG

SEQ ID NO: 976 - protein, 225 aa, Vitis vinifera
MQKTAQAWFMGGPSSSSGREKSPASLLADWNAYAASQEPDSSALGFDLEAAVRTANDKVSGSFNVVSKGVRDIPGSFQSAATNVPSGKSLMYFSLLLAAGIFFVFIAFAMFLPVMVLMPQKFAICFTIGCVFIIGSFFALKGPKNQLAHMFSRERLPFTLGFISSMVGTIYVSMVLHSYVFSVLFSVLQVLALSYYAISYFPGGSAGMKFLSSTLTSLILKCFGR

SEQ ID NO: 977 - protein, 484 aa, Sorghum bicolor
MGSRVAAALLRRGRDQASALLMPRLPRNAPAPAPTPRVGSASSSSCGGGGGGSCLLPPRPGPAGAFSPASRFGSFYAFRSLAPKVMFGQCTRRMSTTAATLNSAAASGAANSGLKLLVTKGPQAQKAVGIWLFGCAAWVFSLVILGGITRLTRSGLSMTDWKFTGEIPPITDDAWQLEFEKYKQSPEYKRVNKGMSLEDFKFIYWMEYAHRMWGRALGFVFAGPFAYFIAKGYVTRQLGLRLSALFALGGAQGLIGWWMVKSGLEEPTSEYVQPRVSPYRLATHLTSAFVIYCGILWTALSVVMPDPPTGSMSWVNGAAKIRKLAIPVSAVVGITAISGAFVAGNDAGHAYNSFPKMGDSWIPEDVFSMEPFIRNFFENTSTVQLNHRILATSTLLSVGGLWLAARKIDMHPAVKSLIGSTLGMAALQVTLGISTLLMYVPTSLGSAHQAGALTLLSLMILLTHTLRRPSPALLKSIATAVKST

SEQ ID NO: 978 - protein, 483 aa, Zea mays
MGSRVAAALIRRGRYLASSLLTPRLPRSALAPAPPHRVGSASSSCGGGGGGSCLLPPRSGPAGAFSYASRFGNFHAFRSLAPKAMFGQCTRRMSTTATALNSTVASGAANSGFKLLVTKGAHVQKAVGIWLFGCAAWVFSLVILGGITRLTRSGLSMTDWKFTGEIPPMTDEAWQLEFEKYKQSPEYKRVNKGMSLEDFKFIYWMEYAHRMWGRALGFVFAGPFAYFIARGYVTRQLGIRLSALFALGGAQGLIGWWMVKSGLEEPTSEYVQPRVSPYRLATHLTSAFIIYCGILWTALSVVMPDPPTGSMSWVNGAAKIRKLAIPVSAVVGITAISGAFVAGNDAGHAYNSFPKMGDSWIPEDVFSMEPFVRNFFENTSTVQLNHRILAATTLLSVGGLWLAARKIDMHPAVKSLIGSTLGMAALQVTLGISTLLTYVPTSLGSAHQAGALTLLSLTILLVHTLRRPSPARLKSIATAVKST

SEQ ID NO: 979 - protein, 483 aa, Hordeum vulgare subsp. vulgare
MMGSRVAASLLRRGRDQGSALMTIPRLPRSGPAPPPAPPRVGSGSFGGGCRHLPPPPPPQSTGGLFAASRAASYHAFRSFGSKSFMGQCTRKMSTTAAALNSNMANATANSALKLLVTKGPQAQKAVGIWLFGCAAWVFSMVILGGVTRLTRSGLSMTDWKFAGGLPPMSEEEWLLEFQKYKQSPEYMRVNKGMNLEDFKFIYWMEYAHRMWGRALGFVFAVPFAYFVAKGYVTRQLGVRLSALFALGGAQGLIGWWMVKSGLEEPASEYVEPRVSPYRLAAHLTSAFVIYCGILWTALSVVMPDPPAESMKWVKGAAKFRKLALPASAVVGITAISGAFVAGNDAGRAYNTFPKMGDSWIPEDVFSMEPFIRNFFENTSTVQLNHRILATSTLLSVSALWLAARKVDMHPAVKSLVGSTLGMAALQVTLGISTLLMYVPTSLGSAHQAGALTLLSLMILLTHTLRRPSPALLKSLASAVKST

SEQ ID NO: 980 - protein, 481 aa, Oryza sativa Indica Group
MGSRVAAALLRRGRDQASSLMAARLPRGAPAPSPAAPRVGSGSVCGCGGGGGLLTGSRSTGSVFSASRLASFHAFRSIGSKTLMGQCTRKMTTTVAAMNSGVANAAAYSGLKLLVTKGPQAQKAIGIWLFGCATWVFGLVILGGVTRLTRSGLSMTDWKFTGSLPPMSDEEWLLEFEKYKLSPEYKRVNKGMSLGDFKFIYWMEYGHRMWGRALGFLFSVPFAYFIAKGYVTRQLGLRLSGLFALGAGQGLIGWWMVKSGLEEPASEYVQPRVSPYRLATHLTSAFVIYCGILWTALSVVMPEPPAGSMNWVNSAAKIKKLAIPVSAVVGITAISGAFVAGNDAGHAYNTFPKMGDTWIPEDVFAMEPFIRNFFENTSTVQLNHRILATTTLLSVGGLWLAARKVDMHPAIKSLIGSTLGMAALQVTLGISTLLMYVPTSLGSAHQAGALTLLSLMILLTHTLRRPSPALLKSLASAVKST

SEQ ID NO: 981 - protein, 482 aa, Oryza sativa Japonica Group
MMGSRVAAALLRRGRDQASSLMAARLPRGAPAPSPAAPRVGSGSVCGCGGGGGLLTGSRSTGSVFSASRLASFHAFRSIGSKTLMGQCTRKMTTTVAAMNSGVANAAAYSGLKLLVTKGPQAQKAIGIWLFGCATWVFGLVILGGVTRLTRSGLSMTDWKFTGSLPPMSDEEWLLEFEKYKLSPEYKRVNKGMSLGDFKFIYWMEYGHRMWGRALGFLFSVPFAYFIAKGYVTRQLGLRLSGLFALGAGQGLIGWWMVKSGLEEPASEYVQPRVSPYRLATHLTSAFVIYCGILWTALSVVMPEPPAGSMNWVNSAAKIKKLAIPVSAVVGITAISGAFVAGNDAGHAYNTFPKMGDTWIPEDVFAMEPFIRNFFENTSTVQLNHRILATTTLLSVGGLWLAARKVDMHPAIKSLIGSTLGMAALQVTLGISTLLMYVPTSLGSAHQAGALTLLSLMILLTHTLRRPSPALLKSLASAVKST

SEQ ID NO: 982 - protein, 224 aa, Coix lacryma-jobi
MGQKINPLGFRLGTTQNHHSFWFAQPKNYSEGLQEDKKIRNCIKNYIKKNRKKGSNRKMESDSSSEVIAHIEIQKEIDTIHVIIHIGFPNLLKKKGAIEELEKDLQKEVNSVNQRLNIAIEKVKEPYRQPNILAEYIAFQLKNRVSFRKAMKKAIELTKKVDIKGIKIQIAGRLAGKEIARAECIKKGRLPLQTIRAKIDYCCYPIRTIYGVLGVKIWIFVEEE

SEQ ID NO: 983 - protein, 224 aa, Zea mays
MGQKINPLGFRLGTTQNHHSFWFAQPKNYSEGLQEDKKIRNCIKNYIQKNRKKGSNRKMESDSSSEVITHIEIQKEIDTIHVIIHIGFPNLLKKKGAIEELEKDLQKEVNSVNQRLNIAIEKVKEPYRQPNILAEYIAFQLKNRVSFRKAMKKAIELTKKADIKGIKIQIAGRLAGKEIARAECIKKGRLPLQTIRAKIDYCCYPIRTIYGVLGVKIWIFVEEE

SEQ ID NO: 984 - protein, 224 aa, Chasmanthium latifolium
MGQKINPLGFRLGTTQNHHSFWFAQPKNYSEGLQEDQKIRNCIKNYIQKNRKKGSNRKIESDPSSEVITHIEIQKEIDTIHVIIHIGFPNLLKKKGAIEELEKDLQKEVNSVNQRLNIAIEKVKEPYRQPNILAEYIAFQLKNRVSFRKAMKKAIELTKKADIKGVKIKIAGRLAGKEIARAECIKKGRLPLQTIRAKIDYCCYPIRTIYGVLGVKIWIFVEEE

SEQ ID NO: 985 - protein, 239 aa, Phyllostachys nigra var. henonis
MGQKINPLGFRLGTTQNHHSFWFAQPKNYSEGLQEDKKIRNCIKNYIQKNRKKGSNRKIESDSSSEVITHNRKMDSGSSSEVITRIEIQKEIDTIHVIIHIGFPNLLKKKGAIEELEKDLQKEVNSVNQRLNIAIEKVKEPYRQPNILAEYIAFQLKNRVSFRKAMKKAIELTKKADIRGVKVKIAGRLAGKEIARAECIKKGRLPLQTIRAKIDYCCYPIRTIYGVLGVKIWIFVDEE

SEQ ID NO: 986 - protein, 239 aa, Dendrocalamus latiflorus
MGQKINPLGFRLGTTQNHHSFWFAQPKNYSEGLQEDKKIRNCIKNYIQKNRKKGSNRKIESDSSSEVITHNRKMDSGSSSEVITHIEIQKEIDTIHVIIHIGFPNLLKKKGAIEELEKDLQKEVNSVNQRLNIAIEKVKEPYRQPNILAEYIAFQLKNRVSFRKAMKKAIELTKKADIRGVKVKIAGRLAGKEIARAECIKKGRLPLQTIRAKIDYCCYPIRTIYGVLGVKIWIFVDEE

SEQ ID NO: 987 - protein, 239 aa, Potamophila parviflora
MGQKINPLGFRLGTTQNHHSFWFAQPKNYSEGLQEDKKIRNCIKNYIQKNRKKGSNRKIESDSSSEVITHNRKMESDSSSEVITHIEIQKEIDTIHVIIHIGFPNLLKKKGAIEELEKDLQKEVNSVNQRLNIGIEKVKEPYRQPSILAEYIAFQLKNRVSFRKAMKKAIELTKKADIKGVKVKIAGRLAGKEIARAECIKKGRLPLQTIRAKIDYCCYPIRTIYGVLGVKIWIFIDEE

SEQ ID NO: 988 - protein, 239 aa, Oryza australiensis
MGQKINPLGFRLGTTQNHHSFWFAQPKNYSEGLQEDKKIRNCIKNYIQKNRKKGSNRKIESDSSFEVITHNKKMDSGSSSEVITHIEIQKEIDTIHVIIHIGFPNLLKKKGAIEELEKDLQKEVNSVNQRLNIGIEKVKEPYRQPNILAEYIAFQLKNRVSFRKAMKKAIELTKKTDIKGVKVKIAGRLAGKEIARAECIKKGRLPLQTIRAKIDYCCYPIRTIYGVLGVKIWIFVDEE

SEQ ID NO: 989 - protein, 239 aa, Oryza sativa Japonica Group
MGQKINPLGFRLGTTQNHHSFWFAQPKNYSEGLQEDKKIRNCIKNYIQKNRKKGSNRKIEADSSFEVITHNKKMDSGSSSEVITHIEIQKEIDTIHVIIHIGFPNLLKKKGAIEELEKDLQKEVNSVNQRLNIGIEKVKEPYRQPNILAEYIAFQLKNRVSFRKAMKKAIELTKKTDIKGVKVKIAGRLAGKEIARAECIKKGRLPLQTIRAKIDYCCYPIRTIYGVLGVKIWIFVDEE

SEQ ID NO: 990 - protein, 239 aa, Bambusa emeiensis
MGQKINPLGFRLGTTQNHHSFWFAQPKNYSEGLQEDKKIRNCIKNYIQKNRKKGSNRKIESDSSSEVITHNRKMDSGSSSEVITHIEIQKEIDTIHVIIHIGFPNLLKKKGAIEELEKDLQKEVNSVNQRLNIAIEKVKEPYRQPSILAEYIAFQLKNRVSFRKAMKKAIELTQKADIRGVKVKIAGRLAGKEIARAECIKKGRLPLQTIRAKIDYCCYPIRTIYGVLGVKIWIFIDEE

SEQ ID NO: 991 - protein, 239 aa, Oryza sativa Japonica Group
MGQKINPLGFRLGTTQNHHSFWFAQPKNYSEGLQEDKKIRNCIKNYIQKNRKKGSNRKIEADSSFEVITHNKKMDSGSSSEVITHIEIQKEIDTIHVIIHIGFPNLLKKKGAIEELEKDLQKEVNSVNQRLNIGIEKVKEPYRQPNILVEYIAFQLKNRVSFRKAMKKAIELTKKTDIKGVKVKIAGRLAGKEIARAECIKKGRLPLQTIRAKIDYCCYPIRTIYGVLGVKIWIFVDEE

SEQ ID NO: 992 - protein, 537 aa, Sorghum bicolor
MAAADLTLLLLLLAPLLAIPLYFLLAATTTTRRRRTPPRGSKPRLPPGPWALPVIGHLHHLARPWGPGGRRLPHRVMRDLARRHGPLMLLRFGEVPVVVASSAAAAREVMRTHDAAFASRPIGPMSRLWFQGADGIIFAPYGDDWRSLRRVCTQELLTARRVQSFRPVREDELRRLLASVAAAAAAASSGTGTTVVNLTEKISTYIADSTVRAIIGSRRLKDRDAYLRMLKGLFGIMPGMSLPDLFPSSRLAMLLSRAPARIQAYRRSMRRIMDGIIDEHRDRAAAAAADGGADDEDEDEDFVDVLLRLQKEVDSQFPLTTENIKTVMLDIFGASTETSTTTLGWAMAELLRNPRVMAKAQHEVRQAFAGHDTVTEDSLAGLRYLRLVIKESLRLHPPATMLVPRQCQSACQVLGFDVPAGTTVIVNAWAIGRDPAHWDEPDEFLPERFEQSGSRDFRGADFEFIPFGAGRRICPGMTFGLAHIELALAALLFHFDWSLPGGLAAEELDMTEAFGIAVPRRSDLLVVPIPRVPLPTK

SEQ ID NO: 993 - protein, 505 aa, Zea mays
MAADPTLLLLVPFLAIPLYFFLATRRRTPRGGARLPPGPWALPVVGHLHHLARGLPHRVMRDLARRHGPLMMLRFGEVPVVVASSPAAAREVMRTHDAAFASRPIGPVSRLWFQGAEGILFAPYGDDWRHLRRVCTQELLTARRVQSFRPVREDELRRLLASVASTSGPVNLTEKISTYIADSTVRAIIGSRRLKDRDAYLRMLKGLFGIMPGMSLPDLFPSSRLAMLLSRAPARIQAYRRSMRRIMDGIIQEHRDRAAAGDGDEEDFVDVLLRLQKEVDSQFPLTTENIKTVMLDIFGASTETSTTTLDWAMAELLRNPRVMEKAQREVRQALSGHGAVTEDRLAGLRYLRFVIKESLRLHPPATMLVPRQCQSACQVLGYDVPAGITVIVNAWAIGRDPAHWDEPDKFLPERFEQSTRDFKGADFEFIPFGAGRRICPGMTFGLAHIEIALAALLFHFDWSLPGGLAAEELDMTEAFGIATPRRSDLLVVATPRVPLPQSYRI

SEQ ID NO: 994 - protein, 446 aa, Zea mays
MRDLARRHGPLMMLRFGEVPVVVASSPAAAREVMRTHDAAFASRPIGPVSRLWFQGAEGILFAPYGDDWRHLRRVCTQELLTARRVQSFRPVREDELRRLLASVASTSGPVNLTEKISTYIADSTVRAIIGSRRLKDRDAYLRMLKGLFGIMPGMSLPDLFPSSRLAMLLSRAPARIQAYRRSMRRIMDGIIQEHRDRAAAGDGDEEDFVDVLLRLQKEVDSQFPLTTENIKTVMLDIFGASTETSTTTLDWAMAELLRNPRVMEKAQREVRQALSGHGAVTEDRLAGLRYLRFVIKESLRLHPPATMLVPRQCQSACQVLGYDVPAGITVIVNAWAIGRDPAHWDEPDKFLPERFEQSTRDFKGADFEFIPFGAGRRICPGMTFGLAHIEIALAALLFHFDWSLPGGLAAEELDMTEAFGIATPRRSDLLVVATPRVPLPQSYRI

SEQ ID NO: 995 - protein, 505 aa, Zea mays; identical to SEQ ID NO: 993

SEQ ID NO: 996 - protein, 446 aa, Zea mays; identical to SEQ ID NO: 994

SEQ ID NO: 997 - protein, 537 aa, Sorghum bicolor; identical to SEQ ID NO: 992

SEQ ID NO: 998 - protein, 222 aa, Sorghum bicolor
MAAAAAARRLLSRRASSSSLSALLRRGAAAEQPLLLRPAVVAAASRLGFPRGMARRPGGDGFGPTRPGAGGDRAPSDMAPLFPGCDYEHWLIVMDKPGGEGANKQQMIDCYIQTLAKVLGSEEEAKRKIYNVSCERYFGFGCEIDEETSNKLEGLPGVLFVLPDSYVDPEYKDYGAELFVNGEIVQRPPERQRRVEPVPQRSADRPRYNDRTRYARRRENQR

SEQ ID NO: 999 - protein, 223 aa, Zea mays
MAAAAARRLLSRRASSSSLSALLRRGAVPEQSLVLRPAVVAAASRLGFQRGMARRPGGDGYVSTRSGAGGDRAPMATEMAPLFPGCDYEHWLIVMDKPGGEGASKQQMIDCYIQTLAKVLGSEEEAKKKIYNVSCERYFGFGCEIDEETSNKLEGLPGVLFVLPDSYVDAEYKDYGAELFVNGEIVQRTPERQRRVEPVPQRAADRPRYNDRTRYARRRENQR

SEQ ID NO: 1000 - protein, 227 aa, Oryza sativa Japonica Group
MAAAAAAAARRLLSRRATSFSASALLRRGGPGAPESLLRPTVAAVSRVGFLRGFARRPGGDGYSPMRSGGGGGGGGDRAPTEMAPLFPGCDYEHWLIVMDKPGGEGATKQQMIDCYIQTLAKVLGSEEEAKKKIYNVSCERYFGFGCEIDEETSNKLEGLPGVLFVLPDSYVDPEYKDYGAELFVNGEIVQRSPERQRRVEPVPQRASDRPRYNDRTRYARRRENQR

SEQ ID NO: 1001 - protein, 244 aa, Hordeum vulgare subsp. vulgare
MAAAAAAMARRILSPSSTSAARLLISRRISSAPSFPRAPAAAAKEMLRPAAVASSSFLLLRGVGGARGMARRPGGDGYSPARGGGGGGGDRAPTEMAPLFPGCDYEHWLIVMDKPGGEGASKHQMIDCYIQTLAKVLGSEEEAKKKIYNVSCERYFGFGCEIDEETSNKLEGIPGVLFVLPDSYVDPEHKDYGAELFVNGEIVQRSPERQRRVEPVPQRASDRPRYNDRTRYARRRENQQQPQR

SEQ ID NO: 1002 - protein, 236 aa, Hordeum vulgare subsp. vulgare
MAAAAAAAGARRLLARRASSSPVSISALLRRGGGAAAAAAPHEPLLRPAALAAVASRLGFLRGMARRPGGDGYSPARSGGGGGGDRAPTEMAPLFPGCDYEHWLIVMDKPGGEGATKQQMIDCYIQTLAKVLGSEEEARKKIYNVSCERYFGFGCEIDEETSNKLEGIPGVLFVLPDSYVDPEHKDYGAELFVNGEIVQRSPERQRRVEPVPQRASDRPRYNDRTRYQRRRENQQR

SEQ ID NO: 1003 - protein, 165 aa, Oryza sativa Japonica Group
MAAAAAAAARRLLSRRAPTEMAPLFPGCDYEHWLIVMDKPGGEGATKQQMIDCYIQTLAKVLGSEEEAKKKIYNVSCERYFGFGCEIDEETSNKLEGLPGVLFVLPDSYVDPEYKDYGAELFVNGEIVQRSPERQRRVEPVPQRASDRPRYNDRTRYARRRENQR

SEQ ID NO: 1004 - protein, 748 aa, Zea mays
MLSSSASRRDAARSGAELPRPHAVAGMARSGELPKGAPSATAPDAVRCEGWMVRHGRRKIGRSFFHTRYFVLDNGVLAYYKKKPRDHMIPLKSIIIDGNCRVEDRGLKTHHGQMIYLLCIYNKKEKENQITMGGYDIEDALAWKRKIELLIDQQQDTTTAKNHKAFASLDFDIDLGGPFSFSDHDSGPEDEEEPRPTLLRRTTIGNGPPDSVLDWTKEADSGLSNQNATSQAYSRKNWRLLRCQNGLRIFEELVEVEYLARSYSRAMRAVGVVEASCEAIFGLVMSMDASRYEWDCSFQYGSLVEEVDGHTAILYHRLQLNWFSMLVWPRDLCYVRYWRRNDDGSYVVLFRSTENQNCGPQPGFVRASIESGGFKISPLKSLNGRPRTQVQHLMQIDVRGWGVNYLPSFQYYSLLQMLNCVAGLREYFSQTDEIHTVPRIPVMHTMVNAASMKKDQNLQEPDSKTKQADNKHLDMVDEESEDDDDYQVPDADVEEEPTKSDSDAKNSDPIDLSWFSGIIRQDTNEKSRNCWAVPDSKIFKVRSKNFPHDKSKVPAGKYLMELVAVDWFKDAKRMDHVARRKGSAVQVAAEKGMFTFLVNIQIPGPSHYSLVLYFVSNSLKKGSLLQRFADGDDDFRNSRLKLIPSVPKGSWIVRQSVGSTPCLLGKAVDCSYLRGPDYLEVDVDIGSSAVANGVLGLVFGVVTTLVVDMAFLIQANTYDELPEQLLGAARLSHIEPSAAVYPVLDNIS

SEQ ID NO: 1005 - protein, 689 aa, Sorghum bicolor
MARSEELPKGGCAGPTPAAVRHEGWMVRHGRRKIGRSFFHTRYFVLDNRVLAYYKKQPRDSMIPLKSIVIDGNCRVEDRGLKTHHGQMIYLLCIYNKKEKENQITMGGYNIQDTLAWKRKIELLIDQQQDTTTAKHRKAFASLDFDIDLGGPFSFSDHDSGQVKPEDEDDEEEEPRPTLLRRTTIGNGLRIFEELVEVEYLARSCSRAMRAVGVVEASCEAIFGLVMSMDVTRYEWDCSFQYGSLVEEVDGHTAILYHRLQLNWCSMLVWPRDLCYLRYWRRNDDGSYVVLFRSTEHQNCGPQPGFVRASIESGGFKISPLKSLNGRPRTQVQHLMQIDVRGWGVNYLPSFQYHSLLQMLNCVAGLREYFSQTDEVHTVPRIPVMHTMFNAVSMKKDQNLQEPDSKTKQTDSKHLDMVDEESEDDDDYQAPEADLEEEPTKSDSDAKSSDPIDLSWFSGTIRQDTNEKSRNCWAVPDSKIFKVRSKTFPHDKSKVPAGKYLMELVAIDWFKDTKRMDHVARRKGSAAQVAADKGMFTFLVNIQIPGPSHYSLVLYFVSNSLEKGSLLQRFADGDDDFRNSRLKLIPSVPKGSWIVRQSVGSTPCLLGKAVDCSYLRGPDYLEVDVDIGSSAVANGVLGLVFGVVTTLVVDMAFLIQANTYDELPEQLLGAARLSHIEPSAAVCPDLENI

SEQ ID NO: 1006 - protein, 719 aa, Oryza sativa Indica Group
MARSGELPKVSAAATAAVRHEGWMLRYGRRKIGRSFVRTRYFVLDNKLLAYYKKQPKDNMVPVKALQIDGNCRVEDRGLKTHHGQMVYVLCIYNKKEKENHITMGAHDIEDALVWKKKLELLIDQQQDTMTAKNRKAFASLDFDMEFGGPLSFSDRDNEEEPRPTLLRRTTIGNGPPDSVHDWTKEPDIGLSDQNDTNHAYSRKNWRLLRCQNGLRIFEELVEVEYLARSCSRAMRAVGVVEATCESIFGLIMSMDVTRYEWDCSFQYGSLVEEVDGHTAILYHRLQLNWFSMLVWPRDLCYVRYWRRNDDGSYVVLFRSTEHQNCGPQPGFVRAFIESGGFKISPLKCVNGRPRTQVQHLMQIDLKGWGVNYFSSFQYYSLLQMLNCVAGLREYFSQTDDIHPVPRIPVMSTMATVSKLKKDKKLQETDLKTKQADFGQVDNKNLDMIDEESEEDDDYQVPEANLEEAPTRSDSDAKYTDPIDLSCFSGIIRRDANEKSRNCWTVPDSKLFKVRSESFPHDKSKVPATKYLMELVAIDWLRDIKRMDHVARRKGCAAQVAAEKGMFTFVVNIQIPGSSHYSLVLYFVTRTLEKGSLLQRFADGDDDFRNSRLKLIPSVPKGSWIVRQSVGSTPCLLGKAVDCSYMRGQEYIEVDVDIGSSAVANGVLGLVFGVVTTLIVDMAFLIQANTYDELPEQLLGAARLSNIEPSSAIVPVLDK

SEQ ID NO: 1007 - protein, 699 aa, Oryza sativa Japonica Group
MARSGELPKVSAAATAAVRHEGWMLRYGRRKIGRSFVRTRYFVLDNKLLAYYKKQPKDNMVPVKALQIDGNCRVEDRGLKTHHGQMVYVLCIYNKKEKENHITMGAHDIEDALVWKKKLELLIDQQQDTMTAKNRKAFASLDFDMEFGGPLSFSDRDSPPDSVHDWTKEPDIGLSDQNDTNHAYSRKNWRLLRCQNGLRIFEELVEVEYLARSCSRAMRAVGVVEATCESIFGLIMSMDVTRYEWDCSFQYGSLVEEVDGHTAILYHRLQLNWLVWPRDLCYVRYWRRNDDGSYVVLFRSTEHQNCGPQPGFVRAFIESGGFKISPLKCVNGRPRTQVQHLMQIDLKGWGVNYFSSFQYYSLLQMLNCVAGLREYFSQTDDIHPVPRIPVMSTMATVSKLKKDKKLQETDLKTKQADFGQVDNKNLDMIDEESEEDDDYQVPEANLEEAPTRSDSDAKYTDPIDLSCFSGIIRRDANEKSRNCWTVPDSKLFKVRSESFPHDKSKVPATKYLMELVAIDWLRDIKRMDHVARRKGCAAQVAAEKGMFTFVVNIQIPGSSHYSLVLYFVTRTLEKGSLLQRFADGDDDFRNSRLKLIPSVPKGSWIVRQSVGSTPCLLGKAVDCSYMRGQEYIEVDVDIGSSAVANGVLGLVFGVVTTLIVDMAFLIQANTYDELPEQLLGAARLSNIEPSSAIVPVLDK

SEQ ID NO: 1008 - protein, 804 aa, Oryza sativa Japonica Group
MMLSSSASRREVGGGGAASSTKSGELSLSKVASVAIRESSGSGSGGISKSSELLSRAGTMAAAREAAAAAVHHEGWMVRYGRRKIGRSFFHTRYFVLDSRLLAYYKKKPKDNMVPLKSLLIDGNCRVEDRGLKTHHGQMVYVLCVYNKKEKEHQITMGAYDIEDALAWKKNIELIIDQQENMTSKNRKAFASMDFDTELGGQFIFSDHDSAAEDEEERPMLIRRTTIGNGPPESIHDWTKEHDIGPPNQIDPIQVSSKKNWRLLRCQNGLRIFEELLEFDYLARSCSRAMRAVGVVEATCEAIFGLVMSMDVTRYEWDCSFRYGSLVEEVDGHTAILYHKLQLHWCPMLVWPRDLCYVRYWRRNDDGSYVVLFRSTEHPNCGRQKGYVRAFIESGGFKISPLKCRNGRPRTQVQHLMQIDLRGWLLNYSPSFQYHSLLQIQNCVAGLREYFSQTDETHITPRIPVMENMVDTSAVQKDDKKSTEEVDSKTKTPDRGQADSKNMGIIDEETDEDEDYQVPEANIEEDPNKDAKRADEPPEKIDLSCFSGILRCDADEKSRNCWTVPDSKLFKVRSKNFPHDKSKIPAASYLMELAAIDWFKDSKRMDNVGRQKGCVAQVAAEKGMHTFVANIQIPGSTHYSLVMYFVTKSLKKGSLLQRFFDGDDEFRNSRLKLIPSVPKGSWIVRQSVGSTPCLLGKAVDCSYVRGAGYLEVDVDIGSSAVANGVLGLVFGVVTTLVVDMAFLIQANTYEELPEQVIGAARLAHVEPAAAIVPQDLTPPPPALADDDNAAASSSEDDHLSKKTN

SEQ ID NO: 1009 - protein, 327 aa, Zea mays
MPRPPTMVIQDDYIDMDLTPAATPEPSPASPRFEFQSAGAGAAGDRHREAAFASPADELFYKGNLLPLHLPPRLQLVQRLLQDQEQPPPLRGAKRDAESDATAAAAAERGDADAAAAASKVCAAKKPSWAKKLKVVKRWASKEYIRSLFLARPPLPSDIVAAAGGASASGHGIGSVSARGSVLEQEEVCQCQHRKSFSGIIRRVRLVATKAPGTSPLCSSSSSSSSSSTPSCRNANGFFFRTPASAAGATPALKRSSSAGSSEEGAIQGAIAHCKRSQLLQPGMVASAAARRSVSDVMFYSVTNTPRASSVTAGEVAQERRQEMCRG

SEQ ID NO: 1010 - protein, 335 aa, Sorghum bicolor
MARPPPTMVIQDDYIDMDLTPSVPPPSSPRFEFQSAGAAGADARHREAAFASPADELFYKGNLLPLHLPPRLQLVQRLLQDQEQPPPLRGAKRDAESDPAAATESGDSDADAAAAAAGGKACAAKTKPSWAKKLKVVKRWASREYIRSLFLARPPLPSDIVAGVGAGAGASASGHGIGSVSARGSVLEQEEACQCHHRKSFSGIIRRVRLVATSNKVPGTSPLCSSSSSSSSSTPSCGNANGFFFRTAAASAGTATPALKRSSSAGSSEEGAIQGAIAHCKRSQLLQPGMVVSSAAAARRSVSDVMFYSVTNTPRASSVAAGEVAQERRQEMCRG

SEQ ID NO: 1011 - protein, 284 aa, Zea mays
MRCKKHPYQVGGGGVCATCLRDRLIALEAAQNGDASSSPPPPAAAPAFPRSVSPYVSRRKSDTSGGGGALRHHPSLLFFRTPQVGPAYGGGALEEGDIGYEYKRRRAGKFSVLATLFGHHHGHRSEETHQEGATERKKHSWFAAIMPRRRKKQAAPASITSPRSAPPRRSCRVVSNRGLSPERDSHGSGDESSSPAADPPWRPSPSPMRRTRCRRRQTNSMPSGFAVCLSPLVRPSPGRRRHVQPPDPGSFSSEFRPSPLHSLSSAASVTRCRSRKLADVGRFR

SEQ ID NO: 1012 - protein, 283 aa, Zea mays
MRCKKHPYQVGGGGVCATCLRDRLIALEAAQNGDASSSPPPAAAPVFPRSVSPYVSRRKSDTSGGGGALRHHPSLLFFRTPQVGPAYGGGALEEGDIGYEYKRRRAGKFSVLATLFGHHHGHRSEETHQEGATERKKHSWFAAIMPRRRKKQAAPASITSPRSAPPRRSCRVVSNRGLSPERDSHGSGDESSSPAADPPWRPSPSPMRRTRCRRRQTNSMPSGFAVCLSPLVRPSPGRRRHVQPPDPGSFSSEFRPSPLHSLSSAASVTRCRSRKLADVGRFR

SEQ ID NO: 1013 - protein, 307 aa, Sorghum bicolor
MRCKKHPYQAGGGVCATCLCDRLLTLEAAQNGDASSPPHAQAPPVPPAEPLAFPRSVSPYVSRRKSDTAGALRHHPSLLFFRTPQVGPAYGGGAGGALEEGDIAYEYEKRRARKFSVLATLFGHHHHHHHHRSEEKHHHQQEGAPKERKKRSWTWFAGIIPRRRKKQSAAAAAAVSATSPQSAPPRRSSCRAVSNRGLSPERDSHGGSGDESSSPAAADHPPWRPSPSPMRRTPCRRRQTNSMPSGFAVCLSPLVRPSPGRRHRHVQPPDPGSFSCELRPSPLHSLSSAASVTRCRSRKLADCGRFR

SEQ ID NO: 1014 - protein, 290 aa, Oryza sativa Japonica Group
MGMRCKKHPYQAGGGVCATCLNDRLLALAAAQNGASSSPPPPAAPPAAAAPAFPRSVSPYVSRRKSDSSGGGALKHHPSLLFFRTPQVGPAYGSSGGLEEGDIGYEKRRAGKFSVIATLFGHHHHHHRSEEKDKGGDNRESRNRSWLAGFMPRRRKKQPPAPAAAAAASSPPPRRSCRVVSNRGLSPERDCDGSDEESSSPTDPPWQPSPSPMRRTPCRRRQTSTMPSGFAVCLSPLVRPSPGRRHRHAHPPDPGTFSCELRPSPLHNLSSAASITRCRSRKLADGGRFR

SEQ ID NO: 1015 - protein, 401 aa, Sorghum bicolor
MGCFLGCFGGAKERRRRRKRSPSQSPNGRARAVPRVSPKKVDLDGEAASAAAPLLATLLELRDSTDDMCLAVVKKKVTFDPNVTTFEAAPIPEDDGEGADPEDGEDSREKGWMLTPDCAKSEAFPLNHRYSNCAGIESDSDYEDAEEDEFEDYDDDDDEEEEEGEDGLDECAIDDDDDEHGLLGIGRSEEDACESLFLLPFGKTSKDSGGQVAAPVVPPAESPSVLSSVENLNLTRWKESKPRAAAAPKSSDKENVTVGQENRMALLAEPPAAAKRKEERPAVSDYSYTPRTPSKQEASVDASLSTWLGSSGTPESNSVRSYSPISREERPILGALTVEDIKISSANSTPRRSRSPSPSPDDMPILGTVGAYWNCSAKEADPVTRGGFMRTRTRFGQNFAG

SEQ ID NO: 1016 - protein, 397 aa, Zea mays
MGCFLGCFGGAKERRRRRRKRSPSQSPNGRARALLRVTPNKVDLDGEAVSAAAPLLATLLELRDSTDDMCLALVKKKVTFDPNVTTFEAAPIPEDDGEEADPEDGGDSREKGWMLASECAKSEAFPLNHRYSKLAGSGNVSDYEDAEEDEFEDEEEEDDDDEEDEEGEDGLDECAIDDDEDEHGLLGIGRSEEDACESLFLFPFGKMSRDSGGQVAAPVAPPVLGSVENFNLTRWKEPMAAAAPKTSDKENVTVGRENRMDFLAEPPAVAANRKEEQMPAVSDNRYTPSTPSKQEASVDASLSTWLGSSGTPESNSVRSYSPISRDERPILGALTVEDIKVSSANSTPRRSRSPSPSPDDMPILGTVGAYWNCSAKESDPVTRGGFMRTRTRFGQVR

SEQ ID NO: 1017 - protein, 403 aa, Zea mays
MGCFLGCFGGAKERRRRRRKRSPSQSPNGRARALPRVTPNKVDLDGEAVSAAAPLLATLLELRDSTDEMCLALVKKKVTFDPNVTTFEAAPIPEDDGEEADPEDGGDSSEKGWMQASECTKSEAFPLNHRYSKFAGSGNVSDYEDAEEDEFEDEEEEEDDDYEDEEGEDGLDECRIDDDEDEHGLLGIGRSEEDACESLFLFPFGKMSRDSGGQVAAPVAPPAEAPAVLGSVESLNLTRWKEPKPRGAAAPKSSDKENVTVGRENRMDFLAEPPAVAAKGKEERPAVSDNSYTPSTPSKQEASVDASLSTWLGSSGTPESNSVRSYSPISRDERPILGALTVEDMKVSSANSTPRRSRSPSPSPDDMPILGTVGAYWNCSAKESDPVTRGGFMRTRTRFCQVR

SEQ ID NO: 1018 - protein, 399 aa, Zea mays
MGCFLGCFGGAKERRRRRKRSPSQSPNGRARAVPRVTPKKVDVDGEAAASAAAPLLATLLELRDSTDGMCLAVVKKKVTFDPNVTTFEAAPIPEDDGEGTDPEDGGASREKGWMLVPECAKSEAFPLNHRYSNCAGSDTDSDYEDAEEDEFEGDEDDEEEDEDGIDECAIDGDEDEDEHGLLGIGRSEEDACESLFLLPFGKTSKDSFGQVVAPAVPPAAEAPAVLGSVENLNLARWKEPKPRAAAALKSSDKENVTVGQENRMDDLLAEPPAAKRKEERPAVSGYTPSTPSKQEASVDASLSTWLGSSGTPESNSVRSYSPISREDRPILGDLTVEDIKISSASSTPRRSRSPSPSPDDMPILGTVGAYWNCSAKEADPVTRGGFMRTRTRFGQGFAG

SEQ ID NO: 1019 - protein, 400 aa, Zea mays
MGCFLGCFGGAKERRRRRKRSPSQSPNGRARAVPRVTPKKVDVDGEAAASAAAPLLATLLELRDSTDGMCLAVVKKKVTFDPNVTTFEAAPIPEDDGEGADPEDGGGASREKGWMLVPECAKSEAFPLNHRYSNCAGSDTDSDYEDAEEDEFEGDEDDEEEDEDGIDECAIDGDEDEDEHGLLGIGRSEEDACESLFLLPFGKTSKDSFGQVVAPVVPPAAEAPAVLGSVENLNLARWKEPKPRAAAALKPSDKENVTVGQENRMDDLLAELPAAKRKEERPAVSGYTPSTPSKQEASVDASLSTWLGSSGTPESNSVRSYSPISREDRPILGALTVEDIKISSASSTPRRSRSPSPSPDDMPILGTVGAYWNCSAKEADPVTRGGFMRTRTRFGQGFAG

SEQ ID NO: 1020 - protein, 406 aa, Oryza sativa Japonica Group
MGCFLGCFGGAKERRRRRKRSPAHSPSGRARATPRLSPKKAAAAAALDGDVVSAAAPLLATLLELRDSTDDLCLTVIKKKVTFDPNVTTYEAAAIPEAEEEDDEEAEPAAGDDKDEARWMLAPDCAKSEAFPLNHRYSNCAYGDNDSEYDEDEDEDEEEDEDEEEEADGLDECAIDDEDDDGLLGIGRGEDEACESLFLLPMSKTKESGGGHEAASGVTSPEAPPAPQQTRDANPVLSSVENLTQWKDAKARAATATAAPNASDKENRTTANLLPEPAIPAKKREWQVVCSDYSPSTPSKQEVSVDASLSTWLGSSGTPESNSVRSFSPISREDRPILGALTVEDIKISSANSSPRRSRSPSPSPDDMPILGTVGAYWNCSSKAGDPVTRGGFMRTRTRFGQNFAG

SEQ ID NO: 1021 - protein, 409 aa, Oryza sativa Japonica Group
MGCFLGCFGGAKERRRRRKRSPAHSPSGRARATPRLSPKKAAAAAALDGDVVSAAAPLLATLLELRDSTDDLCLTVIKKKVTFDPNVTTYEAAAIPEAEEEDDEEAEPAAGDDKDEARWMLAPDCAKSEAFPLNHRYSNCAYGDNDSEYDEDEDEDEEEDEDEEEEADGLDECAIDDEDDDGLLGIGRGEDEACESLFLLPMSKTKESGGGHEAASGVTSPEAPPAPQQTRDANPVLSSVENLTQWKDAKARAATATAAPNASDKENRTTANLLPEPAIPAKKREWQVVCSDYSPSTPSKQEVSVDASLSTWLGSSGTPESNSVRSFSPISREDRPILGALTVEDIKISSANSSPRRSRSPSPSPDDMPILGTVGAYWNCSSKAGDPVTRGGFMRTRTRFGQDEVVNCY

SEQ ID NO: 1022 - protein, 408 aa, Oryza sativa Indica Group
MGCFLGCFGGAKERRRRRKRSPAHSPSGRARATPRLSPKKAAAAAALDGDVVSAAAPLLATLLELRDSTDDLCLTVIKKKVTFDPNVTTYEAAAIPEAEEEDDEEAEPAAGDDKDEARWMLAPDCAKSEAFPLNHRYSNCAYGDNDSEYDEDEDEEEEEDEDEEEEADGLDECAIDDEDDDGLLGIGRGEDEACESLFLLPMSKTKESGGGHEAASGVTSPEAPPAPQQTRDANPVLSSVENLTQWKDAKARAATATAAPNASDKENRTTANLLPEPAIPAKKREWQVVCSDYSPSTPSKQEVSVDASLSTWLGSSGTPESNSVRSFSPISREDRPILGALTVEDIKISSANSSPRRSRSPSPSPDDMPILGTVGAYWNCSSKADPVTRGGFMRTRTRFGQDEVVNCY

SEQ ID NO: 1023 - protein, 227 aa, Zea mays
MEQEEACTSSLRQCRICHDEEDERRSAMESPCACSGSLKYAHRGCVQRWCDEKGSAVCEICLQNFEPGYTVPPKKTQPADVAVTIRDSVGVPRPQHEPEEEEQEQVDAALIGGSDPEYAECARAAGRSASWCRSVAVTFTVVLLLRHLVTVVTVGAANQFAFGLLTVYLLRASGILLPFYLVMRLISVIQQGQRQYRLRLLQEQRRHALRSARLHGQEQEQHVILVR

SEQ ID NO: 1024 - protein, 220 aa, Oryza sativa Japonica Group
MERDEVCCSCAMRQCRICHEEEEEGCTAMESPCGCSGSLKYAHRGCVQRWCDEKGSTLCEICLQNFEPGYTAPPKKAQPAHVAVTIRESLEVPRPSYEPEDTPLIGEQDYAECAGAAGRSATWCRSVAVTFTAVLLLRHLVAVVTVGAAHQYAFSLLTIYLLRASGILLPFYVVMRLISTVQKGQRQYQLQLLQEQRRNAARMHRLHGQEEQNQHAILVR

SEQ ID NO: 1025 - protein, 574 aa, Sorghum bicolor
MGGGGAIVHGFRRWFHRRNGSTSGSNQSSVAGEGDDGSSDLEVIEDPDLVALRAIRVPKRKMPLPVESHRKNSVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIKANDDLTPEHHQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDLITDLLGTPSSETLSRIRNEKARRYLSCMRKKYPVPFTHKFRNADPLALRLLERLLAFDPKDRPTAEEALADPYFASLANVEREPSRHPISKLEFEFERRKLAKDDVRELIYREILEYHPQMLEEYMKGGEQISFLYPSGVDRFKRQFAHLEEHYSKGERGSPLQRKHASLPRERVVVSKDGNTEQHINDQERSADSVARTTVSPPRSEDADMNDVKSTSLSSRSYLKSASISASKCVVVKNKHPEDDEIPEEMEGVVDGLSEQVSRMHS

SEQ ID NO: 1026 - protein, 579 aa, Zea mays
MGGGGAIVHGFRRWFHRRSEGSTSNSNQSSLAGEGEADDGSSDLEVIEDPDLLGLRAIRVPKRKMPLPVESHRKNSVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIRANDDLTPEHHQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKYPVPFTHKFRHADPLALRLLERLLAFDPKDRPSAEEALADPYFASLANVEREPSRHPISKLEFEFERKKLAKDDVRELIYREILEYHPQMLEEYMKGGEQISFLYPSGVDRFKLQFAHLEEHYSKGERGSPLQRKHASLPRERVVVSKDGNTEQQINDQERSADSVARTTVSPPRSEDADMDDVKPTSLSSRSYLKSASISASKCVVVRNKHPEPEDDGIPEEMEGTVDGLSEKVSRMHS

SEQ ID NO: 1027 - protein, 579 aa, Zea mays
MGGGGAIVHGFRRWFHRRSEGSTSNSNQPSLAGEGEADDGSSDLEVIEDPDLLGLRAIRVPKRKMPLPVESHRKNSVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIRANDDLTPEHHQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKYPVPFTHKFRHADPLALRLLERLLAFDPKDRPSAEEALADPYFASLANVEREPSRHPISKLEFEFERKKLAKDDVRELIYREILEYHPQMLEEYMKGGEQISFLYPSGVDRFKLQFAHLEEHYSKGERGSPLQRKHASLPRERVVVSKDGNTEQQINDQERSADSVARTTVSPPRSEDADMDDVKPTSLSSRSYLKSASISASKCVVVRNKHPEPEDDGIPEEMEGTVDGLSEKVSRMHS

SEQ ID NO: 1028 - protein, 576 aa, Zea mays
MGGGGAIVHGFRRWFHRRSGSTSNQSSIAGDGEGEADGGSPDLEIVDDPDLLGLRAIRVPKRKMPLPVESHRKDSVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIKANDDLTPEHHQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKYPVPFTHKFRNADPLALRLLERLLAFDPKDRPTAEEALADPYFASLANVEREPSRHPISKLEFEFERRKLAKDDVRELIYREILEYHPQMLEEHMQGGEQISFLYPSGVDRFKRQFAHLEEHYSKGERGSPLQRKHASLPRERVVVSKDGDTDQHINDQERSADSVARTTVSPPRSEDDDMSDVKSTSLSSRSYLKSASISASKCVVATKKHPEDDGIAEEMEGAVNGLSEKVSRMHS

SEQ ID NO: 1029 - protein, 580 aa, Oryza sativa Indica Group
MGGGGTLVDGFRRLFHRRTASGSNQSSNAGEEAASSDLEVADDPDLVALRSIRIRVPKRKMPLPVESHKKNTVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIRANDDLTPEHYQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDIITDLLGTPSSETLSRIRNEKARRYLSTMRKKHAVPFSQKFRNTDPLALRLLERLLAFDPKDRPSAEEALADPYFASLANVEREPSRHPISKLEFEFERRKLTKDDVRELIYREILEYHPQMLQEYMKGGEQISFLYPSGVDRFKRQFAHLEENYSKGERGSPLQRKHASLPRERVGVSKDGYNQQNTNDQERSADSVARTTVSPPMSQDAQQHGSAGQNGVTSTDLSSRSYLKSASISASKCVAVKDNKEPEDDYISEEMEGSVDGLSEQVSRMHS

SEQ ID NO: 1030 - protein, 580 aa, Oryza sativa Japonica Group
MGGGGTLVDGFRRLFHRRTASGSNQSSNAGEEAASSDLEVADDPDLVALRSIRIRVPKRKMPLPVESHKKNTVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIRANDDLTPEHYQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDIITDLLGTPSSETLSRIRNEKARRYLSTMRKKHAVPFSQKFRNTDPLALRLLERLLAFDPKDRSSAEEALADPYFASLANVEREPSRHPISKLEFEFERRKLTKDDVRELIYREILEYHPQMLQEYMKGGEQISFLYPSGVDRFKRQFAHLEENYSKGERGSPLQRKHASLPRERVGVSKDGYNQQNTNDQERSADSVARTTVSPPMSQDAQQHGSAGQNGVTSTDLSSRSYLKSASISASKCVAVKDNKEPEDDYISEEMEGSVDGLSEQVSRMHS

SEQ ID NO: 1031 - protein, 578 aa, Triticum aestivum
MGGGNGIVDGFRRLFHRRTPSGSVLGSSNQSSAGEDSSDVEAAEGLDLVGLRSIRVPKRKMPLPVESHKKNIMEKEFFTEYGEASQYQIQEVVGKGSYGVVAAAIDTRTGERVAIKKINDVFEHVSDATRILREVKLLRLLRHPDVVEIKHIMLPPSRREFQDIYVVFELMESDLHQVIRANDDLTAEHYQFFLYQLLRALKYIHGANVFHRDLKPKNILANADCKLKICDFGLARVSFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKHPVPLTQKFPNADPLAVRLLGRLLAFDPKDRPSAEEALADPYFASLANVEREPSRHPISKLEFEFERRKVTKDDVRELIYREILEYHPQMLEEYMKGGDQISFLYPSGVDRFKRQFAHLEEHYSKGERGSPLQRKHASLPRQRVGASNDGNNEQHISDQEMSAEPDAHGTVSPQKSQDAAGVGQNGLSPTSLSSRTYLKSASISASKCVVVNPNKQPEYDDAISEETEGAVDGLSEKVSKMHA

SEQ ID NO: 1032 - protein, 578 aa, Triticum aestivum
MGGGNGIVDGFRRLFHRRTPSGSVLGSSNQSSAGEDSSDAEAAEDLDLVGLRPIRVPKRKMPLPVESHKKNIMEKEFFTEYGEASQYQIQEVVGKGSYGVVAAAIDTRTGERVAIKKINDVFEHVSDATRILREVKLLRLLRHPDVVEIKHIMLPPSRREFQDIYVVFELMESDLHQVIRANDDLTAEHYQFFLYQLLRALKYIHGANVFHRDLKPKNILANADCKLKICDFGLARVSFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKHPVPLTQKFPNADPLAVRLLGRLLAFDPKDRPSAEEALADPYFASLANVEREPSRHPISKLEFEFERRKVTKDDVRELIYREILEYHPQMLEEYMKGGDQISFLYPSGVDRFKRQFAHLEEHYSKGERGSPLQRKHASLPRQRVGASNDGNNEQHISDQEMSAEPDAHGAVSPQKSQDAPGVGQNGLSPTSLSSRTYLKSASISASKCVVVNPNKQPEYDDAISEETEGAVDGLSEKVSKMHA

SEQ ID NO: 1033 - protein, 578 aa, Triticum aestivum
MGGGNGIVDGFRRLFHRRTPSGSVLGSSNQSSAGEDSSDVEAAEGLDLVGLRSIRVPKRKMPLPVESHKKNIMEKEFFTEYGEASQYQIQEVVGKGSYGVVAAAIDTRTGERVAIKKINDVFEHVSDATRILREVKLLRLLRHPDVVEIKHIMLPPSRREFQDIYVVFELMESDLHQVIRANDDLTAEHYQFFLYQLLRALKYIHGANVFHRDLKPKNILANADCKLKICDFGLARVSFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKHPVPLTQKFPNADPLAVRLLGRLLAFDPKDRPSAEEALADPYFASLANVEREPSRHPISKLEFEFERRKVTKDDVRELIYREILEYHPQMLEEYMKGGDQISFLYPSGVDRFKRQFAHLEEHYSKGERGSPLQRKHASLPRQRVGASNDGNNEQHISDQEMSAEPDAHGAVSPQKSQDAPGVGQNGLSPTSLSSRTYLKSASISASKCVVVNPNKQPEYDDAISEETEGAVDGLSEKVSKMHA

SEQ ID NO: 1034 - protein, 578 aa, Triticum aestivum
MGGGNGIVDGFRRLFHRRTPSGSVLGSSNQSSAGEDSSDVEAVEDLDLVGLRPIRVPKRKMPLPVESHKKNIMEKEFFTEYGEASQYQIQEVVGKGSYGVVAAAIDTRTGERVAIKKINDVFEHVSDATRILREVKLLRLLRHPDVVEIKHIMLPPSRKEFQDIYVVFELMESDLHHVIRANDDLTAEHYQFFLYQLLRALKYIHGANVFHRDLKPKNILANADCKLKICDFGLARVSFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKHPVPLTQKFPNADPLAVRLLGRLLAFDPKDRPSAEEALADPYFASLANVEREPSRHPISKLEFEFERRKVTKDDVRELIYREILEYHPQMLEEYMKGGDQISFLYPSGVDRFKRQFAHLEEHYSKGERGSPLQRKHASLPRQRVGASNDGNNEQHISDQEMSAEPDAHGTVSPQKSQDAPSVGPNGLSPTSLSSRTYLKSASISASKCVVVNPNKQPEYDDAISEETEGAVDGLSEKVSKMHA

SEQ ID NO: 1035 - protein, 950 aa, Oryza sativa Indica Group
MEQLRTIGRELAMGSQGGWGQSKEFLDLVKSIGEARSKAEEDRIISRELDHLKRRLADPDVPRRKMKELLLRLVYAEMLGHDASFGHIHAVKMTHDESLPLKRTGYLAVSLFLDERHDLVILVVNTIQKDLRSDNYLVVCAALTAACRLIGEEAIPAVLPQVVELLAHPKEAVRKKAVMALHRFYQRSPSSVSHLVSNFRKRLCDNDPGVMGATLCPLYDLILEDPNSYKDLVVSFVNILKQVAERRLPTSYDYHQMPAPFIQIKLLKILAVLGSGDKQASGNMYMVLGDIFRKGDTASNIGNAILYECICCISSIFPNAKMLDAAAETTSKFLKSDSHNLKYMGIDALGRLIKINPDIAEEHQLAVIDCLEDPDDTLKRKTFELLYKMTKSTNVEVIVDRMIEYMINITDHHYKTEIASRCVELAEQFAPSNQWFIQTMNKVFEHAGDLVNIRVAHNLMRLIAEGFGEEDEGADSQLRSSAVDSYLRIVGEPKLPSSFLQIICWVLGEYGTADGKYSASYIIGKLYDVAEAHPTDDTVRAYAISAILKIFAFEIALGRKIDMLPECQSLIDELSASHSTDLQQRAYELQALLGLDKQAVENVMPADASCEDIEIDRNLSFLNGYVQQAFENGAAPYIPESERSGVVSVGNYKAQDQQETSAHALRFKAYELPPAASQASISPTTDLVPVPEPSYYKEDHQMSRSQPSGDSLSGEFGLKLRLDGVQKKWGRPAYSSSSTPSSSTSSQQATNGGVSSEVGGSTSSQARESTYGSKRQQATEVSAEKQRLAASLFGKADRKAQAGRKTAKESSSTEKVATANATPQPAKEQVIPSAPPPDLLDLGEPVSSSPPLADPFTQLEGLLGPASASPVVSETPASSTSKTPDLISIFSDDVQTGVTSGSTEPSLGVNVVAAKKGPSLQDALQKDAAARQVGVTPTGNNPILFKDLLG

SEQ ID NO: 1036 - protein, 950 aa, Oryza sativa Japonica Group
MEQLRTIGRELAMGSQGGWGQSKEFLDLVKSIGEARSKAEEDRIISRELDHLKRRLADPDVPRRKMKELLLRLVYAEMLGHDASFGHIHAVKMTHDESLPLKRTGYLAVSLFLDERHDLVILVVNTIQKDLRSDNYLVVCAALTAACRLIGEEAIPAVLPQVVELLAHPKEAVRKKAVMALHRFYQRSPSSVSHLVSNFRKRLCDNDPGVMGATLCPLYDLILEDPNSYKDLVVSFVNILKQVAERRLPTSYDYHQMPAPFIQIKLLKILAVLGSGDKQASGNMYMVLGDIFRKGDTASNIGNAILYECICCISSIFPNAKMLDAAAETTSKFLKSDSHNLKYMGIDALGRLIKINPDIAEEHQLAVIDCLEDPDDTLKRKTFELLYKMTKSTNVEVIVDRMIEYMINITDHHYKTEIASRCVELAEQFAPSNQWFIQTMNKVFEHAGDLVNIRVAHNLMRLIAEGFGEEDEGADSQLRSSAVDSYLRIVGEPKLPSSFLQIICWVLGEYGTADGKYSASYIIGKLYDVAEAHPTDDTVRAYAISAILKIFAFEIALGRKIDMLPECQSLIDELSASHSTDLQQRAYELQALLGLDKQAVENVMPADASCEDIEIDRNLSFLNGYVQQAIENGAAPYIPESERSGVVSVGNYKAQDQQETSAHALRFEAYELPPAASQASISPTTDLVPVPEPSYYKEDHQMSRSQPSGDSLSGEFGLKLRLDGVQKKWGRPAYSSSSTPSSSTSSQQATNGGVSSEVGGSTSSQARESTYGSKRQQATEVSAEKQRLAASLFGKADRKTQAGRKTAKESSSTEKVATANATPQPAKEQVIPSAPPPDLLDLGEPVSSSPPLADPFTQLEGLLGPASASPVVSETPASSTSKTPDLMSIFSDDVQTGVTSGSTEPSLGVNVVAAKKGPSLQDALQKDAAARQVGVTPTGNNPILFKDLLG

SEQ ID NO: 1037 - protein, 885 aa, Oryza sativa Japonica Group
MKELLLRLVYAEMLGHDASFGHIHAVKMTHDESLPLKRTGYLAVSLFLDERHDLVILVVNTIQKDLRSDNYLVVCAALTAACRLIGEEAIPAVLPQVVELLAHPKEAVRKKAVMALHRFYQRSPSSVSHLVSNFRKRLCDNDPGVMGATLCPLYDLILEDPNSYKDLVVSFVNILKQVAERRLPTSYDYHQMPAPFIQIKLLKILAVLGSGDKQASGNMYMVLGDIFRKGDTASNIGNAILYECICCISSIFPNAKMLDAAAETTSKFLKSDSHNLKYMGIDALGRLIKINPDIAEEHQLAVIDCLEDPDDTLKRKTFELLYKMTKSTNVEVIVDRMIEYMINITDHHYKTEIASRCVELAEQFAPSNQWFIQTMNKVFEHAGDLVNIRVAHNLMRLIAEGFGEEDEGADSQLRSSAVDSYLRIVGEPKLPSSFLQIICWVLGEYGTADGKYSASYIIGKLYDVAEAHPTDDTVRAYAISAILKIFAFEIALGRKIDMLPECQSLIDELSASHSTDLQQRAYELQALLGLDKQAVENVMPADASCEDIEIDRNLSFLNGYVQQAIENGAAPYIPESERSGVVSVGNYKAQDQQETSAHALRFEAYELPPAASQASISPTTDLVPVPEPSYYKEDHQMSRSQPSGDSLSGEFGLKLRLDGVQKKWGRPAYSSSSTPSSSTSSQQATNGGVSSEVGGSTSSQARESTYGSKRQQATEVSAEKQRLAASLFGKADRKTQAGRKTAKESSSTEKVATANATPQPAKEQVIPSAPPPDLLDLGEPVSSSPPLADPFTQLEGLLGPASASPVVSETPASSTSKTPDLMSIFSDDVQTGVTSGSTEPSLGVNVVAAKKGPSLQDALQKDAAARQVGVTPTGNNPILFKDLLG

SEQ ID NO: 1038 - protein, 969 aa, Sorghum bicolor
MEQLRTIGRELAMGSQGGWGQSKEFLDLVKSIGEARSKAEEDRIIARELEHLKRRLADPDVPRRKMKELLLRLVYAEMLGHDASFGHIHAVKMTHDESLPLKRTGYLAVALFLDERHDLVILVVNTIQKDLRSDNYLVVCAALTAACRLIGEEAIPAVLPQVVELLAHPKEAVRKKAVMALHRFYQRSPSSVSHLVSNFRKRLCDNDPGVMGATLCPLYDLILEEPNSYKDLVVSFVNILKQVAERRLPTSYDYHQMPAPFIQIKLLKILAVLGSGDKQASGHMYTVLGDIFRKGDTASNIGNAILYECICCISSIFPNPKMLEAAAETTSKFLKSDSHNLKYMGIDALGRLIKINPDIAEEHQLAVIDCLEDPDDTLKRKTFELLYKMTKSTNVEVIVDRMIEYMINITDHHYKTEIASRCVELAEQFAPSNQWFIQTMNKVFEHAGDLVNIRVAHNLMRLIAEGFGEEDEGADSQLRSSAVDSYLRIVGEPKLPSSFLQIICWVLGEYGTADGKYSASYIIGKLCDVAEAHLTDDTVKAYAISAILKIFAFEIALGRKIDLLPECQTLVDELSASHSTDLQQRAYELQALLGLDKNAVESVMPADASCEDIEVDRNLSFLNSYVQQALENGASPYIPESERSGVISVGSYRSQEQQETSAHTLRFEAYEMPKPSLPLATSQTSISTPTTDLVPVPETGYYKEDHQTSRSQPPGDAVSGEFGVKLRLDGVQKKWGRPTYSSSTPSSSTSSQQTTNGTSHSDGGGSSSQPRESSYGSKRQQGTEVSAEKQRLAASLFGSAAAKADRKAQASRKTAKDSPSTEKVATTNVTAQPVKEQVIPAAPPPDLLDLGDEPVSSNPPLADPFSQLEGLLGPASAAPVLSGTPATGASKAPDLMSIFSDDVPTGVASGSTDPTLGDVNSTSSHKGATAVASKKGPSLQDALQKDATARQVGVTPTGNNPNLFKDLLG

SEQ ID NO: 1039 - protein, 969 aa, Zea mays
MEQLRTIGRELAMGSQGGWGQSKEFLDLVKSIGEARSKAEEDRIIARELEHLKRRLADPDVPRRKMKELLLRLVYAEMLGHDASFGHIHAVKMTHDESLPLKRTGYLAVALFLDERHDLVILVVNTIQKDLRSDNYLVVCAALTAACRLIGEEAIPAVLPQVVELLAHPKEAVRKKAVMALHRFYQRSPSSVSHLVSNFRKRLCDNDPGVMGATLCPLYDLILEEPNSYKDLVVSFVNILKQVAERRLPTSYDYHQMPAPFIQIKLLKILAVLGSGDKQASGHMYTVLGDIFRKGDTASNIGNAILYECICCISFIFPNPKMLEAAAETTSKFLKSDSHNLKYMGIDALGRLIKINPDIAEEHQLAVIDCLEDPDDTLKRKTFELLYKMTKSTNVEVIVDRMIEYMINITDHHYKTEIASRCVELAEQFAPSNQWFIQTMNKVFEHAGDLVNIRVAHNLMRLIAEGFGEEDEGADSQLRSSAVDSYLRIVGEPKLPSSFLQIICWVLGEYGTADGKYSASYIIGKLCDVAEAHLTDDTVKAYAISAILKTFAFEITLGRKIDLLPECQTLVDELSASHSTDLQQRAYELQALLGLDKTAVESVMPADASCEDIEVDRSLSFLNSYVQQALENGASPYIPESERSGVISVGSYRSQEQQETSAHTLRFEAYEMPKPSLPLATSQTSMSTPPTDLVPVPEAGYYKEDNQTSMSQPPSDAISGEFGVKLRLDGVQKKWGRPTYSSSTPSSSISSQPTPNGASHSDGGGSSSQPRESSYGSKRQQGTEVSAEKQRLAASLFGSAAAKADRKAQASRKTAKDSPSTEKVATTNVTAQPVKEQVIPAAPPPDLLDLGDEPVSSSPPSADPFSQLEGLLGPASAAPVLSGTPATSTSKAPGLLSIFSDDVPTGVTSVSTDPTLGDVNSMGSRKGAAAVASMKGPSLQDALQKDAAARQVGVTPTVNNPNLFKDLLG

SEQ ID NO: 1040 - protein, 954 aa, Hordeum vulgare subsp. vulgare
MEQLRTIGRELAMGSQGGWGQSKEFLDLVKSIGEARSKAEEDRIISRELEHLKRRLADPDVPRRKMKELLLRLVYAEMLGHDASFGHIHAVKMTHDESLPLKRTGYLAVALFIDERHDLVILVVNTIQKDLRSDNYLVVCAALTAASRLIGEEAIPAVLPQVVDLLAHPKESVRKKAVMALHRFYQRSPSSVSHLVSNFRKRLCDNDPGVMGATLCPLYDLILEDPNAYKDLVVSFVNILKQVAERRLPTSYDYHQMPAPFIQIKLLKILAVLGSGDKSASGHMYTVLGDIFRKGDTASNIGNAILYECICCVSCIFPNSKMLDAAAETTSKFLKSDSHNLKYMGIDALGRLIKINADIAEQHQLAVIDCLEDPDDTLKRKTFELLYKMTKSTNVEVIVDRMIEYMISITDHHYKAEIASRCVELAEQFAPSNQWFIQTMNKVFEHAGDLVNIRVAHNLMRLIAEGFGEEDEGADSQLRSSAVNSYLRILGEPKLPSSFLQIICWVLGEYGTADGKHPASYIIGKLCDVAEAHPTDDTVRGYAVSAILKIFAFEIAVGRKSDMLPEFQSLVDELSSSHSTDLQQRAYEVQALLGLDKQAVESVMPIDASCEDIEVDRNLSFLNSYVQQALENGATPYIPGSERSGVVSVGNYRAQDQHETSAHALRFEAYELPKPSLPTATSQSSVSLPTTDLVPVPEPSHYREDHHQTRSQPSGNAVSGEFGAKLRLDGVQKKWGRESYASSSTPSSSASSQQPANGGSNSDGGGLVTSQARESSYGSKTQPGTEVSAEKQRLAASLFGSSAAKPNRKGHAGRKATKESSSTEKAAPQPAKEQVTPAAPPPDLLDLGEEPVSSSAPSADPFSQLDGLLGPASASPALAGTSAPSASNTPDLMSIFSDDVQTGATSASTEPAQKGATTKKGHSLQDALQKDATARQVGVTPTGNNPNLFKDLLG

SEQ ID NO: 1041 - protein, 980 aa, Populus trichocarpa
MEQLKTIGRELAMGSQGGFGQSKEFLDLVKSIGEARSKAEEDRIVLREIESLKRRIVEPGIPKRKMKEYIIRLVYVEMLGHDASFGYIHAVKMTHDDNLVLKRTGYLAVTLFLNEDHDLIILIVNTIQKDLKSDNYLVVCAALNAVCKLINEETIPAVLPQVVELLGHSKEAVRKKAIMALHRFYHKSPSSVSHLLSNFRKKLCDSDPGVMGATLCPLFDLITIDANSYKDLVVSFVSILKQVAERRLPKVYDYHQLPAPFIQIRLLKILALLGSGDKQASEHMYTVVGDIFGKCDSSSNIGNAVLYECICCVSSIHPNPKLLEAAADVIARFLKSDSHNLKYMGIDALGRLIKLSPEIAEQHQLAVIDCLEDPDDTLKRKTFELLYKMTKSSNVEVIVDRMIDYMISINDNHYKTEIASRCVELAEQFAPSNHWFIQTMNKVFEHAGDLVNIKVAHNLMRLIAEGFGEDDDTADSQLRSSAVESYLHIIGEPKLPSVFLHVICWVLGEYGTADGKFSASYVTGKLCDVAESYSSDETVKAYAVTALMKIYAFEIAAGRKLDILPECQSLIEELSASHSTDLQQRAYELQAVIGLDVRAIGSIMPSDASCEDIEVDKCLSFLNGYVQQSLEKGAQPYIPENERSGMVNISNFRNQDQLEVASHGLRFEAYELPKPSVQSWTPPMSVASSTELVPVPEPSYYRETPQTASVPSSSDTGPSGLKLRLDGVQKKWGRPTYSSSSASTSNSSSLKAVNGITQVDGVSTGNSKTHETSYDSRRPQVEISEEKQKLAASLFGGSSKTERRSSTGHKVAKASSHAAEKLHTPKSTAISSADNAVEKPNLVQPPPDLLDLGEPIVTSSAPSVDPFRQLEGLLDATQVPGTLGGTKAPDFMALYAETPASGQSAGVSHPLSLIRDEINLVPGLSNASSNTVHGGATAANPSQISKGPNVKDALEKDALVRQMGVTPSGQNPNLFKDLFG

SEQ ID NO: 1042 - protein, 981 aa, Ricinus communis
MEQLKTIGRELAMGSQGGFGQSKEFLDLVKSIGEARSKAEEDRIVLSEIETLKKRIVEPDIPKRKMKEYIIRLVYVEMLGHDASFGYIHAVKMTHDDNLLLKRTGYLAVTLFLNEDHDLIILIVNTIQKDLKSDNYLVVCAALNAVCKLINEETIPAVLPQVVELLGHSKEAVRKKAIMALHRFYHKSPSSVSHLVSNFRKRLCDNDPGVMGATLCPLFDLITVDVNSYKELVVSFVSILKQVAERRLPKSYDYHQMPAPFIQIKLLKIMALLGSGDKQASEHMYTVVGDILRKCDSSSNIGNAVLYESICCVSSIHPNPKLLEAAADVIARFLKSDSHNLKYMGIDALGRLIKLSPDIAEQHQLAVIDCLEDPDDTLKRKTFELLYKMTKSSNVEVIVDRMIDYMININDSHYKTEIASRCVELAEQFAPSNHWFIQTMNRVFEHAGDLVKSKVAHNLMRLIAEGFGEDDDNADSQLRSSAVESYLHIIGDPKLPSVFLQVICWVLGEYGTADGKFSASYITGKLCDVADAYSNDETVKAYAVTALMKLYAFEIAAGRKVDILPECQSLIEELSASHSTDLQQRAYELQAVIGLDAHAVECILPSDASCEDIEIDDNLSFLDGYVQQSIEKGAQPYIPESERSGVLNISSFRNQDQHEASSHGLRFEAYELPKPSAPSRIPPVALAPSRELVPVPEPSYYGEAQQAAIAASSSNTGSSEVKLRLDGVQKKWGKPTYSSPATSTSSSSSQKTVNGVGPVDGVGNVNSKAPPPSYDSRRPQVEISPEKQKLAASLFGGSSKTERRTSSIGHKVARGSSHVPKPAAVSATDVAVERKTTPVQPPPDLLDLGESTVKSSDLLVDPFKQLEGLLDQTQLSSSANSGMNSASSAPDIMQLYADTSASGQSGNLVSPLSSHKSDDNLVSGSTNAIANPAQSGSTVLSSTQFSKGPNLKDSLEKDALVRQMGVTPQSQNPNLFKDLLG

SEQ ID NO: 1043 - protein, 185 aa, Zea mays
MPLTWCSSIFQVTNANCTKKSIERPSTGELMASSSSSSHRRLILAAAVLLSVLAAASASAGTSCVPGWAIPHNPLPSCRWYVTSRTCGIGPRLPWPELKRRCCRELADIPAYCRCTALSILMDGAIPPGPDAQLEGRLEDLPGCPREVQRGFAATLVTEAECNLATISGVAECPWILGGGTMPSK

SEQ ID NO: 1044 - protein, 155 aa, Zea mays
MASSSSSSHRRLILAAAVLLSVLAAASASAGTSCVPGWAIPHNPLPSCRWYVTSRTCGIGPRLPWPELKRRCCRELADIPAYCRCTALSILMDGAIPPGPDAQLEGRLEDLPGCPREVQRGFAATLVTEAECNLATISGVAECPWILGGGTMPSK

SEQ ID NO: 1045 - protein, 155 aa, Zea mays subsp. parviglumis
MASSSSSSHRRLILAAAVLLSVLAAASASAGTSCVPGWAIPHNPLPSCRWYVTSRTCGIGPRLPWPEMKRRCCRELADIPAYCRCTALSILMDGAIPPGPDAQLEGRLEDLPGCPREVQRGFAATLVTEAECNLATISGVAECPWILGGGTMPSK

SEQ ID NO: 1046 - protein, 155 aa, Zea mays subsp. parviglumis
MASSSSSSHRRLILAAAVLLSVLAAASASAGTSCVPGWAIPHNPLPSCRWYVTSRTCGIGPRLPWPEMKRRCCRELADIPAYCRCTALSILMDGAIPPGPDAQLEGRLEDLPGCPREVQRGFAATLITEAECNLATISGVAECPWILGGGTMPSK

SEQ ID NO: 1047 - protein, 155 aa, Zea mays subsp. parviglumis
MASSSSSSHRRLILAAAVLLSVLAAASASAGTSCVPGWAIPHNPLPSCRWYVTSRTCGIGPRLPWPELKRRCCQELADIPAYCRCTALSILMDGAIPPGPDAQLEGRLEDLPGCPREVQRGFAATLVTEAECNLATISGVAECPWILGGGTMPSK

SEQ ID NO: 1048 - protein, 155 aa, Zea mays subsp. parviglumis
MASSSSSSHRRLILAAAVLLSVLAAASASAGTSCVPGWAIPHNPLPSCRWYVTSRTCGIGPRLPWPKLKRRCCRELADIPAYCRCTALSILMDGAIPPGPDAQLEGRLEDLPGCPREVQRGFAATLVTEAECNLATISGVAECPWILGGGTMPSK

SEQ ID NO: 1049 - protein, 155 aa, Zea diploperennis
MASSSSSSHRRLILAAAVLLSVLAAASASAGTSCVPGWAIPHNPLPSCRWYVTSRTCGIGPRLPWPELKRRCCRELADIPAYCRCTALSILMDGVIPPGPDAQLEGRLEDLPGCPREVQRGFAATLVTEAECNLATISGVAECPWILGGGTMPSK

SEQ ID NO: 1050 - protein, 155 aa, Zea mays
  misc_feature (25)..(25): Xaa can be any naturally occurring amino acid
MASSSSSSHRRLILAAAVLLSVLAXASASAGTSCVPGWAIPHNPLPSCRWYVTSRTCGIGPRLPWPELKRRCCRELADIPAYCRCTALSILMDGAIPPGPDAQLEGRLEDLPGCPREVQRGFAATLVTEAECNLATISGVAECPWILGGGTMPSK

SEQ ID NO: 1051 - protein, 155 aa, Zea mays subsp. parviglumis
MASSSSSSHRRLILAAAVLLSVLAAASASAGTSCVPGWAIPHNPLPSCRWYVTSRTCGIGPRLPWPELKRRCCRELADIPTYCRCTALSILMDGAIPPGPDAQLEGRLEDLPGCPREVQRGFAATLVTEAECNLATISGVAECPWILGGGTMPSK

SEQ ID NO: 1052 - protein, 155 aa, Zea mays subsp. parviglumis
MASSSSSSHRRLILAAAVLLSVLAAASASAGTSCVPGWAIPHNPLPSCRWYVTSRTCGIGPRLPWPELKRRCCRELADIPTYCRCTALSILMDGAIPPGPDAQLEGRLEDLPGCPREVQRGFAATLITEAECNLATISGVAECPWILGGGTMPSK

SEQ ID NO: 1053 - protein, 222 aa, Sorghum bicolor
MGMSRAPRRRASPSAAAAVPWLLLFAVLFVGRATAQGPGATPLSKHASFFDRNGDGVVSFEETYGAFRALGFGFGMSGVSAAFINGALGSKCRPQNATSSKLDIYIEDIYKGKHGSDSGSYDTEGRFVPDKFEAIFANHAKTVPDALTSDEIDQLLQANREPGDYTGWAGAEAEWKILYSLGKNQNGLLHKDVARSVYDGTLFHRLAPNWKPLDKESVIREN

SEQ ID NO: 1054 - protein, 226 aa, Zea mays
MEVGRTPRRRASPAAAAAAAAAAVPSLLLFAVLFVGRAAAALGGPGPALYKHASFFDRDGDGVVSFAETYGAFRALGFGLGLSSASAAFINGALGSKCRPQNATSSKLDIYIEDIRRGKHGSDSGSYDAQGRFVPEKFEEIFARHARTVPDALTSDEIDQLLQANREPGDYSGWAGAEAEWKILYSLGKDGDGLLRKDVARSVYDGTLFHRLAPRWKSPDSDMERS

SEQ ID NO: 1055 - protein, 232 aa, Zea mays
MEVGRAPRRRVSPAAAAAAVPSLLLFAVLFAGRAAAFGHLQGAGATALYKHASFFDRDGDGVVSFSETYGAFRALGFGFGLSSVSAALINGALGSKCRPQNATSSKLDIYIEDIQKGKHGSDSGSYDAEGRFVPDKFEEIFAKHAKTVPDALTSDEIDQLLQANREPGDYSGWAGAEAEWKTLYSLGKDKDGLLRKDVARSVYDGTLFHMLAPNWKSPDEEEEQELSVIRES

SEQ ID NO: 1056 - protein, 219 aa, Zea mays
MEVGRTPRRRASPAAAVPSLLLFALLFVCRAAAALGGPAPALYKHASFFDRDGDGVVSFAETYGAFRALGFGLGLSSVSAAFINGALGSKCRPQNATSSKLDIYIEDIRRGKHGSDSGSYDAQGRFVPEKFEEIFARHARTVPDALTSDEIDQLLQANREPGDYSGWAGAEAEWKILYSLGKDGDGLLRKDVARSVYDGTLFHRLAPRWKSPDSDMERS

SEQ ID NO: 1057 - protein, 234 aa, Zea mays
MEVGRAPRRRVSPAAAAAAVPSLLLFAVLFAGRAAAFGHLQAAGAGATALYKHASFFDRDGDGVVSFSETYGAFRALGFGFGLSSVSAALINGALGSKCRPQNATSSKLDIYIEDIQKGKHGSDSGSYDAEGRFVPDKFEEIFAKHAKTVPDALTSDEIDQLLQANREPGDYSGWAGAEAEWKTLYSLGKDKDGLLRKDVARSVYDGTLFHMLAPNWKSPDEEEEQELSVIRES

SEQ ID NO: 1058 - protein, 720 aa, Sorghum bicolor
MATSALDSLPAPLRSLRLKTKQQELLLRVSALALIYVLAFAVRLFSVLRYESMIHEFDPYFNYRTTLFLTENGFSEFWNWFDSESWYPLGRVVGGTLFPGLMVTAALLHRLLRALSLAVHIREVCVLTAPFFAANTTLVAYAFGREIWDSGAGLVAAALIAIVPGYISRSVAGSYDNEGVAIFALLLTFYLFVRAVNTGSLAWALASAFGYFYMVSAWGGYVFIINLIPLYVLVLLVTGRYSQRLYVAYNCMYVLGMLLAMQIRFVGFQHVQSGEHMAAMGVFFLLQVFFFLDWVKYLLNDARLFKSFLRTTLTCVITVGTLALGIGTASGYISPWTGRFYSLLDPTYAKDHIPIIASVSEHQPTAWSSFMFDFHILLFLFPAGLYFCFKRLSDATIFIVMYGLTSMYFAGVMVRLILVAAPAVCLISAIAASATIKNLTTLIRAKSRSPQTTSGKTTGSKAAAKGAVDQSLPFQHNAAIALLLGAFYLLSRYAIHCTWVTSEAYSSPSIVLAARGHNGGRVIFDDYREAYYWLRQNTPPDAKIMSWWDYGYQITAMGNRTVIVDNNTWNNTHIATVGRAMSSYEDEAYEIMQSLDVNYVLVVFGGVTGYSSDDINKFLWMVRIGGGVFPVIKEPDYLVNGEYRIDKGAAPKMLNCLMYKLCYYRFGELTTEYGKPPGYDRVRGVEIGNKDIKLEYLEEAFTTSNWIVRIYKVKPPKNRS

SEQ ID NO: 1059 - protein, 720 aa, Zea mays
MAPSALASLPAPLRSLRLKTKQQELLLRVSALALIYVLAFAVRLFSVLRYESMIHEFDPYFNYRTTLFLTENGFSEFWNWFDSESWYPLGRVVGGTLFPGLMVTAALLHRLLRALSLAVHIREVCVLTAPFFAANTTLVAYAFGREIWDSGAGLVAAALIATVPGYISRSVAGSYDNEGVAIFALLLTFYFFVRAVNTGSLAWALASAFGYFYMVSAWGGYVFIINLVPLYVLVLLVTGRYSQRLYVAYNCMYVLGMLLAMQIRFVGFQHVQSGEHMAAMGVFFLLQVFFFLDWVKYLLNDARLFKSFLRITLTCVITVGTLALGIGTASGYISPWTGRFYSLLDPTYAKDHIPIIASVSEHQPTAWSSFMFDFHILLFLFPAGLYFCFKRLSDATIFIVMYGLTSMYFAGVMVRLILVAAPAVCLISAIAASATIKNLTTLIRTKSRSPQTTSGKTTGSKSAAKGVVDQSLPFQHNAAIGLLLGAFYLLSRYAIHCTWVTSEAYSSPSIVLAARGHNGGRVIFDDYREAYYWLRQNTPPDAKIMSWWDYGYQITAMGNRTVIVDNNTWNNTHIATVGRAMSSYEDEAYEIMQSLDVNYVLVVFGGVTGYSSDDINKFLWMVRIGGGVFPVIKEPDYLVNGEYRIDKGAAPKMLNCLMYKLCYYRFGELTTEYGKPPGYDRVRGVEIGNKDIKLEYLEEAFTTSNWIVRIYKVKPPKNRS

SEQ ID NO: 1060 - protein, 719 aa, Zea mays
MAPPALDSLPAPLRSLRLKTKQQELLLRVSALALIYVLAFAVRLFSVLRYESMIHEFDPYFNYRTTLFLTENGFSEFWNWFDFESWYPLGRVVGGTLYPGLMVTAALLHRLLRALYLTVHIREVCVLTAPFFAANTTLVAYAFGREIWDSGAGLVAAALIAIVPGYISRSVAGSYDNEGVAIFALLLTFYLFVRAVNTGSLAWALASAFGYFYMVSAWGGYVFIINLVPLYVLVLLVTGRYSQRLYVAYNCMYVLGMLLAMQIRFVGFQHVQSGEHMAAMGVFFLLQVFFFLDWVKYLLNDARLFKSFLRITLTCVITIGTLALGLGTASGYISPWTGRFYSLLDPTYAKDHIPIIASVSEHQPTAWSSFMFDFHILLFLFPAGLYFCFKRLSDATIFIVMYGLTTMYFAGVMVRLILVAAPAVCLISAIAASATIKNLTTLIRTKSKSPQTTGKTTGSKAGAKGAVDQSLPFQHNAAIALLLGAFYLLSRYAIHCTWVTSEAYSSPSIVLAARGHNGGRVIFDDYREAYYWLRQNTPPDAKIMSWWDYGYQITAMGNRTVIVDNNTWNNTHIATVGRAMSSYEDEAYEIMQSLDVNYVLVVFGGVTGYSSDDINKFLWMVRIGGGVFPVIKEPDYLVNGEYRIDKGAAPKMLNCLMYKLCYYRFGELTTEYGKPPGYDRVRGVEIGNKDIKLEYLEEAFTTSNWIVRIYKVKPPKNRS

SEQ ID NO: 1061 - protein, 721 aa, Oryza sativa Japonica Group
MAAATALDSLPAPLRSLRLKTKQQELLLRVSALALIYVLAFVVRLFSVLRYESMIHEFDPYFNYRTTLFLSDHGFSEFWNWFDFESWYPLGRVVGGTLFPGLMVTAALLHRLLRALSLAVHIREVCVLTAPFFAANTTLVAYAFGREIWDSGAGLVAAALIAVCPGYISRSVAGSYDNEGVAIFALLLTFYLFVRAVNTGSLAWSLASAFGYFYMVSAWGGYVFIINLLPLYVLVLLVTGRYSQRLYVAYNSTYVLGMLLAMQIRFVGFQHVQSGEHMAAMGVFFLLQVFFFLDWVKYLLNDAKLFKSFLRITLTCVITVGTLALGIGTASGYISPWTGRFYSLLDPTYAKDHIPIIASVSEHQPTAWSSFMFDFHILLFLFPAGLYFCFKRLSDATIFIVMYGLTSMYFAGVMVRLILVAAPAVCLISAIAASATIKNLTTLIRTKSKSPQTVSGKSSGSKAAAKGAVDQSLPFQQNVAIALLLGAFYLLSRYAVHCTWVTSEAYSSPSIVLAARGHNGGRVIFDDYREAYYWLRQNTPSDAKIMSWWDYGYQITAMGNRTVIVDNNTWNNTHIATVGRAMSSYEDEAYEIMQSLDVNYVLVVFGGVTGYSSDDINKFLWMVRIGGGVFPVIKEPDYLVNGEYRVDKGAAPKMLNCLMYKLCYYRFGELTTEYGKPPGYDRVRGVEIGNKDIKLEYLEEAFTTSNWIVRIYKVKPPKNRS

SEQ ID NO: 1062 - protein, 725 aa, Hordeum vulgare subsp. vulgare
MAAAAATTTMLDSLPAPLLRALRLKTKQQELLLRVSALALIYVLAFAVRLFSVLRYESMIHEFDPYFNYRTTLYLTEHGYSEFWNWFDHESWYPLGRVVGGTLFPGLMVTAALLHRLLRALSLAVHIREVCVLTAPFFAANTTLVAYAFGREIWDSGAGLVAAALIAVCPGYISRSVAGSYDNEGVAIFALLLTFYLFVRAVNTGSLAWSLAAAFGYFYMVSAWGGYVFIINLLPLYVLVLLVTGRYSQRLYVAYNCTYVLGMLLGMQIRFVGFQHVQSGEHMAAMGVFFLLQVFFFLDWVKYMLNDVKLFKSFLRITLTCVISVGTLALGIGTASGYISPWTGRFYSLLDPTYAKDHIPIIASVSEHQPTAWSSFMFDFHILLFLFPAGLYFCFKRLSDATIFIVMYGLTSMYFAGVMVRLILVAAPAVCLISAIAVSATVKNLTTLIRSKSKSPQTTGKTTGSKAAAKGAVDQPLPFQHNVAVALLVGAFYLLSRYAIHCTWVTSEAYSSPSIVLSARGHNGGRVIFDDYREAYYWLRQNTPTDAKIMSWWDYGYQITAMGNRTVIVDNNTWNNTHIATVGRAMSSYEDEAYEIMQSLDVNYVLVVFGGVTGYSSDDINKFLWMVRIGGGVFPVIKESDYLVNGEYRVDKGASPKMLNCLMYKLCYYRFGELTTEYGKPPGYDRVRGVEIGNKDVKLEYLEEAFTTSNWIVRIYKVKPPKNRS

SEQ ID NO: 1063 - protein, 707 aa, Oryza officinalis
MAAASAALDLLPAPLRSLRLKTKQQELLLRVSALALIYVLAFVVRLFSVLRYESMIHEFDPYFNYRTTLFLSEHGFSEFWNWFDSESWYPLGRVVGGTLFPGLMVTAALLHRLLRALSLAVHIREVCVLTAPFFAANTTLVAYAFGREIWDSGAGLVAAALIAVCPGYISRSVAGSYDNEGVAIFALLLTFYLFVRAVNTGSLAWALASAFGYFYMVSAWGGYVFIINLLPLYVLVLLVTGRYSQRLYVAYNSTYVLGMLLAMQIRFVGFQHVQSGEHMAAMGVFFLLQVFFFLDWVKYLLNDAKLFKSFLRITLTCVITVGTLALGIGTASGYISPWTGRFYSLLDPTYAKDHIPIIASVSEHQPTAWSSFMFDFHILLFLFPAGLYFCFKRLSDATIFIVMYGLTTPAVCLISAIAASATIKNLTTLIRTKSKSPQTVSGKSTGSKAAAKGAVDQSLPFQQNVAIALLLGAFYLLSRYAVHCTWVTSEAYSSPSIVLAARGHNGGRVIFDDYREAYYWLRQNTPSDAKIMSWWDYGYQITAMGNRTVIVDNNTWNNTHIATVGRAMSSYEDEAYEIMQSLDVNYVLVVFGGVTGYSSDDINKFLWMVRIGGGVFPVIKEPDYLVNGEYRVDKGAAPKMLNCLMYKLCYYRFGELTTEYGKPPGYDRVRGVEIGNKDIKLEHLEEAFTTSNWIVRIYKVKPPKNRS

SEQ ID NO: 1064 - protein, 737 aa, Vitis vinifera
MEAVNGVKSGSNSTASTFQSAFFKPDLSLKSLKLKTKQQELLIRVSILTLVYILAFITRLFSVLRYESMIHEFDPYFNYRTTVFLTEKGFYEFWNWFDSESWYPLGRIIGGTLYPGLMVTAALIYSIIRFLRFAVHIREVCVLTAPFFASNTTIVAYFFGKELWDSGAGLVAAALIAICPGYISRSVAGSYDNEGVAIFALLLTFYLFVKAVNTGSLAWALASAFGYFYMVSAWGGYVFIINLIPLYAMVLLITGRYSMRLYVAYNCMYILGMLLAMQIRFVGFQHVQSGEHMAAMGVFFLMQVFYFLDWVKHLLSDTKLFQAFLRITVTCAVGVGAIALGVGTASGYISPWTGRFYSLLDPTYAKDHIPIIASVSEHQPTAWSSFMFDFHILLFLFPAGLYFCFKRLSDATIFIVMYGLTSMYFAGVMVRLILVATPAMCLISAIAVSATIKNLTQLVRTKSKVAHTGSTKGTTSGKASSKASLDQSLPFQRNGAIALLIGAFYLLCKYATHCTWVTSEAYSSPSIVLAARGAYGNRVIFDDYREAYFWLRQNTPPDAKVMSWWDYGYQITAMGNRTVIVDNNTWNNTHIATVGRAMSSYEDEAYEIMRSLDVDYVLVVFGGVTGYSSDDINKFLWMVRIGGGVFPVIKEPDYLVNGEYRVDKGAAPKMLNCLMYKLSYYRFGELQTEYGKPPGYDRARGVEIGNKDIKLEYLEEAFTTSNWIVRIYKVKPPNNRW

SEQ ID NO: 1065 - protein, 721 aa, Populus trichocarpa
MSLKSDLLSTLSLKSLKLKTKQQELLIRVSILCLVYVLAFITRLFSVLRYESMIHEFDPYFNYRTTLFLTQKGFYEFWNWFDSESWYPLGRIIGGTLYPGLMVTAAIMYWGLRFLRFAVHIREVCVLTAPFFASNTTLVAYFFGKEIWDTGAGLVAAVLIAICPGYISRSVAGSYDNEGVAIFALLLTFYFFVKAVNTGSLAWGLASAFGYFYMVSAWGGYVFIINLIPLYVLVLLITGRYSMRLYVAYNCMYVLGMLLAMQIRFVGFQHVQSGEHMAAMGVFFLMQVFYFLDWVKYLLNDKKLFEAFLRITVTCAVGVGAIALGVGTASGYISPWTGRFYSLLDPTYAKDHIPIIASVSEHQPTAWSSFMFDFHILLFLFPAGLYFCFKRLSDATIFIVMYGLTSMYFAGVMVRLILVATPAVCLISAIAVSATIKNLTMLLRTKSKVSQTGSTKGTGGGKASSKALLDQSQPFQNNGAIALLFGAFYLLSRYAIHCTWVTSEAYSSPSIVLAARGAHGNRVIFDDYREAYFWLRQNTPPDAKVMSWWDYGYQITAMGNRTVIVDNNTWNNTHIATVGRAMSSYEDEAYEIMKSLDVDYVLVVFGGVTGYSSDDINKFLWMVRIGGGVFPVIKEPDYLVNGEYRVDKGAAPKMLNCLMYKLSYYRFGELVTEYGKPPGYDRARGVEIGNKDIKLEHLEEAFTTSNWIVRIYKVKPPNNRW

SEQ ID NO: 1066 - protein, 738 aa, Arabidopsis lyrata subsp. lyrata
MGGKSEPTKSESMATKTTNPDLLNSSFFPFKSLKLKTKQQELLLRISILGLVYILAFIARLFSVLRYESMIHEFDPYFNYRTTLFLTEKGFYEFWNWFDSESWYPLGRIIGGTLYPGLMVTAALIYWTLRFLRFFVHIREVCVLTAPFFASNTTLVAYFFGKEIWDTGAGLVAAVLIAICPGYISRSVAGSYDNEAVAIFALLLTFYLFVKAVNTGSLAWALGSAFGYFYMVSAWGGYVFIINLVPLYVLVLLITGRYSMRLYIAYNCMYILGMLLAMQIRFVGFQHVQSGEHMGAMGVFLLMQVFYFLDWVKYQLNDTKLFQTFLRITVTSAILVGGIALGVGTASGYISPWTGRFYSLLDPTYAKDHIPIIASVSEHQPTAWSSFMFDYHILLFLFPAGLYFCFKRLTDATIFIVMYGLTSLYFAGVMVRLILVATPAVCLISAIAVSATVKNLTSLLRTKQKVSQTGSTKGAGSSKASSKVTLDQSQPFQKNGAIALLLGVFYLLSRYAIHCTWVTSEAYSSPSIVLAARGAHGNRIIFDDYREAYYWLRQNTPTDAKIMSWWDYGYQITAMGNRTVIVDNNTWNNTHIATVGRAMSSYEDEAYDIMRSLDVNYVLVVFGGVTGYSSDDINKFLWMVRIGGGVFPVIKEPDYLVNGEFRVDKGASPKMLNCLMYKLCYYRFGELTTEYGKPPGYDRARGVEIGNKDIKLEHLEEAYTTSNWIVRIYRVKPPTNRL

SEQ ID NO: 1067 - protein, 721 aa, Populus trichocarpa
MEVTKTEPITNKSSSSSVSVKSDLMSTLSLKSFKLKTKQQELLIRVSILCLVYILAFITRLFSVLRYESMIHEFDPYFNYRTTLFLTQKGFYEFWNWFDSESWYPLGRIIGGTLYPGLMVTAAIMYWGLRFLRFAVHIREVCVLTAPFFASNTTLVAYFFGKEIWDTGAGLVAAVLIAICPGYISRSVAGSYDNEGVAIFALLLTFYLFVKAVNTGSLAWGVASAFGYFYMVSAWGGYVFIINLVPLYVLVLLITGRYSMRLYVAYNSMYVLGMLLAMQIRFVGFQHVQSGEHMAAMGVFFLMQVFYFLGWVKHLLGDKKKFEAFLRITVTCAVGVGAIALGVGTASGYISPWTGRFYSLLDPTYAKDHIPIIASVSEHQPTAWSSFMFDFHILLFLFPAGLYFCFKRLSDATIFIVMYGLTSMYFAGVMVRLILVATPAVCLISAIAVSATIKNLTTLLRTKSKQALPDQSQPFQRNGAIALLFGAFYLLSRYAIHCTWVTSEAYSSPSIVLAARGAHGNRVIFDDYREAYYWLRQNTPPDAKVMSWWDYGYQITAMGNRTVIVDNNTWNNTHIATVGRAMSSYEDEAYEIMRSLDVDYVLVVFGGVTGYSSDDINKFLWMVRIGGGVFPVIKEPDYLVNGEYRVDKGAAPKMLNCLMYKLSYYRFGELVTEYGKPPGYDRARGVEIGNKDIKLEHLEEAFTTSNWIVRIYKVKPPNNRW

SEQ ID NO: 1068 - protein, 579 aa, Sorghum bicolor
MATSYLLPCYVLITVLVLFFSVDVTEGAIREYQFDVQMTNVTRLCSSKSIVTVNGQFPGPPVFAREGDFVVIRVVNHVPYNMSIHWHGVRQLRSGWADGPAYITQCPIQSGQSYVYKFTITGQRGTLWWHAHISWLRATVYGAIVILPKPGVPYPFPAPYKEVPVIFGEWWTADTEAVISQALQTGGGPNVSDAFTINGLPGPLYNCSAKDTFKLKVKPGKTYMLRIINAALNDELFFSIAGHPLTVVDVDAVYIKPITVDTILITPGQTTNVLLTTKPSYPGATYYMLAAPYSTARPGTFDNTTVAGILEYEDPTSPPPHAAFNKNLPALKPTLPQINDTSFVANYTAKLRSLATAEYPAAVPQEVDRRFFFTVGLGTHPCAVNGTCQGPTNSSRFAASVNNVSFVLPTTALLQSHFAGKSKGVYSSNFPAAPLVPFNYTGTPPNNTNVANGTKLVVLPYGASVELVLQGTSILGAESHPLHLHGFNFFVVGQGFGNFDPAKDPAKYNLVDPVERNTVGVPAAGWVAIRFRADNPGVWFMHCHLEVHVSWGLKMAWLVLDGDRPNEKLLPPPSDLPRC

SEQ ID NO: 1069 - protein, 582 aa, Zea mays
MATPYRLPCCCYALVTVLVLFFSVDATEGAIREYQFDVQMTNVTRLCSSKSIVTVNGQFPGPTVFAREGDFVVIRVVNHVPYNMSIHWHGIRQLRSGWADGPAYITQCPIQSGQSYVYKFTITGQRGTLWWHAHISWLRATVYGPIVILPKPGVPYPFPAPYDEVPVLFGEWWTADTEAVISQALQTGGGPNVSDAFTINGLPGPLYNCSAKDTFKLKVKPGKTYMLRIINAALNDELFFSIAGHPLTVVDVDAVYIKPITVETIIITPGQTTNVLLTTKPSYPGATYYMLAAPYSTARPGTFDNTTVAGILEYEDPTSSPPPHAAFDKNLPALKPTLPQINDTSFVANYTARLRSLATAEYPADVPREVHRRFFFTVGLGTHPCAVNGTCQGPTNSSRFAASVNNVSFVLPTTALLQSHFAGKSRGVYSSNFPAAPLVPFNYTGTPPNNTNVSNGTKLVVLPYGTSVELVMQGTSILGAESHPLHLHGFNFFVVGQGFGNFDPAKDPAKYNLVDPVERNTVGVPAAGWVAIRFRADNPGVWFMHCHLEVHVSWGLKMAWLVLDGDRPNEKLLPPPSDLPKC

SEQ ID NO: 1070 - protein, 582 aa, Zea mays
MATPYRLPCCCYALVTVLVLFFSVDATEGAIREYQFDVQMTNVTRLCSSKSIVTVNGQFPGPTVFAREGDFVVIRVVNHVPYNMSIHWHGIRQLRSGWADGPAYITQCPIQSGQSYVYKFTITGQRGTLWWHAHISWLRATVYGPIVILPKPGVPYPFPAPYDEVPVLFGEWWTADTEAVISQALQTGGGPNVSDAFTINGLPGPLYNCSAKDTFKLKVKPGKTYMLRIINAALNDELFFSIAGHPLTVVDVDAVYIKPITVETIIITPGQTTNVLLTTKPSYPGATYYMLAAPYSTARPGTFDNTTVAGILEYEDPTSSPPPHAAFDKNLPALKPTLPQINDTSFVANYTARLRSLATAEYPADVPREVHRRFFFTVGLGTHPCAVNGTCQGPTNSSRFAASVNNVSFVLPTTALLQSHFAGKSRGVYSSNFPAAPLVPFNYTGTPPNNTNVSNGTKLVVLPYGTSVELVMQGTSILGAESHPLHLHGFNFFVVGQGFGNFDPAKDPAKYNLVDPVERNTVGVPAAGWVAIRFRADNPGVWFMHCHLEVHVSWGLKMAWLVLDGERPNEKLLPPPSDLPTC

SEQ ID NO: 1071 - protein, 577 aa, Oryza sativa Indica Group
MAISYLLRSSILAVAALLLFSVNLAKGDIREYQFDVKTTNVTRLCSSKSIVTVNGQFPGPTVFAREGDLVVIRVINHSPYNMSIHWHGIRQLRSGWADGPAYITQCPIQPGGSYVYKYTITGQRGTLWWHAHISWLRATVYGPIIILPKAGVPYPFPAPDKEVPVVFGEWWKADTEAVISQATQTGGGPNVSDAFTINGLPGPLYNCSAKDTFKLKVEAGKTYMLRLINAALNDELFFSIAGHTLTVVDVDAVYVKPFTVDTLLITPGQTTNVLLTTKPSYPGATFYMLAAPYSTAMSGTFDNTTVAGILEYEDPSSHSTAAFNKNLPVLRPTLPQINDTSFVSNYTAKLRSLATAEYPANVPQQVDTRFFFTVGLGTHPCAVNGTCQGPNGSRFAAAVNNVSFVLPSTALLQSHYTGRSNGVYASNFPAMPLSPFNYTGTPPNNTNVSNGTRLVVLPYGASVELVMQGTSVLGAESHPFHLHGFNFFVVGQGFGNFDPVNDPAKYNLVDPVERNTVGVPAAGWVAIRFLADNPGVWFMHCHLEVHVSWGLKMAWVVQDGSLPNQKILPPPSDLPKC

SEQ ID NO: 1072 - protein, 577 aa, Oryza sativa Japonica Group
MAISYLLRSSILAVAALLLFSVNLAKGDIREYQFDVKTTNVTRLCSSKSIVTVNGQFPGPTVFAREGDLVVIRVINHSPYNMSIHWHGIRQLRSGWADGPAYITQCPIQPGGSYVYKYTITGQRGTLWWHAHISWLRATVYGPIIILPKAGVPYPFPAPDKEVPVVFGEWWKADTEAVISQATQTGGGPNVSDAFTINGLPGPLYNCSAKDTFKLKVEAGKTYMLRLINAALNDELFFSIAGHTLTVVDVDAVYVKPFTVDTLLITPGQTTNVLLTTKPSYPGATFYMLAAPYSTAMSGTFDNTTVAGILEYEDPSSHSTAAFNKNLPVLRPTLPQINDTSFVSNYTAKLRSFATAEYPANVPQQVDTRFFFTVGLGTHPCAVNGTCQGPNGSRFAAAVNNVSFVLPSTALLQSHYTGRSNGVYASNFPAMPLSPFNYTGTPPNNTNVSNGTRLVVLPYGASVELVMQGTSVLGAESHPFHLHGFNFFVVGQGFGNFDPVNDPAKYNLVDPVERNTVGVPAAGWVAIRFLVDNPGVWFMHCHLEVHVSWGLKMAWVVQDGSLPNQKILPPPSDLPKC

SEQ ID NO: 1073 - protein, 572 aa, Hordeum vulgare subsp. vulgare
MAAILVAAVMVVVLSVNAAESSTVEYQFDVATMNVTRLCGSKSIVAVNGQFPGPTVSAREGDLVVVRVVNKAQYNMSIHWHGVRQIRSGWADGPAYITQCPIQPGQSYVYKFTVTGQRGTLWWHAHISWLRATVYGPIVILPKLGVPYPFAAPYKEVPLMFGEWWKADTEAVISQALQTGGGPNVSDAFTINGLPGPLYNCSAKDTFKLKVKPGKTYMLRIINAALNDELFFSIAGHPLTIVDVDAVYIKPITVETLIITPGQTTNVLLTAKPSYPGATYYMLAAPYSTAASGTFDNTTVAGILEYVDPSSPSSAGFNKNLPLLRPTLPQINDTSFVSNYTDKLRSLATEEYPAAVPQEVDRRFFFTVGLGTHPCAVNGTCQGPTNDSRFAAAVNNVSFVLPTTALLQSHYTGMSNGVYSSNFPAVPKSPFNYTGTPPNNTNVSNGTRLVVLSYGDAVELVMQGTSILGAESHPFHLHGFNFFVVGQGFGNFDPVHDPAKYNLVDPVERNTVGVPAAGWVAIRFRADNPGVWFMHCHLEVHVSWGLKMAWVVQDGSLPEQKLLPPPSDLPKC

SEQ ID NO: 1074 - protein, 572 aa, Hordeum vulgare subsp. vulgare
MAAILVAAVMVVVLSVNAAESSTVEYQFDVATMNVTRLCGSKSIVAVNGQFPGPTVSAREGDLVVVRVVNKAQYNMSIHWHGVRQIRSGWADGPAYITQCPIQPGQSYVYKFTVTGQRGTLWWHAHISWLRATVYGPIVILPKLGVPYPFAAPYKEVPLMFGEWWKADTEAVISQALQTGGGPNVSDAFTINGLPGPLYNCSAKDTFKLKVKPRKTYMLRIINAALNDELFFSIAGHPLTIVDVDAVYIKPITVETLIITPGQTTNVLLTAKPSYPGATYYMLAAPYSTAASGTFDNTTVAGILEYVDPSSPSSAGFNKNLPLLRPTLPQINDTSFVSNYTDKLRSLATEEYPAAVPQEVDRRFFFTVGLGTHPCAVNGTCQGPTNDSRFAAAVNNVSFVLPTTALLQSHYTGMSNGVYSSNFPAVPKSPFNYTGTPPNNTNVSNGTRLVVLSYGDAVELVMQGTSILGAESHPFHLHGFNFFVVGQGFGNFDPVHDPAKYNLVDPVERNTVGVPAAGWVAIRFRADNPGVWFMHCHLEVHVSWGLKMAWVVQDGSLPEQKLLPPPSDLPKC

SEQ ID NO: 1075 - protein, 587 aa, Zea mays
MAISSALPCSSLLMAAAQLMLLASVVVQVQGITRHYDFNVTMANVTRLCASKSIITVNGQFPGPKIVAREGDRLVIRVTNHAQHNISLHWHGIRQLRTGWADGPAYITQCPIQTGQSYVYNYTVVGQRGTLWWHAHISWLRATVYGPLVILPKLGVPYPFPAPYKEVPVIFGEWWLADTEVVIKQALQLGAGPNVSDAHTINGLPGPLYNCSAKDTYKLKVKPGKTYMLRLINAALNDELFFSVANHSLTVVEVDAVYVKPFTVDTLLIAPGQTTNVLLAAKPSYPGANYYMSAAPYSTARPATFDNTTVAGILEYELYPDAPRPSASAGSFNEALPLYRPTLPQLNDTSFVGNFTAKLRSLATPRYPAAVPRTVDRRFFFAVGLGTHPCPANATCQGPTNTTQFAASVNNVSFVLPTKALLHSHFTGLSSGVYSPDFPVAPLAPFNYTGTPPNNTNVASGTKLMVVPYGANVELVMQGTSILGVESHPLHLHGFNFFVVGQGYGNYDPVNDPSKFNLVDPVERNTVGVPAGGWVAIRFLADNPGVWFMHCHLEAHTTWGLRMAWLVLDGSLPHQKLLPPPSDLPKC

SEQ ID NO: 1076 - protein, 585 aa, Zea mays
MAMAISSALPCSLLVAALMLLASVVQVQGITRHYDFNVTMANVTRLCASKSIITVNGQFPGPKIVAREGDRLVIRVTNHAQHNISLHWHGIRQLRTGWADGPAYITQCPIQTGQSYVYNYTVVGQRGTLWWHAHISWLRATVYGPLVILPKLGVPYPFPAPYKEVPVIFGEWWLADTEVVIKQALQLGAGPNVSDAHTINGLPGPLYNCSAKDTYKLKVKPGKTYMLRLINAALNDELFFSVANHSLTVVEVDAVYVKPFTVDTLLIAPGQTTNVLLAAKPSYPGANYYMSAAPYSTARPATFDNTTVAGILEYELYPDAPRPSASAGSFNEALPLYRPTLPQLNDTSFVGNFTAKLRSLATPRYPAAVPRTVDRRFFFAVGLGTHPCPANATCQGPTNTTQFAASVNNVSFVLPTKALLHSHFTGLSSGVYSPDFPVAPLAPFNYTGTPPNNTNVASGTKLMVVPYGANVELVMQGTSILGVESHPLHLHGFNFFVVGQGYGNYDPVNDPSKFNLVDPVERNTVGVPAGGWVAIRFLADNPGVWFMHCHLEAHTTWGLRMAWLVLDGSLPHQKLLPPPSDLPKC

SEQ ID NO: 1077 - protein, 579 aa, Sorghum bicolor
MAISSALPCSLLMAALMLLASAVEVQGITRHYDFNVTMANVTRLCASKSIITVNGQFPGPKIVAREGDRLVIRVTNHAQHNISLHWHGIRQLRTGWADGPAYITQCPIQTGQSYVYNYTIVGQRGTLWWHAHISWLRATVYGPLVVLPKLGVPYPFPAPYKEVPVIFGEWWLADTEVVIQQALQLGAGPNVSDAHTINGLPGPLYNCSAKDTFKLKVKPGKTYMLRLINAALNDELFFSIANHSLTVVEVDAVYVKPFTVDTLVIAPGQTTNVLLAAKPFYPAANYYMTARTYSTGRPATFDNTTVAGILEYEYPDAPSAAASFNKALPLYRPALPQLNDTSFVGNFTAKLLSLATPEYPAAVPQTVDKRFFFTVGLGTHPCPANTTCQGPTNTTQFAASVNNVSFVLPTKALLHSHFAGLSSGVYESDFPVAPLAPFNYTGTPPNNTNVANGTKLMVIPYGTNVELVMQGTSILGIESHPLHLHGFNFFVVGQGYGNYDPVNDPPKFNLVDPVERNTVGVPAGGWVAIRFLADNPGVWFMHCHLEVHTTWGLRMAWLVLDGSLPHQKLLPPPSDLPKC

SEQ ID NO: 1078 - protein, 579 aa, Sorghum bicolor; identical to SEQ ID NO: 1077

SEQ ID NO: 1079 - protein, 587 aa, Zea mays; identical to SEQ ID NO: 1075

SEQ ID NO: 1080 - protein, 584 aa, Zea mays
MAISSALPCSSLLMAAAQLKLLASVVVQVQGITRHYDFNVTMANVTRLCATKSIVTVNGQFPGPKIVAREGDRLIIRVTNQAQHNISLHWHGIRQLRTGWADGPAYITQCPIQTGQSYVYNYTVAGQRGTLWWHAHISWLRATVYGPLVVLPRPGVPYPFPAPYKEVPVIFGEWWLADTEVVVEQALQLGAGPNVSDAHTINGLPGPLYNCSAKDTYKLKVKPGKTYMLRLINAALNDELFFSVANHSLTVVEVDAVYVKPFTVDTLPIAPGQTTNVLLAAKPFYPGANYYMSAKPYSTARPATFDNTTVAGILEYEYPDAPSSSAASFDKALPLHRPTLPQLNDTSFVGNFTAKLRSLATPQYPAAVPRTVDRAFFFTVGLGTHPCPGNATCLGPTNTTQFAAAVNNVSFVLPTRALLHSHFAGLSSGVYSSDFPVAPLTPFNYTGTPPNNTNVASGTKLMVVPYGANVELVLQGTSILGVESHPLHLHGFNFFVVGQGYGNYDPVNDPPKFNLVDPVERNTVGVPAGGWVAIRFLADNPGVWFMHCHLEVHTTWGLRMAWLVLDGSLPHQKLLPPPSDLPKC

SEQ ID NO: 1081 - protein, 585 aa, Zea mays; identical to SEQ ID NO: 1076

SEQ ID NO: 1082 - protein, 579 aa, Oryza sativa Japonica Group
MTMAISSALPSPLLLAASLLLLIVQAQGITRHYEFNVQMANATRLCNTKSMVTVNGQCPGPELVAREGDRVVIRVTNNVAHNISLHWHGVRQVRTGWADGPAYITQCPIQTGQSYVYNFTVAGQRGTLWWHAHISWLRATVYGALVILPKLGVPYPFPAPHKEVPVIFGEWWNADTEEVVNQAVQTGGGPNVSDAFTINGLPGPLYNCSAQDTFKLKVKPGKTYMLRLINAALNEELFFAVANHTLTVVEVDAVYVKPFTVDTLVISPGQTTNVLLTAKPYYPGANFYMSAAPYSTARPGTFGNTTVAGILEYENPAMSPSAASFVKGLPLFKPTLPQLNDTDFVTNFTDKLRSLATPEYPAAVPQSVDKRFFFTVGLGTLPCPANMTCQGPNNTQMAASMNNVSFVLPARALLQSHFTGLSSGVYAPDFPVAPLSPFNYTGTPPNNTNVKTGTKLLVLRYNTSVELVMQDTSILGIESHPLHLHGFNFFVIGQGFGNYDAVNDPAKFNLVDPVERNTVGVPAGGWVAIRFLADNPGVWFMHCHLEAHTTWGLRMAWLVLDGSHPNQKLLPPPSDLPKC

SEQ ID NO: 1083 - protein, 577 aa, Oryza sativa Japonica Group
MAISSALPSPLLLAASLLLLIVQAQGITRHYEFNVQMANATRLCNTKSMVTVNGQCPGPELVAREGDRVVIRVTNNVAHNISLHWHGVRQVRTGWADGPAYITQCPIQTGQSYVYNFTVAGQRGTLWWHAHISWLRATVYGALVILPKLGVPYPFPAPHKEVPVIFGEWWNADTEEVVNQAVQTGGGPNVSDAFTINGLPGPLYNCSAQDTFKLKVKPGKTYMLRLINAALNEELFFAVANHTLTVVEVDAVYVKPFTVDTLVISPGQTTNVLLTAKPYYPGANFYMSAAPYSTARPGTFGNTTVAGILEYENPAMSPSAASFVKGLPLFKPTLPQLNDTDFVTNFTDKLRSLATPEYPAAVPQSVDKRFFFTVGLGTLPCPANMTCQGPNNTQMAASMNNVSFVLPARALLQSHFTGLSSGVYAPDFPVAPLSPFNYTGTPPNNTNVKTGTKLLVLRYNTSVELVMQDTSILGIESHPLHLHGFNFFVIGQGFGNYDAVNDPAKFNLVDPVERNTVGVPAGGWVAIRFLADNPGVWFMHCHLEAHTTWGLRMAWLVLDGSHPNQKLLPPPSDLPKC

SEQ ID NO: 1084 - protein, 577 aa, Oryza sativa Indica Group
MAISSALPSPLLLAASLLLLIVQAQGITRHYEFNVQMANATRLCNTKSMVTVNGQCPGPELVAREGDRVVIRVTNNVAHNISLHWHGVRQVRTGWADGPAYITQCPIQTGQSYVYNFTVAGQRGTLWWHAHISWLRATVYGALVILPKLGVPYPFPAPHKEVPVIFGEWWNADTEEVVNQAVQTGGGPNVSDAFTINGLPGPLYNCSAQDTFKLKVKPGKTYMLRLINAALNEELFFAVANHTLTVVEVDAVYVKPFTVDTLVISPGQTTNVLLTAKPYYPGANFYMSAAPYSTARPGTFGNTTVAGILEYENPAMSPSAASFVKGLPLFKPTLPQLNDTDFVTNFTDRLRSLATPEYPAAVPQSVDKRFFFTVGLGTLPCPANMTCQGPNNTQMAASMNNVSFVLPARALLQSHFTGLSSGVYAPDFPVAPLWPFNYTGTPPNNTNVKTGTKLLVLRYNTSVELVMQDTSILGIESHPLHLHGFNFFVIGQGFGNYDAVNDPAKFNLVDPVERNTVGVPAGGWVAIRFLADNPGVWFMHCHLEAHTTWGLRMAWLVLDGSHPNQKLLPPPSDLPKC

SEQ ID NO: 1085 - protein, 577 aa, Hordeum vulgare subsp. vulgare
MAMTIYSGLHCSLLMATLTLLVVQAQGITRHYDFNIQMANVTRLCGTKSIVTVNGQFPGPELIAREGDRVHVRVTNHVAHNMSIHWHGVRQMRTGWADGPAYITQCPIQTGQTYVYKFTVTAQRGTLWWHAHISWFRSTVYGAIVILPKLGVPYPFPAPHKELPVIFGEWWLSDTEAIVSTALKVGGAPNISDAFTINGLPGPLYDCSAKDTFKLKVEPGKTYLLRLINAALNDELFFSVANHTLTVVEVDAVYVKPFTVKTLVISPGQTTNVLLATKPVYPGANFYMLARPYSTIRPGTFDNSTVAGILEYRNPGSPSSSSFDKALPIFKPMLPYYNDTNFVTNFTTKLRSLATKQYPAAVPQSVDRRFFFTIGLGTLPCPKNMTCQGPNGTQFAAAVNNVSLVLPSTALLQSHFTGLTSGVYAANFPVMPLSPFNYTGTPPNNTNVATGTKLLAVSFNTSVELVMQDTSILGIESHPLHLHGFNFFVVGQGFGNYDAVNDPAKFNLVDPVERNTVGVPAGGWVAIRFLADNPGVWFMHCHLEVHTTWGLRMAWLVQDGSKPSQKLLPPPSDMPKC

SEQ ID NO: 1086 - protein, 579 aa, Sorghum bicolor; identical to SEQ ID NO: 1068

SEQ ID NO: 1087 - protein, 551 aa, Oryza sativa Japonica Group
RVRPRVRNVQMANATRLCNTKSMVTVNGQCPGPELVAREGDRVVIRVTNNVAHNISLHWHGVRQVRTGWADGPAYITQCPIQTGQSYVYNFTVAGQRGTLWWHAHISWLRATVYGALVILPKLGVPYPFPAPHKEVPVIFGEWWNADTEEVVNQAVQTGGGPNVSDAFTINGLPGPLYNCSAQDTFKLKVKPGKTYMLRLINAALNEELFFAVANHTLTVVEVDAVYVKPFTVDTLVISPGQTTNVLLTAKPYYPGANFYMSAAPYSTARPGTFGNTTVAGILEYENPAMSPSAASFVKGLPLFKPTLPQLNDTDFVTNFTDKLRSLATPEYPAAVPQSVDKRFFFTVGLGTLPCPANMTCQGPNNTQMAASMNNVSFVLPARALLQSHFTGLSSGVYAPDFPVAPLSPFNYTGTPPNNTNVKTGTKLLVLRYNTSVELVMQDTSILGIESHPLHLHGFNFFVIGQGFGNYDAVNDPAKFNLVDPVERNTVGVPAGGWVAIRFLADNPGVWFMHCHLEAHTTWGLRMAWLVLDGSHPNQKLLPPPSDLPKC

SEQ ID NO: 1088 - protein, 568 aa, Sorghum bicolor
MASLSSTWLLLLLSCLALALLAADAEVHHHEFVVQETPVKRLCKTHNIITVNGQFPGPMLEVREGDTLVINVVNRAQYNVTIHWHGIRQMRTGWADGPEFVTQCPIKPGGSYKYRFTIEGQEGTLWWHAHSSWLRATVYGGLIIRPRENKTYPFAKPSREVPLILGEWWDANPIDVIREAQKTGGGPNVSDAFTINGQPGDLFKCSQKETTAIPVKAGETALLRFINAALNHELFVTIAQHKMTVVATDASYTKPFTTSVLMIAPGQTTDVLVTMDQAPTRYYVAARAYVSGQNVAFDNTTTTAVLEYDCGCASDFGPKIQPAFPALPAFNDTSAATAFAAGIKSPNRVKIHENVDEYLFFTVGLGLFNCKPGQLCKGPNNNTRFTASMNNVSFVFPKSDSLLHAHYYKVPGVFTTDFPAYPPVQFDYTGNVSQALWQPVPGTKLYPLRFGSVVQVVLQDTSIVTPENHPIHIHGYDFFILAEGFGNFDPKKDVEKFNYVDPPQRNTVAVPVNGWAVIQFVADNPGVWLMHCHLDVHITWGLAMAFLVEDGYGELQSLEPPPVDLPMC

SEQ ID NO: 1089 - protein, 572 aa, Zea mays
MASSSSSRLLLLLLPCLALTLLGAADAEVHHHEFVIQETPVKRLCKTHNIITVNGQYPGPTLEVREGDTLVINVVNRAQYNATIHWHGIRQIRTGWADGPEFVTQCPIRPGGSYKYRFTIQGQEGTLWWHAHSSWLRATVYGALIIRPRENKTYPFAKPSREVPVILGEWWDANPIDVIREAQRTGGGPNVSDAFTINGQPGDLYKCSNKETTAIPVEAGETALLRFINAALNHELFVTIAQHKMTVVATDASYTKPFTTSVLMLAPGQTTDVLVTMDQPPTRYYVAARAYVSGQNVAFDNTTTTAVLEYDCGCASDFGPKIQPAFPAALPAFNDTSAATAFAAGIRSPDRVKVHENVDEYLFFTVGLGLFNCKPGQLCAGPNNNTRFAASMNNVSFVFPQTDSLLHAHYYKIPGVFTTDFPAYPPVQFDYTGQNVSQALWQPVPATKLYPLRFGSVVQLVLQDTSIVTPENHPIHIHGYDFFILAEGFGNFDPKKDVEKFNYVDPPQRNTVAVPVNGWAVIQFVADNPGVWLMHCHLDVHITWGLAMAFLVEDGYGELQSLEPPPVDLPMC

SEQ ID NO: 1090 - protein, 571 aa, Zea mays
MTSPSSSSSWLLLLLSCLALALLAADAEVHHHEFVVQETPVKRLCKTHNVITVNGQYPGPTLEVREGDTLVINVVNRAQYNVTIHWHGIRQMRTGWADGPEFVTQCPIRPGGSYKYRFTIEGQEGTLWWHAHSSWLRATVYGALIIRPRENKTYPFAKPSREVPVILGEWWDANPIDVIREAQRTGGAPNVSDAFTINGQPGDLYKCSQKETTAIPVKPGETALLRFINAALNHELFVTIAQHRMTVVATDASYTKPFTTSVLMVAPGQTTDVLVTMDQAPARYYVAARAYVSGQNVAFDNTTTTAVVEYDCGCASDFGPKIQPAFPSLPAFNDTAAAAAFAAGIKSPGRVRVHESVDEHLFFTVGLGLFNCEPGQLCAGPNNSTRFTASMNNVSFVFPRTDSLLHAHYFKTPGVFTTDFPAHPPVQFDYTAQNVSQALWQPVPATKLYPLRFGSVVQLVLQDTSIVTPENHPIHIHGYDFFILAEGFGNFDPEKDVDKFNYVVPPQRNTVAVPVNGWAVIQFVADNPGVWLMHCHLDVHITWGLAMAFLVEDGYGELQSLEPPPVDLPMC

SEQ ID NO: 1091 - protein, 567 aa, Oryza sativa Japonica Group
MASSSSSRLLFLLSCSVLALLAGAEVHHHEFIVQETPVKRLCKTHNVITVNGQLPGPTLEVREGDTVVINVVNHAQYNVTIHWHGIRQFRTGWADGPEFVTQCPIKPGGSYKYRFTIEGQEGTLWWHAHSSWLRATVYGALIIRPRENKTYPFEKPAREVPLILGEWWDADPIQVIREAQRTGAAPNISDAYTINGQPGDLYNCSKEETTAVPVKPGETALLRFINAALNQELFVSIAQHKMTVVGVDASYTKPFTTSVLMIAPGQTTDVLVTMDQAPTRYYLAARAYDSAQGVAFDNTTTTAVIEYDCGCATDFGPSIPPAFPVLPAFNDTNTATAFAAGIRSPHEVKIPGPVDENLFFTVGVGLFNCEPGQQCGGPNNTRFTASMNNISFVFPQTTSLLHAHYYGIPGVFTTDFPAYPPVQFDYTAQNVPRYLWQPVPATKLYKLKFGSVVQIVLQDTSIVSPENHPIHIHGYDFYILAEGFGNFDPKKDAKKFNYVDPPQRNTVAVPTNGWAVIRFVADNPGVWLMHCHLDVHITWGLAMAFLVEDGYGKLETLEAPPVDLPMC

SEQ ID NO: 1092 - protein, 516 aa, Zea mays
MTSIVWSVYTLSRSWPAVSINARCMHGVCRHGIRQIRTGWADGPEFVTQCPIRPGGSYKYRFTIQGQEGTLWWHAHSSWLRATVYGALIIRPRENKTYPFAKPSREVPVILGEWWDANPIDVIREAQRTGGGPNVSDAFTINGQPGDLYKCSNKETTAIPVKAGETALLRFINAALNHELFVTIAQHKMTVVATDASYTKPFTTSVLMLAPGQTTDVLVTMDQPPTRYYVAARAYVSGQNVAFDNTTTTAVLEYDCGCASDFGPKIQPAFPAALPAFNDTSAATAFAAGIRSPDRVKVHENVDEYLFFTVGLGLFNCKPGQLCAGPNNNTRFAASMNNVSFVFPQTDSLLHAHYYKIPGVFTTDFPAYPPVQFDYTGQNVSQALWQPVPATKLYPLRFGSVVQLVLQDTSIVTPENHPIHIHGYDFFILAEGFGNFDPKKDVEKFNYVDPPQRNTVAVPVNGWAVIQFVADNPGVWLMHCHLDVHITWGLAMAFLVEDGYGELQSLEPPPVDLPMC

SEQ ID NO: 1093 - protein, 575 aa, Populus trichocarpa
MEVIKSIFADRHCSFFLVVLLLASTMSLAIAEIHHHDFVVQATKVKRLCKTHNSITVNGMFPGPTLEVKNGDTLVVKVVNKARYNVTIHWHGIRQMRTGWADGPEFVTQCPIRPGGSYTYRFNIEGQEGTLWWHAHSSWLRATVYGALIIHPREGSSYPFAKPKRETPILLGEWWDANPVDVVREATRTGAAPNISDAYTINGQPGDLYNCSSEDTTIVPIASGETNLLRVINAALNQPLFFTIANHKFTVIGADASYLKPFTTSVIMLGPGQTTDVLISGDQLPGRYYMAARAYQSAQNAPFDNTTTTAILEYKSALCPAKCTTKPVMPRLPAYNDTATVTAFSGSLRSPRKVEVPTDIDENLFFTIGLGLNNCPKNSRARRCQGPNGTRFTASMNNVSFVFPSNIALLQAYQQKVPGIYTTDFPAKPPVKFDYTGNVSRSLFQPVRGTKLYKLKYGSRVQIVLQDTSIVTPENHPIHLHGYDFYIIAEGFGNFNPKTHKSKFNLVDPPMRNTVAVPSNGWAVIRFVADNPGVWLMHCHLDVHITWGLAMAFLVEDGIGELQSVEPPPADLPIC

SEQ ID NO: 1094 - protein, 550 aa, Populus trichocarpa
MSLAIAKTHHHDFTVQATKVKRLCKTHNSITVNGMFPGPTLEVKNGDTLVVKVVNRARYNVTIHWHGIRQMRTGWADGPEFVTQCPIRPGGSYTYRFTIEGQEGTLWWHAHSSWLRATVYGALIIHPREGSSYPFSKPKRETPILLGEWWDANPIDVVREATRTGAAPNISDAYTINGQPGDLFNCSSKDTTIVPIDSGETNLLRVINAALNQPLFFTIANHKFTVVGADASYLKPFTTSVIMLGPGQTTDVLISGDQLPGRYYMAARAYQSAQNAPFDNTTTTAILEYKSVLCPAKCTKKPFMPPLPAYNDTATVTAFSRSFRSPRKVEVPTDIDENLFFTIGLGLNNCPKNFRARRCQGPNGTRFTASMNNVSFVFPSKASLLQAYKQKIPGVFTTDFPAKPQVKFDYTGNVSRSLFQPARGTKLYKLKYGSRVQIVLQDTSIVTPENHPIHLHGYDFYIIAEGFGNFNPKTDKSKFNLVDPPMRNTVAVPVNGWAVIRFVADNPGVWLMHCHLDVHITWGLAMAFLVEEGIGILQSVEPPPADLPIC

SEQ ID NO: 1095 - protein, 574 aa, Populus trichocarpa
MEVINRIFANRHCSFFLLLLLASAMSLAIAKTHHHDFTVQATKVKRLCKTHNSITVNGMFPGPTLEVKNGDTLVVKVVNRARYNVTIHWHGIRQMRTGWADGPEFVTQCPIRPGGSYTYRFTIEGQEGTLWWHAHSSWLRATVYGALIIHPREGSSYPFSKPKRETPILLGEWWDTNPIDVVREATRTGAAPNISDAYTINGQPGDLFNCSSKDTTIVPIDSGETNLLRVINAALNQPLFFTIANHKFTVVGADASYLKPFTTSVIMLGPGQTTDVLISGDQLPGRYYMAARAYQSAQNAPFDNTTTTAILEYKSVLCPAKCTKKPFMPPLPAYNDTATVTAFSRSFRSPRKVEVPTDIDENLFFTIGLGLNNCPKNFRARRCQGPNGTRFTASMNNVSFVFPSKASLLQAYKQKIPGVFTTDFPAKPQVKFDYTGNVSRSLFQPARGTKLYKLKYGSRVQIVLQDTSIVTPENHPIHLHGYDFYIIAEGFGNFNPKTDKSKFNLVDPPMRNTVAVPVNGWAVIRFVADNPGVWLMHCHLDVHITWGLAMAFLVEEGIGILQSVEPPPADLPIC

SEQ ID NO: 1096 - protein, 470 aa, Zea mays
MAGTEVEDPPAAALEVPAKRGLLRYNSPLAQVSLLGLICFCCPGMFNALSGLGGGGQVDPTIADNANTALYACFAVFGVLGGAAHNLLGPRATLLAGALTYPLYAGSFLYYNHRPGSQVFPVTAGALLGAGAGFLWAAQGAVMTSYPPPNRRGTYISLFWCLFNLGGVLGGLLPFALNYNRGDKKGSVSDGTYIAFMAFMLVGAALTVLVLPPARIVRDDGTRATRVTFSSPATEGAEILKLFANWKMLLALPAAWASNFFYTYQFNNVNSGLFTLRTRGLNNVFYWGAQMIGSAGIGYFLDFGFASRRKRGLFGVAAVAAVGTAIWGGGLANQLSYNAVPVPDPIDFKDGHRYAGPFLLYFSYGLLDAMFQSLIYWIIGALANDSQILSRYVGFYKGVQSAGAAVAWQVDRRHTPLMSQLIVNWGLMTISYPLLALLVFLAVKDESYSVSSVEDGREKDSKLSAPTSFH

SEQ ID NO: 1097 - protein, 426 aa, Zea mays
MFNALSGLGGGGQVDPTIADNANTALYACFAVFGVLGGAAHNLLGPRATLLAGALTYPLYAGSFLYYNHRPGSQVFPVTAGALLGAGAGFLWAAQGAVMTSYPPPNRRGTYISLFWCLFNLGGVLGGLLPFALNYNRGDKKGSVSDGTYIAFMAFMLVGAALTVLVLPPARIVRDDGTRATRVTFSSPATEGAEILKLFANWKMLLALPAAWASNFFYTYQFNNVNSGLFTLRTRGLNNVFYWGAQMIGSAGIGYFLDFGFASRRKRGLFGVAAVAAVGTAIWGGGLANQLSYNAVPVPDPIDFKDGHRYAGPFLLYFSYGLLDAMFQSLIYWIIGALANDSQILSRYVGFYKGVQSAGAAVAWQVDRRHTPLMSQLIVNWGLMTISYPLLALLVFLAVKDESYSVSSVEDGREKDSKLSAPTSFH

SEQ ID NO: 1098 - protein, 439 aa, Sorghum bicolor
MATTTEVEGPPPPPAKRGLLRYNSPLAQVSLLGLICFCCPGMFNALSGLGGGGQVDASTADNANTALYAFFAVFGVLGGAAHNLLGPRVTLMLGALTYPLYAGSFLFYNHHPHKQAFPVTAGALLGAGAGFLWAAQGAVMTSYPPPNRRGTYISLFWCLFNLGGVLGGLLPFSFNVLVLPPARIVRDDGTKATRVTFSSPATEGVEILKLFANWKMLLVLPAAWASNFFYTYQFNNVNGGLFTLRTKGLNNVFYWGAQMIGSAGIGYFLDFGFASRRKRGLVGVVAVAVLGTAIWGGGLANQLKYRTVPLLHPIDFKDGHRYAGPFLLYFSYGLLDAMFQSLIYWIIGALANDSQILSRYVGFYKGVQSAGAAVAWQVDKQHTPLISQLIVNWGLMTISYPLLVLLVFLAVKDEDYSVSSVEEDGKEKDSKLSAPTSFH

SEQ ID NO: 1099 - protein, 479 aa, Sorghum bicolor
MAVTDVEGTAAPAALELEVPAKRSILRYNSPLAQVSLLGLICFCCPGMFNALSGLGGGDQVDASTADKANTALYACFAVFAILGGGAQNLLGPRATLMLGALTYPLYAGSFLYYKHHPESQAFPVTAGALLGAGAGFLWAAQGAVMTSYPPPNRRGTYISLFWCIFNLGSVLGGLLPFSFNYHRSNKQPASVVNNSTYIAFIAFMLVGAGLTVLVLPPAKIVRDDGTKATTTTSRVVVVPFSSPAAAEGAEILKLFTNWKMLLVLLPAWASSSTGTLFFYTDQFNGGVFTLRTKGLNNVVFWGAQMIGSAGIGYFLDFGFASRRKRGLFGVVAVAVVGTAIWGGGLANQLKYRGVELVDPIDFKDGHHRYAGPFMLYFCYGLLDAMFQTVIYWIIGALAINDSQILSRYVGFFKGVQSAGAAVAWQVNRRHTPLRSQLIVNWALITVSYPLLALLVFVAVKDEDYSVSSVEDGKENDSN

SEQ ID NO: 1100 - protein, 467 aa, Oryza sativa Indica Group
MAVTAEVESSPAATGKLRYNSPLVQVSLIGLVCFCCPGMFNALTGLGGGGQLDHSTADNANTALYSCFAVFGVLGGAAHNLLGPRVTLLAGALTYPLYAASFLYYNHHPSRQAFPVTAGALLGVGAGLLWAAQGAIMTSYPPPSRRGSYISLFWCLFNLGGVLGGLLPFSLNYHRAADAASVNDATYIAFMAFMLLGAGLALLLLPASRIVRDDGSRATRMSYSSVSTEGWEILKLFANWRMLLVLPAAWASNFFYTYQFNNVNGRLFTLRTKGLNNVFYWGAQMLGSAAIGYFLDFGFGSSSRRRRGLCGVAAVAVLGTAIWAGGLANQLRYADGNWGERLIDFKDGRRYAGPFLLYFSYGLLDAMFQSLIYWIIGALANDTQILSRYVGFYKGVQSAGAAVAWQIDTHKTSLISQLIVNWALTTVSYPLLALLVFLAVKEEDSSVSSVEDGKEKDSKLSAPTSFH

SEQ ID NO: 1101 - protein, 474 aa, Hordeum vulgare subsp. vulgare
MAVTELPEAGSSPQEQATEATAPPRPGLRYNSPLVQVSLIGLVCFCCPGMFNALSGLGGGGQFDHTTADNANTALYACFAVFGVLGGAAHNLLGPRLTLLLGTLTYPLYAASFLYYNHRKSQVFPITAGALLGAGAGLLWAAQGAIMTSYPPPNRRGSYISLFWCLFNLGGVLGGLLPFSFNYTRTDAGSVNDATYAAFIAFMLLGAALTFLVLPPARIVRDDGTRATRVTYSSVSTEGWEILKLFANWRMLLILPAAWASNFFYTYQFNNVNGLLFTLRTKGLNNVFYWGAQMLGSAGIGYFLDFGFASRRKRGLMGVAAVAVLGTAIWAGGLANQLRYLDGTFPDQIDFKEGRRYAGPFLLYFSYGLLDAMFQSLIYWIIGALANDTQILSRYVGFYKGVQSAGAAVAWQVDTHKTSLLSQLIVNWGLTTVSYPLLAVLVLLAVKDEDYSVSNVDDAGKEKDTKMAAPSSFH

SEQ ID NO: 1102 - protein, 234 aa, Zea mays; identical to SEQ ID NO: 1057

SEQ ID NO: 1103 - protein, 232 aa, Zea mays; identical to SEQ ID NO: 1055

SEQ ID NO: 1104 - protein, 226 aa, Zea mays; identical to SEQ ID NO: 1054

SEQ ID NO: 1105 - protein, 219 aa, Zea mays; identical to SEQ ID NO: 1056

SEQ ID NO: 1106 - protein, 222 aa, Sorghum bicolor; identical to SEQ ID NO: 1053

SEQ ID NO: 1107 - protein, 576 aa, Sorghum bicolor
MAAPSSLAFLLFFGTLLALPQSSHGATRYYTFNVTMQKVTRLCTTRAIPTVNGKFPGPKIVTREGDRVVVKVVNNVKDNVTIHWHGVRQLRTGWSDGPAYVTQCPIQTGQSFVYNFTITGQRGTLFWHAHVSWLRATLYGPIVILPKRGVPYPFLPVKPYKEVPIIFGEWFNADPEAIIAQALQTGAGPNVSDAFTINGLPGPLYNCSSKDTFKLKVLPGKWYLLRLINAALNDELFFSIANHTLTVVDVDASYVKPFHTDIVLITPGQTTNVLLRAEPDAGCAAATHLMLARPYGTGQPGTFDNTTVAAVLEYAPAAAAGHIKSLPLFRPSLPALNDTAFAANYSARLRSLATPEFPATVPRAVDRSFFFAVGLGTNPCPANQTCQGPTNRTKFTASMNNVSFTMPTTALLQAHYDNIAGVYTADFPVAPLEPFNYTGTTPNNTNVSSGTKVVVLEYNTSVEVVLQGTSVLGAESHPLHLHGFDFFVVGQGFGNYDSSKDPAKFNLDDPVQRNTVGVPSGGWVAIRFFADNPGVWFMHCHLEVHTSWGLKMAWVVNDGPLPEQKLMPPPPDLPKC

SEQ ID NO: 1108 - protein, 576 aa, Zea mays
MGAAPPSSWLAFILFFGTLVALPQSSHGGGTTRHYTFNVTMKKVTRLCTTRAIPTVNGQFPGPKIVTREGDRVVVKVLNNVKDNVTIHWHGVRQLRTGWSDGPAYVTQCPIQTGQSFVYNFTITGQRGTLFWHAHVSWMRATLYGAIVILPKRGVPYPLPVKPYKDVPVIFGEWFNADPETIVAQALQTGAGPNVSDAFTINGLPGPLYNCSSKDTFKLKVLPGKWYLLRLINAALNDELFFSIANHTLTVVDVDAAYVKPFRTDIVLITPGQTTNVLLRAEPDAGCPAATHLMLARPYGTGQPGTFDNTTVAAVLEYAPPGHIRSLPLFRPSLPALNDTAFAANYSARLRSLATPDYPANVPRAVDRSFFFAVGLGTNPCPVNQTCQGPNGTMFTASMNNVSFNMPTTALLQAHYGSVAGVYTPDFPVAPLEPFNYTGTPPNNTNVSHGTKVVVLDYNTSVEVVLQATSILGAESHPLHLHGFDFFVVGQGFGNYDSSKDPPKFNLVDPVQRNTVGVPAGGWVAIRFFADNPGVWFMHCHLEVHTSWGLKMAWVVNDGPLPEQKLMPPPADLPKC

SEQ ID NO: 1109 - protein, 578 aa, Oryza sativa Japonica Group
MGARCLALLLLYGTLLLLLLLPQLPLAGAATRYYTFNVKLQNVTRLCNTRAIPTVNGKFPGPKIVTREGDRVVVKVVNNIKDNITIHWHGVRQMRTGWSDGPAYVTQCPIQTGQSYVYNFTINGQRGTLFWHAHVSWLRSTLYGPIIILPKAGLPLPFTEPHKDVPIIFGEWFNADPEAIVAQALQTGGGPNVSDAYTINGLPGPLYNCSSKDTFRLKVQPGKMYLLRLINAALNDELFFSVANHTLTVVDVDASYVKPFDTDVVLITPGQTTNVLLRAKPTAEAAGATHLMMARPYATGRPGTYDNTTVAAVLEYAPPGHIKSLPLLRPSLPALNDTAFAAGFAAKLRSLACPDYPSNVPRRVDKPFFFAVGLGTTPCPGSNNQTCQGPTNTTKFTASINNVSFDMPTTALLQAHYTGQSAGVYTADFPASPLEPFNYTGTPPNNTNVSNGTRVVVLPYNASVEVVLQDTSILGAESHPLHLHGFDFFVVGQGTGNYDPSKHPAEFNLVDPVQRNTVGVPAGGWVAIRFFADNPGVWFMHCHLEVHTTWGLKMAWVVNDGPLPEQKLMPPPSDLPMC

SEQ ID NO: 1110 - protein, 576 aa, Ricinus communis
MGSPFLLPKPSFLGVSLFILVTFCLLPEPAFGRTRHYKFDIKLQNVTRLCHTKSIVTVNGMFPGPRIVAREGDNLLIKVVNHVQNNISLHWHGIRQLRSGWADGPAYITQCPIQTGQHYLYNYTVVGQRGTLWWHAHISWLRSTLYGPIIIFPKRGVPYPFAKPYKEVPITFGEWFNADTETIIKQALQTGGGPNVSDAYTINGLPGPLYNCSAKDTFKLKVKTGKTYMLRLINAALNDELFFSIANHTLTVVDVDAVYVKPFETKILLIAPGQTTNVLLKTKPSFPNAAFFMTARPYVTGQGTFDNSTVAGILEYEPSTLSNKKLPLFKPSLPALNDTAFATNFTNRLRSLASAQFPANVPQVVDKQFFFTVGLGTNPCPKNQTCQGPNGTKFAASINNISFAMPTTALLQAHYSGQSKGVYSPYFPISPIIPFNYTGNPPNNTMVSNGTKLVVLSYNTSVELILQDTSILGAESHPLHLHGFNFFVVGQGFGNFDPKKDPAKYNLIDPVERNTVGVPSGGWVAIRFRADNPGVWFMHCHLEVHTSWGLKMAWVVLDGKLPNQKLRPPPADLPKC

SEQ ID NO: 1111 - protein, 584 aa, Vitis vinifera
MGASLLSSTAIFRVMFIVLNTLWLSPELASSAGVTRHYKFHIKLQNVTRLCHTKSIVSVNGQFPGPPIIAREGDQVVVKVINHVQNNVTIHWHGVRQLRSGWADGPAYVTQCPIQTGQTYVYNFTITGQRGTLFWHAHISWLRATLYGPIIILPKKNVPYPFVKPYKEVPIIFGEWWNADPEAVITQALQNGGGPNVSDAYTINGLPGPLYNCSAQDTFKLKVKPGRTYLLRLINAALNDELFFSIANHTLTVVDVDAIYVKPFKTDTILITPGQTTNLLLKAKPHFPNATFLMAARPYATGRGTFDNSTVTGLLHYETPPKSSPSASSFKNLPLFKPTLPPLNDTSFAANFTHKLRSLANSQFPANVPQKVDKRFFFTVGLGTNPCPQNQTCQGPNNSTKFSASVNNVSFVLPTTAILQAHFFQQSNGVYTTDFPATPIFPFNYTGTPPNNTMVNNGTKVVVLPFNTSVELVLQDTSILGIESHPLHLHGFNFFVVGQGFGNFDSKKDPPKFNLVDPVERNTVGVPSGGWVAIRFLADNPGVWFMHCHFEVHMSWGLKMVWMVMDGKLPNQKLPPPPSDLPQC

SEQ ID NO: 1112 - protein, 566 aa, Vitis vinifera
MALCLLPELALAQDSGITRHYKFDIKLQNVTRLCHTKSILTVNGQFPGPRIVAREGDRLLIKVVNHVQNNISIHWHGIRQLRSGWADGPAYVTQCPIQTGQSYVYNFTVVGQRGTLFWHAHISWLRSTLYGPLIILPKRNVPYPFEKPHKEVPIIFGEWWNADTEAVISQALQTGGGPNVSDAYTINGLPGPLYNCSAKDTFKLRVKASKTYLLRLINAALNDELFFSIANHTLTVVDADAIYVKPFETDTLLIAPGQTTNVLLKTKPHFPNAAFLITARPYVTGLGTFDNSTVAGILEYELPSASPHSTVSIKKLPLFKPTLPPLNDTSFATNFTNRLRSLASPQFPANVPQKVDRHFFFTIGLGTSPCDQNQTCQGPNGTKFAASVNNVSFASSTTALLQAHFSGQSNGVYNPDFPITPIIPFNYTGTPPNNTLVSNGTKVVVLPFNTSVELVMQDTSILGAESHPLHLHGFNFFVVGQGFGNYDPNKDPANFNLVDPIERNTVGVPSGGWVAIRFLADNPGVWFMHCHLEIHTSWGLKMAWVVLDGKLPNQKLLPPPADLPKC

SEQ ID NO: 1113 - protein, 583 aa, Vitis vinifera
MGSSLLSSAAMFRVLFLVLNSLWLFPELASAGITRHYKFNIKLQNVTRLCHTKNIVSVNGQFPGPRIIAREGDRVVVNVVNHVPNNVTIHWHGVRQLRSGWADGPAYVTQCPIQTGQTYVYNFTITGQRGTLFWHAHISWLRSTVYGPIIILPKKNVPYPFVKPYKEVPIIFGEWWNADPEAVITQALQNGGGPNVSDAYTINGLPGPLYNCSAQDTFKLKVKPGKTYLLRLINAALNDELFFSIANHTLTVVDVDAIYVKPFKTDTILITPGQTTNLLLKAKPHFPNATFLMAARPYATGRGTFDNSTVAGLLHYEPPQKSSPSASSFKNLPVFKPTLPPLNDTSFAANFTRKLRSLANSQFPANVPKKVDKRFFFTVGLGTSPCPQNQTCQGPNNSTKFSASVNNVSFVLPTTAILQAHFFQQSNGVYTTDFPATPIFPFNYTGTPPNNTMASNGTKVVVLPFNTTVELVLQDTSILGIESHPLHLHGFNFFVVGQGFGNFDSKKDPPKFNLVDPVERNTVGVPSGGWVAIRFVADNPGVWFMHCHLEVHTSWGLKMAWIVKDGKLPNQKLPPPPSDLPQC

SEQ ID NO: 1114 - protein, 584 aa, Vitis vinifera
MGASLLSSTAIFRVLFVVLNTLWLFPELASSAGITRHYKFNIKLQNVTRLCHTKSIVSVNGQFPGPHIIAREGDRVVVKVVNHVQNNVTIHWHGVRQLRSGWADGPAYVTQCPIQTGQTYVYNFTITGQRGTLFWHAHISWLRSTLYGPIIILPKKNVPYPFVKPYKEVPIIFGEWWNADPEAVITQALQNGGGPNVSDAYTINGLPGPLYNCSAQDTFKLKVKPGKTYLLRLINAALNDELFFSIANHTLTVVDVDAIYVKPFKTDTILITPGQTTNLLLKAKPHFPNATFLMAARPYATGRGTFDNSTVAGILHYEPPPKSSPSASSFKNLPLFKPTLPPLNDTSFAANFTGKLRSLANTQFPANVPQKVDQRFFFTVGLGTNPCPQNQTCQGPTNITMFSASVNNVSFVLPTTAILQAHFFQQSKGVYTTDFPTTPIFPFNYTGTPPNNTMVSNGTKVVVLPFNTSVELVLQDTSILGIESHPLHLHGFNFFVVGQGFGNFDSKKDPPKFNLVDPVERNTVGVPSGGWVAIRFLADNPGVWFMHCHLEVHTSWGLKMAWIVMDGKLPNQKLPPPPSDLPKC

SEQ ID NO: 1115 - protein, 571 aa, Zea mays; identical to SEQ ID NO: 1090

SEQ ID NO: 1116 - protein, 572 aa, Zea mays; identical to SEQ ID NO: 1089

SEQ ID NO: 1117 - protein, 568 aa, Sorghum bicolor; identical to SEQ ID NO: 1088

SEQ ID NO: 1118 - protein, 567 aa, Oryza sativa Japonica Group; identical to SEQ ID NO: 1091

SEQ ID NO: 1119 - protein, 516 aa, Zea mays; identical to SEQ ID NO: 1092

SEQ ID NO: 1120 - protein, 575 aa, Populus trichocarpa; identical to SEQ ID NO: 1093

SEQ ID NO: 1121 - protein, 577 aa, Vitis vinifera
MEALSCCIANSRSFLLGLLLLLASAVFFTEAETHHHDFVVQATPVKRLCKTHNTITVNGQYPGPTLEINNGDTLEVKVTNKARYNVTIHWHGIRQMRTGWADGPEFVTQCPIRPGGSYTYRFTVQGQEGTLWWHAHSSWLRATVYGALIIHPKPGSSYPFTKPKRETPILLGEWWDANPIDVVRQATRTGAAPNVSDAYTINGQPGDLYNCSSKDTVIVPIDSGETNLLRVINSGLNQELFFTVANHKFTVVSADASYTKPFTTSVIMLGPGQTTDVLITGDQPPARYYMAARAYQSAQGAPFDNTTTTAILEYKSAPCPAKKGVSTTPVFPSLPAFNDTATVTAFSKSFRSPAKVEVPTDIDESLFFTVGLGLNRCPPKFKSSQCQGPNGTRFTASMNNVSFVLPSNFSLLQAHQQGIPGVFTTDYPAAPPVKFDYTGNVSRSLWQPVPGTKLYKLKYGSRVQVVLQGTSIFTAENHPIHLHGYDFYIIAEGFGNFNPSTDTSKFNLVDPPLRNTVAVPVNGWAVIRFVADNPGVWLMHCHLDVHITWGLAMAFLVENGVGALQSIETPPADLPLC

SEQ ID NO: 1122 - protein, 576 aa, Vitis vinifera
MEALSCCIANSRSFLLGLLLLLASAVFFTEAETHHHDFVVQATPVKRLCKTHNTITVNGQYPGPTLEINNGDTLEVKVTNKARYNVTIHWHGIRQMRTGWADGPEFVTQCPIRPGGSYTYRFTVQGQEGTLWWHAHSSWLRATVYGALIIHPKPGSSYPFTKPKRETPILLGEWWDANPIDVVRQATRTGAAPNVSDAYTINGQPGDLYNCSSKDTVIVPIDSGETNLLRVINSGLNQELFFTVANHKFTVVSADASYTKPFTTSVIMLGPGQTTDVLITGDQPPARYYMAARAYQSAQGAPFDNTTTTAILEYKSAPCPAKKGVSTTPVFPSLPAFNDTATVTAFSKSFRSPAKVEVPTDIDESLFFTVGLGLNRCPPKFKSSQCQGPNGTRFTASMNNVSFVLPSNFSLLQAHQQGIPGVFTTDYPAAPPVKFDYTGNVSRSLWQPVPGTKLYKLKYGSRVQVVLQGTSIFTAENHPIHLHGYDFYIIAEGFGNFNPSTDTSKFNLVDPPLRNTVAVPVNGWAVIRFVADNPVWLMHCHLDVHITWGLAMAFLVENGVGALQSIETPPADLPLC

SEQ ID NO: 1123 - protein, 587 aa, Zea mays; identical to SEQ ID NO: 1075

SEQ ID NO: 1124 - protein, 585 aa, Zea mays; identical to SEQ ID NO: 1076

SEQ ID NO: 1125 - protein, 584 aa, Zea mays; identical to SEQ ID NO: 1080

SEQ ID NO: 1126 - protein, 579 aa, Sorghum bicolor; identical to SEQ ID NO: 1077

SEQ ID NO: 1127 - protein, 579 aa, Oryza sativa Japonica Group; identical to SEQ ID NO: 1082

SEQ ID NO: 1128 - protein, 577 aa, Oryza sativa Japonica Group; identical to SEQ ID NO: 1083

SEQ ID NO: 1129 - protein, 577 aa, Oryza sativa Indica Group; identical to SEQ ID NO: 1084

SEQ ID NO: 1130 - protein, 551 aa, Oryza sativa Japonica Group; identical to SEQ ID NO: 1087

SEQ ID NO: 1131 - protein, 577 aa, Hordeum vulgare subsp. vulgare; identical to SEQ ID NO: 1085

SEQ ID NO: 1132 - protein, 579 aa, Sorghum bicolor; identical to SEQ ID NO: 1068

SEQ ID NO: 1133 - protein, 544 aa, Sorghum bicolor
MATVTRLCVTKSIPTVNGRFPGPRIVVREGDRLVVQVHNNINNNVTFHWHGVRQLRSGWSDGPSFITQCPIRPGQSYAYDFRIVGQRGTLWWHAHFSWLRATLYGPLVILPPRGVPYPFPKPHAEVPLMLGEWFNADPEAVIKQALQTGGGPNVSDAYTFNGLPGPTYNCSGGGAGDTFKLRVKPGKTYLLRLVNAALNDELFFAVANHTLTVVQADASYVKPFTADTLVISPGQTMDVLLTAAAATAPSSTAAYAIAVAPYTNTVGTFDNTTAIAVLEYYGAPPQSAAALRNLPLPALPLYNDTGAVANFSAKFRSLASAQYPALVPRTVDRRFFFAVGLGADPCQSRVNGTCQGPNGTRFAATMNNVSFTMPKTSLLQAHYQRRYSGVLTANFPGVPPTPFNYTGTPPNNTFVTHGTRVVPLSFNTTVEVVLQDTSILGAESHPLHLHGYDFFVVGQGFGNYDAGNDTAKYNLVDPVQRNTISVPTAGWVAIRFVADNPGVWIMHCHLDVHLSWGLAMAWLVNDGPLPNQKLPPPPSDIPRC

SEQ ID NO: 1134 - protein, 582 aa, Zea mays
MAVGRRLSPACLLLLRLTVALVVLTALPELAAARTRRYTFNVTMATVTRLCVTKSVPTVNGQFPGPRLVVREGDRLVVQVHNNINSNVTFHWHGVRQLRSGWADGPSYITQCPIRPGQSYAYDFRIVGQRGTLWWHAHFSWLRATLYGPLVILPPRGVPYPFPKPDRQVTLMLGEWFNADPEAVIKQALQTGGAPNVSDAYTFNGLPGPTYNCSSGDDTFRLRVRPGRTYLLRLVNAALNDELFFAVANHTLTVVQADASYVKPFAAATLVISPGQTMDVLLTASASAAPSSAFAIAVAPYTNTVGTFDNTTAVAVVEYGPHQSAAALRSLPLPALPRYNDTAAVANFSAMFRSLASARYPARVPRTVDRRFFFTVGLGADPCRSRVNGTCQGPNGTRFAASMNNVSFAMPRTTSLLQAHYQRRYSGVLAANFPAVPPTRFDYTGAPPNNTFVTHGTRVVPLSFNTTVEVVLQDTSVLGAESHPLHLHGYDFFVVGTGFGNYDATNDTARYNLVDPVQRNTVSVPTAGWVAIRFVADNPGVWIMHCHLDVHLTWGLAMAWLVNDGPLPNQKLPPPPSDIPRC

SEQ ID NO: 1135 - protein, 540 aa, Oryza sativa Japonica Group
MATVTRLCVTKSVPTVNGQFPGPKLVVREGDTLVIRVTNNINNNVTFHWHGIRQVRSGWADGPAYITQCPIRSGGSYVYRFTVTGQRGTLWWHAHFSWLRATLYGPLVILPPRGVAYPFPKPHREVPLLLGEWFNADPEAVIKQALQTGGGPNVSDAYTFNGLPGPTYNCSSSNDTFKLRVRPGKTYLLRLINAALNDELFFGVANHTLMVVQADASYVKPFAATALVISPGQTMDVLLTAAANNPPSRSFAIAVAPYTNTVGTFDNTTAVAVLEYYGAATSAAALRSLPLPSLPAYNDTGAVANFSASFRSLASAQYPARVPRTVDRHFFFAVGLGADPCQSPVNGTCQGPNNTRFAASMNNVSFVMPRTSLLQAHYQRRYNGVLAANFPAAPRTPFNYTGTPPNNTFVTHGTRVVPLSFNTTVEVVLQDTSILGAESHPLHLHGYDFYVVGTGFGNYDASNDTAKYNLVDPVQRNTISVPTAGWVAIRFVADNPGVWIMHCHLDVHLSWGLSMAWLVNDGPLPNQKLPPPPSDIPMCS

SEQ ID NO: 1136 - protein, 513 aa, Oryza sativa Japonica Group
MATVTRLCVTKSVPTVNGQFPGPKLVVREGDTLVIRVTNNINNNVTFHWHGIRQVRSGWADGPAYITQCPIRSGGSYVYRFTVTGQRGTLWWHAHFSWLRATLYGPLVILPPRGVAYPFPKPHREVPLLLGEWFNADPEAVIKQALQTGGGPNVSDAYTFNGLPGPTYNCSSSNDTFKLRVRPGKTYLLRLINAALNDELFFGVANHTLMVVQADASYVKPFAATALVISPGQTMDVLLTAAANNPPSRSFAIAVAPYTNTVGTFDNTTAVAVLEYYGAATSAAALRSLPLPSLPAYNDTGAVANFSASFRSLASAQYPARVPRTVDRHFFFAVGLGADPCQSPVNGTCQGPNNTRFAASMNNVSFVMPRTSLLQAHYQRRYNGVLAANFPAAPRTPFNYTGTPPNNTFVTHGTRVVPLSFNTTVEVVLQDTSILGAESHPLHLHGYDFYVVGTGFGNYDASNDTAKYNLVDPVQRNTISVPTAGWVAIRFVADNPGWLPALYLYLHLKREFL

SEQ ID NO: 1137 - protein, 579 aa, Sorghum bicolor
MGSRHGLRRGGQAAAVFSACPFLAFAVLLALPGLAAGDTHYYTFNVQMTNVTRLCVTKSIPTVNGQFPGPKLVVREGDRLVVKVHNHINYNVSFHWHGVRQLRNGWADGPAYITQCPIQGGQSYVYDFTITGQRGTLWWHAHFSWLRVHLYGPLVILPKRGEGYPFPRPYKEVPILFGEWFNADTEAVINQALQTGGGPNVSDAYTFNGLPGPTYNCSSKDTYKLKVKPGRTYMLRLINSALNDELFFGIANHTLTVVEADANYVKPFTVNTLVISPGQTMNVLLTTPPNPASPAYAMAIAPYTNTQGTFDNTTAAAVLEYAPTTTTLPPLPLPALPLYNDTGAVTNFSRNFRSLNSAQYPAQVPAAVDRHLLFTVGLGTDPCPSNQTCQGPNGTKFAASINNNSFFRPRTALLEAHYQRRYAGVLLADFPTTPPHPFNYTGTPPNNTFVQHGTRVVPLRFNTSVELVLQGTSIQGAESHPLHLHGYDFFVVGQGFGNFDPVNDPPNYNLADPVERNTISVPTAGWVAVRFLADNPGVWLMHCHFDVHLSWGLSMAWLVNDGPLPNQKMLPPPSDLPKC

SEQ ID NO: 1138 - protein, 582 aa, Zea mays
MGARRGLRRGQAAAAAFSACPFLALAVVLLALPELAAGDTHYYTFNVQMTNVTRLCVTKSIPTVNGEFPGPKLVVREGDRLVVKVHNHINYNVSFHWHGVRQLRNGWADGPSYITQCPIQGGQSYVYDFTVTGQRGTLWWHAHFSWLRVHLYGPLVILPKRGEGYPFPRPYKEVPILFGEWFNADTEAVINQALQTGAGPNVSDAYTFNGLPGPTYNCSSKDTYKLKVKPGRTYMLRLINSALNDELFFGIANHTLTVVEADASYVKPFTVSTLVISPGQTMNVLLTTAPSPASPAYAMAIAPYTNTQGTFDNTTAAAVLEYAPTTTRNNTLPPLPALPLYNDTGAVSNFSRNFRSLNSARYPARVPVAVDRHLLFTVGLGTDPCPYTNQTCQGPNGTKFAASVNNNSFFRPRTALLEAHYRRRYAGVLLADFPTAPPHPFNYTGTPPNNTFVQHGTRVVPLRFNASVELVLQGTSIQGAESHPLHLHGYNFFVVGQGFGNFDPVNDPPGYNLADPVERNTISVPTAGWVAVRFLADNPGVWLMHCHFDVHLSWGLSMAWLVNDGPLPNEKMLPPPSDLPKC

SEQ ID NO: 1139 - protein, 588 aa, Zea mays
MGARRGLRRGQAAAAAFSACPFLALAVVLLALPELAAGDTHYYTFNVQMTNVTRLCVTKSIPTVNGEFPGPKLVVREGDRLVVKVHNHINYNVSFHWHGVRQLRNGWADGPSYITQCPIQGGQSYVYDFTVTGQRGTLWWHAHFSWLRVHLYGPLVILPKRGEGYPFPRPYKEVPILFGEWFNADTEAVINQALQTGAGPNVSDAYTFNGLPGPTYNCSSKDTYKLKVKAREGRTCSRLHQLRPQTNELFFGIANHTLTVVEADASYVKPFTVSTLVISPGQTMNVLLTTAPSPASPAYAMAIAPYTNTQGTFDNTTAAAVLEYAPTPPPVATRNNTLPPLPALPLYNDTGAVSNFSRNFRSLNSARYPARVPAAVDRHLLFTVGLGTDPCPYTNQTCQGPNGTKFAASVNNNSFFRPRTALLEAHYRRRYAGVLLGDFPTAPPHPFNYTGTPPNNTFVQHGTRVVPLRFNASVELVLQGTSIQGAESHPLHLHGYNFFVVGQGFGNFDPVNDPPGYNLADPVERNTISVPTAGWVAVRFLADNPGVWLMHCHFDVHLSWGLSMAWLVNDGPLPNEKMLPPPSDLPKC

SEQ ID NO: 1140 - protein, 719 aa, Zea mays; identical to SEQ ID NO: 1060

SEQ ID NO: 1141 - protein, 720 aa, Sorghum bicolor; identical to SEQ ID NO: 1058

SEQ ID NO: 1142 - protein, 720 aa, Zea mays; identical to SEQ ID NO: 1059

SEQ ID NO: 1143 - protein, 721 aa, Oryza sativa Japonica Group; identical to SEQ ID NO: 1061

SEQ ID NO: 1144 - protein, 725 aa, Hordeum vulgare subsp. vulgare; identical to SEQ ID NO: 1062

SEQ ID NO: 1145 - protein, 737 aa, Vitis vinifera; identical to SEQ ID NO: 1064

SEQ ID NO: 1146 - protein, 707 aa, Oryza officinalis; identical to SEQ ID NO: 1063

SEQ ID NO: 1147 - protein, 721 aa, Populus trichocarpa; identical to SEQ ID NO: 1065

SEQ ID NO: 1148 - protein, 738 aa, Arabidopsis lyrata subsp. lyrata; identical to SEQ ID NO: 1066

SEQ ID NO: 1149 - protein, 721 aa, Populus trichocarpa; identical to SEQ ID NO: 1067

SEQ ID NO: 1150 - protein, 547 aa, Sorghum bicolor
MATCQCPELAQCHHRALLPTAKSYPKLHDRPRPAPGTGTGTGSVLAEVAAILCLTGPMVGAGILFYMRSLVSMVFLGRLGQLPLAGGSLALGFANITGYSVLSGLAGGMDPVCGQAFGAGRTDLLRTALRRTVLLLLAACVPIAMLWVAMHRVLVSTGQDPDIAATAYAYILWCLPDLVLQCFLHPIRIYLRAQSVTLPLTYGAAAALLLHVPINFLLVSVLGLGIRGVALGGVWTNLNFLLFLVAYVYLRGMYGAHDDDGSAKKGGASVAAPPPAEEEVGANSKEWWSLVRLCVHSCMSVCLEWWWYEIMVLLCGVLIDPKAAVAAMGVLIQTTSLIYIFPHSLGCAVSTRVGHELGARRPERARLVARVGLGLGAALGLVACAFAVSVRGVWARMFTADEAILKLAAAALPLLGMAELGNCPQTAGCGVLRGSARPEKAARINVSAFYGVGMPVALALAFWPAGLDFRGMWGGMLAAQLVCAALMLRAVLGTDWAEQTERARQLTGGGRGDGFDVVGIVDEDKTSHAEAAKAEVGNALFMVADCV

SEQ ID NO: 1151 - protein, 532 aa, Zea mays
MATCQCPEPAQCHHRPLLSSTADTYPELHDRPRPAPGSVLAEVAAILCLTGPMVGAGILFYMRSLVSMVFLGRLGQLPLAGGSLALGFANITGYSVLSGLAGGMDPVCGQAFGAGRTDLLRAALRRTVLLLLAASVPIGLLWAAMHRVLVSTGQDPDIAATAYAYILCCLPDLVLQCFLHPIRIYLRAQSVTLPLTYGAAAALLLHVPINFLLVSGLGLGVRGVALGGVWTNLNFLLFLVAYVYFRGMYGAHDDGGAKKGASVAPPTPAEGEWWSLVRLCVHSCMSVCLEWWWYEIMVLLCGVLIDPKAAVAAMGVLIQTTSLIYIFPHSLGCAVSTRVGHELGARRPERARLVARVGLGLGAALGLVACAFAVSVRGIWARMFTADEAILRLAAAALPLLGTAELGNCPQTAGCGVLRGSARPEKAARINVSAFYGVGMPVALALAFWPARLDFRGMWGGMLAAQLVCAALMLRAVLGTDWAEQTERARQLTGGRGGGFDVVGIVDEDKTSHAEAAKAEVGNTLFVVADCV

SEQ ID NO: 1152 - protein, 541 aa, Oryza sativa Japonica Group
MASRHSDEATQCHQQLLVMPAATASYPKLHDRPRLAGAAAGVLGEVASILCLAGPMVGAGILLYLRSLVSMVFLGRLGQLPLAGGSLALGFANITGYSVLSGLAGGMDPVCGQAFGAGRTDLLRAALRRTVVLLLAASVPISALWVAMHRVLVATGQDPDIAATAYAYILCSLPDLAVQCFLHPIRIYLRAQSVTLPLTYAAAAALLLHVPINVVLVDRLGLGIRGVALGAVCTNLNCLLFLAAYVCLSGMYGGRAKACASAAAPAAGEEDDDGGVREWWSLVRLSVHSCMSVCLEWWWYEIMVLLCGVLADPKAAVAAMGVLIQTTSLIYIFPHSLGCAVSTRVGHELGAGRPERARLVARVGVGLGAALGIVAFGFAVSVRAAWARMFTAEDAILRLAAAALPLLGAAELGNCPQTAGCGVLRGSARPERAARINVAAFYGVGMPVALALAFWPAGLDFRGMWGGMLAAQLVCAWLMLRAVLGTDWAEQAERARELTGGGDGYAAVAAVIVDDDKAKQHAEMDKPQQVDNTLLMAIDCV

SEQ ID NO: 1153 - protein, 534 aa, Oryza brachyantha
MAICDKEEAAQCLHQLLIVPESYPKLHDRPRLAAAGAGVLGEVASIFRLTGPMVGAGILLYLRSLVSMIFLGRLGQLPLAGGSLALGFANITGYSVLSGLAGGMDPVCGQAFGAGRTDLLRAALRRTVVLLLAASVPISALWVAMHRVLVATGQDPDIAATAYAYILCSLPDLAVQCFLHPIRIYLRAQSVTLPLTYAAAAALLFHVPINFVLVDRLGLGIRGVALGAVCTNLNCLLFLAAYVCLSGMYGRDGDGGMATAKGCEEDGGVVREWWSLVRLSVHSCMSVCLEWWWYEIMVLLCGVLADPKAAVAAMGVLIQTTSLIYIFPHSLGCAVSTRVGHELGAGRPDRARLVARVGLGLGAALGLVAFAFAVSVRAAWGRMFTTEDAILKLAAAALPLLGAAELGNCPQTAGCGVLRGSARPEKAARINVSAFYGAGMPVALALAFWPVGLDFRGMWGGMLAAQLVCAWLMLRAVLGTDWAEQTERARVLTGGRDDGYAVVVVVHDDTAKPHAEMAKSEADTNTLLMAIDRV

SEQ ID NO: 1154 - protein, 544 aa, Oryza sativa Indica Group
MASRHSDEATQCHQQLLVMPAATASYPKLHDRPRLAGAAAGVLGEVASILCLAGPMVGAGILLYLRSLVSMVFLGRLGQLPLAGGSLALGFANITGYSVLSGLAGGMDPVCGQAFGAGRTDLLRAALRRTVVLLLVASVPISALWVAMHRVLVATGQDPDIAATAYAYILCSLPDLAVQCFLHPIRIYLRAQSVTLPLTYAAAAALLLHVPINVVLVDRLGLGIRGVALGAVCTNLNCLLFLAAYVCLSGMYGGRAKACASAAAPAAGEEDDDGGVREWWSLVRLSVHSCMSVCLEWWWYEIMVLLCGVLADPKAAVAAMGVLIQTTSLIYIFPHSLGCAVSTRVGHELGAGRPERARLVARVGVGLGAALGIVAFGFAVSVRAAWARMFTAEDAILRLAAAALPLLGAAELGNCPQTAGCGVLRGSARPERAARINVAAFYGVGMPVALALAFWPAGLDFRGMWGGMLAAQLVCAWLMLRAVLGTDWAEQAERARELTGGGGGGDGYAAVAAVIVYDDKAKQHAEMDKPQQVDNTLLMAIDCV

SEQ ID NO: 1155 - protein, 532 aa, Sorghum bicolor
MCHCHCSEPTQCHHQVLLPPTKACPALGDRPRPARRGDGGAPTEVIASILRLAVPMVGAGLLMYMRSLVSMLFLGTLGRLPLAGGSLALGFANITGYSVLSGLAAGMDPVCGQAFGAGRTSVLTAALRRTVVLLLAASVPITLLWLAMHRALVATGQDPDIAAAAYDFILCSLPDLVVQSFLHPLRVYLRAQSVTLPLTYAAAAALLLHVPVNCLLVHSLRLGIRGVALGAVCTNLNFLLFLVAYVYLTGLMRHGDDGGNGKADALMCATPPPAEDVEWGCLLRLSLHSCMSVCLEWWWYEIMVLLCGVLADPKAAVAAMGILIQTTSLLYIFPHSLSCAVSTRVGHELGAGRPERARLVARVGLCCGAALGLLACAFAASVRGVWARMFTTDAAILRLASAALPILGAAELGNCPQTAGCGVLRGSARPGKAARINVSAFYGVGMPAALALAFWPARLDFAGMWAGMLAAQLVCAALMLHAVLRTDWDEQAVRASVLTGGGIVVVADVKSGHADAAKVKANNGMLVVTVLT

SEQ ID NO: 1156 - protein, 554 aa, Oryza sativa Japonica Group
MDKRRKASLHNILNHLHPRNAIDDRVVAVAQCHQPLLPPPEACPALHDRPRSARGGGGAIAEVASIVRLAMPMVGAGLLMYMRSLVSMLFLGRLGRLPLAGGSLALGFANITGYSVLSGLAAGMDPVCGQAFGAGRTSVLAAALRRTVVLLLAASVPIAALWLAMHRVLVAAGQDPDIAACAYEFILCSLPDLAVQSFLHPLRVYLRAQSITLPLTYAAAAALALHVPVNVLLVHGLGLGIRGVALAAVWTNLNFLLFLVAYAYFSGLIRGDDDDDGGNGKAGEEGATTTTTTMEWGWLVKLSVHSCMSVCLEWWWYEIMVLLCGVLADPKAAVAAMGILIQTTSLLYIFPHSLSCAVSTRVGHELGAGRPERARLAARVGLACGAALGVVACAFAASLRGVWARMFTADATILRLASSALPILGAAELGNCPQTVGCGVLRGSARPGRAARINVSAFYGVGMPAALALAFWPARLDFRGMWAGMLAAQLVCAALMLLAVRRTDWDEQAARAREITGAVAGVVVGDGDVVVKGDHADAAKVKADSGLLVVTVLS

SEQ ID NO: 1157 - protein, 584 aa, Zea mays; identical to SEQ ID NO: 1080

SEQ ID NO: 1158 - protein, 587 aa, Zea mays; identical to SEQ ID NO: 1075

SEQ ID NO: 1159 - protein, 585 aa, Zea mays; identical to SEQ ID NO: 1076

SEQ ID NO: 1160 - protein, 579 aa, Sorghum bicolor; identical to SEQ ID NO: 1077

SEQ ID NO: 1161 - protein, 579 aa, Oryza sativa Japonica Group; identical to SEQ ID NO: 1082

SEQ ID NO: 1162 - protein, 577 aa, Oryza sativa Japonica Group; identical to SEQ ID NO: 1083

SEQ ID NO: 1163 - protein, 577 aa, Oryza sativa Indica Group; identical to SEQ ID NO: 1084

SEQ ID NO: 1164 - protein, 577 aa, Hordeum vulgare subsp. vulgare; identical to SEQ ID NO: 1085

SEQ ID NO: 1165 - protein, 551 aa, Oryza sativa Japonica Group; identical to SEQ ID NO: 1087

SEQ ID NO: 1166 - protein, 579 aa, Sorghum bicolor; identical to SEQ ID NO: 1068

SEQ ID NO: 1167 - protein, 516 aa, Zea mays; identical to SEQ ID NO: 1092

SEQ ID NO: 1168 - protein, 572 aa, Zea mays; identical to SEQ ID NO: 1089

SEQ ID NO: 1169 - protein, 568 aa, Sorghum bicolor; identical to SEQ ID NO: 1088

SEQ ID NO: 1170 - protein, 571 aa, Zea mays; identical to SEQ ID NO: 1090

SEQ ID NO: 1171 - protein, 567 aa, Oryza sativa Japonica Group; identical to SEQ ID NO: 1091

SEQ ID NO: 1172 - protein, 312 aa, Zea mays
MGSGRNGAVVRRYVRSKEPRMRWSADLHRSFVQAIDSLGGQHKATPKLILQFMGARGLTISHVKSHLQMYRAASLGAERGGGTPAQLLQRRYSCSGDERGGPKEEFLCCPPPPPLKRARMGYESMQGSHGVSDARTTAGGGGLYCIDDYMQAMAVGWRIKEEGLIRWQRRDAAAATPSNLQAMGCLVQESGPFKQVRRPEAHRLGSALKQQDGDDSSKEDGNDGRPQSSNAATKEDEASEQCSLSLSLGNLDAKCGRGMAAAASSRSGESSCILTASPARRSSSDCSGHSGCFVVGPGGVVSLELSLSICGS

SEQ ID NO: 1173 - protein, 312 aa, Sorghum bicolor
MGSGGGGRNGAVARRYIRSKEPRMRWSADLHRSFLQAIDCLGGQHKATPKLILQFMGVKELTISHVKSHLQMHRAARLGAGRGGPGMQRRHSCTGDEQGPKEEEFLCPPPPLKRVRMGYDESMQGSHGVSDARTTAAAAGGLYCIDDYMQAMASMGRRIKEEGLIRWQRRDAAADAPATIAAATPSNLQAMGCLVQESDPFKIRRPEARHLGSALIQQDASNKEDGSGCPLFSSFSIAAKDEPSEQCSLSLSLGLDPRCARAMTAASSPSGESSCILMASPERRSSSDCSGHSGCFVGPGVSLELSLSICGS

SEQ ID NO: 1174 - protein, 481 aa, Sorghum bicolor
MDGSSSKVVELKPHGDVAEEDPARRGGPGTDEADDNEKAPRRSRRVASLDVFRGLTVALMILVDGAGGEWPVIGHAPWNGCNLADFVMPFFLFIVGMAIPLSLKRIPDRGRAVRRVVIRTLKLLFWGILLQGRYSHAPDELTYGVDMKHVRWGGILQRIALAYLVVAVLEIVTKDAKIQDQSSSGFSIFRMYLSQWIVACCILVIYLALVYGIYVPDWEFRVRNVDSPNYGKVLTVTCGTRGILDPPCNAVGYIDRKVLGINHMYQKPAWRRHRACTDDSPHEGHFRNDAPAWCVAPFEPEGILSSLSAVLSTIIGVHYGHVLVHMKSHTDRLRQWVTMGICLLVLGIILHFSHAIPLNKQLYTFSYICVTAGAAGVVFSVLYFLVDIVSLRYVFAPLQWIGMNAMLVYVMAAEGIFEGFLNGWYYEGTNNTLVYWVRKHVFVKVWHSTRVGILLYVLFAQILFWSLVSGVLHRAGLYWKL

SEQ ID NO: 1175 - protein, 484 aa, Zea mays
MDDGSSNKVVEDVAEEDPGRRGGPWRTDEADANEKAPRPSRRVASLDVFRGLTVALMILVDGAGGEWPVIGHAPWNGCNLADFVMPFFLFIVGMAVPLALKRIPDRGRAVRRVVVRTLKLLFWGILLQGGYSHAPDELAYGVDMRHVRWGGILQRIALAYLVVAVLEMVTKDGAKVHQDQPPGSSGRFSRVFRMYLSQWIVACCILVVYLSLAYGVYVPDWEFRVRNADSPDYGKVLTVRCGTRGALDPPCNAVGYIDRRVLGINHMYQKPAWRRHRACTDDSPHEGPFREDAPAWCVAPFEPEGILSSLSAVLSTVVGVHYGHVLVHMKSHTDRLRQWVTMGVALLVLGIILHFSHAIPLNKQLYTFSYICVTAGAAGVVFSALYFLVDVVSLRYAFAPLRWVGMNAMLVYVMAAEGVFEGFLNGWYYESTNNTLVYWVRKHVFVKVWHSTRVGILLYVLFAQILFWALVSGVLHRARLYWKL

SEQ ID NO: 1176 - protein, 486 aa, Hordeum vulgare subsp. vulgare
MDGGQNVAKRHAPGAEEDPDRHRTHEAADDLDDDGEKKASRPSSSSSRRVASLDVFRGLTVALMILVDGAGGEWPVIGHAPWHGCNLADFVMPFFLFIVGMAIPLSLKRIPDRGWAVRRVVIRTLKLLFWGILLQGGYSHAPDELTYGVDMKHIRWCGILQRIALAYLVVAVIEIATKDARVQDQSSSGFFSVFRLYLSQWIVACCILLIYLSLVYGVYVPDWEFTVRNVDSPNYGKVLTVTCGTRGNLSPPCNAVGYIDRKVLGINHLYQKPAWRRHRDCTDDSPHEGPFKRDAPAWCASPFEPEGLLSSFSAVLSTIIGVHYGHVLVHMKSHMDRLKQWVTMGVALLLLGIILHFSHAIPLNKQLYTLSYICVTAGAAGIIFSMLYFLVDVVHLRYVFAPLRWVGMNAMLVYVMAAAGIFEGFLNGWYYDGPNNTLVYWVRKHVFVRVWHSARVGILLYVLVAQILLWALIAGLLHRAGVYWKL

SEQ ID NO: 1177 - protein, 488 aa, Oryza sativa Japonica Group
MDGGGQGVARRHGAVAEEDPDRRRGDRSGKEGDDDGVDVDEKAPPPRRTSRRVASLDVFRGLTVALMILVDGAGGEWPVIGHAPWNGCNLADFVMPFFLFIVGMAIPLSLKRIPDRGRAVRRVVLRTLKLLFWGILLQGGYSHAPDDLSYGVDMKHVRWCGILQRIALAYLVVAVLEIVTKNAKVQDQSSSGFSIFRMYFSQWIVACCILVIYLSLVYGIYVPDWDFRVSDVKNPNFGKILTVTCGTRGKLSPPCNAVGYIDRKVLGINHMYHRPAWRRHKDCTDDSPHEGPFKTDSPAWCYAPFEPEGLLSSLSAVLSTIIGVHYGHVLVHMKSHTDRLKQWSIMGITLLILGLTLHFSHAIPLNKQLYTFSYICVTAGAAGIVFCMFYFLVDILNLHYPFAPLKWTGMNAMLVYVMAAAGIFEGFLNGWYYEGTNNTLVYWVRKHVFVKVWHSTRVGILLYVLFAQILFWALVAGLLHRARLYWKL

SEQ ID NO: 1178 - protein, 414 aa, Oryza sativa Japonica Group
MGGPPPPPQGAAGQPPQWGAIPPPMPPHQYGAPPPQQPPAMWGQPPPQAHYGQVPPPQPYYAAPPPQAMPAPAAADEVKTLWIGDLQPWMDESYIYNCFAATGEVQSVKLIRDKQSGQLQGYGFVEFTSRAAADRILQTYNGQMMPNVEMVFRLNWASAGEKRDDTPDYTIFVGDLAADVTDYLLQETFRVHYPSVKGAKVVTDKMTMRSKGYGFVKFGDPTEQARAMTEMNGMLCSSRPMRIGPAANKKTTGVQERVPNAQGAQSENDPNNTTIFVGGLDPNVTEDVLKQVFAPYGEVVHVKIPVGKRCGFVQYVNRPSAEQALAVLQGTLIGGQNVRLSWGRSLSNKQPQHDSNQWGAGAGAGGYYGGYGQGYEAYGGYAQPQDPNMYGYGAYAGYPNYQQQQVAQQQPPQQ

SEQ ID NO: 1179 - protein, 425 aa, Oryza sativa Japonica Group
MQQPPSQPQPGMGGPPPPPQGAAGQPPQWGAIPPPMPPHQYGAPPPQQPPAMWGQPPPQAHYGQVPPPQPYYAAPPPQAMPAPAAADEVKTLWIGDLQPWMDESYIYNCFAATGEVQSVKLIRDKQSGQLQGYGFVEFTSRAAADRILQTYNGQMMPNVEMVFRLNWASAGEKRDDTPDYTIFVGDLAADVTDYLLQETFRVHYPSVKGAKVVTDKMTMRSKGYGFVKFGDPTEQARAMTEMNGMLCSSRPMRIGPAANKKTTGVQERVPNAQGAQSENDPNNTTIFVGGLDPNVTEDVLKQVFAPYGEVVHVKIPVGKRCGFVQYVNRPSAEQALAVLQGTLIGGQNVRLSWGRSLSNKQPQHDSNQWGAGAGAGGYYGGYGQGYEAYGGYAQPQDPNMYGYGAYAGYPNYQQQQVAQQQPPQQ

SEQ ID NO: 1180 - protein, 426 aa, Oryza sativa Indica Group
MMQQPPSQPQPGMGGPPPPPQGAAGQPPQWGAIPPPMPPHQYGAPPPQQPPAMWGQPPPQAHYGQVPQPQPYYAAPPPQAMPAPAAADEVKTLWIGDLQPWMDESYIYNCFAATGEVQSVKLIRDKQSGQLQGYGFVEFTSRAAADRILQTYNGQMMPNVEMVFRLNWASAGEKRDDTPDYTIFVGDLAADVTDYLLQETFRVHYPSVKGAKVVTDKMTMRSKGYGFVKFGDPTEQARAMTEMNGMLCSSRPMRIGPAANKKTTGVQERVPNAQGAQSENDPNNTTIFVGGLDPNVTEDVLKQVFAPYGEVVHVKIPVGKRCGFVQYVNRPSAEQALAVLQGTLIGGQNVRLSWGRSLSNKQPQHDSNQWGAGAGAGGYYGGYGQGYEAYGGYAQPQDPNMYGYGAYAGYPNYQQQQVAQQQPPQQ

SEQ ID NO: 1181 - protein, 434 aa, Zea mays
MMQQPPQPQPGMALPPPPQTGGGQPPQWGAIPPPMTQQYGAPPPQQPPAMWGQPPSQAHYGQAPPPQPYYAAPPVPAAPAAADEVRTLWIGDLQYWMDDNYVFGCFSNTGEVQNVKLIRDKNSGQLQGYGFVEFTSRAAAERVLQTYNGQMMPNVDLTFRLNWASAGEKRDDTPDYTIFVGDLAADVTDYLLQETFRVHYPSVKGAKVVTDKLTMRTKGYGFVKFGDPTEQARAMTEMNGMPCSSRPMRIGPAASRKNAGGVVQERVPNSQGAQSENDPNNTTIFVGGLDPNVTEDVLKQAFSPYGEVIHVKIPVGKRCGFVQFVTRPSAEQALLMLQGALIGAQNVRLSWGRSLSNKQTQPQQESMQWGAGAPAGVGDYYGGYGQGYEAYGSGYAQPQDPNMYGYGAYVGYPNYQQQPAAQQPQQQQVKLLAN

SEQ ID NO: 1182 - protein, 436 aa, Hordeum vulgare subsp. vulgare
MMQPPPPSQPQPGMGAPMPPQGAGGQPPHWGAIPPPMPHYAQPPPQQQPPPQAMWGQPPPQAAPYGQVPAPQQYYAAPQAPAAPAASDEVRTLWIGDLQYWMDENYIYSCFANTGEFQSVKLIRDKQTGQLQGYGFVEFASHAAAERVLQTFNGQMMPNVELAYRLNWASAGEKRDDTPDYTIFVGDLAADVTDYMLQETFRVHYPSVKGAKVVTDKMTMRSKGYGFVKFGDPTEQARAMTEMNGMPCSSRPMRIGPAANRKTTGVQERVPIPNTNTQGAQSDNDPNNTTIFVGGLDPNVTEDALKQVFAPYGEVVHVKIPVGKRCGFVQYANRPSAEQALQLLQGTLVGGQNVRLSWGRSPSNKQTQPQEATQWGAGAAAGAAGGYYAGYGQGYEAYGQGYAQPQDPNMYGYGAYAGYPNYQQPAAAPQPPPPQQ

SEQ ID NO: 1183 - protein, 440 aa, Sorghum bicolor
MMQQPPPPQPQPGMAPPPPTQAGGGQPPQWGGIPPPMTQQYGAPPPQQPPAMWGQPPPQAHYGQAPPPQPYYAAPPAPAPAPAAPAAADEVRTLWIGDLQYWMDESYVLGCFLSTGEVQNVKLIRDKNSGQLQGYGFVEFTSRAAAERVLQTYNGQMMPNVELTFRLNWASAGEKRDDTPDYTIFVGDLAADVTDYLLQETFRVHYPSVKGAKVVTDKLTMRTKGYGFVKFGDPTEQARAMTEMNGMPCSSRPMRIGPAASRKNTGGVVQERVPNSQGAQSENDPNNTTIFVGGLDPNVTEDTLKQVFSPYGEVVHVKIPVGKRCGFVQFVTRPSAEQALLMLQGALIGAQNVRLSWGRSLSNKQAQPQQESNQWGAAAAAGAGGYYGGYGQGYEAYGSGYAQPQDPNMYGYGAYAGYPNYQQQQAAQQPQQQQVKLLAN

SEQ ID NO: 1184 - protein, 432 aa, Zea mays
MMQQPPPQQPQPGMAPPPPPQAAGGQPPQWGGIPPPMAQQYGAPPPQQPPAMWGQPPPQAHYGQAPTPQQYYAAPPVPVQAPAAPAAADEVRTLWIGDLQYWMDENYVFGCFSNTGEVQNVKLIRDKNSGQLQGYGFVEFTSRAAAERVLQTYNGQMMPNVDLTFRLNWASAGEKRDDTPEYTIFVGDLAADVTDYLLQETFRVHYPSVKGAKVVTDKLTMRTKGYGFVKFGDPTEQARAMTEMNGMPCSSRPMRIGPAASRKNTGGVVQERVPNSQGAQSENDPNNTTIFVGGLDPNVTEDTLKQVFSPYGEVVHVKIPVGKRCGFVQFVTRPSAEQALLMLQGALIGAQNVRLSWGRSLSNKQAQPQQESNQWGAAAGAGGYYGGYGQGYEAYGSGYAQPQDPNMYGYGAYGGYPNYQQQPAAQQQQQQQ

SEQ ID NO: 1185 - protein, 456 aa, Zea mays
MMPQQQQPGMAPPPPQAAPGAPPHWGGIPPPMAPQHQYAPPPTHQAPPPPQMWGQAPPPPPPPQAAYGQAPPPPQAAYGQALPPPQAAYGQAPPPPQAAYYGAVPAPAAVAAAPVGPSEVRTLWIGDLQYWMDDNYIYGCFASTGEVQNVKLIRDKHTGQLQGYGFIEFISRAAAERVLQTYNGTMMPNVELPFRLNWASAGEKRDDTPDYTIFVGDLAADVTDYVLQETFRAHYPSVKGAKVVTDKLTMRTKGYGFVKFGDPNEQARAMTEMNGMLCSSRPMRIGPAANKKATVVQEKVPSAQGVQSDNDPNNTTIFVGGLDPNVTEDMLKQVFTPYGDVVHVKIPVGKRCGFVQYANRSSAEEALVILQGTLVGGQNVRLSWGRSPSNKQVQPQQDSNQWAGANAGYYGYGQGYEAYGYPQSQDPNMYNYGAGAYAGYPNYQQQPVAQQPPQQQ

SEQ ID NO: 1186 - protein, 453 aa, Zea mays
MMPQQQQPGMAPPPPQAAPGAPPHWGGIPPPMAPQHQYAPPPTHQAPPPPQMWGQAPPPPPPPQAAYGQAPPPPQAAYGQALPPPQAAYGQAPPPPQAAYYGAVPAPAAVAAAPVGPSEVRTLWIGDLQYWMDDNYIYGCFASTGEVQNVKLIRDKHTGQLQGYGFIEFISRAAAERVLQTYNGTMMPNVELPFRLNWASAGEKRDDTPDYTIFVGDLAADVTDYVLQETFRAHYPSVKGAKVVTDKLTMRTKGYGFVKFGDPNEQARAMTEMNGMLCSSRPMRIGPAANKKATVVQEKVPSAQGVQSDNDPNNTTIFVGGLDPNVTEDMLKQVFTPYGDVVHVKIPVGKRCGFVQYANRSSAEEALVILQGTLVGGQNVRLSWGRSPSNKQVQDSNQWAGANAGYYGYGQGYEAYGYPQSQDPNMYNYGAGAYAGYPNYQQQPVAQQPPQQQ

SEQ ID NO: 1187 - protein, 748 aa, Sorghum bicolor
MADLAAAAAAPPPATDLFGEPIEAHPPWFKPDAFLRAGFDPDAYVAELRSYVPLESLAAELRAHLAALRAELVGLINRDYADFVGLSARLKGVDAAAARMRAPLADLRDKVAAFRAGASAALAALRAGLEQRAAATAARELLELLLDTSHVVSKVEKLIKELPTAPSDSSNAEVPNNDTGMPNGEAGTGVRETQSILLERIASEMNRLKFYISHAQNIPFIENIEKRVQGATKLLDGSLERCFVDGLEHRDAKVIYNCLRAYAAIDNTSSAEELFRTTVVSPLIQKIVPQNYARAVAGASSDELEDDYQQIKECVKKDCKFILEISSSENSGLHVFDFLGNSILKEVLSAIQKGKPGAFSPGKPKEFLRNYKASLGFLDFLEGYCLSKSAVTKFRAEPAYTDFMRQWNVGVYFSLRFQEIAGGLDSTLTNTFSPTGSNEAQGKQLLLKQSIKLLESLESCWSDEVLLFSHCDKFLRLSLQLISRYTTWLSSGLSARKASDGSPNSPADAEWALSTPIEDFIYIMHDVHAVIGELSESGSFIGHVNQLLGSCPIEVLNLVKQSILQAVEPLKEVLPAIMNVMIGIIVKKSNEDLKHLKGITATYRMTNKLPVRHSPYVSGILHPLKVFLEGERIHYLSEDDKTRLCRGSTDKITAIYYDLVSEVVTVARKTESSLQRLRQGAQRRVGASTDASDNIISDTDKICMQLFLDIQEYARNLRAIGIDAREIDSYRALWQCVAPKDKQENIQF

SEQ ID NO: 1188 - protein, 767 aa, Hordeum vulgare subsp. vulgare
MADLAAPPRPAAAPQPPAAAAAAAKDLFGETIEAHPPWFRPEAFLRAGFDPDAYVAELRSYVPLESLAAELRSHLAALRAELVGLINRDYADFVGLSARLKGVDAAAARMRAPLADLRDKVAAFRAAASAALAALRAGLEQRAAATQARELLELLLDTSHVVSKVEKLIKELPTAPSDSSDVEVRSVDKGYSGNDTTPSNVEAGTDVRETQSILLERIASEMNRLKFYISHAQNLPFIENMEKRVQGATKLLDGSLERCFVVGLEHRDAKVIYNCLRAYAAIDNTSSAEELFRTTVVSPLIQKIVPQNYAKAVSGVSSDDLEDDYEQIMQCVEKDCKFILEISSSANSGLHIFDFLANSILKEVHSAIMKGKPGACSPGKPKDFLRNYKASLKFLDFLEGYCPSKSAVAKFRSEPAYTDFMRLWHVSVYFSLRFQEIAGGLDGALTATISPVGVNENQMKQKTLLLKQSIKLLESLQSCWSDDVLIFSQSDKFLRLSLQLISRYTTWLSSGLAARNASDGSSSSPADSEWALSVPVEDFIYVMHDVNAVIGELSESGNFVGRVNQLLASCPIEVLTLVKQSILQAVEPLKELLPSIMDAMIGVIVKRSNEDLKHLKGITATYRMTNKLPVRHSPYVSGILHPLKVFLEGDRVHYLSEDDKTKLRRGSTDKITATYYDMVSEVVNVARKTESSLQRLRQGQQKRIGGSTDASDNIISDTDKICMQLFLDIQEYARNLRTLGIDAKEIESYRSLWQCVAPKDKQDIIQF

SEQ ID NO: 1189 - protein, 754 aa, Oryza sativa Japonica Group
MADLAVAAPPPTDLFGEPIEAHPPWFKPDSFLRPDFDPDAYVADLRSYVPLDSLAAELRSHLASLRAELVGLINRDYADFVGLSARLKGVDAAAARMRPPLAELRDKVASFRAAAAAGLAALRSGLEQRAAATAARELLELLLDTSHVVSKVEKLIKELPSAPSDSSNVEAVSGDKGYSGNVATPPNMDDGTDVRETQSILLERIASEMNRLKFYISHAQNLPFIENMEKRAQGATKLLDGSLERCFVDGLEHRDDKVIYNCLRAYAAIDNTSSAEEIFRTTVVSPLIQKIVPQNYAKVVAGVSSDDLEDDYEQIMQCVEKDCKFILEISSLANSGLHVFDFLANSILKEVHLAIQKGKPGATSPGKPKQFLKNYKASLRFLDFLEGYCSSKPAVTKFRSEPAYADFMRQWHVAVYFTLKFQDIAGGLDSVLTATITPAGMHDNQAKPQTLLLKQSVKLLESLQACWSDDVLVFSHSDKFLRLSLQLISRYTTWLSSGLAARKASDGGSSSPADAEWALSVPVEDFIYVMHDVNAVISELLESGQFVEHVNQLLASCPTEVLALVKHSILQAVEPLKELLPAIMNVMIMVIVKRSNEDLKHLKGITATYRMTNKLPVRHSPYVSGILHPLKVFLEGDRIHYLSEDDKAKLRRGSTDKITSIYYDMVSEVVTVARKTESSLQRLRQGAQRRVGANTDTSDNIISDTDKICMQLFLDIQEYARNLRAIGIDAREIETFRALWQCVAPRDKQDNIQF

SEQ ID NO: 1190 - protein, 754 aa, Oryza sativa Indica Group
MADLAVAAPPPTDLFGEPIEAHPPWFKPDSFLRPDFDPDAYVADLRSYVPLDSLAAELRSHLASLRAELVGLINRDYADFVGLSARLKGVDAAAARMRPPLAELRDKVASFRAAAAAGLAALRAGLEQRAAATAARELLELLLDTSHVVSKVEKLIKELPSAPSDSSNVEAVSGDKGYSGNVATPPNMDDGTDVRETQSILLERIASEMNRLKFYISHAQNLPFIENMEKRAQGATKLLDGSLERCFVDGLEHRDDKVIYNCLRAYAAIDNTSSAEEIFRTTVVSPLIQKIVPQNYAKVVAGVSSDDLEDDYEQIMQCVEKDCKFILEISSLANSGLHVFDFLANSILKEVHLAIQKGKPGATSPGKPKQFLKNYKASLRFLDFLEGYCSSKPAVTKFRSEPAYADFMRQWHVAVYFTLKFQDIAGGLDSVLTATITPAGMHDNQAKPQTLLLKQSVKLLESLQACWSDDVLVFSHSDKFLRLSLQLISRYTTWLSSGLAARKASDGGSSSPADAEWALSVPVEDFIYVMHDVNAVIGELLESGQFVEHVNQLLASCPTEVLALVKHSILQAVEPLKELLPAIMNVMIMVIVKRSNEDLKHLKGITATYRMTNKLPVRHSPYVSGILHPLKVFLEGDRIHYLSEDDKAKLRRGSTDKITSIYYDMVSEVVTVARKTESSLQRLRQGAQRRVGANTDTSDNIISDTDKICMQLFLDIQEYARNLRAIGIDAREIETFRALWQCVAPRDKQDNIQF

SEQ ID NO: 1191 - protein, 220 aa, Zea mays
MCARSIALASLGLRVPASGSSPSSSAPIHAASPSLSSPSRDPRREASMWPRVLPLLLPRGAQPCRASLPWLFHSPALPHRRSPISMVARPPVLWPCRASWSSPRPAKLPCARPATPLSLAARVPLLAKAPARSLRSCFRGGRSSSSGARAPSPWCSASSPMARRAPLLSPPARAPYGVHLPGKSSLFPLPWRVSSSTSGRRLRARPQTVVRPILSPSRGS

SEQ ID NO: 1192 - protein, 427 aa, Oryza sativa Japonica Group
MAPPPPPPQAGVAGGGGAPPQWGAIPPPVPHQQQQYAPPPPQMWGQAPPPPPQMWGQAPPPPQPAYGQPPPAQAGYYGAPPQAAPAVPAGPNEVRTLWIGDLQYWMDENYISACFAPTGELQSVKLIRDKQTGQLQGYGFIEFTSHAGAERVLQTYNGAMMPNVEQTYRLNWASAGEKRDDTPDYTIFVGDLAADVTDYILQETFRVHYPSVKGAKVVTDKMTMRSKGYGFVKFGDPSEQARAMTEMNGMVCSSRPMRIGPAANKKATGVQEKVPSAQGVQSDSDPSNTTIFVGGLDPSVTDDMLKQVFTPYGDVVHVKIPVGKRCGFVQFANRASADEALVLLQGTLIGGQNVRLSWGRSPSNRQAQPQQDSNQWGGANAGYYGYGQGYEGYGYAQPQDPNMYGYGAYAGYPNYQQPLAQQPQQQQ

SEQ ID NO: 1193 - protein, 329 aa, Oryza sativa Japonica Group
MDENTVSACFAPTGELQSVKLIRDKQTGQLQGYGFIEFTSHAGAERVLQTYNGAMMPNVEQTYRLNWASAGEKRDDTPDYTIFVGDLAADVTDYILQETFRVHYPSVKGAKVVTDKMTMRSKGYGFVKFGDPSEQARAMTEMNGMVCSSRPMRIGPAANKKATGVQEKVPSAQGVQSDSDPSNTTIFVGGLDPSVTDDMLKQVFTPYGDVVHVKIPVGKRCGFVQFANRASADEALVLLQGTLIGGQNVRLSWGRSPSNRQAQPQQDSNQWGGANAGYYGYGQGYEGYGYAQPQDPNMYGYGAYAGYPNYQQPLAQQPQQQQPDYLVSL

SEQ ID NO: 1194 - protein, 456 aa, Zea mays; identical to SEQ ID NO: 1185

SEQ ID NO: 1195 - protein, 453 aa, Zea mays; identical to SEQ ID NO: 1186

SEQ ID NO: 1196 - protein, 432 aa, Zea mays subsp. mays
MDWDLKAAGAWDLAELEQDHAAAAPSSGGHAANAAAAGTGTESRPPAPGAAGAPAECSVDLKLGGMGECEPGAARREREAAAGAAKRPRPAGPGGQQQQQCPSCAVDGCRADLGKCRDYHRRHKVCEAHSKTPVVVVAGREMRFCQQCSRFHLLAEFDADKRSCRKRLDGHNRRRRKPQPDTMASASFIASQQGTRFSPFAHPRLEASWPPGVMKNEESPYHITHQIPLGSSSSGNRQQHFVALGAATPAYAKEGRRFPFLQEGEISFATGVVLEPPASAPACQPLLRTGAPSESSGAGGSKMFSDQGLARVLDSDCALSLLSAPANSSGIDVSRMVRPTEHVPMAQQPVVPGLQFGSASWFPRPQASTGGSFVPSCPAAVEGEQQLNAVLGPNDSEVSMNYGGMFHVGGGSGGGEGSSDGGTSSSMPFSWQ

SEQ ID NO: 1197 - protein, 432 aa, Zea mays subsp. mays
MDWDLNAAGAWDLAELERDHAAAAPSSGGHAANAAAAGTGTESRPPAPGAAGAPAECSVDLKLGGMGECEPGAARREREAAAGAAKRPRPAGPGGQQQQQQCPSCAVDGCRADLGKCRDYHRRHKVCEAHSKTPVVVVAGREMRFCQQCSRFHLLAEFDADKRSCRKRLDGHNRRRRKPQPDTMASASFIASQQGTRFSPFAHPRLEASWPPGVMKTEESPYHITHQIPLGSSSSSRQQHFVALGAATPAYAKEGRRFPFLQEGEISFATGVVLEPPAAAPACQPLLRTGAPSESSGAGGSKMFSDQGLARVLDSDCALSLLSAPANSSGIDVSRMVRPTEHVPMAQQPVVPGLQFGSASWFPRPQASTGGSFVPSCPAAVEGEQQLNAVLGPNDSEVSMNYGGMFHVGGGSGGGEGSSDGGTSSSMPFSWQ

SEQ ID NO: 1198 - protein, 431 aa, Zea mays subsp. mays
MDWDLNAAGAWDLAELEQDHAAAAPSSGGHAANAAAAGTGTESRPPAPGAAGAPAECSVDLKLGGMGECEPGAARREREAAAGAAKRPRPAGPGGQQQQQCPSCAVDGCRADLGKCRDYHRRHKVCEAHSKTPVVVVAGREMRFCQQCSRFHLLAEFDADKRSCRKRLDGHNRRRRKPQPDTMASASFIASQQGTRFSPFAHPRLEASWPPGVMKTEESPYHITHQIPLGSSSSSRQQHFVALGAATPAYAKEGRRFPFLQEGEISFATGVVLEPPAAAPACQPLLRTGAPSESSGAGGSKMFSDQGLARVLDSDCALSLLSAPANSSGIDVSRMVRPTEHVPMAQQPVVPGLQFGSASWFPRPQASTGGSFVPFCPAAVEGEQQLNAVLGPNDSEVSMNYGGMFHVGGGSGGGEGSSDGGTSSSMPFSWQ

SEQ ID NO: 1199 - protein, 435 aa, Sorghum bicolor
MDWDLKAPGAWDLAELEHEQHAAATAAAAGPSGGHANAGVAGTGTGCRPPPGAGGAPAECSVDLKLGGLGEPGAAPPARREREAAAAAAAAAEHQQGQGQHQQQQCPSCAVEGCKADLSKCRDYHRRHKVCEAHSKTPVVVVAGREMRFCQQCSRFHLLAEFDADKRSCRKRLDGHNRRRRKPQPDTMASASFITSQQGTRFSPFAPPRLEASWPGVIKTEESPYYTHQIPLGSSSNRQQHFVGSTTPAYAKEGRRFPFLQEGEISFATGVVLEPPACQPLLKTVAVAPPESSSSSSAGGGNKMFSDGLTRVLDSECALSLLSAPANSSGIDVSRMVRPTEHVPMAQPVVSGLQFGSSSWFSPRPQASTGVTAGSGFPSCPAVVEGEQQQLNTVLSPHDNEVNYGGMFHVGGGSGGGGEGSSDGGTSSSMPFSWQ

SEQ ID NO: 1200 - protein, 399 aa, Zea mays
MEGNGGAGGGSGSAAPPWDLAMHWAPAVVSSYPPQPLELQQQELTCLKLGKRPACCWAGAPGNQAAQVHGNGGAGGAAAEGKRKDKAPAAAAVTRCQVEGCHLSLADAKEYHRRHKVCEAHSKSPRVVVLGAEQRFCQQCSRFHAISEFDDAKRSCRRRLAGHNERRRKSNASEAMARGVAHPHGVTAFGHGGFLPSRGLVPAGSSPAAAGALSLLSSARGSVAGASGPWLVTAAREDIPARSSAALDDLIAENRAAALLARQYFVSDRSPAPRRDFVASSTAGCSLQQQQHPPDHDHTAGWHPHPHPYSGGGGGSCGGRYQYHHVAPPSAWHATTLDLMQPTASTTAAPATAGAALWPAVPERAGARSSRSRSETKDGDASGCSGLDAWAPTGGARVL

SEQ ID NO: 1201 - protein, 418 aa, Sorghum bicolor
MEGNGGAGGGSGSAAPPWDLAMHWAPSAGSSYPQQPLALRPGGVPSSQLQLLHQQQQQQQQELTCLKLGKRPACCWAGAALGSQVVAAQAGAGLPHHLHGNGGGAAAGCGGGASGKAAEGKRKEKQAAAAAPGAAAVPRCQVEGCHVALADAKDYHRRHKVCEAHSKAPRVVVLGAEQRFCQQCSRFHAISEFDEAKRSCRRRLAGHNERRRKSNASEAMARGAAHPHGVTAFGHGFLPPCGGLSGSSAGALSLLSSARSGATSAAPWQVTTSDISARSSAALDDLIAENRAALLAWQYFSDRSSSAPGRHFASSSSTATGCALPPADDQHAAASWRPHPHSGVGGGRHHMAPPGVWHTTLDLMQTASSAAPATSTGAPFRPVPERAGARPRGKSKDGDDASGCSLDAWAPAGGARVL

SEQ ID NO: 1202 - protein, 325 aa, Zea mays
MDWAAASGSPSWGAAATDPGPTMLSFAGPSSSAADAEVRLQDFAAGLAQSSRPTGAAPGAGRRSRAAVGGAGAEACSVDGCRSDLSRCREYHRRHKVCEAHSKAPVVVVGGQERRFCQQCSRFHMLSEFDEEKRSCRKRLDGHNRRRRKPQHDLTNLGGFFPYHQVNQFEFYPQTIPTVGQNSDAVHLVGRQQPFSISFSRTPDEFPFPQGGGSSVLHHLHAARPGHHAEGSSHTGSSTRDNALSGTLGPECALSLLSSSLRRPSTAGVPAVGQPQVTASSTTAVSQAATAAVATAAFAASAGHHVFVPDAMFEDPSQALPFSWQ

SEQ ID NO: 1203 - protein, 331 aa, Zea mays
MDWAAASGSPSWGAAATDPGPTMLSFAGPSSAAADAEVRLQDFAAGLAQSSRPTGAAPGAGRRSRAAGGGAGAEACSVDVCRSDLSRCREYHRRHKVCEAHSKAPVVVVGGQERRFCQQCSRFHMLSEFDEEKRSCRKRLDGHNRRRRKPQHDLTNLGGFFPYHQVNQFEFYPQTIPTVGQNSDAVHLVGRQQPFSISFSRTPPDEFPFPQGQGGGSSVLHHLHAARPGHHAEGSSSHTGSSTRDNALSVSGTLGPECALSLLSSSLRRPSTAGVPAVGQPQVTASSTTAVSQAATAAVATAAFAASAGHRVFVPDAMFEDPSQALPFSWQ

SEQ ID NO: 1204 - protein, 325 aa, Sorghum bicolor
MDWAAASGAPSWGAAATDPGPTMLSFAGPSSSTTPAADAEARLQDFAAGLAQSARPAGAAGAGRRSRAAGGGAGVEACSVDGCRSDLSRCREYHRRHKVCEAHSKTPVVVVAGQEQRFCQQCSRFHMLSEFDEGKRSCRKRLDGHNRRRRKPQHDLTNLGGFFPYHQVNQFEVYPRTIPTVGQNSDAMHLVGRQQPFSISFSRTPNQFPFPQGGGSTLHAARPGHLLAEGSSHTGSSTCSNPLSGTLGPECALSLLSSSLHHPSAAGIPTAGQPQVASSLSRIAAVSQAATTAMATAFAAGVGHHVFVPDAMFEDPSQALPFSWQ

SEQ ID NO: 1205 - protein, 267 aa, Zea mays
MSSGSFMTSQQGTRFSSFPVPRPEPSWPGVIKSEDSGSYYAHQRHPVLSSRPHFAGGGSTPPAYSSKEGRRFPFLQDGCDQQQVGGFSAGAGAQQLEVSSTSTVCQPLLKAAAAAAPPPPPESSSSNKMFSDGLAPAVLDSDCALSLLSSPANSSSVDVGRMVVHQPAEHIPMAQPLVPGGLQQQQQHHPFGGSPAWFACSQAGSSAVSAGGFACPPGVESEQLNTVLVPSSDGGGHDMNMNYHGIFHVGGDGSSDGTSPSLPFSWQ

SEQ ID NO: 1206 - protein, 306 aa, Sorghum bicolor
MPHPGTGTEGMAASPSPDHLFGLRNSFYIGAYHAAITSSQSLPAHALSPDDLVERDALLYRSYIAIGSHQLVIGEIGPSAATPLQAVKLLAVYLSGDAGNRESVVSRLRELLSDAAVGTNPILRLMAGTVFMHERDYAEALKHTSSGGSMELHALNVQIYLQMNRTDHAEKQLRVMQQLDEDHTLTQLANAWIDLVMGGSKIQEAHLIFQDLSEKYPATCTILNGKALCSMHMGNFEDAEGLLLESLNKDAKDAETLANLTVCSLNLGKPATRYLNQLKLAQPDHALVKRMSSAADSFDRACQAMA

SEQ ID NO: 1207 - protein, 294 aa, Zea mays
MAASPDHLFGLRNSFYVGAYHAVITSSQSLPAHALSPDDLVERDALMYRSYIAIGSYQLVIGEIGPSAATPLQAVKLLAVYLSGDGGNRESVVSRLRELLSDAAVGSNPILRVMAGTVFMHERDYAEALKHTNSGGSMELLALNVQIYLQMNRTDHAEKQLRVMQQLDEDHTLTQLANAWVDLVLGGSKIQEARLIFQDLSEKYPTTCTILNGKALCSMHMGNFEDAEGLLLESLNKDAKDTETLANLTVCSLNLGKPATRYLNQLKLAHPDHALVKRMSSAAESFDRACQAMA

SEQ ID NO: 1208 - protein, 297 aa, Oryza sativa Japonica Group
MAGAASPDHLFGLRNSFYVGAYQAVITGVQAIPARAALSPDALAERDSLLYRSYIAIGSHQLVIDEIGPGAATPLQAVRLLTVYLSGGAGGKESAIRKLNELLADDAVGSNPILRLVAGTVLMHERDYAGALKHTNSGGTMELLAMNVQICLQMHRSDHAEKQLRIMQQLDEDHTLTQLANAWVDLVMGGSKIQEAHLIFQDLSEKYPATCLILNGKALCLMHMGNFEDAEGLLLESLNKDAKDAETLANLVVCSLNLGKSASRYLNQLKLAHPDHMLVKRMSSAEDSFDRACQAIS

SEQ ID NO: 1209 - protein, 297 aa, Oryza sativa Indica Group
MAGAASPDHLFGLRYSFYVGAYQAVITGVQAIPARAALSPDALAERDSLLYRSYIAIGSHQLVIDEIGPGAATPLQAVRLLAVYLSGGAGGKESAIRKLNELLADDAVGSNPILRLVAGTVLMHERDYAGALKHTNSGGTMELLAMNVQICLQMHRSDHAEKQLRIMQQLDEDHTLTQLANAWVDLVMGGSKIQEAHLIFQDLSEKYPATCLILNGKALCLMHMGNFEDAEGLLLESLNKDAKDAETLANLVVCSLNLGKSASRYLNQLKLAHPDHMLVKRMSSAEDSFDRACQAIS

SEQ ID NO: 1210 - protein, 297 aa, Oryza sativa Indica Group
MAGAASPDHLFGLRYSFYVGAYQAVITGVQAIPARAALSPDALAERDSLLYRSYIAIGSHQLVIDEIGPGAATPLQAVRLLTVYLSGGAGGKESAIRKLNELLADDAVGSNPILRLVAGTVLMHERDYAGALKHTNSGGTMELLAMNVQICLQMHRSDHAEKQLRIMQQLDEDHTLTQLANAWVDLVMGGSKIQEAHLIFQDLSEKYPATCLILNGKALCLMHMGNFEDAEGLLLESLNKDAKDAETLANLVVCSLNLGKSASRYLNQLKLAHPDHMLVKRMSSAEDSFDRACQAIS

SEQ ID NO: 1211 - protein, 253 aa, Zea mays
MHMPIRCFPNLLFFFWSEPGRFRSFLLDFSYPRVPSSVRDDAWQWQGMQHGGDRMLLGTASAIQWHGNQEPHPPHRSAAAGYGNHAYNNCHGGGGLVAAAAGASMLSSAFEPPPGGGGCVAGATAADSSCALSLLSTQPWDTPTQSGSSHHNRSPAMSAAAGAFEVAPSSVVASSYTASSSWSGSRDPADGARKNAQRHDDGLHLVHPPGPVHHGHFSGELELALQGSGPPHVDHGGGTCFSHSDTNAMNWSL

SEQ ID NO: 1212 - protein, 429 aa, Zea mays
MDWDLKMPVSWDLPDLEHDAMPPPPPVSAASTAAASGIAAAAAAPSSATAPSRAECSVDLKLGGLGEFGAADGTATKEPAAATAAPSASPMKRPRLGPGGAGGAQCPSCAVDGCKADLSKCRDYHRRHKVCEAHSKTPVVVVAGREMRFCQQCSRFHLLLEFDEAKRSCRKRLDGHNRRRRKPQPDTMNSGSFMTSQQGLFSSAGTRFSSFPAPRPEPSWSGVIKSEDSSYYTHHPVLSNRPHVAGTSTSPAYSKEGRRFPFLQDGDQVSFSASGAGTLEVSTVCQPLLKTTAAVAPPPPESSKMLAPVLDSDCALSLLSSPANSSSVDVSRMVQPAERIPMAQPLVPGLQHHQFGGSPVPDWFAGSGAVPAAGTGGFACPHSVESEQFNTVLVPSSDGGHEMNYHGIFHVGGEGSSDGTPPSLPFSWQ

SEQ ID NO: 1213 - protein, 464 aa, Sorghum bicolor
MDWDLKMPVSWDLPDLEHDAAMPQPPPIAATAAAASPAAASGIAAAATAAPPHAAATRGAPSRAECSVDLKLGGLGEFGAVADGTKEPAAAATATAAPSAPSASPMKRPRSGPGGAAGAQCPSCAVDGCKADLSKCRDYHRRHKVCEAHSKTPVVVVAGREMRFCQQCSRFHLLAEFDEAKRSCRKRLDGHNRRRRKPQPDAMNSGSFMTSQQGLFSSAGTRFSSFPAPRPEPSWSGVIKSEDSSYYTPHPHPVLSNRPHFAGGSTSSAYSKEGRRFPFLQDGDQVSFSAGAGTLEVSTVCQPLLKTAAAAAPPPESSSSNKMFSDGLTPVLDSDCALSLLSSPANSSSVDVSRMVVQPAAEHIPMAQPLVPSSSLQHHHQHHQFGSSPGGWFACSQAGSSAVSGAGTGTGGFACPASVESEQLNTVLVPSNDAGHEMNYHGIFHVGGEGSSDGTSPSLPFSWQ

SEQ ID NO: 1214 - protein, 472 aa, Oryza sativa Japonica Group
MDWDLKMPVSWDLAELEHNAVPNMAAAASAAEPGIAAVAASRGAPGRPECSVDLKLGGLGEFGAADALKEPAAAAKAPVSSAAAAASVAKVPPSTSTLKRPRGGGGGGGGQCPSCAVDGCKADLSKHRDYHRRHKVCEPHSKTPVVVVSGREMRFCQQCSRFHLLGEFDEAKRSCRKRLDGHNRRRRKPQADSMSSGSFMTSQQGTRFASFTPPRPEPSWPGIIKSEETPYYSHHHHPHPVMTSRQPHFVGSPSSATTAAFSPKEGRRFPFLHEGDQISFGGGGGAAAAATLEISVCQTTVVAPPPPESSSSNKMFSSDGLTTATTTTTTAHHHHHHHQVLDSDCALSLLSSPANSSSVDVSRMVQPSPAAAAGAEHHHHHQIPMAQPLVPNLQQQFGGSSPWFASSPAAAAVAGGGFACPSMDSEQQQQQQLNAVLVPGSNENEMNYHGMFHVGGEGSSDGTSPSLPFSWQ

SEQ ID NO: 1215 - protein, 378 aa, Zea mays
MATGGGSSRSDDVRGLKFGKKIYFEQDGGSGSGAGAVGGRKGKGVATGGARPASAASAAQPPRCQVDGCGVDLSAVKQYYCRHKVCNMHSKEPRVFVAGIEQRFCQQCSRFHQLHEFDQGKRSCRRRLIGHNERRRKPPPGPLTSRYGRLAASLQEPGRFRSFLLDFSYPRVPSSVRDAWPGIQHGGDRMLGTVQWHGHQEPPHPHRSAAAGYGNHAAYNCHGGLVAGGAPMLSSAAFELPPGGCVAGVAADSSCALSLLSTQPWDTTSHDHRSPAMPAAGAFDGTPVAPSVMASSYAASSAWTGSRDPAADGARNAQRLDDALHLVHPGSAAVHFSGELELALQGSGGPPHLPRVDHGGSGGGTFNHSTTSAMNWSL

SEQ ID NO: 1216 - protein, 378 aa, Zea mays
  misc_feature (151)..(151): Xaa can be any naturally occurring amino acid
MATGGGSSRSDDVRGLKFGKKIYFEQDGGSGSGAGAVGGRKGKGVATGGARPASAASAAQPPRCQVDGCGVDLSAVKQYYCRHKVCNMHSKEPRVFVAGIEQRFCQQCSRFHQLHEFDQGKRSCRRRLIGHNERRRKPPPGPLTSRYGRLXASLQEPGRFRSFLLDFSYPRVPSSVRDAWPGIQHGGDRMLGTVQWHGHQEPPHPHRSAAAGYGNHAAYNCHGGLVAGGAPMLSSAAFELPPGGCVAGVAADSSCALSLLSTQPWDTTSHDHRSPAMPAAGAFDGTPVAPSVMASSYAASSAWTGSRDPAADGARNAQRLDDALHLVHPGSAAVHFSGELELALQGSGGPPHLPRVDHGGSGGGTFNHSTTSAMNWSL

SEQ ID NO: 1217 - protein, 388 aa, Sorghum bicolor
MATGGSGSDDVHGLTFGKKIYFEQDAAVAAAGGSGSGSATAAAGGRKGKGVATGGGRPASASAASATQPPRCQVDGCGVDLSAVKQYYCRHKVCYMHSKEPRVVVAGIEQRFCQQCSRFHQLPEFDQGKRSCRRRLIGHNERRRKPPPGPLTSRYGRLAASFQEPGRFRSFLLDFSYPRVPSSVRDAWQGVQPGGDRMLGTIQWHGNQEPHPHRSAAAGYGNHAYNCHGGLVAGASMLPSAFELPPGGCVAGVTTDSSCALSLLSTQPWDTTPQSGSHNRSPAMSAAASAFEGTPVAPSVMASSYTASSTWTASRDPADGARNAQQHHDDALHLVHPGPVHHGHFSGELELALQGSGPPPPPNMPHVDHGSSSGTFSHSTTNAMNWSL

SEQ ID NO: 1218 - protein, 383 aa, Zea mays
MATGGGGGSDDFHGLTFGQKIYFEQDAGAAGGSATGGRKGKGAAASASAAQPPRCRVDGCGVDLSAVKQYYCRHKVCYMHSKEPRVFVAGIEQRFCQQCSRFHQLPEFDQGKRSCRRRLIGHNERRRKPPPGPLTSRYGPLAASLVQEPGRFRSFLLDFSYPRVPSSVRDDAWQWQGMQHGGDRMLLGTASAIQWHGNQEPHPPHRSAAAGYGNHAYNNCHGGGGLVAAAAGASMLSSAFEPPPGGGGCVAGATAADSSCALSLLSTQPWDTPTQSGSSHHNRSPAMSAAAGAFEVAPSSVVASSYTASSSWSGSRDPADGARKNAQRHDDGLHLVHPPGPVHHGHFSGELELALQGSGPPHVDHGGGTCFSHSDTNAMNWSL

SEQ ID NO: 1219 - protein, 408 aa, Zea mays
MEAGGASGGDDGDGQLHGLKFGKKIYFEDAGGSSSSGGSGSASATAPPATQQPSPPAASPRAAPGGGRRGRAAAGGAGPSLPPAPPRCLVDGCNADLTDAKTYYCRHKVCEMHSKEPRVVVNGLELRFCQQCSRFHNLAEFDQQKKSCRKRLAGHNERRRRPPPGPLASRYGRLAAPLGEEPGGRFRSFMLDFSYPRVPSAMRDGFPAVRPGGERVPGSNIQWQAASLDPPPPHHQSAAAGYGAHSYGSPGSSSSSRPPVFPAGPELPPGGGCLAGVPTDSSCALSLLSTQPWDAAGHSAGHGHGHAASLPATAGFDGNPVAMASSYIAPPSPWTDSRAHEGGRRNVPQLPPDVPLGDVHSGPGTHHGQFSGELELALQGNRPAPAPRNGQGSAGAFDQAGSTTEWSL

SEQ ID NO: 1220 - protein, 409 aa, Sorghum bicolor
MESGGASGGGGGGGGDDQLHGLKFGKKIYFEDAAAAGSSSGGGGGGSGNASATTAAPATQQPSPPQAASPRAASGGGGRRGRAAGGPSPAPAPARCQVDGCNVDLTDVKPYYCRHKVCKMHSKEPRVVVNGLEQRFCQQCSRFHQLPEFDQLKKSCRRRLAGHNERRRRPPPGPLATRYGRLAASFGEEPGRFRSFMLDFSYPRVPTAMRDGFPAVRPGERAPGSIQWQASLDPHHHQSAVAGYSAHSYGSQGSSSSRPPVFPGPEIPPGGCLAGVPSDSSCALSLLSTQPWDTTHSSGHSHAASMPATAGFDGNPVAPSLMASSYIAPSPWTDSRGHEGGRNVPQLPPDVPLSEVHSGSSSHHGQFSGELELALQGNRPAPGSAPAPRNDQGSTGAFDQSGNTMDWSL

SEQ ID NO: 1221 - protein, 440 aa, Sorghum bicolor
MGSFGMNWNQKNSMVWDWEHLVPSVSNAVTRHGSANSSGGTLTSSSELGHGSSKSSISASIDSPSGVGNSLEFNFAAVQRHVKNTGTNGRVDDSGNSPSSMIAFSQGEPLISLKLGKRAYFENVCGGQEAKVSAPSDVTSAVTVVKKTKVSQQNAKNWYCQVEGCKVDLSSAKDYNRKHKVCVAHSKAPKVVVAGLERRFCQQCSRFHGLAEFDQNKRSCRRRLTHHNARRRKPQADAISFNSSRLSSMFYDTSHRTNLFFSQPLYGQVRSNAVSPWDNSGGFKFMETKHLSVQPTKTVGLDELHFSTPQISTSVVAHTGHHHNFDRFMPFKGTNTKVLNQVSGVEASATASNSNNGAPEPGRALSLLSDGSWGSNSAVIQQPPSHADAGALPPLATVAVSNTAARHPLDPSLGRFWQDDHPPLDGPAPQIQELAHLRTW

SEQ ID NO: 1222 - protein, 439 aa, Zea mays
MGSFGMNWNQKDPMVWDWEHLVPSVSNAVTRHGSANSSGGTLTSNSELGHGSSKSSISASIDSPSGVGNSLEFNFAAVERHVKNTGTNGRVDDSGNSPSSMIAFNQGEPLISLKLGKRAYFENACGGQDAKVSAASDVTSAASVVKKTKVSQQNAKNWYCQVEGCKVDLSSAKDYNRKHKVCVVHSKATKVVVAGLERRFCQQCSRFHGLAEFDQNKRSCRRRLMHHNARRRKPQADTISFNSSTMFYDTRQRTNLFFSQPLYGQVRSNAGSSWDNLGGLKFMETKHPPVHPTKTASPDELHFSALQITSAAAHTGHHHDLDGFMAFKGTSTKVLNQGVEAWAAASSSNNGGPEGGRALSLLSDGSWGSSSAVIQQPTSHADAGALLPPLATVAVSNAAAAAGHPLDPSPGRFWPQDDHPPLVDGPATQIPELAHLRIW

SEQ ID NO: 1223 - protein, 660 aa, Sorghum bicolor
MQGQRNSMEHYADVFGFDIASSSGNPVMDQQSYWNNVLGSVESQNPQGYQMNHSDAAMPYGNEAQQDGTFLGFWESGEASSSGSALNYGSSNNVKTEHLNIGGGLRIGERQLVADNGISLDVDINLNANVNDLCGQSSNVNCTSQGPEQYGGSDRNGINSQPTDLRLHPYRTFLLGAEQADSFTLNPSENPLSDFSLMQESIDQRAGSSLDGRRLACKRKNIEGANGQSSAGASTSFSLRNDNAFYNIASSSYNPAPIRNSSSPNCLPVPSSIEDQLPQYGTNAGLSAGTYDLNGGVHNAGNSQRSFRARTTTSQQIAPCSVWPSSNAIRLSNSWNHQPPHFQNAFDGPQEVIPVVSSLNLQYQHPVNVSGVPQAANRFTGHGASSSRATSLENRNLGSEEVTRRNVVPTNYTDLVPPSAVDLRRLVPEPSNWSSDVRGTAISGSIPPVSRANNSSAANPPAGFNHQNLTRRHPRNLSEEIGRLSGALRGHQPPRLRSGFLLERQGDGVWGVPLSTRGREGRRLMEIRNALEMIHRGENVRLESIFYGGVEIHDRHRDMRLDIDNMSYEELLALEERIGDVSTGLSEEAVIKLLKQRKFSSWRLKASLDPEPCCICQEEYVDGDDLGRLDCGHDFHACCIKQWLVVKNVCPICKNTALKT

SEQ ID NO: 1224 - protein, 663 aa, Zea mays
MQGQRNSMEHFADVFGFDVASSSGNPVMDQQSYWNNVLGSVESHNLQGYQMAHSDAAMPYGNEPQQDGTFLGFWESGEASSSASALNYGSSNNVKTEHLNIGGGGGLRIGESRLVADNGISLDVDINLNANVNDLCGQSSNVNCASQGPEQYCGSDRNAINSQPTDLGLHPFRTFLLDAQQAESFTLNPSENPLGDFSSMQESIEQRPGGSLDGRRLACKRKNIEGANGQSSAGASTSFPHRNDNAFHNIASSSYNPAPIRNSSSPKCLPVPSSIEDQLPRYGTNVGLSAGTYDLHGGVNNAVNSQRSFRARTTTSQQVAPCSVWPSSNAIRLSNSWNHQPPHFQSAFDDPQEVIPVVSSLNLQYQHPMNVPGVPQAANRFTDHGASSSRAGSLENRIIGSEEVPRRYAAPTNYSDLVPPPAVDLRRLVPEPFNWSSDVRGTAISGSIIPPVSRTNNSSTVNPPAGFNHQNLTRRHPRNLSEEIGRLSGALRGHQPPRLRSGFLLERQGDGVWGVPLSTRGREGRRLMEIRNALEMIQRGENVRLESIFYGGLDIHDRHRDMRLDIDNMSYEELLALEERIGNVSTGLSEEAVIKLLKQRKFSSWRLKASLDPEPCCICQEEYVDGDDLGRLDCGHDFHAGCIKQWLVVKNVCPICKNTALKA

SEQ ID NO: 1225 - protein, 655 aa, Zea mays
MQGQRNSVEHFADVFGFDIASSSGNPVMDQQSYWNNVLGSVESQNLQGYQMNHSDAAMPYGNEAEQDGTFLGFWESGEASASGSSNNAKTEHLSIGGGLRIGERRLVADNGISLDVDINLNANVNDLCGQSSNVNCTSQGPEHYGGGDRSVVNSQPTDLRLHPYRTFLLDAEQADSFTLNPSENPLCDFSLMQESIDQRPGSSLDGRRLACKRKNVEGPNGQSSAGASTSFSHRNDNAFHNIASSSYNPAPIRNPSSPNCLPVPSSIDDQLPRYGTNAGLSAGTYDLNGGVNNAGNSQRSFRARITTSQQIAPCSVWPSSNAIRLPNSWNHQPPHFQSAFDDTQEVIPVVSSLNLQYQHPVNVSSVPPAANRFTGHGASSSRAGSLENRILGSQEAPTRNVVPANYSDLVPPSVVDPRRLLPEPSNWSSDVRGTAISGSIPPVSRANNSATVNPPAGFSHQNLTRRHPRNLSEEIGRLSGALRGHQPPRLRPGFLLERQGDGVWGVPLSTRGREGRRLMEIRNALEMIHRGENVRLESIFYGGVDIHDRHRDMRLDIDNMSYEELLALEERIGNVGTGLSEEAVIRLLKQRKFSSWTLKASLDPEPCCICQEEYADGDDLGRLDCGHDFHAGCITQWLVVKNVCPICKSTALKKT

SEQ ID NO: 1226 - protein, 667 aa, Oryza sativa Japonica Group
MQGQKNSVEQLADVFGFDHASSSGNPVMDQQGYWNNILGSVESHNLQGYQVNRSDGTIPYGNGVHQNGTFLGFWESGEASASGSSLHFGGSNEIKAEQRNIGGGLRIGERRLVAERNLSLDNVDIGLNINGNDLSGENSNVNGASQGSELHGGCSHTGSNGQASELRLHPYRTFILGADQPEPFNSLNGSENPLGDFSLMPEGIDQRPGSSLDGRRLACKRKNIEGVNGQCSAGASTSFSHRNDSIFHNIASSSHNPSPSTNLPSPNCLLVPSTLDEQLPRYGATTAGLSSSSYDPSGGNNNSGGSQRSFRPRTSLAQHIGPYGVWPSSSTIRHSNSWNHQPPPFQSSFDEPPEVIPVVSSLNFQYQHPMNVVPGIPQMSHRFTGPGASSSRTGNLENRIIGSEEFSARNVVATSFPDAVPPAALDMRHLIPEPSSWNVDGRATTIPGNVPSSSRANTNSMVNPPAGSPFIAHQNLHRRNPRNLSEEISRLSGALRGHQHPRLRSGFLLERQGDGVWGVPLSTRSREGRRLIEIRNALEMIHRGENVRFESIFYGGVDIHDRHRDMRLDIDNMSYEELLALEERIGNVSTGLSEEEVTKLLKQRKFSSWRLEASVEEEPCCICQEEYVDGDDLGTLDCGHDFHVGCVRQWLVVKNTCPICKNTALKS

SEQ ID NO: 1227 - protein, 383 aa, Zea mays; identical to SEQ ID NO: 1218

SEQ ID NO: 1228 - protein, 388 aa, Sorghum bicolor; identical to SEQ ID NO: 1217

SEQ ID NO: 1229 - protein, 378 aa, Zea mays; identical to SEQ ID NO: 1215

SEQ ID NO: 1230 - protein, 378 aa, Zea mays; identical to SEQ ID NO: 1216
  misc_feature (151)..(151): Xaa can be any naturally occurring amino acid

SEQ ID NO: 1231 - protein, 329 aa, Zea mays
PSTAPAPARCQVDGCNVDLTDVKPAYYCRHKVCKMHSKEPRVLVNGLEQRFCQQCSRFHQLPEFDQLKKSCRKRLAGHNERRRRPPPGPLASRYGRHAASLGEPGRLRSFMLDFSYPRVSSAMRGGFPAVRPGGERVPGGIQWQAGLDPRHHQGAVAGYGAHYGSEGGSSSSARPPVFPGPELPPGGCLAGVPADSSCALSLLSTQPWDAAHSHSHSHAAPTAGFDGGSPVAPSLMAASSYIAPSPWTETDSWGHEGGRSVPQLPPDDVPLGEVHSGSSSHHGQFSGELELALQGNRPAPGSAAPPAPRNNQGSAGTFDQAGNTMDWSL

SEQ ID NO: 1232 - protein, 409 aa, Sorghum bicolor; identical to SEQ ID NO: 1220

SEQ ID NO: 1233 - protein, 408 aa, Zea mays; identical to SEQ ID NO: 1219

SEQ ID NO: 1234 - protein, 251 aa, Zea mays
MAAEAGPISKVLIVIAMQKEATPLVHKFNLVEAPAHQSTFPKGAPWVWYHGSYKGLHIDLVLPGMDAVLGVDSVGTVPVAVVTSFSIQTLKPDLIINAGTAGGFKAKGASITDVFLASDVAFHDRRIPIPIFDMYGTGARKTFAAPNILKELNLKVGKLSTGDSLDMCPQDKELILRNDATIKDMEGAAVAYVADMFSTPAIFVKAVTDIVDGVKPTYEEFLQNLIAVTTALELAVTKVVDFISGKRISDL

SEQ ID NO: 1235 - protein, 251 aa, Zea mays
MAAEAGPISKVLIVVAMQTEAMPLVHKFKLVEAPAHESTFPKGAPWVRYHGNYKGLHIDLVLPGKDAVLGVDSVGTVSAALLTSFSIQTLKPDLIINAGTAGGFKAKGASIGDVFLASDVSFHDRRIPIPVFDMYGIGARKTSAVPNILKELNLKIGKLSTGDSLDMSPQDEKVILSNDATVKDMEGAAVAYVADMFSTPAIFVKAVTDIVDGEKPTSEEFLQNLIAVTAALDLAVTKVVDFISGKRISDL

SEQ ID NO: 1236 - protein, 251 aa, Zea mays
MAAEAGPISKVLIVVAMQTEAMPLVHKFKLVEAPAHESTFPKGAPWVRYHGNYKGLHIDLVLPGKDAVLGVDSVGTVSAALLTSFSIQTLKPDLIINAGTAGGFKAKGASIGDVFLASDVSFHDRRIPIPVFDMYGIGARKTSAVPNILKELNLKIGKLSTGDSLDMSPQDEKVILSNDATVKDMEGAAVAYVADMFSTPAIFVKAVTDIVDGDKPTSEEFLQNLIAVTAALDLAVTKVVDFISGKRISDL

SEQ ID NO: 1237 - protein, 251 aa, Sorghum bicolor
MAAEAGPISKVLVVVAMQTEAMPLVNKFKLVEAPAHESTFPKGAPWVRYHGNYKDLHIDLVLPGKDAAFGVDSVGTVSVALVTSFSIQTLKPDLIINAGTAGGFKAKGASIGDVFLASDVAFHDRRIPIPVFDMYGIGARKTFAAPNILKELNLKVGKLSTGDSLDMSPHDEEVILSNDATVKDMEGAAVAYVADMFSTPAIFLKAVTDIVDGEKPTTEEFLQNLIAVTAALDLAVTKVVDFISGKRISDL

SEQ ID NO: 1238 - protein, 226 aa, Zea mays
MAAEAGPISKVLIVIAMQKEATPLVHKFNLVEAPAHQSTFPKGAPWVWYHGSYKGLHIDLVLPGMDAVLGVDSVGTVPVAVVTSFSIQTLKPDLIINAGTAGGFKAKGASITDVFLASDVAFHDRRIPIPVGKLSTGDSLDMCPQDKELILRNDATIKDMEGAAVAYVADMFSTPAIFVKAVTDIVDGVKPTYEEFLQNLIAVTTALELAVTKVVDFISGKRISDL

SEQ ID NO: 1239 - protein, 259 aa, Oryza sativa Japonica Group
MAPPSDSDDSAPIPAGAISKLLIVIAMQTEALPLVNKFHLVEAEESIFPKGAPWIRYHGNYKGLHVDLVWPGKDPVLGVDCVGTVSAALVTYASIQSLKPDLIINAGTAGGFKAKGADIGDVYLASDVAFHDRRIPIPVFDMYGIGTRKTFATPNILKELNLKVGKLSTGDSLDMSPHDESAILNNDATVKDMEGAAVAYVADMFSTPAIFVKAVTDIVDGEKPTAEEFLQNLVAVTAALDKAVTEVVDFISGKCISDL

SEQ ID NO: 1240 - protein, 259 aa, Oryza sativa
MAPPSDSDDSAPIPAGAISKLLIVIAMQTEALPLVNEFHLVEAEESIFPKGAPWIRYHGNYKGLHVDLVWPGKDPVLGVDCVGTVSAALVTYASIQSLKPDLIINAGTAGGFKAKGADIGDVYLASDVAFHDRRIPIPVFDMYGIGTRKTFATPNILKELNLKVGKLSTGDSLDMSPHDESAILNNDATVKDMEGAAVAYVADMFSTPAIFVKAVTDIVDGEKPTAEEFLQNLVAVTAALDKAVTEVVDFISGKCISDL

SEQ ID NO: 1241 - protein, 256 aa, Oryza sativa Indica Group
PSDSDDSAPIPAGAISKLLIVIAMQTEALPLVNKFHLVEAEESIFPTGAPWIRYHGNYKGLHVDLVWPGKDPVLGVDCVGTVSAALVTYASIQSLKPDLIINAGTAGGFKAKGADIGDVYLASDVAFHDRRIPIPVFDMYGIGTRKTFATPNILKELNLKVGKLSTGDSLDMSPHDESAILNNDATVKDMEGAAVAYVADMFSTPAIFVKAVTDIVDGEKPTAEEFLQNLVAVTAALDKAVTEVVDFISGKCISDL

SEQ ID NO: 1242 - protein, 265 aa, Hordeum vulgare subsp. vulgare
MAPPSSEEPAAASAEASAAGAISKVLVVIAMQTEALPLVTRFQLVEAAADESIFPKGAPWTRYHGEYKGLHIDLVWPGKDPLLGVDSVGTVSAALVTYASIQLLKPDLIINAGTAGGFKAKGAGIGDVFLASDVAFHDRRIPIPVFDSYGIGARKTFETPNIVKELNLKVGKLSTGDSLDMSPHDESAILSNEATVKDMEGAAVAYVADLFSTPAIFVKAVTDIVDGEKPTAEEFLQNLISVTMALDQAVLQVVDFISGKCISDL

SEQ ID NO: 1243 - protein, 275 aa, Oryza sativa Indica Group
MAPPSDSDDSAPIPAGAISKLLIVIAMQTEALPLVNKFHLVEAEESIFPKGAPWIRYHGNYKGLHVDLVWPGKDPVLGVDCVGTVSAALVTYASIQSLKPDLIINAGTAGGFKAKGADIGDVYLASDVAFHDRRIPIPVFDMYGIGTRKTFATPNILKELNLKVGKLSTGDSLDMSPHDESAILNNDATVKGYGVVICRLKLASLFLFFQGAAVAYVADMFSTPAIFVKAVTDIVDGEKPTAEEFLQNLVAVTAALDKAVTEVVDFISGKCISDL

SEQ ID NO: 1244 - protein, 432 aa, Zea mays subsp. mays; identical to SEQ ID NO: 1197

SEQ ID NO: 1245 - protein, 432 aa, Zea mays subsp. mays; identical to SEQ ID NO: 1196

SEQ ID NO: 1246 - protein, 431 aa, Zea mays subsp. mays; identical to SEQ ID NO: 1198

SEQ ID NO: 1247 - protein, 435 aa, Sorghum bicolor; identical to SEQ ID NO: 1199

SEQ ID NO: 1248 - protein, 394 aa, Hordeum vulgare subsp. vulgare
MDWDLKMPPGAWDLADLESDAAPAPAGGIANAECSVDLKLGGLGECGAAPDTRGLGKAPAEAAASPSAAKRPRASSGGGAGQHQQCPSCAVDGCRADLSRCRDYHRRHKVCEAHSKTPVVTVAGREMRFCQQCSRFHLLTEFDEAKRSCRKRLDGHNRRRRKPQPDPMNSASFMTSQQGTRFPSFPTPRPEQNWPGIIKTEENPYYTHQLPLGISNRHHFGGSTSTFAKEGRRFPFLQEGEINFATGVALEPAVCQPLLKTVAPPESSSSSSKMFSDGLTPVLDSDCALSLLSAPANSSGIDVGQMVQQTEHIPIAQPLFSNLQQFSSSSWFSRTQASTGTVSATGFSCPVVENEQLNNVLTSDNNDLNYNGIFHVGGEGSSDGAPPSLPFPWQ

SEQ ID NO: 1249 - protein, 488 aa, Sorghum bicolor
MATQAAFLAGLSQLAAQPGRDRAVAPARVAVAAVGVGSAKVGVRVGVKAGTAEAKAVAQRRGVRCRASLIEPDGGRLVDLVAPEEGGRRAALRREAAELPHRLRLSRVDKEWVHVLSEGWASPLQGFMREHEFLQALHFNAIRGADGRMVNMSVPIVLSLGDAQRRAIQADGATRVALVDQRDRPIAVLSDIEIYKHNKEERIARTWGTTAPGLPYVEEAITNAGDWLIGGDLEVIEPIKYNDGLDQYRLSPAQLREEFARRNADAVFAFQLRNPVHNGHALLMTDTRKRLLEMGYKNPVLLLHPLGGFTKADDVPLSWRMKQHEKVLEEGVLNPESTVVAIFPSPMHYAGPTEVQWHAKARINAGANFYIVGRDPAGMSHPTEKRDLYDADHGKKVLSMAPGLERLNILPFKVAAYDTKQKKMDFFDPSRKDDFLFISGTKMRTLAKNRENPPDGFMCPGGWKVLVEYYDSLVPSEGSSKLREPVAA

SEQ ID NO: 1250 - protein, 487 aa, Zea mays
MAMQAAFLAGFSQLAAQPSRDCAVAVAPTRVAVAAVGSAKVGARVGLKAGIAAPAPAAGRGVRCRASLIEPDGGQLVDLVAPEEGGRRAALRREAAELPHRLRLGRVDKEWVHVLSEGWASPLQGFMREHEFLQTLHFNAIRGQDGRMVNMSVPIVLSVGDAQRRAIQADGATRVALVDERDRPIAVLSDIEIYKHNKEERIARTWGTTAPGLPYVEEAITNAGDWLIGGDLEIIEPIKYNDGLDQYRLSPAQLREEFARRNADAVFAFQLRNPVHNGHALLMTDTRKRLLEMGYKNPVLLLHPLGGFTKADDVPLSWRMKQHEKVLEEGVLNPESTVVAIFPSPMHYAGPTEVQWHAKARINAGANFYIVGRDPAGMSHPTEKRDLYDADHGKKVLSMAPGLERLNILPFKVAAYDTKQKKMDFFDPSRKDDFLFISGTKMRTLAKNRESPPDGFMCPGGWKVLVEYYDSLVPSEGSSKLREPIAA

SEQ ID NO: 1251 - protein, 489 aa, Zea mays
MATQAAFLAGFSQLAAQPGRDRAVAVAVAPAPGPARVAVAAVGSAKLGVKAGTSRTAAVARLGVRCRASLIEPDGGRLVDLVAPEEGGRRAALRREAAELPHRLRLGRVDKEWVHVLSEGWASPLQGFMREHEFLQALHFNAIRGQDGRMVNMSVPIVLSVGDAQRRAIQADGATRVALVDERDRPIAVLSDIEIYKHNKEERVARTWGTTAPGLPYVEEAITNAGDWLVGGDLEVIEPIKYNDGLDQYRLSPAQLREEFARRNADAVFAFQLRNPVHNGHALLMTDTRKRLLEMGYKNPVLLLHPLGGFTKADDVPLSWRMKQHEKVLEEGVLNPESTVVAIFPSPMHYAGPTEVQWHAKARINAGANFYIVGRDPAGMSHPTEKRDLYDADHGKKVLSMAPGLERLNILPFKVAAYDTKQKKMDFFDPSRKDDFLFISGTKMRTLAKNRESPPDGFMCPGGWKVLVEYYDSLVPSEGSSKLREPVAA

SEQ ID NO: 1252 - protein, 487 aa, Zea mays
MAMQAAFLAGFSQLAAQPSRDCAVAVAPTRVAVAAVGSAKVGARVGLKAGIAAPAPAAGRGVRFRASLIEPDGGQLVDLVAPEEGGRRAALRREAAELPHRLRLGRVDKEWVHVLSEGWASPLQGFMREHEFLQTLHFNAIRGQDGRMVNMSVPIVLSVGDAQRRAILADGATRVALVDERDRPIAVLSDIEIYKHNKEERIARTWGTTAPGLPYVEEAITNAGDWLIGGDLEIIEPIKYNDGLDQYRLSPAQLREEFARRNADAVFAFQLRNPVHNGHALLMTDTRKRLLEMGYKNPVLLLHPLGGFTKADDVPLSWRMKQHEKVLEEGVLNPESTVVAIFPSPMHYAGPTEVQWHAKARINAGANFYIVGRDPAGMSHPTEKRDLYDADHGKKVLSMAPGLERLNILPFKVAAYDTKQKKMDFFDPSRKDDFLFISGTKMRTLAKNRESPPDGFMCPGGWKVLVEYYDSLVPSEGSSKLREPIAA

SEQ ID NO: 1253 - protein, 489 aa, Zea mays
MATQAAFLAGFSQLAAQPGRDRAVAVAVAPAPGPARVAVAAVGSAKLGVKAGTSRTAAVARLGVRCRASLIEPDGGRLVDLVAPEEGGRRAALRREAAELPHRLRLGRVDKEWVHVLSEGWASPLQGFMRDDEFLQTLHFNAIRGQDGRMVNMSVPIVLSVGDAQRRAIQADGATRVAVVDERDRPIAVLSDIEIYKHNKEERIARTWGTTAPGLPYVEEAITNAGDWLIGGDLEVIEPIKYNDGLDQYRLSPAQLREEFARRNADAVFAFQLRNPVHNGHALLMTDTRKRLLEMGYKNPVLLPHPLGGFTKADDVPLSWRMKQHEKVLEEGVLNPESTVVAIFPSPMHYAGPTEVQWHAKARINAGANFYIVGRDPAGMSHPTEKRDLYDADHGKKVLSMAPGLERLNILPFKVAAYDTKQKKMDFFDPSRKDDFLFISGTKMRTLAKNRESPPDGFMCPGGWKVLVEYYDSLVPSEGSSKLREPIAA

SEQ ID NO: 1254 - protein, 477 aa, Oryza sativa Indica Group
MAMQAAFAASMFPQLAQRRGSDRAVVVAPPAPAPVRVAMRSGGAAAAAARGVRCRASLIEPDGGRLVELVVPEEGGRREAARREAAALAHRVRLGRVETEWLHVLSEGWASPLRGFMREAEFLQALHFNAIRGGDGAMVNMSVPIVLPLGDAQRRAIEASGARRVALVDAADRPLAVLSDIEIYKHNKEERIARTWGTTAPGLPYVDEAITNAGDWLIGGDLEVIEPIKYNDGLDQYRLSPAQLREEFARRNADAVFAFQLRNPVHNGHALLMTDTRKRLLEMGYKNPVLLLHPLGGFTKADDVPLSWRMKQHEKVLEEGVLNPESTVVAIFPSPMHYAGPTEVQWHAKARINAGANFYIVGRDPAGMGHPTEKRDLYDADHGKKVLSMAPGLEKLNILPFKVAAYDTKQKKMDFFDPSRKDDFLFISGTKMRTLAKNRQSPPDGFMCPGGWKVLVEYYDSLTPSADSSKLREAVAA

SEQ ID NO: 1255 - protein, 477 aa, Oryza sativa Japonica Group
MAMQAAFAASMFPQLAQRRGSDRAVVVAPPAPAPVRVAMRSGGAAAAAARGVRCRASLIEPDGGRLVELVVPEEGGRREAARREAAALAHRVRLGRVETEWLHVLSEGWASPLRGFMREAEFLQALHFNAIRGGDGAMVNMSVPIVLPLGDAQRRAIEASGARRVALVDAADRPLAVLSDIEIYKHNKEERIARTWGTTAPGLPYVDEAITNAGDWLIGGDLEVIEPIKYNDGLDQYRLSPAQLREEFARRNADAVFAFQLRNPVHNGHALLMTDTRKRLLEMGYKNPVLLLHPLGGFTKADDVPLSWRMKQHEKVLEEGVLNPESTVVAIFPSPMHYAGPTEVQWHAKARINAGANFYIVGRDPAGMGHPTEKRDLYDADHGKKVLSMAPGLEKLNILPFKVAAYDTKQKKMDFFDPSRKDDFLFISGTKMRTLAKNCQSPPDGFMCPGGWKVLVEYYDSLTPSADSSKLREAVAA

SEQ ID NO: 1256 - protein, 473 aa, Hordeum vulgare subsp. vulgare
MATQAAFAVRFPQLARPSRGQGQPAPAPARVAVRGVGRAAAAAARGVRCRAGGLIEPDGGRLVELVAPEEGGRRAALRREAAALPHRVRLGRVDTEWLHVLSEGWASPLRGFMRETEFLQALHFNAVRGADGSLVNMSVPIVLALDDAQRRAIQASAATSVALVDAHDRPVAVLRDIEIYKHNKEERIARTWGTTARGLPYVEEAITNAGDWLIGGDLEVIEPIKYNDGLDQYRLSPAQLREEFARRNADAVFAFQLRNPVHNGHALLMTDTRRRLLEMGYKNPVLLLHPLGGFTKADDVPLSVRMKQHEKVLEEGVLNPESTVVAIFPSPMHYAGPTEVQWHAKARINAGANFYIVGRDPAGMGHPTEKRDLYDADHGKKVLSMAPGLERLNILPFKVAAYDTKHNKMNFFDPSRKEDFLFISGTKMRSLAKNRESPPDGFMCPGGWKVLVEYYDSLAPPEGSSKLREAVAA

SEQ ID NO: 1257 - protein, 476 aa, Oryza sativa Indica Group
MAMQAAFAASMFPQLAQRRGSDRAVVVAPPAPAPVRVAMRSGGAAAAAARGVRCRASLIEPDGGRLVELVVPEEGGRREAARREAAALAHRVRLGRVETEWLHVLSEGWASPLRGFMREAEFLQALHFNAIRGGDGAMVNMSVPIVLPLGDAQRRAIEASGARRVALVDAADRPLAVLSDIEIYKHNKEERIARTWGTTAPGLPYVDEAITNAGDWLIGGDLEVIEPIKYNDGLDQYRLSPAQLREEFARRNADAVFAFQLRNPVHNGHALLMTDTRKRLLEMGYKNPVLLLHPLGGFTKADDVPLSWRMKQHEKVLEEGVLNPESTVVAIFPSPMHYAGPTEVQWHAKARINAGANFYIVGRDPAGMGHPTEKRDLYDADHGKKVLSMAPGLEKLNILPFKAAYDTKQKKMDFFDPSRKDDFLFISGTKMRTLAKNRQSPPDGFMCPGGWKVLVEYYDSLTPSADSSKLREAVAA

SEQ ID NO: 1258 - protein, 461 aa, Oryza sativa Japonica Group
MAMQAAFAASMFPQLAQRRGSDRAVVVAPPAPAPVRVAMRSGGAAAAAARGVRCRASLIEPDGGRLVELVVPEEGGRREAARREAAALAHRGGASPLRGFMREAEFLQALHFNAIRGGDGAMVNMSVPIVLPLGDAQRRAIEASGVRRVALVDAADRPLAVLSDIEIYKHNKEERIARTWGTTAPGLPYVDEAITNAGDWLIGGDLEVIEPIKYNDGLDQYRLSPAQLREEFARRNADAVFAFQLRNPVHNGHALLMTDTRKRLLEMGYKNPVLLLHPLGGFTKADDVPLSWRMKQHEKVLEEGVLNPESTVVAIFPSPMHYAGPTEVQWHAKARINAGANFYIVGRDPAGMGHPTEKRDLYDADHGKKVLSMAPGLEKLNILPFKVAAYDTKQKKMDFFDPSRKDDFLFISGTKMRTLAKNCQSPPDGFMCPGGWKVLVEYYDSLTPSADSSKLREAVAA

SEQ ID NO: 1259 - protein, 533 aa, Sorghum bicolor
MSLASAGAAAARKPAAAWRRPGGVGGGRGVGVARRRAVAAAAALLLALVYAAGLLVFLLGGRLSGGGATAGGPGPAAVTVASSLRRRTRPVDGEPPHAQLRLMTSHYQNSGDPWMPCVNSRLTRSELPPSNGYLMIEANGGLNQQRLSICDAVAVASLLNATLVIPTFHLNSVWRDPSKFGDIFDEDHFIETLKEHVRVVKKLPEDVLLRFNHNISSIPNMRTKAYSSPNHYVQNVLPKLLELGVVRIAPFSNRLALSVPLNIQALRCLVNYHALRFAEPIRILSDDLVGRMTKKSLLTGGKYVSVHLRFEEDMVAFSCCTYDGGWREKTEMDNARERSWRGKFRRHGRVINPEANRRDGKCPLTPLEVGMMLRGMGFDNTTSLYVASGKIYNSEKYMAPLRQMFPLLTTKDSLALPEELAQFKGHSSQLAALDYTVCVQSEVFVTTQGGNFPHFLMGHRRYLFGGNAKTIKPDKRKLVLSFDDPNIRWDQFKQNMQEILHHSDMKSIAFRKPNDSVYTFPMPECMCQQDGMI

SEQ ID NO: 1260 - protein, 562 aa, Oryza sativa Japonica Group
MSVALYARGGGCGAKAAAARRSGRGGGGRRRAAVVLLLALAYVAGLLVFVLAGGGGVGVGGRVEVGREVGVMTVASLRRRRAAAAAAPQPGSVYRSHLVFERLWPDIRDDASSASAAASSLSSTSWRRSMLMTSHYQNPGELWMPCVNRKLIRPELPPSNGYLMIEANGGLNQQRLSICDAVAVASLLNATLVIPAFHFNSVWRDHSKFGDIFDEDHFIETLKEHVRVVKELPVDVLTRFDHNISSIPNMRTKAYSSPNHYMQKVLPKLLELGAVRIAPFSNRLAQSVPSNLQALRCFVNYQALRFAEPIRVLAEDMVERMVKRSTLTGGKFVSVHLRFEEDMVAFSCCTYDGGLKEKTEMENARERSWRGKFHRHGRVINPEANRRDGKCPLTPLEVGMMLRGMGFDNTTSLYVASGKIYNAEKYMAPLRQMFPLLATKDTLALPEELAEFEGHSSRLAALDYSVCLPSEVFVTTQGGNFPHFLMGHRRYLFGGNARTIKPDKRKLVLSFDDPNIRWNRFKRHMQDILHHSDMRGTALRKPNDSIYTFPMPECMCQQDGMM

SEQ ID NO: 1261 - protein, 491 aa, Oryza sativa Japonica Group
MTVASLRRRRAAAAAAPQPGSVYRSHLVFERLWPDIRDDASSASAAASSLSSTSWRRSMLMTSHYQNPGELWMPCVNRKLIRPELPPSNGYLMIEANGGLNQQRLSICDAVAVASLLNATLVIPAFHFNSVWRDHSKFGDIFDEDHFIETLKEHVRVVKELPVDVLTRFDHNISSIPNMRTKAYSSPNHYMQKVLPKLLELGAVRIAPFSNRLAQSVPSNLQALRCFVNYQALRFAEPIRVLAEDMVERMVKRSTLTGGKFVSVHLRFEEDMVAFSCCTYDGGLKEKTEMENARERSWRGKFHRHGRVINPEANRRDGKCPLTPLEVGMMLRGMGFDNTTSLYVASGKIYNAEKYMAPLRQMFPLLATKDTLALPEELAEFEGHSSRLAALDYSVCLPSEVFVTTQGGNFPHFLMGHRRYLFGGNARTIKPDKRKLVLSFDDPNIRWNRFKRHMQDILHHSDMRGTALRKPNDSIYTFPMPECMCQQDGMM

SEQ ID NO: 1262 - protein, 566 aa, Oryza sativa Indica Group
MSVALYARGGGVGCGAKAAAAARRPGRGGGGGRRRAAAVLLLLLALAYVAGLLVFVLAGVAGVGGRLELGREVGVMTVASLRRRRAAAAAAAQPGSVYRSHLVFERLWPDIRDDASSASAAASSLSSTSWRRSMLMTSHYQNPGELWMPCVNRKLIRPELPPSNGYLMIEANGGLNQQRLSICDAVAVASLLNATLVIPAFHFNSVWRDHSKFGDIFDEDHFIETLKQHVRVVKELPVDVLTRFDHNISSIPNMRTKAYSSPNHYMQKVLPELLELGAVRIAPFSNRLAQSVPSNLQALRCFVNYQALRFAGPIRVLAEDMVERMVKRSTLTGGKFVSVHLRFEEDMVAFSCCTYDGGLKEKTEMENARERSWRGKFHRHGRVINPEANRRDGKCPLTPLEVGMMLRGMGFDNTTSLYVASGKIYNAEKYMAPLRQMFPLLATKDTLALPEELAEFEGHSSRLAALDYSVCLPSEVFVTTQGGNFPHFLMGHRRYLFGGNAKTIKPDKRKLVLSFDDPNIRWNRFKRHMQDILHHSDMRGTALRKPNDSIYTFPMPECMCQQDGMM

SEQ ID NO: 1263 - protein, 489 aa, Zea mays; identical to SEQ ID NO: 1251

SEQ ID NO: 1264 - protein, 489 aa, Zea mays; identical to SEQ ID NO: 1253

SEQ ID NO: 1265 - protein, 487 aa, Zea mays; identical to SEQ ID NO: 1250

SEQ ID NO: 1266 - protein, 487 aa, Zea mays; identical to SEQ ID NO: 1252

SEQ ID NO: 1267 - protein, 488 aa, Sorghum bicolor; identical to SEQ ID NO: 1249

SEQ ID NO: 1268 - protein, 473 aa, Hordeum vulgare subsp. vulgare; identical to SEQ ID NO: 1256

SEQ ID NO: 1269 - protein, 477 aa, Oryza sativa Indica Group; identical to SEQ ID NO: 1254

SEQ ID NO: 1270 - protein, 477 aa, Oryza sativa Japonica Group; identical to SEQ ID NO: 1255

SEQ ID NO: 1271 - protein, 476 aa, Oryza sativa Indica Group; identical to SEQ ID NO: 1257

SEQ ID NO: 1272 - protein, 461 aa, Oryza sativa Japonica Group; identical to SEQ ID NO: 1258

SEQ ID NO: 1273 - protein, 523 aa, Zea mays
MGTSREIAIGPVAVVSLLLSSMIQKVVDPAADPATYRSLVFTVTFLAGVFQVSFGLFRLGFLVDFLSHAAIVGFMGGAAIVIGMQQLKGLLGLAHFTNSTDVVSVLKAVCSALRHDPWHPGNFLIGCSFLIFILTTRFIGRRYKKLFWLSAISPLLSVILSTAAVYATRADRHGVKIIQKVHAGLNPSSVKQIHLNGPHTTECAKIAVICAVIALTEAIAVGRSFASVRGYRLDGNKEMLAMGFSNVAGSLSSCYVATGSFSRTAVNFSAGARSTVSNIVMSITVFVTLELFMKLLYYTPMAVLASIILSALPGLIDIKEACSIWKIDKMDFLTCLGAFVGVLFGSVEIGLAVALGISFAKIIIQSLRPQVEILGRLQGTDIFCSVRQYPVACLTPTVLPIRVDTSFLCFINATSVKERITEWVWEGVETSNGKARERIQAVVLDMSSVVNIDTSGLTALEEIHKELVSLGLQMAIASPGWKAVQKMKVSQVVDRVGQDWIFMTVGEAVEACLAAHKGTALAC

SEQ ID NO: 1274 - protein, 660 aa, Sorghum bicolor
MEASSASAVESTATVSVFDVSSNKQRPDTAKLVLNSPSPPSLREELVGVVGKAFRPRPPGGGGRAPRCPWILTALQCVFPVLQWGRTYTLKSFRSDVMAGLTLASLGIPQSIGYANLAKLDPQYGLYTSVVPPLIYAVMGTSREIAIGPVAVVSLLLSSMIQKVVDPAADPATYRSLVFTVTFLAGVFQVSFGLFRLGFLVDFLSHAAIVGFMGGAAIVIGLQQLKGLLGLSHFTNSTDVVSVVKAVCSALHDPWHPGNFLIGCSFLIFILTTRFIGRRYKKLFWLSAISPLLSVILSTAAVYATRADKHGVKIIQKVHAGLNPSSAKQIHLNGPHATECAKIAVICAVIALTEAIAVGRSFASVRGYKLDGNKEMLAMGFSNVAGSLSSCYVATGSFSRTAVNFSAGARSTVSNIVMSITVFVALELFMKLLYYTPMAVLASIILSALPGLIDIKEACNIWKIDKMDFLICLGAFVGVLFGSVEIGLAVALAISFAKIIIQSIRPQVEVLGRLQGTNIFCSVRQYPVACQTPTVLPIRMDTSFLCFINATFIKERIIEWVREEVENPNGKARERIQAVVLDMSSVVNIDTSGLTALEEIHKELVSLGIQMAIASPGWKAVQKMKVSRVVDRVGEDWIFMTVGEAVEACLAAHKGTALEC

SEQ ID NO: 1275 - protein, 665 aa, Hordeum vulgare subsp. vulgare
MESSSAPAALETAVTVPSSAFDVSRRPDTAGLVLNSPRPPSLREELVGVVGKAFRPRGAGTGGAGGDRRPPRFAWVLTALQAVFPVLQWGRTYTLKSFRSDVMAGLTLASLGIPQSIGYANLAKLDPQYGLYTSVVPPLIYAVMGTSREIAIGPVAVVSLLLSSMVQKVVDPAVDPVTYRTLVFTVTFLAGVFQVSFGLFRLGFLVDFLSHAAIVGFMGGAAIVIGLQQLKGLLGLSRFTNSTDVVAVAKAVFSALHDPWHPGNFFIGCSFLIFILATRFIGRKYKKLFWLSAISPLLSVILSTAAVYATKADKHGVKIIREVHAGLNPSSVKLIQLNGPYTTECAKIAIICAVIALTEAIAVGRSFATIRGYKLDGNKEMIAMGFSNVAGSLSSCYVATGSFSRTAVNFSAGARSTVSNIVMAATVFIALEFFMKLLYYTPMAVLASIILSALPGLIDIREACNIWRVDKMDFLICLGAFLGVLFGSVEIGLGVALAISFAKIIIQSLRPQVEVLGRLQGTNIFCSVRQYPVACRTPAVQVIRIDTSFLCFTNATFIKERIMEWVRAEVDTSNEKVRERVQSVVLDMSNVVNIDTSGLVGLEEIHKELASLGIQMAIASPGWQAIQKMKLAHVVDRIGEDWIFLTVGEAVEGCLTAHKGSAMEC

SEQ ID NO: 1276 - protein, 660 aa, Oryza sativa Japonica Group
MEDTAAAVETPVTVSTFGVSRHPDTARLVLSSPKPPGVREEFVGVVRKAFRPRASGGGGAGRTPPARWGWALTALQTVFPVLQWGRTYNFKLFRSDVMAGLTLASLGIPQSIGYANLAKLDPQYGLYTSVVPPLIYAVMGTSREIAIGPVAVVSLLLSSMVSKIVDPAVDPVTYRALVFTVTFLAGVFQVSFGLFRLGFLVDFLSHAAIVGFMAGAAIVIGLQQLKGLLGLSHFTNSTDVVSVIKAVCSALRDPWHPGNFLIGCSFLIFILATRFIGRRYKKLFWLSAISPLLSVILSTAAVYATRADKHGVKIIQRVHAGLNPSSASQLRLSGPYTVDCAKTAIICAVIALTEAIAVGRSFASIRGYKLDGNKEMIAMGCSNVAGSLSSCYVATGSFSRTAVNFSAGARSTVSNIVMSITVFIALELLMKSLYYTPIAVLASIILSALPGLIDIKEALSIWKVDKMDFLTCLGAFVGVLFGSVEIGLAVALAISFAKIIIQSIRPQVEVLGRLQGTNIFCSIRQYPVACRIPSVLTIRIDTSFLCFINSTFIKERIIEWIREEVETSDEKARERVQSVVLDMSNVVNIDTSGISALEEIHKELASLSIQMAIAGPGWQAIQKMKLAGVVDQVGGDWIFLTVGEAVEACVTMQKGTALEC

SEQ ID NO: 1277 - protein, 660 aa, Oryza sativa Indica Group
MEDTAAAVETPVTVSTFGVSRHPDTARLVLSSPKPPGVREEFVGVVRKAFRPRASGGGGAGRTPPARWGWALTALQTVFPVLQWGRTYNFKLFRSDVMAGLTLASLGIPQSIGYANLAKLDPQYGLYTSVVPPLIYAVMGTSREIAIGPVAVVSLLLSSMVSKIVDPAVDPVTYRALVFTVTFLAGVFQVSFGLFRLGFLVDFLSHAAIVGFMAGAAIVIGLQQLKGLLGLSHFTNSTDVVSVIKAVCSALRDPWHPGNFLIGCSFLIFILATRFIGRRYKKLFWLSAISPLLSVILSTAAVYATRADKHGVKIIQRVHAGLNPSSASQLRLSGPYTVDCAKTAIICAVIALTEAIAVGRSFASIRGYKLDGNKEMIAMGCSNVAGSLSSCYVATGSFSRTAVNFSAGARSTVSNIVMSITVFIALELLMKSLYYTPIAVLASIILSALPGLIDIKEALSIWKVDKMDFLTCLGAFVGVLFGSVEIGLAVSLAISFAKIIIQSIRPQVEVLGRLQGTNIFCSIRQYPVACRIPSVLTIRIDTSFLCFINSTFIKERIIEWIREEVETSDEKARERVQSVVLDMSNVVNIDTSGISALEEIHKELASLSIQMAIAGPGWQAIQKMKLAGVVDQVGGDWIFLTVGEAVEACVTMQKGTALEC

SEQ ID NO: 1278 - protein, 638 aa, Oryza sativa Indica Group
MEPMASEPSVPIGTAFADLLLQGPEHPSLWNDLTGMFRKAFRWRGADKRFTLSVYVMSVLQGLFPILDWWKTYNLKFFRSDLMAGLTLASLSIPQSIGYATLAKLDPQYGLYTSVVPPLVYAVTGSSREIAIGPVAIVSLLLSSMIQKIVDPSVDPAFYRKMVFTVTFLTGVFQFAFGLFRLGFLVDFLSHAAIVGFMGGAAIVIGLQQLKGLLGLSHFTNRTDVVSVTKAVWVSVHETWHPENVFIGCSFFMFILAMRFIGRKYKKLFWVSAIAPVLSVALSTLFVYATRADKHGVKIIQKVNSGINASSVEQIDLKGGYAAECAKIALVCAVIALTEAVAVGRSFSAINGYRLDGNKEMVAMGFMNIAGSLSSCYVATGSFSRTAVNFAAGCKTTVSNIIMAATVMVALELLTKLLYYTPVSILASIILSALPGLINVQEVCFLWKVDKMDFLTCMGSFLGVLFGSVEIGLSVALLVSFAKIIIQSIWPQVEILGRLQGTEIFCNVKQYPVVHETPTVLTVRIETSFLCFVNSSSIKEKIMGWVTDEREAFRSVVLDMSNVVNMDTSGLAALEELHKELACLGIQMAIAKPGWQVIHKMKLARLVDGIGEGWFFLTVGEAVEACLANKAGNALECC

SEQ ID NO: 1279 - protein, 638 aa, Oryza sativa Japonica Group
MEPMASESSVPIGTAFADLLLQGPEHPSLWNDLTGMFRKAFRWQGADKRFTLSVYVMSVLQGLFPILDWWKTYNLKFFRSDLMAGLTLASLSIPQSIGYATLAKLDPQYGLYTSVVPPLVYAVTGSSREIAIGPVAIVSLLLSSMIQKIVDPSVDPAFYRKMVFTVTFLTGVFQFAFGLFRLGFLVDFLSHAAIVGFMGGAAIVIGLQQLKGLLGLSHFTNRTDVVSVTKAVWVSVHETWHPENVFIGCSFFMFILAMRFIGRKYKKLFWVSAIAPVLSVALSTLFVYATRADKHGVKIIQKVNSGINASSVEQIDLKGGYAAECAKIALVCAVIALTEAVAVGRSFSAINGYRLDGNKEMVAMGFMNIAGSLSSCYVATGSFSRTAVNFAAGCKTTVSNIIMAATVMVALELLTKLLYYTPVSILASIILSALPGLINVQEVCFLWKVDKMDFLTCMGSFLGVLFGSVEIGLSVALLVSFAKIIIQSIWPQVEILGRLQGTEIFCNVKQYPVVHETPTVLTVRIETSFLCFVNSSSIKEKIMGWVTDEREAFCSVVLDMSNVVNMDTSGLVALEELHKELACLGIQMAIAKPGWQVIHKMKLARLVDGIGEGWFFLTVGEAVEACLANKAGNALECC

SEQ ID NO: 1280 - protein, 656 aa, Oryza sativa Japonica Group
MEFQPFPQGVHPNTSEPAMEPMASESSVPIGTAFADLLLQGPEHPSLWNDLTGMFRKAFRWQGADKRFTLSVYVMSVLQGLFPILDWWKTYNLKFFRSDLMAGLTLASLSIPQSIGYATLAKLDPQYGLYTSVVPPLVYAVTGSSREIAIGPVAIVSLLLSSMIQKIVDPSVDPAFYRKMVFTVTFLTGVFQFAFGLFRLGFLVDFLSHAAIVGFMGGAAIVIGLQQLKGLLGLSHFTNRTDVVSVTKAVWVSVHETWHPENVFIGCSFFMFILAMRFIGRKYKKLFWVSAIAPVLSVALSTLFVYATRADKHGVKIIQKVNSGINASSVEQIDLKGGYAAECAKIALVCAVIALTEAVAVGRSFSAINGYRLDGNKEMVAMGFMNIAGSLSSCYVATGSFSRTAVNFAAGCKTTVSNIIMAATVMVALELLTKLLYYTPVSILASIILSALPGLINVQEVCFLWKVDKMDFLTCMGSFLGVLFGSVEIGLSVALLVSFAKIIIQSIWPQVEILGRLQGTEIFCNVKQYPVVHETPTVLTVRIETSFLCFVNSSSIKEKIMGWVTDEREAFCSVVLDMSNVVNMDTSGLVALEELHKELACLGIQMAIAKPGWQVIHKMKLARLVDGIGEGWFFLTVGEAVEACLANKAGNALECC

SEQ ID NO: 1281 - protein, 233 aa, Zea mays
MTPPHFGNMVSTVAPVVAWPHLQSQAHRLIDDDEVHRGYRDGFILVVFFGDKSTGGSSPASSSPSRTASPRRQPTPRPSTSDVIFFLVNLPAFDTNVDYHRHQTQAARQRFVRRRSSTKCLTLPWLMAQRDAAEKAAHTVPGMEMTTLFSAYRRAVFSPIDHLRPSVGTSGWIPSFRLLRTREPRRQSELNKNHFGANSVVTRGPLSCPPLGVSRRSWANTSEPLHSLSKPGL

SEQ ID NO: 1282 - protein, 252 aa, Zea mays
MFFVPLHVIPAGGGSTVWENDAPPLRQYGRTVAPVVAWPHLQSQAHRLIDDDEVHRGYRDGFILVVFFGDKSTGGSSPASSSPSRTASPRRQPTPRPSTSDVIFFLVNLPAFDTNVDYHRHQTQAARQRFVRRRSSTKCLTLPWLMAQRDAAEKAAHTVPGMEMTTLFSAYRRAVFSPIDHLRPSVGTSGWIPSFRLLRTREPRRQSELNKNHFGANSVVTRGPLSCPPLGVSRRSWANTSEPLHSLSKPGL

SEQ ID NO: 1283 - protein, 252 aa, Zea mays; identical to SEQ ID NO: 1282

SEQ ID NO: 1284 - protein, 233 aa, Zea mays; identical to SEQ ID NO: 1281

SEQ ID NO: 1285 - protein, 355 aa, Sorghum bicolor
MSAYCGKYKDELIKNAAYIGTPGKGILAADESTGTIGKRLSSINVENVEENRRALRELLFCCPGALQYISGVILFEETLYQKTKDGKPFVDVLKEGGVLPGIKVDKGTIEVAGTDKETTTQGHDDLGKRCAKYYEAGARFAKWRAVLKIGPNEPSQLAIDLNAQGLARYAIICQENGLVPIVEPEILVDGPHDIDRCAYVTEVVLAACYKALNEHHVLLEGTLLKPNMVTPGSDSKKVTPELIAEYTVRTLQRTVPAAVPAVVFLSGGQSEEEATLNLNAMNKLNTKKPWSLSFSFGRALQASTLKAWAGKVENIEKARAAFLARCKANSEATLGTYKGDAAADTESLHVKDYKY

SEQ ID NO: 1286 - protein, 355 aa, Zea mays
MSAYCGKYKDELIKNAAYIGTPGKGILAADESTGTIGKRLSSINVENVEENRRALRELLFCCPGALQYISGVILFEETLYQKTKDGKPFVDVLKEGGVLPGIKVDKGTIEVVGTDKETTTQGHDDLGKRCAKYYEAGARFAKWRAVLKIGPNEPSQLAIDLNAQGLARYAIICQENGLVPIVEPEILVDGPHDIDRCAYVTETVLAACYKALNEHHVLLEGTLLKPNMVTPGSDSKKVTPEVIAEYTVRTLQRTVPAAVPAVVFLSGGQSEEEATRNLNAMNKLSTKKPWSLSFSFGRALQASTLKAWAGKVENLEKARAAFLARCKANSEATLGTYKGDAAADTESLHVKDYKY

SEQ ID NO: 1287 - protein, 355 aa, Zea mays
MSAYCGKYKDELIKNAAYIGTPGKGILAADESTGTIGKRLSSINVENVEENRRALRELLFCCPGALQYISGVILFEETLYQKTKDGKPFVDVLKEGGVLPGIKVDKGTIEVVGTDKETTTQGHDDLGKRCAKYYEAGARFAKWRAVLKIGPNEPSQLAIDLNAQGLARYAIICQENGLVPIVEPEILVDGPHDIDRCAYVTETVLAACYKALNEHHVLLEGTLLKPNMVTPGSDSKKVTPEVIAEYTVRTLQRTVPAAVPAVLFLSGGQSEEEATRNLNAMNKLSTKKPWSLSFSFGRALQASTLKAWAGKVENLEKARAAFLARCKANSEATLGTYKGDAAADTESLHVKDYKY

SEQ ID NO: 1288 - protein, 355 aa, Zea mays
MSAYCGKYADELIKNAAYIGTPGKGILAADESTGTIGKRLSSINVENVEENRRALRELLFCCPGALQYISGVILFEETLYQKTKDGKPFVDVLKEGGVLPGIKVDKGTIEVVGTDKETTTQGHDDLGKRCAKYYEAGARFAKWRAVLKIGPNEPSQLAIDLNAQGLARYAIICQENGLVPIVEPEILVDGPHDIDRCAYVTETVLAACYKALNEHHVLLEGTLLKPNMVTPGSDSKKVTPEVIAQYTVRTLQRTVPAAVPAVVFLSGGQSEEEATLNLNAMNKLSTKKPWALSFSFGRALQASTLKAWAGKVENVEKARAAFLARCKANSEATLGTYKGDAAADTESLHVKDYKY

SEQ ID NO: 1289 - protein, 358 aa, Sorghum bicolor
MSAYCGKYKDELIKNAAYIGTPGKGILAADESTGTIGKRLSSINVENIEENRRALRELLFCAPGALQYLSGVILFEETLYQKTKDGKPFVDVLNEGGVLPGIKVDKGTIEVAGTNKETTTQGHDDLGKRCAKYYEAGARFAKWRAVLNIGPNEPSQLAIDLNAQGLARYAIICQENGLVPIVEPEILVDGPHDIERCAYVTEMVLAACYKALNEHHVLLEGTLLKPNMVTPGSDSKKVAPEVIAEYTVRALQRTVPAAVPAIVFLSGGQSEEEATLNLNAMNKLNTKKPWSLSFSFGRALQASTLKAWAGKEENVEKARAAFLTRCKANSEATLGTYKGDAAAGEGVSESLHVKDYKY

SEQ ID NO: 1290 - protein, 358 aa, Oryza sativa Japonica Group
MSAYCGKYKDELIKNAAYIGTPGKGILAADESTGTIGKRFASINVENVEENRRSLRELLFCTPGALQYLSGVILFEETLYQKTKDGKPFVDVLKEGGVLPGIKVDKGTIEVAGTEKETTTQGHDDLGKRCAKYYEAGARFAKWRAVLKIGPNEPSQLAIDLNAQGLARYAIICQENGLVPIVEPEILVDGPHDIDRCAYVSEVVLAACYKALNEHHVLLEGTLLKPNMVTPGSDAKKVSPEVIAEYTVRTLQRTVPAAVPAIVFLSGGQSEEEATLNLNAMNKLSTKKPWSLSFSFGRALQQSTLKAWSGKAENIEKARAAFLTRCKANSEATLGTYKGDAVLGEGASESLHVKDYKY

SEQ ID NO: 1291 - protein, 358 aa, Phyllostachys edulis
MSAYCGKYKDELIKNAAHIGTPGKGILAADESTGTIGKRFASINVENVEENRRSLRELLFCTPGALQHLSGVILFEETLYQKTKDGKPFVDVLNEGGVLPGIKVDKGTIEVAGTNKETTTQGHDDLGKRCAKYYEAGARFAKWRAVLKIGPNEPSQLAIDLNAQGLARYAIICQENGLVPIVEPEILVDGPHDIDRCAYVTETVLAACYKALNEHHVLLEGSLLKPNMVTPGSDSKKVAPEVIAEYTVRTLQRTVPAAVPAIVFLSGGQSEEEATLNLNAMNKLSTKKPWSLSFSFGRALQQSTLKAWAGKVENVEKARKAFLTRCKANSEATLGTYKGDALLGEGASESLHVKDYKY

SEQ ID NO: 1292 - protein, 358 aa, Oryza sativa Indica Group
MSAYCGKYKDELIKNAAYIGTPGKGILAADESTGTIGKRFASINVENVEDNRRALRELLFCTPGALQYISGVILFDETLYQKTKDGKPFVDVLKEAGALPGIKVDKGTIEVAGTDKETTTQGHDDLGKQCAKYYEAGARFAKWRAVLKIGPNQPSQLAIDLNAQGLARYAIICQENGLVPIVEPEILVDGPHDIDRCAYVSEVVLAACYKALNEHHVLLEGTLLKPNMVTPGSDAKKVAPEVIAEYTVRTLQRTVPPAVPAIVFLSGGQSEEEATLNLNAMNKLSAKKPWSLSFSFGRALQQSTLKAWAGKTENVEKARAAFLVRCKANSEATLGTYKGDAVLGEGAAESLHVKDYKY

SEQ ID NO: 1293 - protein, 358 aa, Oryza sativa Japonica Group
MSAYCGKYKDELIKNAAYIGTPGKGILAADESTGTIGKRFASINVENVEENRRSLRELLFCTPGALQYLSGVILFEETLYQKTKDGKPFVDVLKEGGVLPGIKVDKGTIEVAGTEKETTTQGHDDLGKRCAKYYEAGARFAKWRAVLKIGPNEPSQLAIHLNAQGLARYAIICQENGLVPIVEPEILVDGPHDIDPCAYVSEVVLAACYKALNEHHVLLEGTLLKPNMVTPGSDAKKVSPEVIAEYTVRTLQRTVPAAVPAIVFLSGGQSKEEATRNLNAMNKLSTKKPWSLSFSFGRALQQSTLKAWSGKAANIEKARAAFLTRCKANSEATLGTYKGDAVLGEGASESLHVKDYKY

SEQ ID NO: 1294 - protein, 358 aa, Oryza sativa Japonica Group
MSAYCGKYKDELIKNAAYIGTPGKGILAADESTGTIGKRFASINVENVEDNRRAFRELLFCTPGALQYISGVILFDETLYQKTKDGKPFVDVLKEAGALPGIKVDKGTIEVAGTDKETTTQGHDDLGKQCAKYYEAGARFAKWRAVLKIGPNQPSQLAIDLNAQGLACYAIICQENGLVPIVEPEILVDGPHDIDRCAYVSEVVLAACYKALNEHHVLLEGTLLKPNMVTPGSDAKKVAPEVIAEYTVRTLQRTVPPAVPAIVFLSGGQSEEEATLNLNAMNKLSAKKPWSLSFSFGRALQQSTLKAWAGKTENVEKARAAFLVRCKANSEATLGTYKGDAVLGEGAAESLHVKDYKY

SEQ ID NO: 1295 - protein, 495 aa, Zea mays
MGTAAVVEDTIRVVLTCLPDPPFRTTGSSRPYQSPSGGGGGGDRISRLSDAVLSNIVARLPAKDAARTTALSRRWRRVWASTPLVLDDSDLLVFHDDGGCSTPNWLAVTDTVSHVLSSHRGPIRFVRLTCCYMALASHNGALQYWLRVLAAGGVEDLVLVNRPLPTSVGLPIDVLHLASLRTLYLGFWCFPDTATLPRGRATVFPCLQEIGLCATVIHARDIDHLLACSPVLEKFASITSIYFTDPVRIRSCSLRCLVFWESLANELDLVVAPRLQRLILWQSRQWMIGSVHFRSRIRIGSATELKVLGYLEPSIHQLEIGGTIIDSGTKMTPSNMVPSVKILALKMQFRIRKEVKMLPTFLRCFPNVETLHVLSHETDEQNGKFNLKFWEEVGSISCLETRITKVVFDRFRGERCELAFLKFVLERAESLLKLVVVLANGDQASVDEMLAKLKSLTTVKRASDFPTLLAVAREGDSAWYFERASDLSVTDPFDL

SEQ ID NO: 1296 - protein, 495 aa, Zea mays
MGTAAVVEDTIRVVLTCLPDPPFRTTGSSRPYQSPSGGGGGGDRISRLSDAVLSNIVARLPAKDAARTTALSRRWRRVWASTPLVLDDSDLLVFHDDGGCSTPNWLAVTDTVSHVLSSHRGPIRFVRLTCCYMALASHNGALQYWLRVLAAGGVEDLVLVNRPLPTSVGLPIDVLHLASLRTLYLGFWCFPDTATLPRGRATVFPCLQEIGLCATVIHARDIDHLLACSPVLEKFASITSIYFTDPVRIRSCSLRCLVFWESLANELDLVVAPRLQRLILWQSRQWMIGSVHFRSRIRIGSATELKVLGYLEPSIHQLEIGGTIIDSGTKMTPSNMVPSVKILALKMQFRIRKEVKMLPTFLRCFPNVETLHVLSHETDEQNGKFNLKFWEEVGSISCLETRITKVVFDKFRGERCELAFLKFVLERAESLLKLVVVLANGDQASVDEMLAKLKSLTTVKRASDFPTLLAVAREGDSAWYFERASDLSVTDPFDL

SEQ ID NO: 1297 - protein, 495 aa, Zea mays
MGTAAVVEDTIRVVLTCLPAPPFRTTGSSRPYQSPSGGGGGGDRISRLSDAVLSNIVARLPAKDAARTTALSRRWRRVWASTPLVLDDSDLLVFHDDGGCSTPNWLAVTDTVSHVLSSHRGPIRFVRLTCCYMALASHNGALQYWLRVLAAGGVEDLVLVNRPLPTSVGLPIDVLHLASLRTLYLGFWCFPDTAALPRGRATVFPCLQEIGLCATVIHARDIDYLLACSPVLEKFASITSIYFTDPVRIRSCSLRCLVFWESLANELDLVVAPRLQRLILWQSRQWMIGSVHFRSRIRIGSATELKVLGYLEPSIHQLEIGGTIIDSGTKMTPSNMVPSVKILALKMQFRIRKEVKMLPTFLRCFPNVETLHVLSHETDEQNGKFNLKFWEEVGSISCLETRITKVVFDKFRGERCELAFLKFVLERAESLLKLVVVLANGDQASVDEMLAKLKSLTTVKRASDFPTLLAVAREGDSAWYFERASDLSVTDPFNL

SEQ ID NO: 1298 - protein, 501 aa, Sorghum bicolor
MAQEQIVGMEDMLRVVLPCLPAPPFRTTGAFRRSHSPRSGGGGEDRISRLPGTVLSNIVARLPAKDAARTTALSRRWRRVWVSTPLVLDDSDLLIFRDGGGGGRSAPVNWPAVTDAVSRVFDGRRGGPIRFVRLTCCFMKLAMRFRILEYWLRVVAAGGVEDLVLVNRPFPSSLPLPLDVLHIASLRTLYLGFWQFPDTAALPRGRATVFPRLQEIGLCATKIQARDIDHLLACSPVLEKFAIIAGLYFPRYVRIRSCSLQCLVFWKSLADELDVVVAPRLQRLILWQACQCIIGSLPFRTSVRIGHATELKVLGYLEPSIHQLQIGSTIIESGTNMIPSSMVPSVKILALKVQFRIRKEAKMLPTFLRCFPNVETLHVLSHEAEEPDGKLNSKFWEEVGSIDCLETHITKVVFDKFRGERCELAFLKFILERAQSLLKLVIVLANGDQASVDEMLAKLKSLTTAKRASECPTLLAVVREGDSAWYFQRASDLSVSDPFDW

SEQ ID NO: 1299 - protein, 233 aa, Zea mays
MVVVTVAEDVDGTDDSRSNDSQPCVGGAGAGEGCWKFRLCDTGGGRGGSCGARALACPFMSPLALALALGAAAFLARIASSVSTYFCTRFSCIRRCTLTSPSAAMESSLTSSFMSASVRATTSASTTLPPLLTMASSADTLVASLSTSRPMREMDLAARSALSVRRCSRRRLACAAGSSSSTILERSLTPAMSRNALESRSLSLYTSFWSSGCSPVRADSIFFSSPKEAWELM

SEQ ID NO: 1300 - protein, 174 aa, Zea mays
MSPLALALALGAAAFLARIASSVSTYFCTRFSCIRRCTLTSPSAAMESSLTSSFMSASVRATTSASTTLPPLLTMASSADTLVASLSTSRPMREMDLAARSALSVRRCSRRRLACAAGSSSSTILERSLTPAMSRNALESRSLSLYTSFWSSGCSPVRADSIFFSSPKEAWELM

SEQ ID NO: 1301 - protein, 122 aa, Sorghum bicolor
MAAKLAQLRAQAARAAEFASKHGGAYYKEVMEKNKQYVVQPPTVEKCQELSKQLFYTRLASLPGRYEAFWKELDSVKQVWKNRKDLKVEDLGIATLFGVELYAWFCVGEIVGRGFTLTGYKV

SEQ ID NO: 1302 - protein, 122 aa, Zea mays
MAARLAQLRAQAVQAAEFASKHGGSYYKELMEKNKQYVVQPPTIEKCQELSKQLFYTRLASLPGRYESFWKELDGVKQVWKNRKDLKVEDLGIATLFGVELYAWFCVGEIVGRGFTLTGYKV

SEQ ID NO: 1303 - protein, 122 aa, Zea mays
MAARLAQLRAQAVQAAEFASKHGGSYYKELMEKNKQYVVQPPTIEKCQELSKQLFYTRLASLPGRYESFWKELDGVKQVWKNRKDLKVEDLGIATLFGVELYAWFCVGEIVGRGFTLTVYKV

SEQ ID NO: 1304 - protein, 122 aa, Zea mays
MAAKLAQLRTQVTRAAEFASKHGCSYYKEVMEKNKQYVVQPPTVEKCQELSKQLFYTRLASLPGRYESFWKELDCVKQVWKNRKDLTVEDLGIASLFGVELYAWFCVGEIVGRGFTLTGYKV

SEQ ID NO: 1305 - protein, 122 aa, Hordeum vulgare subsp. vulgare
MAARLAQLRTKAAQAAEFASKHGGAYYKEAMEKNKQYVVQPPSVEKCQELSKQLFYTRLASLPGRYEALWKEVDGVKQLWKNRKELRVEDLGIATLFGVELYAWFCLGEIAGRGFTLTGYKV

SEQ ID NO: 1306 - protein, 122 aa, Oryza sativa Japonica Group
MASRLAQLRSKAAQASELVSKHGCAYYKEVMEKNKQHVVQPPTVEKCQELSKQLFYTRLASLPGRYEAFWKEFDGVKQVWKNRKELKVEDLGIVTLFGVELYAWFCVGEIVGRGFTITGYKV

SEQ ID NO: 1307 - protein, 122 aa, Musa balbisiana
MASKLHQLRSKAVQASEFVVKHGCAYYKELLEKNKQHIVQPPTVEKCQELSKQLFYTRLASIPGRYESFWKELDGVKRKWRNREDLKIEDAGIAALFGLELYAWFCVGEIVGRGFTFTGYYV

SEQ ID NO: 1308 - protein, 122 aa, Solanum tuberosum
MASKIQQLQSQACQASKFVAKHGTAYYKQLLEQNKQYIVEPPTVEKCNELSKQLLYTRLASIPGRYEAFWKELDSVKQMWKNRKELKVEDAGIAALFGLECFAWYCAGEIIGRGFTFTGYYP

SEQ ID NO: 1309 - protein, 125 aa, Oryza sativa Japonica Group
MAALASKLAQMQAKACDAARFAAKHGCAYHRALMEKNQKYVADPPTIERCQELSKQLFYTRLASLPGRYEAFWKEADQVKNLWRNRKDLNVEHAGVAALFGIELYAWFCVGEIVGRGFTFTGYHV

SEQ ID NO: 1310 - protein, 125 aa, Hordeum vulgare subsp. vulgare
MAALGSKLAQLQAKACEATRFAARHGCAYHKTLMEKNKQFVVQPPTVEKCQELSKQLFYTRIASIPGRCEAFWKEVDQVKQLWRNRSDLNVEHAGIAALFGLELYGWFCVGEIAGRGFTLTGYSV

SEQ ID NO: 1311 - protein, 486 aa, Sorghum bicolor
MAGAAVAAANGGACCHAAKGPGYATPLEAMEKGPREKLVYVTCVYNGTGINKPDYLATVDLDPDSPTYSQVIHRLPVTHIGDELHHSGWNSCSSCHGDPSAKRRFLILPSLLSGRVYVVDTATDPRAPSLHKVVESEDIAEKTGLGFPHTSHCLASGDIMISCLGDKEGNAAGNGFLLLDSEFNVKGRWEKPGHSPLFGYDFWYQPRHKTMISSSWGAPAAFRTGFNLQHVQDGLYGRHLHVYDWPGGELKQTLDLGDTGLLPLEVRFLHDPSKDTGYVGCALTSNMVRFFKTADGSWSHEVAISVKPLKVRNWILPEMPGLITDFVLSLDDRYLYLVNWLHGDIRQYNIEDPAKPFLAGQVWVGGLLQKGSDVVYVTDDGQEEQYNVPQVKGHRLRGGPQMIQLSLDGKRIYVTNSLFSRWDEQFFGDDFVKKGSHMLQIDVDTEKGGLAINPNFFVDFGTEPDGPALAHEMRYPGGDCTSDIWI

SEQ ID NO: 1312 - protein, 493 aa, Zea mays
MAGAAAVETAAAAAAANGKACCHAAKGPGYATPLEAMEKGPREKLVYVTCVYNGTGINKPDYLATVDLDPSSPTYSQVIHRLPVTHIGDELHHSGWNSCSSCHGDPSAKRRFLILPSLLSGRVYVVDTATDPRAPSLHKVVESEDIAENTGLGFPHTSHCLASGDIMISCLGDKEGNAAGNGFLLLDSEFNVKGRWEKPGHSPLFGYDFWYQPRHKTMISSSWGAPAAFRTGFDLQHVQDGLYGRHLHVYDWPGGELKQTLDLGDTGLLPLEVRFLHDPSKDTGYVGCALTSNMVRFFKTADGSWSHEVAISVKPLKVRNWILPEMPGLITDFVISLDDRYLYFVNWLHGDIRQYNIEDPAKPFLAGQVWVGGLLQKGSDVVYVTDDGQEQQYNVPQVKGHRLRGGPQMIQLSLDGKRIYVTNSLFSRWDEQFFGDDLVKKGSHMLQIDVDTEKGGLAVNPNFFVDFGTEPDGPALAHEMRYPGGDCTSDIWI

SEQ ID NO: 1313 - protein, 457 aa, Zea mays
MEKGPREKLVYVTCVYNGTGINKPDYLATVDLDPSSPTYSQVIHRLPVTHIGDELHHSGWNSCSSCHGDPSAKRRFLILPSLLSGRVYVVDTATDPRAPSLHKVVESEDIAENTGLGFPHTSHCLASGDIMISCLGDKEGNAAGNGFLLLDSEFNVKGRWEKPGHSPLFGYDFWYQPRHKTMISSSWGAPAAFRTGFDLQHVQDGLYGRHLHVYDWPGGELKQTLDLGDTGLLPLEVRFLHDPSKDTGYVGCALTSNMVRFFKTADGSWSHEVAISVKPLKVRNWILPEMPGLITDFVISLDDRYLYFVNWLHGDIRQYNIEDPAKPFLAGQVWVGGLLQKGSDVVYVTDDGQEQQYNVPQVKGHRLRGGPQMIQLSLDGKRIYVTNSLFSRWDEQFFGDDLVKKGSHMLQIDVDTEKGGLAVNPNFFVDFGTEPDGPALAHEMRYPGGDCTSDIWI

SEQ ID NO: 1314 - protein, 457 aa, Zea mays
MEKGPREKLVYVTCVYNGTGINKPDYLATVDLDPSSPTYSQVIHRLPVTHIGDELHHSGWNSCSSCHGDPSAKRRFLILPSLLSGRVYVVDTATDPRAPSLHKVVESEDIAENTGLGFPHTSHCLASGDIMISCLGDKEGNAAGNGFLLLDSEFNVKGRWEKPGHSPLVGYDFWYQPRHKTMISSSWGAPAAFRTGFDLQHVQDGLYGRHLHVYDWPGGELKQTLDLGDTGLLPLEVRFLHDPSKDTGYVGCALTSNMVRFFKTADGSWSHEVAISVKPLKVRNWILPEMPGLITDFVISLDDRYLYFVNWLHGDIRQYNIEDPAKPFLAGQVWVGGLLQKGSDVVYVTDDGQEQQYNVPQVKGHRLRGGPQMIQLSLDGKRIYVTNSLFSRWDEQFFGDDLVKKGSHMLQIDVDTEKGGLAVNPNFFVDFGTEPDGPALAHEMRYPGGDCTSDIWI

SEQ ID NO: 1315 - protein, 482 aa, Oryza sativa Japonica Group
MAAAANGAACCGGATGPGYATPLEAMEKGPREKLLYVTCVYNGTGINKPDYLGTVDVDPNSPTYSQVIHRLPVTHVGDELHHSGWNACSSCHGDPSASRRFLILPSLLSGRVYVVDTLKDPRAPALHKVVEAEDIAEKTGLGFPHTSHCLASGEIMISCLGDKEGNAAGNGFLLLDSEFNVKGRWEKPGHSPLFGYDYWYQPRHKTMISSSWGAPAAFRTGFDLQHVQDGLYGRHLHVYDWPGGELKQTLDLGSTGLLPLEVRFLHDPSKDTGYVGCALTSNMVRFFKTADGSWSHEVAISIKPLKVRNWILPEMPGLITDFVISLDDRYLYLVNWLHGDIRQYNIEDPAKPVLAGQVWAGGLLQKGSEVVYVTEDDKEEQYSVPQVKGHRLRGGPQMIQLSLDGKRIYVTNSLFSRWDEQFYGQDLVKKGSHMLQIDVDTEKGGLSINPNFFVDFGAEPEGPSLAHEMRYPGGDCTSDIWI

SEQ ID NO: 1316 - protein, 496 aa, Hordeum vulgare subsp. vulgare
MAAAVAEAAVPAPAKANGAGAGAGCCAAKGPGYATPREAMEKGPREGLLYVTCVYNGTGIDKPDYLATVDVDPSSATYSQVIHRLPATHIGDELHHSGWNACSSCHGDPSTSRRFLILPSLLSGRVYVVDTAKDPRAPALHKVVQAEDIAEKTGLGFPHTSHCLATGDIMISCLGDKEGNAAGNGFLLLDSEFNVKGRWEKPGHSPLFGYDFWYQPRHKTMISSSWGAPAAFRTGFDLQHVQDGLYGRHLHVYDWPGGELKQTLDLGSTGLLPLEVRFLHDPSKDTGYVGCALTSNMVRFFKTADGSWSHEVAISIEPLKVRNWMLPEMPGLITDFVISLDDRYLYLVNWLHGDIRQYNIEDPTKPVLAGQVFVGGLLQKGGDVVYVTDDDKEEQYAVPQVKGHRLRGGPQMIQLSLDGKRVYVTNSLFSRWDEQFYGPDLLKKGSHMLQIDVDTEKGGLSVNPDFFVDFGTEPEGPSLAHEMRYPGGDCTSDIWI

SEQ ID NO: 1317 - protein, 457 aa, Oryza sativa (japonica cultivar-group)
MEKGPREKLLYVTCVYNGTGINKPDYLGTVDVDPNSPTYSQVIHRLPVTHVGDELHHSGWNACSSCHGDPSASRRFLILPSLLSGRVYVVDTLKDPRAPALHKVVEAEDIAEKTGLGFPHTSHCLASGEIMISCLGDKEGNAAGNGFLLLDSEFNVKGRWEKPGHSPLFGYDYWYQPRHKTMISSSWGAPAAFRTGFDLQHVQDGLYGRHLHVYDWPGGELKQTLDLGSTGLLPLEVRFLHDPSKDTGYVGCALTSNMVRFFKTADGSWSHEVAISIKPLKVRNWILPEMPGLITDFVISLDDRYLYLVNWLHGDIRQYNIEDPAKPVLAGQVWAGGLLQKGSEVVYVTEDDKEEQYSVPQVKGHRLRGGPQMIQLSLDGKRIYVTNSLFSRWDEQFYGQDLVKKGSHMLQIDVDTEKGGLSINPNFFVDFGAEPEGPSLAHEMRYPGGDCTSDIWI

SEQ ID NO: 1318 - protein, 483 aa, Populus trichocarpa
MATGTEVVSDNGHGCCKKGPGYATPLEAMSGPRESLLYVTCVYSGTGIEKPDYLATVDVDPNSPTYSKVIHRLPMPNVGDELHHTGWNSCSSCHGDPSAARRYLVLPSLISGRIYAIDTLKDPRAPSLHKVVEPADIVNKTGLAYPHTSHCLASGDVMVSCLGDKDGNAEGNGFLLLDSEFNVKGRWEKPGHSPTFGYDFWYQPRHNIMISSSWGAPAAFTKGFNLQHVADGLYGRHLNVYSWPHGELKQTLDLGDTGLLPLEIRFLHDPSKDSGFVGCALTSNMVRFFKTPDGSWSHEVAISVKPLKVQNWILPEMPGLVTDFLISLDDRFLYFVNWLHGDVRQYSIEDPEKPVLKGQVWVGGLIQKGSSVVAEGEDGKTWQYDVPEIQGHRLRGGPQMIQLSLDGKRLYVTNSLFSTWDRQFYPELMEKGSHMLQIDVDTEKGGLAINPNYFVDFAAEPDGPSLAHEMRYPGGDCTSDIWI

SEQ ID NO: 1319 - protein, 483 aa, Populus trichocarpa
MATGTEVVSAHGHGCCKKGPGYASPLEAMSGPRESLIYVTCVYAGTGIEKPDYLATVDVDPNSPNYSKVIHRLPMPNLGDELHHSGWNSCSSCHGDPSAARRYLILPSLISGRIYAIDTLKDPRAPSLHKVVEPADIVNKTGLAYPHTSHCLASGDVMVSCLGDKDGKAEGNGFLLLDSEFNVKGRWEKPGHSPKFGYDFWYQPRHNTMISSSWGAPAAFTKGFNPQHVSDGLYGRHLHVYSWPNGELKQTLDLGSTGLLPLEIRFLHNPSKDTGFVGCALTSNMVRFFKTPDESWSHEVAISVKPLKVQNWILPEMPGLITDFLLSLDDRFLYFVNWLHGDVRQYNIEDPKNPVLKGQVWVGGLIQKGSPVVAEGEDGKTWQYDVPEIQGHRLRGGPQMIQLSLDGKRLYVTNSLFSTWDRQFYPEVVEKGSHMLQIDVDTEKGGLAINPNYFVDFASEPDGPSLAHEMRYPGGDCTSDIWI

SEQ ID NO: 1320 - protein, 475 aa, Ricinus communis
MVKDSCCMNKGPGYATPLEAMSGPRESLIYVTCVYSGTGIDKPDYLATVDINPNSPTYSQVIHRLPVPYVGDELHHSGWNACSSCHGDPSANRRFLILPSLISGRIYVIDTQKDPKAPSLHKVVEPADIIQKTGLAYPHTSHCLGSGDIMISCLGDKDGKAEGNGFLLLDSNFNVKGRWEKPGHSPLFGYDFWYQPRHNTMISSSWGAPAAFSKGFDLQHVSDGLYGRHLHVYSWPNGELKQTLDLGNTGLLPLEIRFLHDPSKDTGFVGCALTSNMVRFFKTPDGSWSHEVAISVKPLKVKNWILPEMPGLITDFLISLDDRFLYFVNWLHGDIRQYNIEDLKNPVLTGQVWVGGLLQKGSPIMVETEDRSTWQADVPEIQGNRLRGGPQMIQLSLDGKRLYVTNSLFSTWDRQFYPELVEKGSHMLQIDVDTEKGGLKVNPNFFVDFAAEPDGPSLAHEMRYPGGDCTSDIWI

SEQ ID NO: 1321 - protein, 579 aa, Sorghum bicolor; identical to SEQ ID NO: 1068

SEQ ID NO: 1322 - protein, 582 aa, Zea mays; identical to SEQ ID NO: 1069

SEQ ID NO: 1323 - protein, 582 aa, Zea mays; identical to SEQ ID NO: 1070

SEQ ID NO: 1324 - protein, 577 aa, Oryza sativa Indica Group; identical to SEQ ID NO: 1071

SEQ ID NO: 1325 - protein, 577 aa, Oryza sativa Japonica Group; identical to SEQ ID NO: 1072

SEQ ID NO: 1326 - protein, 572 aa, Hordeum vulgare subsp. vulgare; identical to SEQ ID NO: 1073

SEQ ID NO: 1327 - protein, 572 aa, Hordeum vulgare subsp. vulgare; identical to SEQ ID NO: 1074

SEQ ID NO: 1328 - protein, 587 aa, Zea mays; identical to SEQ ID NO: 1075

SEQ ID NO: 1329 - protein, 585 aa, Zea mays; identical to SEQ ID NO: 1076

SEQ ID NO: 1330 - protein, 579 aa, Sorghum bicolor; identical to SEQ ID NO: 1077

SEQ ID NO: 1331 - protein, 337 aa, Zea mays
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKAAAHLKGGAKKVVISAPSKDAPMFVVGVNEKEYKSDINIVSNASCTTNCLTPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNSTN

SEQ ID NO: 1332 - protein, 337 aa, Zea mays
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKAAAHLKGGAKKVVISAPSKDAPMFVVGVNEKEYKSDINIVSNACCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNSTN

SEQ ID NO: 1333 - protein, 337 aa, Zea mays
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKAAAHLKGGAKKVVISAPSKDAPMFVVGVNEKEYKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNSTK

SEQ ID NO: 1334 - protein, 337 aa, Zea mays
MAKIKIGINGFGRIGRLVARVALQSDDVELVAVNDPFISTDYMTYMFKYDTVHGQWKHHEVKVKDSKTLLFGEKEVTVFGCRNPEEIPWGSVGAEYVVESTGVFTDQEKAAAHLKGGAKKVVISAPSKDAPMFVVGVNEKEYKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAESEGSLKGILGYVEEDLVSTDFQGDSRSSIFDAKAGIALNGNFVKLVSWYDNEWGYSTRVVDLIRHMNSTK

SEQ ID NO: 1335 - protein, 337 aa, Zea mays
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKAAAHLKGGAKKVVISAPSKDAPMFVVGVNEKEYKSDINIVSNACCTTNCLAPLAKVINDKFGIVEGLMTTVHAITATQKTVDGPSSKDWRGGRAASFNIIPSSTGAAKGVPHLLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNSTN

SEQ ID NO: 1336 - protein, 337 aa, Sorghum bicolor
MAKIKIGINGFGRIGRLVARVALQSDDVELVAVNDPFITTDYMTYMFKYDTVHGQWKHHEVKVKDSKTLLFGEKEVAVFGSRNPEEIPWGSVGADYVVESTGVFTDQEKAAAHLKGGAKKVVISAPSKDAPMFVVGVNEKEYKSDINIVSNASCTTNCLAPLAKVINDKFGIVEGLMTTVHAITATQKTVDGPSAKDWRGGRAASFNIIPSSTGAAKAVGKVLPVLNGKLTGMAFRVPTVDVSVVDLTVRLEKSATYDEIKAAVKAEAEGSLKGILGYVDEDLVSTDFQGDSRSSIFDAKAGIALNGNFVKLVSWYDNEWGYSTRVVDLIRHMSSTN

SEQ ID NO: 1337 - protein, 337 aa, Oryza sativa Japonica Group
MAKIKIGINGFGRIGRLVARVALQSDDVELVAVNDPFITTDYMTYMFKYDTVHGQWKHHEVKVKDSKTLLFGEKEVTVFGCRNPEEIPWGETGAEFVVESTGVFTDKDKAAAHLKGGAKKVVISAPSKDAPMFVVGVNEKEYKPDIDIVSNASCTTNCLAPLAKVINDRFGIVEGLMTTVHAITATQKTVDGPSSKDWRGGRAASFNIIPSSTGAAKAVGKVLPALNGKLTGMAFRVPTVDVSVVDLTVRLEKPASYDQIKAAIKEESEGKLKGILGYVEEDLVSTDFQGDNRSSIFDAKAGIALNDNFVKLVSWYDNEWGYSSRVVDLIRHMYNTQ

SEQ ID NO: 1338 - protein, 337 aa, Oryza sativa Japonica Group
MGKIKIGINGFGRIGRLVARVALQSEDVELVAVNDPFITTEYMTYMFKYDTVHGQWKHHEVKVKDSKTLIFGTKEVAVFGCRNPEEIPWAAAGAEYVVESTGVFTDKDKAAAHLKGGAKKVVISAPSKDAPMFVVGVNEKEYKSDVNIVSNASCTTNCLAPLAKVINDRFGIVEGLMTTVHAITATQKTVDGPSMKDWRGGRAASFNIIPSSTGAAKAVGKVLPALNGKLTGMAFRVPTVDVSVVDLTVRLEKPASYDQIKAAIKEEAEGKLKGILGYVEEDLVSTDFQGDSRSSIFDAKAGIALSDTFVKLVSWYDNEWGYSTRVIDLIRHMHSTN

SEQ ID NO: 1339 - protein, 356 aa, Oryza sativa Indica Group
MGATFELVEATIVEVQRQGGGKIKIGINGFGRIGRLVARVALQSEDVELVAVNDPFITTEYMTYMFKYDTVHGQWKHHEVKVKDSKTLIFGTKEVAVFGCRNPEEIPWAAAGAEYVVESTGVFTDKDKAAAHLKGGAKKVVISAPSKDAPMFVVGVNEKEYKSDVNIVSNASCTTNCLAPLAKVINDRFGIVEGLMTTVHAITATQKTVDGPSMKDWRGGRAASFNIIPSSTGAAKAVGKVLPALNGKLTGMAFRVPTVDVSVVDLTVRLEKPASYDQIKAAIKEEAEGKLKGILGYVEEDLVSTDFQGDSRSSIFDAKAGIALSDTFVKLVSWYDNEWGYSTRVIDLIRHMHSTN

SEQ ID NO: 1340 - protein, 337 aa, Triticum aestivum
MGKIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDHFVKLVSWYDNEWGYSTRVVDLIRHMHSTK

SEQ ID NO: 1341 - protein, 579 aa, Sorghum bicolor; identical to SEQ ID NO: 1077

SEQ ID NO: 1342 - protein, 587 aa, Zea mays; identical to SEQ ID NO: 1075

SEQ ID NO: 1343 - protein, 584 aa, Zea mays; identical to SEQ ID NO: 1080

SEQ ID NO: 1344 - protein, 585 aa, Zea mays; identical to SEQ ID NO: 1076

SEQ ID NO: 1345 - protein, 579 aa, Oryza sativa Japonica Group; identical to SEQ ID NO: 1082

SEQ ID NO: 1346 - protein, 577 aa, Oryza sativa Japonica Group; identical to SEQ ID NO: 1083

SEQ ID NO: 1347 - protein, 577 aa, Oryza sativa Indica Group; identical to SEQ ID NO: 1084

SEQ ID NO: 1348 - protein, 577 aa, Hordeum vulgare subsp. vulgare; identical to SEQ ID NO: 1085

SEQ ID NO: 1349 - protein, 579 aa, Sorghum bicolor; identical to SEQ ID NO: 1068

SEQ ID NO: 1350 - protein, 551 aa, Oryza sativa Japonica Group; identical to SEQ ID NO: 1087

SEQ ID NO: 1351 - protein, 488 aa, Sorghum bicolor; identical to SEQ ID NO: 1249

SEQ ID NO: 1352 - protein, 487 aa, Zea mays; identical to SEQ ID NO: 1250

SEQ ID NO: 1353 - protein, 489 aa, Zea mays; identical to SEQ ID NO: 1251

SEQ ID NO: 1354 - protein, 487 aa, Zea mays; identical to SEQ ID NO: 1252

SEQ ID NO: 1355 - protein, 489 aa, Zea mays; identical to SEQ ID NO: 1253

SEQ ID NO: 1356 - protein, 477 aa, Oryza sativa Indica Group; identical to SEQ ID NO: 1254

SEQ ID NO: 1357 - protein, 477 aa, Oryza sativa Japonica Group; identical to SEQ ID NO: 1255

SEQ ID NO: 1358 - protein, 473 aa, Hordeum vulgare subsp. vulgare; identical to SEQ ID NO: 1256

SEQ ID NO: 1359 - protein, 476 aa, Oryza sativa Indica Group; identical to SEQ ID NO: 1257

SEQ ID NO: 1360 - protein, 461 aa, Oryza sativa Japonica Group; identical to SEQ ID NO: 1258

SEQ ID NO: 1361 - protein, 489 aa, Zea mays; identical to SEQ ID NO: 1251

SEQ ID NO: 1362 - protein, 489 aa, Zea mays; identical to SEQ ID NO: 1253

SEQ ID NO: 1363 - protein, 487 aa, Zea mays; identical to SEQ ID NO: 1250

SEQ ID NO: 1364 - protein, 487 aa, Zea mays; identical to SEQ ID NO: 1252

SEQ ID NO: 1365 - protein, 488 aa, Sorghum bicolor; identical to SEQ ID NO: 1249

SEQ ID NO: 1366 - protein, 473 aa, Hordeum vulgare subsp. vulgare; identical to SEQ ID NO: 1256

SEQ ID NO: 1367 - protein, 477 aa, Oryza sativa Indica Group; identical to SEQ ID NO: 1254

SEQ ID NO: 1368 - protein, 477 aa, Oryza sativa Japonica Group; identical to SEQ ID NO: 1255

SEQ ID NO: 1369 - protein, 476 aa, Oryza sativa Indica Group; identical to SEQ ID NO: 1257

SEQ ID NO: 1370 - protein, 461 aa, Oryza sativa Japonica Group; identical to SEQ ID NO: 1258

SEQ ID NO: 1371 - protein, 295 aa, Sorghum bicolor
MEVGFLGLGIMGKAMAANLLRHGFRVTVWNRTLAKCQELAALGATVGETPASVVSKCRYTIAMLSDPSAALSVVFDKDGVLEQIGSGKGYVDMSTVDAATSTKISEAVKQKGGAFLEAPVSGSKKPAEDGQLVILAAGDKPLYDGMVPAFDVLGKKSFFLGEIGNGAKMKLVVNMIMGSMMNALSEGLCLADKSGLSPQTLLDVLDLGAIANPMFKLKGPTMLQGSYNPAFPLKHQQKDMRLALALGDENAVAMPVSAAANEAFKKARSLGLGDQDFSAVYEVVKGAGGSGSGQA

SEQ ID NO: 1372 - protein, 295 aa, Zea mays
MEVGFLGLGIMGKAMATNLLRHGFRVTVWNRTLAKCQELAALGATVGETPASVVSKCRYTIAMLSDPSAALSVVFDKDGVLEQIGSGKGYVDMSTVDAATSTKISEAVKQKGGAFLEAPVSGSKKPAEDGQLVILAAGNKPLYDGMIPAFDVLGKKSFFLGEIGNGAKMKLVVNMVMGSMMNSLSEGLCLADKSGLSPQTLLDVLDLGAIANPMFKLKGPTMLQGSYSPAFPLKHQQKDMRLALALGDENAVAMPVSAAANEAFKKARSLGLGDQDFSAVYEVVKGAGGSGSGQP

SEQ ID NO: 1373 - protein, 293 aa, Oryza sativa Japonica Group
MEVGFLGLGIMGKAMAANLLRHGFRVTVWNRTLSKCQELVALGAAVGETPAAVVAKCRYTIAMLSDPSAALSVVFDKDGVLEQIGEGKGYVDMSTVDAATSCKISEAIKQKGGAFVEAPVSGSKKPAEDGQLVILAAGDKVLYDDMVPAFDVLGKKSFFLGEIGNGAKMKLVVNMIMGSMMNALSEGLSLADNSGLSPQTLLDVLDLGAIANPMFKLKGPSMLQGSYNPAFPLKHQQKDMRLALALGDENAVSMPVAAASNEAFKKARSLGLGDLDFSAVYEVLKGAGGSGKA

SEQ ID NO: 1374 - protein, 291 aa, Hordeum vulgare subsp. vulgare
MEVGFLGLGIMGKAMAANLLRHGFRVTVWNRTLSKCDELVAMGAAVGDTPASVVAKCKYTIAMLSDPSAALSVVFDKDGVLEQIGEGKGYVDMSTVDAATSCKISEAVKQKGGAFVEAPVSGSKKPAEDGQLVILAAGDKALYDDMVPAFDILGKKSFFLGEMGNGAKMKLVVNMIMGSMMNAFSEGLCLADKSGLSPQTLLDVLDLGAIANPMFKMKGPSMLQGSYNPAFPLKHQQKDMRLALSLGDENAVSMPVAAAANEAFKKARSLGLGDLDFSAVHEVLKGTGGSG

SEQ ID NO: 1375 - protein, 291 aa, Vitis vinifera
MEVGFLGLGIMGKAMSINLIRSGFKLTVWNRTLSKCDELVELGASIGETPAAVVKKCNYTIAMLSDPSVALSVVFDKDGVLEQICHGKGYIDMSTVGADTSSKISEAITSKGGSFLEAPVSGSKKPAEDGQLVILAAGEKALYDEAIPAFDIMGKKSFFLGQVGNGAKMKLVVNMIMGSMMNAFSEGLVLADRSGLNPHTLLDVLDLGGIANPMFRLKGPTMIQNNYSPAFPLKHQQKDMRLALALGDENAVSMPVAAAANEAFKKARSLGLGDLDFSAVYETVKTLEHSS

SEQ ID NO: 1376 - protein, 290 aa, Glycine max
MEFGFLGLGIMGKAMAINLLRHGFKVTIWNRTLSKCDELVQHGASVGETPATVVKKCKYTIAMLSDPSAALSVVFDKDGVLEHINGKCYIDMSTVDADTSSKISETIKAKGGYFLEAPVSGSKKPAEDGQLIILAAGDKALYDEVLPAFDVLGKKSFFLGEVGNGAKMKLVVNVIMGSMMNAFSEGLTLAERSGLNPGTLLDVLDLGAISNGMFKLKGPTMLQNSYSPAFPLKRQQKDMRLALALGDENAVSMPVAAAANEAFKKARSMGLGDLDFSAVHETLKAPDHSS

SEQ ID NO: 1377 - protein, 287 aa, Vitis vinifera
MEVGFLGLGIMGKAMSINLIRSGFKLTVWNRTLSKCDELVELGASIGETPAAVVKKCNYTIAMLSDPSVALSVNGVLEQICHGKGYIDMSTVGADTSSKISEAITSKGGSFLEAPVSGSKKPAEDGQLVILAAGEKALYDEAIPAFDIMGKKSFFLGQVGNGAKMKLVVNMIMGSMMNAFSEGLVLADRSGLNPHTLLDVLDLGGIANPMFRLKGPTMIQNNYSPAFPLKHQQKDMRLALALGDENAVSMPVAAAANEAFKKARSLGLGDLDFSAVYETVKTLEHSS

SEQ ID NO: 1378 - protein, 289 aa, Populus trichocarpa
MEVGFLGLGIMGKAMSMNLLKNGFKVTVWNRTLSKCNELVEFGASIGETPAQVVKKCRLTIAMLSDPAAALSVVFDKDGVLEQIDSGKGYIDMSTVDPETSSKISQAITSKGGAFLEAPVSGSKQPAETGQLVILAAGDKGLYEESIPAFDVLGKKSFFLGQVGNGAKMKLVVNMIMGSMMNAFSEGLVLSERSGLNPHDLLDILDLGGIANPMFRGKGPAMLKSNHSPAFPLKHQQKDMRLALALGDENAVSMPVAAAANESFKKARSMGLGDLDFSAVHEILKMTKD

SEQ ID NO: 1379 - protein, 287 aa, Solanum lycopersicum
MEEIGFLGIGIMGKAMAVNLLRHGFKVTVWNRTLSRCDELVQHGASVGETPAEVIKKCKYTIAMLSDPAAALSVVFDKHGALEHICAGKGYIDMSTVDADTSSQISQAITSKGGSFLEAPVSGSKKPAEDGQLVILAAGDKDLYDQVVPAFDVLGKKSFFLGKIGNGAKMKLVVNMIMGSMMNAFSEGIVLADKSGLDPHTLLDVLDLGAIANPMFKMKGPAMIKNSYPPAFPLKHQQKDMRLALALGDENAVPMPVAAAANEAFKKARSLGLGDLDFSAVFETLSK

SEQ ID NO: 1380 - protein, 293 aa, Picea sitchensis
MEVGFLGLGIMGKAMAVNLLRNGFKVTVWNRTLSRCEELVEQGASMGSTPAEVVKKCKYIIAMLSDPPAALSVVFGKDGVLEQMCTGKGYIDMSTVDTVTSTKISEAIIEKGGRFLEAPVSGSKKPAEDGQLIILAAGDKSLYDEVMPSFDVMGKKAFFLGEVGNGAKMKLVVNMIMGSMITAFSEGLALADKSGLSQTTLLDVLELGAIANPMFKLKGPAMIQEKFPTAFPLKHQQKDMRLALALGDEVEVSMPVAAAANEAFKKGISLGLSDQDFSAVYQVVKESSAASKV

SEQ ID NO: 1381 - protein, 523 aa, Zea mays; identical to SEQ ID NO: 1273

SEQ ID NO: 1382 - protein, 660 aa, Sorghum bicolor; identical to SEQ ID NO: 1274

SEQ ID NO: 1383 - protein, 665 aa, Hordeum vulgare subsp. vulgare; identical to SEQ ID NO: 1275

SEQ ID NO: 1384 - protein, 660 aa, Oryza sativa Japonica Group; identical to SEQ ID NO: 1276

SEQ ID NO: 1385 - protein, 660 aa, Oryza sativa Indica Group; identical to SEQ ID NO: 1277

SEQ ID NO: 1386 - protein, 638 aa, Oryza sativa Indica Group; identical to SEQ ID NO: 1278

SEQ ID NO: 1387 - protein, 638 aa, Oryza sativa Japonica Group; identical to SEQ ID NO: 1279

SEQ ID NO: 1388 - protein, 656 aa, Oryza sativa Japonica Group; identical to SEQ ID NO: 1280

SEQ ID NO: 1389 - protein, 718 aa, Zea mays
MKSLAKQETQPKSRLIVRLGVFLASHHILFSVICCYAGIIALLLLPSLAKNTYLSENALIPGSANPLFSTEDAIEANRFMKAIEAVARDSSSVIGMANFIAQQIEDLGAEVCYQKFLPHGKNFHPLKFFTSMTNDIAIQPNGTATNFGINTIGILRAPRGDGKEAIVLVTPYNSQRVQSNELLSLALGFSVFSLLSRAAWLSKDVVWLSADSQFGEYAAVSAWLNQYHNPVFLSHSVVSHTKMYGANNIYDGNSEKTEATAFKRAGTMAAALIFKVGETRRYSDRDSVTIYAEASNGQMPNLDLLNVVHYLAVHRQGFRVNIAAFSSLLSSAWLRVIAEILHTIGSVLRKINPDWKLDIAVPDYVEGTANLANSMYNQALGVPTGSHGAFRDYQVDAVSLEFSPTFHVKNENAKSLFLLKGGRLIEGVARSVNNLLEKFHQSFFLYFLTGPSKFISVGVYMIPFALLLAPLPIVAAALADGSRSMEKTADKLIGDGKTDGIADISQNKGGSWKWLRAAKVLLVVQLWAVLVSLLPYYITQIPDATPTQSTLIWVVLSIVVLISLSVLFGSPYSTGVEWKLLKATMITSISIGLGLMSIINFATAQLGALIVIPMCLFSRPLKASGMNFLPRAVLLASNVAFAVLGFPPVALLIMKGVSKGSRSWTIDVGDFWVWMEFLWERSSATYLYLFLVHLPCWLLCVLVFLHPCHQSEYKLKQE

SEQ ID NO: 1390 - protein, 718 aa, Oryza sativa Japonica Group
MASSAKEEAKPKPRLIVRLGVFLASHHILFSAVCCTAGIIALLFLPSLAKNTYLSENALIPGSANTLFSTEDVQEANRFAKGIEAAIGESRGGTTEIPKFIAQQTKNLGAEVYYHEFLPDSKCFHPLKFFTSMTNNMAAKPNGTYTNFGINTVGIIRAPRGDGKEAIVLVTPYNSQKVTPNELLSLALGFSVFSLLSRAAWLSKDIVWLSADSQFGEYSAVSSWLNQYHNPMFLSHPVNLDTKIYGANQILYKPDGTAEKAELMAFKRAGTMAAALIFKVGETRKYGDRDSVTMYAEASNGQMPNLDLLNVVHYLAVHRQGFRVNVETFNSLLSSSWLRVIAEVFQNLGSLLRKINPDWKLDVTVPDYVEGTANLASSMYNQALGVPTGSHGAFRDYQVDAVSLEFAPAFHLKNENAKSSFLLRGGRLTEGVVRSVNNLLEKFHQSFFLYFLTAPSKFISVGVYMIPFALLLAPLPIVAAALAGGSKTKGKLEDECKTKGNADDLQMEGGSWKWLKSARVLLIIQFWAVLVSLLPYYISQIPGAMPIQYAVIWAVLSITILIILYAMFGSPSRAGVEWKLLKATMITSITIGMGLMSIINFATAQLGALILIPMCLFSRPLRAQLEMNFLPRTVLLASNILLTVLGFPPAAFLIMKGLSKGSWTVDIVGDFWLWMEFLWEWSSATYLYVFLVHLPCWLLCIHVLLHPCYQPESKMKQE

SEQ ID NO: 1391 - protein, 718 aa, Oryza sativa Indica Group
MASSAKEEAKPKPRLIVRLGVFLASHHILFSAVCCTAGIIALLFLPSLAKNTYLSENALIPGSANTLFSTEDVQEANRFAKGIEAAIGESRGGTTEIPKFIAQQTKNLGAEVYYHEFLPDSKCFHPLKFFTSMTNNMAAKPNGTYTNFGINTVGIIRAPRGDGKEAIVLVTPYNSQKVTPNELLSLALGFSIFSLLSRAAWLSKDIVWLSADSQFGEYSAVSSWLNQYHNPMFLSHPVNLDTKIYGANQILYKPDGTAEKAELMAFKRAGTMAAALIFKVGETRKYGDRDSVTMYAEASNGQMPNLDLLNVVHYLAVHRQGFRVNVETFNSLLSSSWLRVIAEVFQNLGSLLRKINPDWKLDVTVPDYVEGTANLASSMYNQALGVPTGSHGAFRDYQVDAVSLEFAPAFHLKNENAKSSFLLRGGRLTEGVVRSVNNLLEKFHQSFFLYFLTAPSKFISVGVYMIPFALLLAPLPIVAAALAGGSKTKGKLEDECKTKGNADDLQMEGGSWKWLKSARVLLIIQFWAVLVSLLPYYISQIPGAMPIQYAVIWAVLSITILIILYAMFGSPSRAGVEWKLLKATMITSITIGMGLMSIINFATAQLGALILIPMCLFSRPLRAQLEMNFLPRTVLLASNILLTVLGFPPAAFLIMKGLSKGSWTVDIVGDFWLWMEFLWEWSSATYLYVFLVHLPCWLLCIHVLLHPCYQPESKMKQE

SEQ ID NO: 1392 - DNA, 1916 bp, Zea mays
aagccacgcaacaccgcagcatttcttcttcttcttgtcagtagctgtggcctgcacagctagcgccactgtaccgccattgttttgttagcatggccccgagtaacatcgtcgttcagagcagcagcactccgccggttgccggcggcgacgaggagttcgcgccgtctgtatggggagatttcttcgtcacctatgcccctcccgtctcacaggcatcagagcagcggatgagtgagagagcggagctgctcaaggcgcaagtacgtcaggcgttcgatgctgccagcatggatgttgcaggtctggtcacgtacgtcgacaccctcgaacgcctcggcttagacaaccacttccgcgacctcatcggagctgccctggaacgaatcggagctgaggagctgccggagcacggcggcggcctgcacatcgtcgcgcttcggtttcgcctgctccggcagcatgggatatgggtatctacagatgtgttcgacgcgttcagagaggacgcgggcggtttctgctcgagcctctgcagtgacgaccctaggggtctcctgagcttgtacaatgcggctcacatggcagtacccggcgaggtggtcctcgacgacgccatcgccttcgcgaggggccgcctcctggacatcatcagcaaaggcgaggtcaggtcaccggtgtcagagcagatcacacgagccctcgacatccccctcccacgatttacgaggcggctggaaaccatgcactatattgccgagtatgagcatgaagaggcacacgacggcctgctgcttgagctcgctaggctcaactttgtccttgtgagagcgcttcacctcagggagctgaaggacctgtcactatggtggagggatctctacaacactgtgaagctcccgtacgctcgggaccgtatggtggagatctacttttggacctgtggtatgcttcatgaggaggagtactccctggcacggatgttcttcgccaagacgttcgggatggtgtcactgatggacgacactttcgatgtccatgctactctagacgagtgtcacaagctcaaagaagctatgcagagatgggatgaaagtgaggtctccattctacccgagtatctacgcttgctgtatatcaaaacacttagcaacttcaaagagtttgaggagatcttggaaccgaacaagaagtaccgcatggcttacacaaaagaggcatacaagttgtgctccaaaaactacctaaaggaagccatctggtctaaccagaaataccagccaagcttcaaggagcatgaggagctatcaatcatgacctcaggcttgccgatgctcacgatcctaacactaatgggcttcggtgacgaggcaaccccggaggcgttcgaatgggtaagcagtgttcctgaaatggtccgcgctggttcgcaggtcactcgcttcctcaacgatttgtcttcttacaagttgggaaagaacaagaaagatatgcctggctctgtggagacctacatggtagagaatggcttaacaggagatgaggctgcagcggcaatcgcggcacttctagagaacaggtggagaatactaaaccaaacaaggatggagatagatcacacgctactgccagcggcgcaggtggtggtcaacatggcgagggcaaatgagatcatttacctccacggcagggacgcctacaccttcggtgctgacctcaaggaccttgtcaccacactcttcctcaagcaagtgctccctctctagacaatactctgatcacacaaccagattggctataacgattctcgtgttgtattacgctttgtgtttcattatgcacgctatatatatgatcaatgtacctgtttctattatattgatggtaatataatattctaaaaaaaaaaaaaaaaa

SEQ ID NO: 1393 - DNA, 1859 bp, Zea mays
gcatttcttcttcttcttgtcagtagctgtggcctgcacagctagcgccactgtaccgccattgttttgttagcatggccccgagtaacatcgtcgttcagagcagcagcactccgccggttgccggcggcgacgaggagttcgcgccgtctgtatggggagatttcttcgtcacctatgccactcccgtctcacaggcatcagagcagcggatgagtgagagagcggagctgctcaaggcgcaagtacgtcaggcgttcgatgctgccagcatggatgttgcaggtctgatcacgtacgtcgacaccctcgaacgcctcggcttagacaaccacttccgcgacctcatcggagctgccctggaacgaatcggagctgaggagctgccggagcacggcggcggcctgcacatcgtcgcgcttcggtttcgcctgctccggcagcatgggatatgggtatctacagatgtgttcgacgcgttcagagaggacgcgggcggtttctgctcgagcctctgcagtgacgaccctaggggtctcctgagcttgtacaatgcggctcacatggcagtacccggcgaggtggtcctcgacgacgccatcgccttcgcgaggggccgcctcctggacatcatcagcaaaggcgaggtcaggtcaccggtgtcagagcagatcacacgagccctcgacatccccctcccacgatttacgaggcggctggaaaccatgcactatattgccgagtatgagcatgaagaggcacacgacggcctgctgcttgagctcgctaggctcaactttgtccttgtgagagcgcttcacctcagggagctgaaggacctgtcactatggtggagggagctctacaacactgtgaagctcccgtacgctcgggaccgtatggtggagatctacttttggacctgtggtatgcttcatgaggaggagtactccctggcatggatgttcttcgccaagacgttcgggatggtgtcactgatggacgacactttcgatgtccatgctactctagacgagtgtcacaagctcaaagaagctatgcagagatgggatgaaagtgaggtctccattctacccgagtatctacgcttgctgtatatcaaaacacttagcaacttcaaagagtttgaggagatcttggaaccgaacaagaagtaccgcatggcttacacaaaagaggcatacaagttgtgctccaaaaactacctaaaggaagccatctggtctaaccagaaataccagccaagcttcaaggagcatgaggagctatcaatcatgacctcaggcttgccgatgctcacgatcctaacactaatgggcttcggtgacgaggcaaccccggaggcgttcgaatgggtaagcagtgttcctgaaatggtccgcgctggttcgcaggtcactcgcttcctcaacgatttgtcttcttacaagttgggaaagaacaagaaagatatgcctggctctgtggagacctacatggtagagaatggcttaacaggagatgaggctgcagcggcaatcgcggcacttctagagaacaggtggagaatactaaaccaaacaaggatggagatagatcacacgctactgccagcggcgcaggtggtgctcaacatggcgagggcaaatgagatcatttacctccacggcagagacgcctacaccttcggtgctgacctcaaggaccttgtcaccacactcttcctcaagcaagtgctccctctctagacaatactctgatcacacaactagattggctatataacgattctcgtgttgtattacgctttgtgtttcattatgcacgctatatatatgatcaatgtacctgtttctatc

SEQ ID NO: 1394 - DNA, 1479 bp, Sorghum bicolor
atgagggagaggtcggagcagctcaaggggcaagtacatcaggtgttcaatgccagcttcgatgccctagatgtagctgatttggtgacctatgtcgacacgcttgaacgtcttggcttagacaaccacttccgtgaggtgatcggggctgcattagatcgaatccgggcagaggagccagagtctaacagcctacacattgtcgcacttcggtttcgcctacttcggcagcatgggatctgggtatctgcagatgtgttcgacaagttcagagatgacacaggcagtttcagctcaagcctttgcagtgaccctaggggcctgttgagcttgtacaatgcagctcacatggccgtaccaggtgaggtggttctcgatgaggccatcgtctttacgaggggccaacttgagggcatcaaaagcaaggtcaggtcaccaatatcaaagcaaatctctcgtgctctcgacattgccctcccgcggttcacaagacggcttgaaaccatgcattatattacagagtatgagcatgaagaggcacacgacagcctaatacttgagcttgctaggctaaactttatccttgttagagcccttcaccttagggagctcaaggatctatcaatatggtggagggacctttatgacactgtgaagttaccgtatgctcgagaccgtttggtggagaactacttttggacctctggggtgttgcatgaagaagagtactcactggcacgtatgttttttgccaaggcatttggaatggcctcaccattggatgacacatttgatgctcatgccactctagaggaatgccacaagctccaagaagctatgcagagatgggatgaaagtgaggcttctattctacctgaatatctaagcatgttgtatatcaaaacccttagaaacttcaacgagtttgaggatattttggaaccaaacaagaagtaccgcatggccatctggtccagcaagaagtactcgccaagcttgaaggaacatgaggacttgtcaatcatgacgtctggtctgccgatgcttacaatcatgacattgatgggctatggtgatgaggcaacccaggaagcattcgaatgggtgagcactgtacccgaaatggtccgtgctagtgcacatgtcactcgcctcctcaacgatttgtcttcttacaagttgggaaagcgtaagaagcaggatatgcctagcgccgtggagacctacatggtagagaaaggcgtaactggggaagaggctgtgaaagcaatagcagcacttctagagaataggtggagaatattaaaccaggaaatcatggatatagatcacacactattgccagcagcgcagctggtggtcaacatagcaagggctactgagatcatttacgtccacggcagggacgcctacacctctggtgaagacctcaaagaccttgtcaccacactattcctcaagcaagtgcctctgatctag

SEQ ID NO: 1395 - DNA, 2421 bp, Sorghum bicolor
ttgcaaattttcctattccattccatcttcttcctcctccctgcaccagtccttcttggaagcgagagaggagaggggagggacagggagagagggaggaggagcgaggcaccggtgagctcgcggggaagctgcgtggggctgcttgcacgccgcgcggccctaccctttccccagctcactcaccacgctctccctcttctcaccaactctttccctctctcttatctccttccaagatcccacccccccattcttccttttttttttggtcgtccccaccattcttgctaggatcattccttgatctttcgctcgctcgctccagtacgcccgtttttgttttccagctccgggagatcccatctcggccgccacctcctgcggtttccaagctccaagaggcaagattcattccagctcaaatttgagctcaatttgccccgctgagctcgaatcaatccacgaacaactggctcggcaacaagtgtccttcgtcccccccgatccccgggcttcgattcgatcgaatccgacctaattttattgtgcttgtgcctgtgtgtgtgtctgtgtttttttaacctcctctcgctgcgcttttccgtcgcaaagtgggttccatcgcgtcacccgcacggctcctctccgatcggccggagaaagaaggcgcataaaaaggcgagcgagctcttgatgcggtcttggtcgtagcaacatacagcagctccactgctcctgcctggcctcgcctcgcttgctgttctttatccatatacggacggagcagcggccagcgggcgctccggcagcggcggcaccgcgcggtccaccctccgccagcgggtgctgatgcttgccctgctcgccgccttcgccgtcgcctgcctgctcttcgtgtccaggccatgcgcgcgtgacatgagactgttcctcgcctccctgtgccagcagctcctgctctccctcctcggactcctggcaggcctccgcctgctgggcggcgtcgcggccgcgtcccacgcgggcaacacagagaccatgccgctcatgccgtccttcaagaggaagcgggccgcggtcacggtggagaatgcggaggaggcggccggcgccgccgctggcggcgagccgtcggtgctcgacctgccggagctggccatcgattgcattctcgagaggctgcagccggcggagctgcggagcatggccgccgtctgccgctccatgcgcgagcgctgccgcagcgaccacctctgggagcgccacatgaccagcaagtggggccgtgtcctgggccgcgccgccagggacgaatggaggacgcacgtggcgtccgccagcgagtccggcgcggtctcgggcggcggcggcggcggcaagcgccggaggtggctcgcggcgctctcctgcgtttgcccggtggtgtcctggatgcggcccaggcccgacggtggcaagtcgtccgcccccgtgctggatgattccatcatgtcgtggtacctgtccatggagagcggcaagttctggttcccggctcaggtctacaaccgcgagcatgggcatgttgggttcatgatgtcttgctatgatgcagagctcagttatgattttcacactgacacattccgtgcaaggtatccgccacacggtcgacgaactgtggtcttggaggatggtgtccattgggacaggatcagggcaccacctgttgacactcttgcgcatgatctccacacctctgactgcctacatgaactccggcctggtgatcatattgagattcagtggagaaggaacaaagaattcccatatggctggtggtatggggttgttgggcacttggagtcatgtgatggaaatgaacacttttgtcggtgtcatcttagtgataccgtcgtgctggagttcaatcagtacacgccaggctcaagatggaggcaagcgttggtaaatcggaaggaacacagggaagagggcaatgagggcgacgggttctacggcggtgtcaggaagctccgcagcaaggatgacatctccaagtggaggcagctgtggccaacagacatcctggagtagcaagaacacatatattacttctcacattgggattgatcgattgctcaattgacatgccttccattgaccattgctttgtgctctgtccacggccaattcctctgctgcgctgttgtacacggattagaacacaaggtggcaacaaatcctgtagctggacaagggtgtaaacttattgtcaggcattaccgggcgcagactgtttcatgggactgtaactgtaagcctgtaactactaagcagtctgcgtcttgtgcctgctgttgtagctgtagggcagaaagatcaaatgtaaattacattttttttctagctcaaattcacgacaaattggtgcagtgt

SEQ ID NO: 1396 - DNA, 2378 bp, Zea mays
attccatttcttcttcgtcctcgcaccagtccctcctccttggaagcgagggaggagagtggagggagagggaggagcgaggcaccggtgagctcgggaggcggcgtggggcttgcacgccggccctacccccagctcactcaccacgctcttgtctgaccaactctctctctctcttatctccttccaagattcccccatttttttgttgttgtccccccattcttgctaggatcattccttgatctttcgctcgctccagtacgcctgttttccagctccggagatcccatctcggccacctcctgcggtctccaagctccaagaggccagattccagcacaaatttgaggtcaatttgcccgctgagctcgaatcaatccgctcggcaacaagtgtcatttgttcccccgatccccgggcttcgattcgatcgaatccgacctaattttattgtgtgtgtgtgtgtttaaccttctctcgctgcacttttcctttctcctccctgtcgcaaacgcaaagtgggttccatcgcgtcacccgcacggctcctctgatcgggcggagaaagaaagcgcataaaaggcgagctcttgatgcggtcttggtcgtagcaacagcagctccactgctcccggcatcgcctgctgttgtttatccatatacggacggagcagcgggcgctccggcagaggcagtggcagcgcgctccccccgtcagcgcgtgctgatgcttgcccccctgctcgccgccttcgctgtcgtcttcctgctcctcctgtccaggccatgcgcccgtgacatgagactgttcctcgcctccctgtgccagcagctcgtgctgtccctgctcgggttcctggcaggcctccgcctgctcagcggcgtcgcggccrcctccgcggccacagagaccatgccgctcatgccctccttcaagaggaagcgggcctcggccacggtggagaatgcggaggaggcggccgccacggccggcggcggcgagacgtcggtgctcgacctgccggagctggccatcgattgcattctggagaagctgcggccggcggagctgcggagcatggccgccgtctgccgctccatgcgcgagcgctgccgcggcgaccacctctgggagcgccacatgacaaacaggtggggccgtgtcctgggccgcgccgccagggacgaatggaggacgcacctggcgtccgccagcgagtcccgcgcggcgggcggcggcggcggcggcggcaagcgccggaggtggctcgccgcgctgtcctgcgtttgcccggtggtgtcctggatgcggcccagggccgacggtggcaagtcgtccgcccccgtgctggacgattccatcatgtcgtggtacctgtccgtggagagcggcaagttctggttcccggctcaggtctacaaccgcgagcatgggcatgttgggttcatgatgtcatgctacgatgcagcgctcagttacgatttgcataccgacacattccgtgcaaggtacccaccacacggtcgacgaaccgtggtgttggaggatggcgtgcaatgggacagggtgagggcaccgcctgttgacacccttgcgcattacctgcacacctctgactgcctgcatgagctccggcccggcgaccacatcgagattcagtggagaaggaacaaagaattcccatacggctggtggtatggagttgttgggcacttggagtcatgtgatggaagcgaacacttttgtcggtgccatcttagtgataccgtggtgctggagtttaatcagtacacgccgggctcaaggtggaggcaagcgttggtgaaacggaaggagcatagggaggagggcaacgagggcgacgggttctacggcggcataaggaagctccgcggcaacgatgacatctccaagtggaggcagctgtggccaacagacgtcctggagtaagcaggaaccgcatcccttctcacaccgacattgatccatcgctcaaatgacacgcctttctttcatcatcatattgaccaaattcgtcgtctctgtcgcgctgttgtaaacgggttagtagaagaacaaatcccgtagctggacaagggtgtaacacttactctctccgtttcgttttagttgtcgctggatagtgcaaaattgaactatccagctacaactaaaaagaaacggatggagtatttgttaggcgtaccaggcgcagactgcttcctatttgttcgtggggctgtaactgtaagccttgtttgtgacccctaagcagtctgcgtcttgtgcctgctgctgtagcggtagagcagagagagatcaaatgtaaattacatttttttagctcaaattcacgacaaaaaaaaaaaaaaaa

SEQ ID NO: 1397 - DNA, 2253 bp, Hordeum vulgare subsp. vulgare
ggatcctcccattcctctccttcctccacccactagctttttcttggaagcgagaggagggacggggagggagagggggcggagcggagaggagggcgccggtgagctttgccagggaagctgctcgcgtggggctttgcacggccgggccctgcccacgcttccctcttgctcactcgctcccaccaacgctcgcctctcacctactctctctctctctttctcccttatctccttccaagatcccttttcccctttcatctactacgagtagtttgctaggaccattctttgatctttccttggctccaaatactcccgttccagcagcggagatcccacctcggttccctcccgtccgagtgattagctcgaacttgaccttttttttgtgtgcctgctcatcagttcgtgcttcaatccgagaaatccccgctcggcaacaagtgcccccccccccccccccctctccgggcttcgattcgatcgaatcctgcccaatatttttctaaccctttctccttctcaactctcaagtgaagtgggttccatcgccgatcggccggagaaagtggttgatgcggctgtggtcgtagcagcatcatctcatatctctttccagtgggtctgggtctgggtctgggtggcttgtgttgtttatttgcgaggagcactgtgcgtgcagtcgcagtgctccacgcctcgcttctttgcctctcatcaatgcttgccctggtcgccaccttcgtcttctcctgcctcctcttcttgtccaagccatgcgcccgtgacatgagactcttcctcgcctccatctcccaacaactcgccctctcgcttttcggattcttggccggctacaggctgctcggcggcgtcgcctccagggccacgcccgccgacgccatgcccctcatgccgtccttcaagaggaagcgaccggccgccaaggtggagagtacggatatgaccggcgagccatcggtgctcgacctcccggagctggccatcgactgcattctcgccaagctgccgccggcggagctgcggaacatggccgccgtcagccgctccatgcgggaaaggtgcaggagcgaccacctgtgggagagccacatgtccaacaagtggggttctgtcctgggtacggccgcgagggacgagtggagggcgtatctgtcctcgtcgaccgcggccggcggcggcgcgtcggggtactgcgggtctgctgccagcggcaagcaccggaggtggcttgccgcactgtcctgcgtctgcccggtggtgtcctggatgcggcctagggccgaaggcggcgccggcatgtccgcaggccctgtgctggatgattctatcatgtcgtgctatcttcacatggagagcggcaagttctggttccccgcacaggtctacaaccgagagcatgggcatgttgggttcatgatgtcatgctatgatgcagaggtcagctatgatttccgcactgacacgttccatgcaaggtatccaccacacgggcggcgaactgtagtcttggaggatggcgtgcaatgggaaagggtcagggcacctccagtcgaaactcttgcacatgacctgcatgcctctgactgcttacatgaactacggcctggcgataacattgagattcagtggagaaggaacaaggagttcccatatggctggtggtatggagttgttggccacttggaatcatgtgatggaaatgagcacttttgtcggtgtcatcttagtgacatcgtggtgctggagttcaatcaatacacgcctggctcgagatggaggcagtccctggtaaatcgaaaggaccacagggaagaaggcaacgagagcgatggattctacggtggaataaggaagctccaagacaaggacgaaatctccaagtggaagcagctatggccaacagataccctggaataacgggattattcagccgttattgactcctcaatcaagttggctaattggcatgccttccattgatcccacccgtactcccaccatcagccacaccctccgttcaagttgtacacagggatagaacacgaggtggcaaattctggtggctggacacggctgtaaacttgctgtcgggcaaaataaaagcagactgcggctgttttacgtctagtgtatataaccgcagtttgcgtttctttttgcctgctgttgtagttctagagcagaaagatcaaatataaattacataaaatttagttcaaatttacg

SEQ ID NO: 1398 - DNA, 2347 bp, Oryza sativa Japonica Group
ttgcagcttgggcttcctctcccccccggttgctgctgctgcagctgagcctccgttcttggaagcgagagagagggagggaggagggaggcaattggtgaggcttttggaggaggaaagggaagcttcgggccccagcatcctcctcctcctcttgctcactcaccacgctctcctctcaccaaactctctcttatctccttccaagatcccaaccccttttcttctttttttttgtttgttcttgttaggatcattttcttgatctttcaagctcagctccagcactccccccgttcgtttccagctgcagcagagatcttggttagttggatttttagcttccgtgttttttgagcgagttcttggttaattgctccaatccgagaaaaatcaccaagtgtcctttgcttccctccctccccccttgttttctgggcttcgattcgatcgaattcgaatccccgtcccaaatttatttattttcccacccctcctttgtgtaaaaagcgggttccatcgcgtcacccgcacggctcgtccgatcgaaaagcagcttgaagaagaaaaagtgagagttcttgattcgattctggtcgtagcagcagcagcagcagcgtcttcactggttcgttctttgtttatttataaggagcagcgcccaatccgagctgctgctcctccaccgcggcggcggcggcggcggtgtttgatcgatgcttgccttggtggccaccttcgtcttggcctgcctcgtgttcttgtcgaagccatgcgcgcgtgagatgagattgttcctgtcgacgctgtgccaagaactcgccctcgcgctgctcgggttcctggccgggctccggctgctcggcggcgtcggcgccggcgcggcggccgagaccaccatgccgctgatgccgtccttcaagaggaagcgcgcggcggccgtggaggagggcggcggcggcggaggaggaggaggcggcgaggaggccggcggcgagccgtcggtgctcgacctgccggagctcgccatcgagtgcattctcgcgaggcttcccccctccgagctgcggaacatggccggcgtctgccgctccatgcgggagcgctgccgcggcgaccacctctgggagcgccacatgtcggagaagtggggcggcgtcctcggccacgccgcgagggaggagtggaggacgtacctcgcgtcggcggccgacacgggcggcgccgcggcgtcgtgctcgctcgccggcggcggcaggcaccggaggtggctcgccgcgctgtcctgcgtctgcccggtggtgtcctggatgcgtcccagggccgacggcggcagcggcggcaagtcggccggccccgtgctcgatgattcgatcatgtcgtggtatctgtccatggagagtggcaagttctggttcccggctcaggtctacaaccgtgagcatgggcatgttggattcatgatgtcatgctacgatgcagagctcagctatgatttccacagtgataccttccgtgcaaggtatccaccacacggacgacggaccgtagtcttggaggacggggtacactgggatagggtcagggcacctccagtagacactcacgcacatgatctccatgcctctgactgcttacacgaactccggccaggcgataacattgagatccaatggagaaggaacaaggaattcccctatggctggtggtatggagttgttggccacttggagtcatgtgatggaagtgagcacttttgtcggtgtcatcttagtgacactgttgttctggagttcaaccaatacacacctggttcaagatggaggcaggcgctggtgaaccggaaggaccacagggaagagggcaatgagggcgacggtttctacggtggaatcaggaagctccgcagcaaggatgagatctcaaagtggagacagttgtggccaacagacattcttgagtagcaaggacagagattattattccactgttgttattcatcaagttgccaaattgatgctctccaattgctcattctgtattctgaaacctgacgaaaacgccacccatctcctccactcaagttgtatacacaaaggattggaacatggggtgacaaaatttggtagcttgggacacaattgtgaaacttactgtaaggcacggatgcacagattgcttctgtaaacgggcgttaactgaacatgtatcaagtctacagcattgtatgtgactgctgcagcctgtgcctctgcatgttgttgtagctgtagagcagaaagatcaaatgtaaattacattgttagctccaatttaatttacggcatttcaggatgccgtctcacgg

SEQ ID NO: 1399 - DNA, 2099 bp, Sorghum bicolor
gtcatcaacatttcaacatccccgattcgatccgcgacggcgccacagcaacacaccatacctagctcttccttcccgaaccctcgcgccgccgcatcttcctacacccaagccctaaacaccaccgccctctcaaatctctttcccctcgatccatggccgccgccgccgccgccaccgcgccatcccgcaagacggagacctacaccgacaccaagcgccgcgacgatgtgcgcggcgccaacatcgccgccgcgcgcgccgtcgccgacgccgtgcgcacctcgctgggcccccgtggcatggacaagatgatctcctcgggcgaccaggcgcaggaggtcatcatcaccaacgacggcgccaccatcctctcccgcatggcgctcctccagcccgccgcgcgcatgctcgccgagctatcccgctcgcaggacgccgccgctggggacggcaccacgaccgtcgtcgtcctcgctggatccctcctccgccgcgcccagtcgctcctctccgccggggcccaccccaccgccgccgccgacgccctccaccgcctcgccacgcgcgctgttgagatcctccacgccatggccatccccattgagctatccgaccgggagtccctcgtcaagtccgcgtccactgctctcaactccaaggtcgtctcccagtactccaccctcctctcgcccctcgccgtcgacgccgccctctctgtggtggatcccgctcaccctgaccttctggacctccgtgacatccgcatcgtcaagaagcttggtggcaccgtggacgatactgagctcgtccgtggcctcatctttgacaagaaggctagccatgctgctgggggcccaagtcgggtggagaatgccaagatcgctgtcatacagttccaaatctcaccacctaagactgacattgagcagagcgtcattgtatcggactatgcacagatggaccgcatcctacgtgaggagcgcaattacatcctcgggatggtcaagaagatcaaggcagctggatgtaatgtcttgctcattcagaagagcatcttgcgggatgcggtcactgacttgtctctgcactatcttgctaaggcaaagattctggtggtgaaggacgtggagagggatgagatagagttcatcaccaagaccctaaactgccttcccattgccaacattgagcacttccgcacggataagcttgggtatgcagatgttgttgaggaaatctctgttggggagggcaaggttgtgaagatcactggtatcagagacatgggtaggaccgcaactgtacttgtcaggggatcgaaccagttggttattgatgaagctgaacgcagtctccatgacgccctctgtgtcataaggtgcttggtcaacaagaggtttttgattgctggtggtggtgctccagaaatagagatgtcaatgcagctggctgcttgggcaaaggaacttcgagggatggagagttactgcatcaaggagtttgctgaggcacttgaggtcattccttacacacttgctgagaatgctgggctcaacccaatctccatcgtcactgaactcaggaatcgccatgccagaggtgagaagaacgctggcatcaatgtgaggaaagggcagatcacaaacatcctggaggagaatgtcgtgcagcctttgctggtgagcacaagtgccattacgctagcctgcgagtgtgtcagaatgatcttgaagattgatgacattgtcactgttaggtaaagagcgtgaagtcggtggtcatgtcagcctgctctgttctgtctggattgatattagttaggttactacttaatgtagaactttattgcgtgtttttggatgttttaaacacgtggttttgatgttagtacggagaggacagtaatgtaccctatccttgcatgaaactaccagggctgcacctgcgatatccattttcttttgattggccgtctatgcctttgtttccgttgccgcttacatgtaaggcatgcttttccatgaaattttgcgcaggttgtgttgtaaactgttattagctttatcatcttatatatgtttttttaaatgggaagg

SEQ ID NO: 1400 - DNA, 1887 bp, Zea mays
cagcaccgccctctcacatctcctctcccctcgatccatggccgccgccgccgccgccgccgcgccatcccgcaagacggagacctacaccgacaccaagcgccgcgatgacgtgcgcggcgccaatatcgccgcagcgcgcgccgtcgctgacgccgtgcgcacctcgctgggaccccgtggcatggataagatgatctgttcgggcgaccaggcgcaggaggtcatcatcaccaacgacggtgccaccatcctctcccgcatggcgctcctccagcccgccgcgcgcatgctcgcggagctatcccgctcccaggacgccgccgctggggacggcaccacgactgttgtcgtcctcgctggatccctcctccgccgcgcccagtcgctcctctccgccggggcccacccaaccgccgccgccgacgctctccaccgcctcgcgacacgcgctgttgagatcctccacggcatggccatccccattgagctatctgaccgggaatccctcgtgaagtccgcgtccactgctctcaactctaaggtcgtctcccagtactccacccttctctcgcccctcgccgtcgacgccgccctctccgtggtggatcccgctcaccctgaccttctcgacctccgtgacatccgcatcatcaagaagcttggtggcaccgtggacgatactgagcttgtcactggcctcatttttgacaagaaggctagccatgctgctggggggccaactcgggtagagaatgccaagatcgctgtcatacagttccaaatctcaccacctaagactgacattgagcagagtgtcattgtatcggactatgcacagatggaccgcatactacgtgaggagcgcaattatatcctcgggatggtcaagaagatcaaagctgctggatgcaatgttttgctcattcagaagagcatcttgcgcgacgcggtcactgacttgtctctgcactatcttgctaaggcaaagattctggtggtgaaggacgtggagagggatgagatggagttcatcaccaagaccctaaactgtcttcccattgccaacattgagcacttccgcacggataagcttgggtatgcagacgttgttgaggaaatctctgttggggagggcaaggttgtgaagatcactggtatcagggacatgggtaggaccgccactgtagttgtcaggggctcgaaccagttggttattgatgaagctgaacgtagtctccatgatgccctctgtgtcataaggtgcttggtcaacaagaggtttttgattgctggtggtggtgctccagaaatagagatgtcaatgcagctggctgcttgggcaaaggagcttcgagggatggagagttactgcattaaggagtttgctgacgcacttgaggtcatcccttacacactggctgagaatgctgggctcaacccaatctccattgtcaccgaactcaggaatcgtcacgccagaggtgagaagaacgctggcatcaacgtcaggaaagggcagatcacaaacatcttggaggagaatgtcgtgcagcctttgctggtgagcacaagtgccattacgctggcctgcgagtgtgtcaggatgatcttgaagattgatgacattgtcactgttaggtgagagcatgaagtcggtggtttggtcagattgctctgttctgtctggattgatagtagttaggttactacttagtgtagaacttctattcacgggcgtgtttcaatgttttaaacacaatgttagtacggagaggacagtaatgtacccatccttgcatgacactaccagggttgcatctgctatttccagtttcttatgattggccgtgtatgtatgccttgtttctgtcgccgcttacatgt

SEQ ID NO: 1401 - DNA, 1941 bp, Zea mays
tccagcctccagcgtgatctgagtcctgaccaagccctaaacgccaccgccctcgcaaatctcctttcccttcgatccatggccgccgccgtcgccgcccccgcgccatcccgcaagacggagacctacaccgacaccaagcgccgcgacgacgtgcgcggcgccaacatcgccgctgcgcgcgccgtcgccgacgccgtgcgcacctcgctgggcccccgtggcatggataagatgatcgcttcgggcgaccaggctcaggaggtcatcatcaccaacgacggtgccaccatcctttcccgcatggcgctcctccagcccgccgcgcgcatgctcgccgagctatcccgctcccaggacgccgccgctggggacggcaccactaccgtcgtcgtcctcgctggatccctcctccgccgcgcccagtcgctcctctccgccggggctcaccccaccgccgctgccgacgccctccaccgtctcgccacgcgcgctgttgagatcctccacgccatggccatccccatcgagctatccgaccgggaatccctcgtcaagtctgcgtccacggctctcaactccaaggtcgtctcccagtactccacccttctctcgcccctcgccgtcgacgccgccctctctgtggtggaccccgctcaccctgaccttctcgacctccgggacatccgcatcgtgaagaagcttggtggcaccgtggacgatactgagctcatccctggcctcatctttgacaagaaggctagccatgctgctgggggcccaactcggatggagaatgctaagatcgctgtcatacagttccaaatctcaccacccaagactgacattgagcagagtgtcattgtatccgactacgcacagatggaccgcatcctacgtgaggagcgcaattatatccttgggatggtaaaaaagatcaaggcggctggatgcaatgtattgctcattcagaagagcatcttgcgtgatgcagtcactgacttgtctctgcactatcttgctaaggcaaagattctggtggtgaaggacgtggagagggatgagatggagttcatcaccaagaccctaaactgccttcccattgccaacattgagcacttccgcacggataagtttgggtatgcagatgttgttgaggaagtctctgttggagagggcaaggttgtgaagatcactggaatcaaggacatgggtaggaccgcaactgtacttgtcaggggatctaaccaattggttattgatgaagctgaacgcagtctccatgatgcactctgtgtcataaggtgcttggtcagcaagagatttttgattgctggtggtggtgctccagaaatagagatgtcaatgcagctggctgcttgggcaaaggagcttcgagggatggagagttactgcatcaaggagtttgctgaggcgcttgaggtcatcccttacacattggctgagaatgctgggctcaacccaatctccattgtcaccgaactcaggaatcgccatgccagaggtgagaagaacactggcatcaatgtgaggaaagggcagatcacaaacatcctggaggagaatgtcgtgcagccgttgctggtgagcacaagtgccattacgttagcctgcgagtgtgtcagaatgatcttgaagattgatgacattgtcactgttaggtaagagcgtgaagttggggtcatgtcagcctgctctgttctgtctggattgattattagttaggttactgcttaatgtaaaacttggttcatgggcgtgtttctacacttggttttgatgttagtactatccttgacatgaaactactaccagggttgcatctgcgatctctattttctttacattggccgtgtatgccttcgtttcggtcggccgcttacgcccatgggatttttttgagccggttgtgttgtaatc

SEQ ID NO: 1402 - DNA, 2080 bp, Oryza sativa Japonica Group
acaaagccctaatttaaccctaagggaaattgttgctcctcccagagctccgccgccaggccccgccccatctcgatccgccgccatggccaccgcagtcgccgcctcccccgctcagtcccgcaagactgagacctacaccgacaccaagcgccgggatgacgtccgcggccttaacatagccgccgcgcgcgccgtcgccgacgccgtgcgcacctccctcggcccccgtggcatggacaagatgatctcctccggcgagcaggaggtcatcatcaccaacgacggcgccaccatcctctcccgcatgtccctcctccagcccgccgcccgcatgctcgccgagctctcccgctcccaggacgccgccgccggcgacggtaccactaccgtcgttgtcctcgccggatctctgctccgccgtgctcaatccctactctctgctggtgcccaccctaccgcggcagctgacgctctccaccggctcgccacgcgcgccgttgaggttctccacgccatggccattcccatcgagctctctgaccgcgactccctcgtcaagtccgcatccacagcactcaactctaaggtcgtttcccagtactccagccttctctcccccctcgctgtcgatgccgccctctccgttgttgatcccgctcacccggacctcctcgacctccgagatatccgcgtcgttaagaagcttggtggcaccgttgacgacactgagctcattcgcggcctcatcttcgataagaaggctagccatgctgctggaggaccaactcgggtcgagaatgctaagattgctgtcatacagttccaagtttcacctcccaagacagacatcgagcagagtgtcatcgtatcagattacgcgcagatggatcgcatcctccgtgaggagcgcaattacattcttgggatggtgaagaagatcaaggcttctggatgcaatgttctgctcattcagaaaagcatcttgcgtgatgcagttactgatttgtcacttcattatcttgcaaaggctaagatcctggttgtgaaggatgtggagagggatgagattgagttcatcaccaagaccctgaactgcctgccaattgctaacatcgaacatttccgtgaggacaagcttggttatgcagatcttgttgaggaagtttctgttggggagagcaagattgtcaagatcatgggcattaaggatatgggaaggacagctactgtgcttgtccgggggtccaaccagttagtaattgatgaagctgagcgcagtcttcatgatgccctttgtgtcatcaggtgcttggtgaacaagaggtttttgattgctggtggtggtgcaccagaaatagagatgtcaatgcagcttgctgcttgggcaaaggagctccaagggatggagagttactgcatcaaggagtttgctgaggcacttgaggtcattccttacacattagcagagaatgcagggctcaatcctatttctattgtgactgagcttcggaatcgtcatgccaagggtgagaagaatgcaggcatcaatgtgaggaagggtcagattacaaacatcctggaggagaacgttgtgcaacctttgctggtgagcacaagcgccatcacactagcttgcgagtgtgttagaatgatactgaagattgatgatatagtcactgtgaggtaaggttatgtggcggttgaccatgtaggcctgccctacttaggtctacgtgggttttagaattttatttgttagcgtgcctttcagtctctatgttcttagcgtgtggctttgatgtctgtcgaagagatttatattatgtattttgttacctggatggaacggtcaagtgtagccatctgtttgcacttgagacggccggcaacgccttgccatattgttttacacttacagtttgctgcagatttcttcgcatattatcggtcgcacatttgtagtttgcggatgtgtctatagcttgctttaactctcaagataactgtttgcatggcaaagtatgtacatggcgcttcaaataaagaaagcttaataaagagtcaaacgtgattcgtc

SEQ ID NO: 1403 - DNA, 1891 bp, Hordeum vulgare subsp. vulgare
ggtccctgtcctcctccgtccgaacaagcgaaatctgaaaagccctagccagcgccccctccaccccgatctgccgccgccgccatggccgccgcagccgtcgccgccgcgccgtcggcccgcaagggcgagacctacaccgacaccaagcgccgcgacgacgtccgcggcgccaacatcgcggccgcgcgcgcggtcgccgacgccgtgcgcacctccctcgggccccgcggcatggacaagatgatctcctccggggaccaggaggtcatcatcaccaacgacggcgccaccatcctctcgcgcatgtccctcctccagcccgccgcccgcatgctcgccgagctctcccgctcccaggacgcggcggccggcgacggcaccaccaccgtcgtcgtcctcgcgggggccctgctccgccgcgcgcagtcgctcctagcggctggcgcccaccccaccgctgccgccgactccctccaccgcctcgctgcccgcgccgtccaggtcctcgagggcatggccatccccatcgagctcaccgaccgggactccctcgtcaaatctgcctccaccgcgctcaactccaaggtcgtctcccagtactccagcctcctcgccccgctcgctgtcgacgccgccctctccgtggtcgatcccgcccacccggagcttcttgatctccgcgacatccgcatcataaagaagctcggcggcaccgtggatgacaccgagctcgtccgcggcctcatctttgacaagaaggctagccatgctgccggagggccatctaggatcgagaatgccaagatcgctgtcatccagtttcagatctcgccgcccaagactgatattgagcagagcgtcatcgtgtcagactatgcgcagatggaccgcatcctccgcgaggagcgcaattacatcctagggatggttaagaagatcaaggcgtctggatgcaacgtcctcctcatccagaagagcatcttgcgtgatgcggtgactgagttgtcgctgcattatctcgcaaaggctaagattctggtggtcaaggatgtggagagggacgagattgagttcatcaccaagactctcaactgcctgccaattgccaacattgagcatttccgtgaggataaacttgggtatgctgatgttgtcgaggaagtgtctgccggagatggcaagattgtcaagatcactggcatcagggacatggggaggactgcaactgtgcttgtccgtgggtccaaccagttggttattgatgaagctgaccgtagtctccatgatgccctttgtgtcatcaggtgcttggtgaacaagaggtttctaattgctggtggcggtgctcctgaaatagaaatgtcaatgcaactggctgcttggtcaaaggagctccatgggatggagagttactgcatcaaggagtttgctgatgcacttgaggtcatcccttacacattggcagagaatgcagggctcaacccaattgccattgttaccgagctaaggaaccgccatgccaagggtgagaagaacacgggcatcaacgtgaggaaaggccagatcacaaacatcctggaggagaatgtcgtgcaaccgttgcttgtgagcacgagcgccatctcgctggcgtgcgagtgcgttagaatgatcttgaagattgatgatatagtcactgtaaggtaaatcctgtagggcggatgatcctttttagggctgtattgttatgcgtgatgggacgaccactttggcctgtctggttctatctggcctgttgttacgtaggtgcactataagttacaattttatttgtgaacgtggttctttgatgtgtgttgtgattttgtggctttggcttctgctgaagatatctgtatcttgtatcagt

SEQ ID NO: 1404 - DNA, 1848 bp, Oryza sativa Japonica Group
aatctgaagagcacacgaagccctaattaaccaaaacctccgccgccgccgccatggccgccgcggtcgccgcctccccggcgcaatcccgcaagacggagacctacaccgacaccaagcgccgcgacgacgtccgcggcctcaacattgccgcggggcgcgccgtcgccgccgccgcgcgcacctccctcggcccacgcggcatggacaagatgatctcctccagctcctccggcggcgaccaggccgtcatcatcaccaacgacggcgccaccatcctctcccgcatgcccctcctccagccggccgcccgcatgctcgccgacctctcccgctcccaggacgccgccgccggggacggcaccaccaccgtcgtcgtcctcgccgggtccctcctccgccgcgcccagtccctcctctccgccggcgcccaccccaccgcggccgccgacgccctccacctcctcgccgcgcgcgccgtggaggtcctccacggcatggccatccccgtcgagctctccgaccgcgacgccctcgtcaagtcggcatccaccgccctcaactccaaggtcgtctcccagtactccaccctcctctccccgctcgccgtcgacgccgccctcgccgtcgtcgacccggcccacccgtatctcctcgacctccgcgacatccgcgtggtgaagaagctcggctgcacggtcgacgacaccgagctcatccgcggcctcgtcctcaacaagaaggccagccatgtcgccggagggccaactcggatcggggacgccaagatcgccgtgatccagttccaggtctcgcctcccaagacggacatcgagcacagcgtcgtcgtgtcggattacgcgcagatggatcgaatcctccgcgaggagcggaattacatccttggcatggtgaagaagatcaaggcatccggatgcaacgtcctgctcatccagaaaagcatcctgcgtgattcagtcaccgatctgtcgctccattatctcgcaaaggccaagatcatggtcgtgaaggatgtcgagagggacgagatcgagttcatcaccaagaccctcaactgcatgccaattgctagcatcgaacatctccgcgaggacaagcttggtcatgcacatctggttgaggaaatctcggttggtgatggtaacaataacaagattgtcaagatcactggcatcaagaacatgggaagaacagcaactgttcttgtccggggatccaaccagatggtgatcgacgaagctcagcgcagcctccacgacgcattctgtgtgatcaggtgcttggtgaacaagaggtttctgatcgctggtggtggtgctcctgagatcgagatgtcgatgcagctggctgcttgggcgaaggagctgagagggatggagagttactgcgtcagggagttcgccgaggcgctcgaggtcatcccttacacgttggcagagaatgcagggctcgatcccatctccactgtcaccgagctccggaatcgccatgccaagggcgagaagaacgccgggatcaacgtgaggaagggtcggatcacgaacatcctggaggagaatgtcgtgcagccactgctggtgagcacgagcgccgtcacgctggcctgcgagtgtgttaggatgatactgaagattgatgatattgtcaccgtgaggtaaggttaattaattatgtggtggctgaccgtgctggcctctgctctattttgtctgtcatgttatttaggagatttgatattttgacaccttctaaagtggcacgctttcgttgattcagatggttcgaaatatcatgcattctcacaactgtcaataaaatcaaattggt

SEQ ID NO: 1405 - DNA, 1759 bp, Populus trichocarpa
gccgtttagaaaccccacttttttcatcgttacagaactctctcgatctcactccctcgctctctagggtttctctctttctcgtttacccctacctccttttttaatttacactctctcgccactgaattagggttagggtttagaaaaacaatcaatggcacttgtagcaaaatccgctcctcgatcttccaaaaccgagtcgtacgtcgacaacaagcggaaagaagacatccgccatgccaacatcaagtccgcttgcgcggtggctgacgccgtcagaaccagtcttggtcctaaaggaatggacaaaatgatttcaactgcgagcggcgaagtcatcattaccaatgacggcgccaccattcttaacaagatggaggttctccaaccggctgcgaagatgcttgttgaactctctaaatctcaagacaccgctgctggtgacggcaccaccaccgtcgttgttattgccggatcgttgcttaagcagtgcctttcactcctctcctctggtatccaccctacggtaatctccgattcattacataaagcttcaattaaagctgttgatgttttaactgcaatggctgtgccgttagagttaacggaccgtgattcgttggtgaaatctgctagtacttcattaaatagtaaagttgttagtcagtattcgtcgttgctagctccattagctgttgatgctgttttgactgttgtggatcctgagaagccagatttagttgatcttagggatattaagatagtgaaaaagctgggtggaaccgtggatgatactgagatggttaggggtttggtttttgataagaaagtgagtcatgctgcaggtgggctgacgcgtgttgagaatgccaagattgcggttattcagtttcagatttccccgccgaagactgatattgagcagagtatagtggtatctgattatgcacaaatggataggattctgaaggaagagaggaattatattttgggtatgattaagaagattagggcaactgggtgtaatgtgttgctgattcagaagagtattttgagggatgcggtgacagatttgtccttgcattatctggcgaaagcgaagattttggtgattaaggatgtggagagggatgagattgagttcattactaagactttgaattgtttgcccattgcaaatattgagcatttcaaagaggaaaagttggggtatgcggatcttgttgaggaggtttcacttggagatgggaagattgtcaagattactgggattaaggatatgggaaggactacctgtgtgcttgtacgtgggtccaatcagttagttctcgatgaggcagagcggagcttgcatgatgccttatgtgtcattagatgtttggtgaataaacagtttttgattgcaggaggtggggcaccagagattgaattgtcaagacagcttggagcatgggccaaggtgctgcatgggatggaaggatactgtgtgaagtcatttgctgaggcacttgaggttataccatatactttggcagagaatgcagggttgaatcctattactattgtgactgaactgaggaataggcatgctcaaggagagatcaatgcaggaatcaatgtgaggaaggggcagatcacaaatattttggaggagaatgtggttcagcctctgcttgtgagcacaagttccatcacactggcagcagagtgtgtgcggatgattttgaagattgatgacattgttactgtcaggtag

SEQ ID NO: 1406 - DNA, 1713 bp, Populus trichocarpa
aaccacactctccctcactccctaggttttctctcttccacttttacccctacctccctacttattttacactctcacaccactgaattagggttagggtttcaaacaaaccattcaatggcagctgtctccgctcctagatcttccaaaactgagtcctacatcgacaacaagcggaaagaagacatccgccatgccaacatcaaggcggcgtgcgcggtggctgacgccatcagaaccagtcttggtcctaaaggaatggacaaaatgatttcaacggcgagcggcgaagtgatcattaccaacgacggcgccacgattgttaacaagatggaggttcttcaacctgctgcgaagatgctcgttgaactatctaaatctcaggacaccgctgctggtgacggcaccaccaccgtcgttgtcatcgccggatcgttgcttaagcagtgccttactctcctctcctctggtatccaccctactgttatctcggattcattgcataaagcttcaattaaagctgtcgatgttttaactgcaatggctgtgccgttagagttaacggaccgtgactcgttaattaaatccgctagtacgtcattaaacagtaaagtagttagccagtattcatcattgctagctcccttagccgttgatgctgttttgtctgttgtggatcctgcgaagcctgatttagttgatcttagggatattaagatagtgaaaaagcttggtggaaccgtggatgatacggagatggttaggggtttggtttttgataagaaagtgagtcatgctgcaggtgggcctacacgtgttgagaatgcgaagattgcagttatccagtttcagatttccccaccaaagactgatattgagcagagtattgtggtttctgattatgcacaaatggacaggattctgaaggaagagagaaattatattttgggaatgattaagaagattaaggctactgggtgtaatgtgttgttgattcagaagagtattttgagggatgcggtgacagatttgtctttgcattatttggcaaaagcgaagattctggtgatcaaggatgtggagagggatgagattgagttcattactaagactttgaactgtttgcctattgcaaatattgagcatttcaaagaggaaaagctgggttatgccaatcttgttgaggaggtttcacttggagatgggaagattgtgaagattactgggattaaggatatgggaaggactaccacggtacttgtacgtgggtctaatcatttggttcttgatgaggcagagcggagtttgcacgatgcattgtgtgtcgttaggtgtttggtgagtaagcgttttttgattgctggtggtggggctccggagattgagctgtcacggcagcttggggcatggtcaaaggtgcttcacgggatggaaggatactgtgtgaagtcatttgcagaggcacttgaggtcattccatacactttagcagagaatgcaggattgaacccaattactattgtgactgaactgaggaataggcatgctcaaggagagatcaatacaggaatcaatgtgaggaaggggcagatcacgaatattttggaggagaacgtggtgcagcctctgcttgtcagtacaagtgccatgacactggcaacagagtgtgtccggatgttattgaagatcgatgacattgttactgtcaggtag

SEQ ID NO: 1407 - DNA, 1595 bp, Vitis vinifera
cggctcccgtggctcctctggcgcgctcctccaagaccgagagctacgttgacaacaagcgcaaagatgacatccgccaagccaacatcgtcgcggcacgagctgtggctgatgccgtccgcaccagcttgggcccsaagggcatggacaagatgatttccaccgccagcggcgaggttatcattaccaacgacggcgccaccattctcaacaagatggaggtgctccagccggcggcaaagatgcttgtggagctctctaagtctcaggatattgttgctggcgatggcactaccaccgtggttgtcatcgccggcgctctactgaagcagtgcctctcgcttctttcgcacggcattcacccaacaatcatctcagattcgctccacaaggcgtcgatcaaggccgtggatgtcctcactgccatggccgttccggtggaactctccgaccgcgaatcattgattaaatccgccagcacttcgcttaacagcaaggtagtgagccagtactcgacgctgctcgctccgcttgccgttgatgcagtgctctccgtcgtcgacccggcgaagcccgacctcgtggatctccgcgacgtcaagatcgtgaaaaagctgggaggtactgtggacgacaccgagttggtcaagggcttggttttcgacaagaaggtgagtcacacagctggcgggccgacccgggtggagaacgctaagattgcagtgattcagttccagatttcgcctccaaagactgatattgagcagagtattgtagtttccgattatacccaaatggaccggatattgaaagaagagagaaattatattctaggtatgattaagaagattaaggccactggctgtaacgttctgctgattcagaagagtatattgagagatgcagtgacggatctctcgttgcattatcttgctaaagcaaagattttggtgataaaggatgtggagcgtgatgaaattgagttcattacaaagactctgaattgtttgccaattgcaaatattgagcatttcagggcagagaagttgggttttgcggattgtgttgaggaggtttcacttggagatgggaagattgtgaaaatcactggcattaaggatatgggtcggaccacgactgtgcttgttcgtgggtcgaatatgttggttctagatgaggcagaacggagtttgcacgatgctttgtgtgttgttaggtgtttggtgaacaagaggtttttgattgctggtggtggtgctccagagattgagctatcgaggcagcttggtgcttgggcaaaggtgttgcagggaatggagagctactgtatccggtcatttgcagaggctcttgaagttattccttataccttggctgagaacgcaggcttgaacccaatatctattgtgaccgagcttaggaaccgtcatgctcaaggggagatcaatgccggaatcaatgtgaggaagggacagattacaaacatcttggaggagaatgtggtgcagccactgctggtgagcacaagtgctatcactctggcaacagagtgtgtgcggatgattttgaagatcgatgatattgttacagtgagg

SEQ ID NO: 1408 - DNA, 1759 bp, Sorghum bicolor
ccttccttctcggcgtctccgattccttcctctcctctcgcccctctccatccgctcccaccgtctcgtctagggttttgccccaaaccctagccccccaaatcccccgctccatggacgtcgagggcgaggtccccgccgcggcggcggcggcggtggcgaacggcctgggcggcgcggaggaggcctctgcagcgccggtctcggccgagcagctggacgtggaggcttacgcggcgcagtactcgggccggacccgcctcgcgcgcctgctcttcatcgcggaccggtgcggggtggaggcgatgcagctcgaggcgctgcggatggcgtacgatgagatcaagcgcggggaggacgtgcagctccaccgggacgtcgccgccaagatcggaggccgccttggtccgcgcttcggcctcgaccaggcgtgggtcgacaccgtcacccgccgcgccgatcagcgcaaggagaagctcgagaacgagctcaatggatacaggactaacctgatcaaagagagcatcagaatgggctacaatgacattggtgatttcttctatgcccatggccaactttcggatgccttcaaaagctacatcaggactcgggactattgcaccacttccaaacatatagttcagatgtgcatgaatgtgattctggttagcattgagctggggcaatatgcacatgtttcaaactatgtcagcaaagcagagcaaaccccagactctctggatcctgtcattgtcgccaagctgaaggcagctgcaggattagccaacttggaaacaaagaaatacaaatttgctgctcgtaagtttgttgagacaggaattgaactaggaaacaactactctgaagtcatagctcctcaagatgtagcggtctatggtgcactttgtgcacttgcttcttttgaccgttcagacctgaagagcaaagtcatcgacaatatcaacttccgtaactttctggagctggtgcctgaagtaagggagctggttaatgatttttatgcaagtcgctatggatcttgcttgggtcatcttgagaagctaaagcctaacctgctcctggatatccatttgcatgagcatgtagagactctgtatatggatattcgccacaaagcgatcatacagtacacacttccttttatatctgttgatctcaacttgatggcaactgcctttaagacttctgtctccatgctggagaaggagctggccgcactgattactgagaacaaaatacaggcccggatagactcccacaacaagatcctctacgcaaggcatgctgaccagagaaatgcaactttccaacgtgtccttcaaaccggcaatgactttgagagagatgtcaagtccatgcttctgcgggccaacctcctcaagcatgattacattcagaaggcgagtggaccaaggaagatgtaacttgcgagcattgcttctagacacggcttcctgcatagtacctcctttgttttggaagaattgttctggacgtagaaggtgcatgcacggtctcgtctaggtggctgaagattgtctaaatgcctcgccctcttctttttggtttctgaaagtatggatggttgagcatctggagatgtgatgatctgtcatgctcattttgtgggcaagatttagttttgaattcttaaatgctttggaggtggtacatatgagtccagacaaaattgattggtggttcttggaatttttaacttgtcgcgccatattgtttc

SEQ ID NO: 1409 - DNA, 1638 bp, Zea mays
aattccttcctctcctctcgccccacgcccctctccatctgctcccgctccgcctcgcctagggttttgcccccaaacctagcctcccccgaatctcccacgccatggacgtcgagggcgaggtccccgccgccgccgcggcggcggtggcgaacggcctgggcggcgcgggcgcggaggaggcctctccggcgccggtctcggctgagcagctcgacgtggaggcgtacgcggcgcagtactcggggcggacccgcctcgtgcgcctcctctttgtcgccgaccggtgcggggtggaggcgatgcagctcgaggcgctgcggatggcttacgacgagatcaagcgcggggaggacgtgcagctccaccgcgacgtcgtcaccaagatcggcggccgcctcggtccgcgctacggcctcgaccaggcgtgggtcttcagcgtctcccgccgcgccgaccagcgcaaggagaagctcgagagcgagctcaatggatacaggactaacttaatcaaagagagcatcagaatgggctacaatgacattggtgatttcttctatgcccatggccaactttcagatgctttcaaaagctacatcaggactcgggactattgcaccacttccaaacatatagttcagatgtgcatgaatgtgattctggttagcattgagctggggcaatatgcacatgtttcaaactatgtcagcaaagcagagcaaacccccgactctctggatcctaccattgttgcaaagctgaaggcagctgcaggattagccaacttggaaacaaagaaatacaaatttgctgctcgtaagtttgttgagacaggaattgaactaggaaacaacttctctgaagtcatagctcctcaagacgtggcagtctatggtgccctttgtgcacttgcttcttttgaccgttcagacctgaagagcaaagtcattgacaatatcaacttccgtaactttctggacctggtgcctgaagtaagggagctggttaatgatttttatgcaagtcgctatggatcttgcttgggtcatcttgagaagctaaagcctaacctgctcctggatatccatttgcatcagcatgtagagactctgtatatggagattcgccacaaagcgatcatacagtacacacttccttttatatctgttgacctcaacacgatggcagccgcctttaagacttcggtctccatgctgcagaaggagctggccgcactgattactgaggacaaaatacaggcccggatagactcccacaacaagatcctttacgcaaggcatgctgaccagagaaatgcaactttccagcgtgtccttcaaaccggcaatgactttgagagagatgtcaagtccatgcttctgcgtgccaacctcctcaagcatgattacattcagaagacaagcggaccaaggaagatgtaaagattgcgggcgtcgctgctaggcaaggcttcctgctgcatgcctctccacttttttttttgaagaattgttctgtgacataaaagggaccgaagtctgtctaaatgccctccccctctttctttttattggttgatgaaagttattgtcgaagtaatgtatggttgagcatctggatgtaaaaaaaaaaaaaaaa

SEQ ID NO: 1410 - DNA, 1762 bp, Oryza sativa Japonica Group
gcactctcgcatcgtcttctccttcctccgccttccactctctccgtcgcctcgcctcacctatctagggttttggagcaaaacctagccttcgatcccagcgcgcatggacgtcgagggcgaggtcccggccgcggcggcggaggccgtggccaacggcctcggcggcgcggagccttccccggcgccggtgtccgcggagcagctggacgtggaggcgtacgccgcgcagtacacggggcggacgcgcctggcgcgcctcctgttcatcgccgagaggtgcggggtggaggcggtggagctcgaggcgctgcggatggcgtatgacgagatcaagcggggggaggacaccatgttccaccgggaagtcacgaacaaaatcaacggccgcctcggcccgaaatacgcgctcgaccaggcctggaccgattccgtcaaccgccgcgccgagcagcgcaaggagaagctcgagagcgagctcaatggctacaggaccaaccttatcaaagagagcatcagaatgggttacaatgacattggtgatttcttctatgctcatggccacctttcagatgccttcaaaagctacatccgtacacgtgattattgtaccacttccaagcatatagttcagatgtgtatgaatgtgattctggttagcattgagttgggacaatttccacatgtttccaactatgttagcaaagcagagcaaaccccagatactttggaccctatcattgttgcaaagttgcgagcagctgcaggattagcctacttggcaacaaagaagtacaaacttgcggcccgtaagtttgttgagacaggacatgaactaggaaacaattattctgaagtcatagctccacaagatgttgctgtctatggtgccctttgtgcacttgcttctttcgaccgttcagacctaaagagcaaagttatcgacaacagtaatttccgaaactttctggagctggtgcctgaagtgagggaacttgttaatgatttctattcaagtcgctatggatcatgtttggagcatcttgagaagctaaagacaaacctcctgttggatattcatttgcacgatcatgtagaaactctatacatggatattcgccacaaagctatcatacagtatacacttccatttatatctgttgatcttaacacgatggctgctgcttttatgacgtccgtgtccatgttggagaaagagctagctgcactgatcactgagaacaaaatacaggctcggatagactcccacaacaagattctttatgcgaggcatgctgaccaaagaaatgcaacttttcaacgtgtccttcaaacaggcaatgagtttgagagagatgttaagtctttgcttctgagagctaacctcatcaaacatgatttcaaccaaagagctggacaaaggaagatgtgaactctgccactgctgttgctgaaacaaggcgtgccggcttatccttttggacacatttgttttgtgcctaaaagtgtatgggccatggagaagttttggtgatgaatcatgaattagactgatgactgagcatgcaagtctgtttaaatgcgttttaccttttcggacaattccttgcttgctgtggttttaaatatgatgctgtgtaaacagctctggatatttaagcatctagagacttgacagaacgatctgtcacatttgaggccaagctattttttaaaatataaatgcttagagctggtactgtgatgcatagtaactcttagt

SEQ ID NO: 1411 - DNA, 3552 bp, Oryza sativa Indica Group
tccccggcgccggtgtccgcggagcagctggacgtggaggcgtacgccgcgcagtacacggggcggacgcgcctggcgcgcctcctgttcatcgccgagaggtgcggggtggaggcggtggagctcgaggcgctgcggatggcgtatgacgagatcaagcggggggaggacaccatgttccaccgcgaagtcacgaacaaaatcaacggccgcctcggcccgaaatacgcgctcgaccaggcctggaccgattccgtcaaccgccgcgccgagcagcgcaaggagaagctcgagagcgagctcaatggctacagggtgcgaaaacctaaccacttaatccttatgtttagatgaaatcggtacttcaattgcgttagtttctggttgtgatttgatgagtttgagcattggagctaatccttatgtttagatgaaattggttcttcgtttccgttaattctgctcgtgatatgatgggtttgagcattggaggatatggattatggaagcatgtccacatctcactgactcattatttgcttgatttatgactacggtgttggtgtggagtacgctgagttagttccatgtatgtcctactatgtggatcacggatgactgttctgctttgcgctgattcccaccggagtatgatatatattggtaaatatgttcctaacacgttttttgtgagaaatttaggtaatttgtgtagttagctataacgtttcaatttagatgctattttcttgggatgcattgatgcaaatgcttgttagattacgacgcagcgctgaatttcagattctgagtgtgctgctgtatcagctggttttggatctcagtgcaagtgcatggagtctatgttcaccaaacttttatgattgtggcctctttgggagttgaatcttctgctgatgttgtatatggcacaacattcatcaaagcctgcataaactagcttctgtaatttgtttctcttttcttttgtttggctttgggttattgtttgctttgtggccttgttgtgcgtacttctattctaaggtgatggcatacttattgaagaaactaacttttctggatttattttgtttctcaaattgcagaccaaccttatcaaagagagcatcagaatgggttacaatgacattggtgatttcttctatgctcatggccacctttcagatgccttcaaaagctacatccgtacacgtgattattgtaccacttccaagcatatagttcagatgtgtatgaatgtgattctggttagcattgagttgggacaatttccacatgtttccaactatgttagcaaagcagagcaaaccccagatactttggaccctatcattgttgcaaagttgcgagcagctgcaggattagcctacttggcaacaaagaagtacaaacttgcggcccgtaacgttagtcctctaaccccctatgttacttaccttttccgtaagttatcaaagcagtaatatgaggcaaggtgcggctctagcatcccttgcatccgcacttgtgtttcagtcgcttctgaaaacccaagctgccattcgttgatgctctgtcctgctctgtcaagttgctgatgtacaagggaagcaatgatggcaatggacagcagcatagtgaaaaacaatgtaatttgcaatgatggctattggcagtggcagtatcgacttcaatctccacccatttcaatttgcctcctttatcccttgaatctgcctcttaagatgaggcgacagctgtggtggtcacactggatcttctggacgccttgataacctttcccctcatgcttaaccttttaagtcaatattttgtagatacatatggttagaagtcaatgttatttatttatgtttcaacacaaatttttcatttttttaacttaataaacaatttccaacccgcgtaataaaatttcctagttacatgtgctatggagagctatgtacttgttctagcagatctgtgcacacaaccttttcagagaatggatgtcaacaattgtgaagtactccgtatgtatttactcatatgtcatgttctttgttagcatagaatttgctgctgaatttttctcccttaaagtttgttgagacaggacatgaactaggaaacaattattctgaagtcatagctccacaagatgttgctgtctatggtgccctttgtgcacttgcttctttcgaccgttcagacctaaaggttgctttctgttcgcttatttcctgtctgggtgtgttcctttaaaccattgtactcagatatgattgaataaacattttttacagagcaaagttatcgacaacagtaatttccgaaactttctggagctggtgcctgaagtgagggaacttgttaatgatttctattcaaggtaaagttgtagcttcatgtgttcccgttagtactcagtgtaccgcataattagatataaacatgtgtatcgctgtttttttataacatgttaaatgaaatcgatcaatgaaagatttaatgcatttgttaatccaaaatcgggcataacaccttattccatttcccaagtgaatcacattcaattactgtcctttatatatatattcgtctcatatcagaacagcctcagaggtttgtaataaattaatatcacataatataagcagtcttttccttagaacagtgttgtcctcaaaattctcttgtaacttataagaacatttaatctacagtagtcttgatgtggaatgagaatgattgttcctttcaaattctaaccttatttgtatcctttcaaattctaaccttattttgtacagtatgtcgtagatacatgtgcctttgagtgttgaatctaaaaatatcatgtaaattcgattatgtgctgaaagttgtcatagtccttatttaaaaccacttattcccacgttatagattgtgtacacttcttatttcattccaaagcttttccgaggtcacatttgttcgattcattctgatggattgcagtttacattttttaactgatgtgtgttatatctgctaaccgtgaaatcgttgaaccagtcgctatggatcatgtttggagcatcttgagaagctaaagacaaacctcctgttggatattcatttgcacgatcatgtagaaactctatacatggatattcgccacaaagctatcatacagtatacacttccatttatatctgttgatcttaacacgatggctgctgcttttatgacgtccgtgtccatgttggagaaagaggtagctgcactgatcactgagaacaaaatacaggtactttatcctctattgcgatgcctagggattccaggttgtgttaggttttgctcatatgtgattttctgcaggctcggatagactcccacaacaagattctttatgcgaggcatgctgaccaaagaaatgcaacttttcaacgtgttcttcaaacaggcaatgagtttgagagagatgttaagtctttgcttctgagagctaacctcatcaaacatgatttcaaccaaagagctggacaaaggaagatg

SEQ ID NO: 1412 - DNA, 1730 bp, Oryza sativa Indica Group
ctcgcctcacctatctagggttttggagcaaaacctagccttcgatcccagcgcgcatggacgtcgagggcgaggtcccggccgcggcggcggaggccgtggccaacggcctcggcggcgcggagccttccccggcgccggtgtccgcggagcagctggacgtggaggcgtacgccgcgcagtacacggggcggacgcgcctggcgcgcctcctgttcatcgccgagaggtgcggggtggaggcggtggagctcgaggcgctgcggatggcgtatgacgagatcaagcggggggaggacaccatgttccaccgcgaagtcacgaacaaaatcaacggccgcctcggcccgaaatacgcgctcgaccaggcctggaccgattccgtcaaccgccgcgccgagcagcgcaaggagaagctcgagagcgagctcaatggctacaggaccaaccttatcaaagagagcatcagaatgggttacaatgacattggtgatttcttctatgctcatggccacctttcagatgccttcaaaagctacatccgtacacgtgtatattgtaccacttccaagcatatagttcagatgtgtatgaatgtgattctggttagcattgagttgggacaatttccacatgtttccaactatgttagcaaagcagagcaaaccccagatactttggaccctatcattgttgcaaagttgcgagcagctgcaggattagcctacttggcaacaaagaagtacaaacttgcggcccgtaactttgttgagacaggacatgaactaggaaacaattattctgaagtcatagctccacaagatgttgctgtctatggtgccctttgtgcacttgcttctttcgaccgttcagacctaaagagcaaagttatcgacaacagtaatttccgaaactttctggagctggtgcctgaagtgagggaacttgttaatgatttctattcaagtcgctatggatcatgtttggagcatcttgagaagctaaagacaaacctcctgttggatattcatttgcacgatcatgtagaaactctatacatggatattcgccacaaagctatcatacagtatacacttccatttatatctgttgatcttaacacgatggctgctgcttttatgacgtccgtgtccatgttggagaaagaggtagctgcactgatcactgagaacaaaatacaggctcggatagactcccacaacaagattctttatgcgaggcatgctgaccaaagaaatgcaacttttcaacgtgttcttcaaacaggcaatgagtttgagagagatgttaagtctttgcttctgagagctaacctcatcaaacatgatttcaaccaaagagctggacaaaggaagatgtgaactctgccactgctgttgctgaaacaaggcgtgccggcttatccttttggacacatttgttttgtacctaaaagtgtatgggccatggagaagttttggtgatgaatcatgaattagactgatgactgagcatgcaagtctgtttaaatgcgttttaccttttcggacaattccttgcttgctgtggttttaaatatgatgctgtgtaaacagctctggatatttaagcatctagagacttgacagaacgatctgtcacatttgaggccaagctattttttaaaatataaatgcttagagctggtactgtgatgcatagtaactcttagtaaaaaaaaaaaaaaaaaa

SEQ ID NO: 1413 - DNA, 1642 bp, Hordeum vulgare subsp. vulgare
gagggttttgcggcgaaccccaccgccgatccccgtcgacagcagcatggacgtggagtgcgaggtgtcggcggccgcggccgccgcggtgacgaacgggctgggcggcgggggccagccctccgcggcgcccgtcgccgccgagcagctcgacgtggaggcgtacgcggcgcagtactcgggccggacccgcgtggcgcgcctcatcttcatctcggagcggtgcggggtggaggcggtcgagctcgaggcgctgcggatggcgcacgacgaggcccgggcgcgcgaggacaccacgctctacctcgaagccgttgccaagatcaacggccgcctcgccccgcgctaccgccacgaccaggcctgggtcgactccgtcaaccgccgcgccgagcagcgcaaggagaagctcgagaccgagctcaacggctacaggactaacctgatcaaagagagcatcagaatgggttataacgacattggtgacttcttctatggtcatggccacctttcagaagccttcaaaagctatatccggacacgggactattgcaccacttccaagcatatagttcagatgtgtatgcatgtgattctggtcagcattgagttgggacagtttgcacatgttatcaactatgtcagcaaagcagagcaaaccccagacaccttggatgctgtcatcgttgcaaagttgcgagcagctgcaggattggccaacttggagacaaagaaatataaacttgctgcccgtaagtttcttgagacaggacctgaactaggaagcaactactccgaagtcataactccgcaggatgtggctgtatatggtgtcctttgtgcacttgcttctttcgatcgttcagaactgaagagcaaagttattgacaacataaacttccgtaactttcttgagctagtgcctgaagtaagggagctggtcaatgatttttatgcaagtcgctatgggtcatgcttggagcatcttgagaagctaaagccaaatctccttctggatattcatctgcgtgagcatctagagactctgtacaatgatatccgccacaaagctatcgtacagtacacgattccgttcatatctgtggatctcaacacaatggctagtgccttcaagagctcagtgtccatgctggagaaagagctggctgcgttgatcaccgagaacaaaatacaggctcggatagactcccacaacaagatcctgtatgcaaggcatgctgaccaaagaaatgcaaccttccagcgggccctccagactggcaacgagtttgagagagatatcaaggccatgcttctgagagccaacatcatcaagcatgatttcacccagaagaactggcccggaccaaggaagatgaacttgtgagctcctctgagttgatgctgctaaaatggtgtctatcccctcctctgcttggaaatatttgttttggtacaaagggtgcatggcacattgagagaggtttcagtgaactgccctgatggctgaacaatcagcttcgtttttcctttttctatttgttggctctttaggttatgttccttcctggcacaaacgtcttatgaatagttgtgcatctggagatgtgatatgcccatctgccatgttcattttgatgtc

SEQ ID NO: 1414 - DNA, 1589 bp, Hordeum vulgare subsp. vulgare
gaagtccggttctatctcgccgtcgcctccccgctccttcgcttccgcccggccgtttctctagggtttaacgccatggacgtcgaggatgagctcccgaccgcgcccgcacccgcggacggcggcgagtcctcgcacgcgctggtgtccggggaccagttcgacgtggaggcgtacgcggctcagtactcggggcgcacgcgcgtggcgcggctcctcttcatcgcggagaagtgcgggtcggagcagatgcgtctggatgcgctccggctggcctacgactgggccctcaagggcgaggacacggccctccaccgcgacatctccgttaggatcgccggccgcctcggctcccgctacgccgtcgaccaggcctggtccgacgccgtcgagcgccgcgccctgctgcgcaaggacaagcttgacagcgagctcaatgtctacaggaccaatctgatcaaagagagcatccggatgggttacaacgaccttggggacttccactatgctcagggccacctttcagaggccttcaagagctatatcaggacccgcgattactgcactacctcgaagcatgttgttcagatgtgcttgaatgtcatacttgttagcattgagctggggcagtttatgcacgtctcaaattatgtcatcaaggcggagcagaccccagacgatatggatcctattactgccgccaagttgcgatctgctgctgggttagcctacatggaaacaaacaagtacaaacttgctgcccgaaagtttatagagacaggatcagagctaaggaccaactattctgaagttatagctccacaagatgttgctgtctatggtgcactatgcgcgcttgcttcttttgatcgctcagagctgaagagcaaagttattgacaactacaattttcgcaattttttggaattagtgcctgaagtaagggagctggtaaatgatttttatgcaagccgctacgggtcatgtctgggatatcttgagaagctgaagtcaaacctgctgctggatatgcatttgcacgagcatatcgaaactctgtacaaggacattcgccacaaagccatcattcagtacacattcccattcatatctgttgatctcaacttgatggctgttgccttccagacctctgtgtccctgttagagaaagagttggcagcgcttatcaccgataacaagatacaggctcgcatagactcgcacaacaagattttgtacgcaagtcacgccgatcaaagaaacgcaaccttccagcgggcactgcagacgggcaacgagtttgagagagatgtcaagtccatgcttctgagggcgaaccttctcaagcacgagtacagtcagaaggcagcagaaaagaagctgtgagaaaaagttctgcagagtgctaatgttaccgcagatacatgtgaaaaacagttcttgatttggacctgaggtgcattgagagattttagtgatgattcgtgccatggtcgagtatttcacatgacgactttccatattgaagccaagatactaggtttaagtatgtttttgagcacgcgaatataatataatttctgccatac

SEQ ID NO: 1415 - DNA, 1752 bp, Vitis vinifera
aagccctaaccctagcgaagtggttttgattcacaccatggaaggtgaagaagaatcgtctgcgggggcaatgatcgacgagatctattccaacggcggtgacgcaaagcgcaacagaccaatcataagcggggaagcactcgatatcgaagcttacgcgagcctttacagtgggcgaaccaagatcaccaggctcctcttcatcgccgaccgatgcgagaaccgtcagatgcagatggaggcgtatcggatggcatacgatgagataaaaaagggcgagaacacgcaactctatagggaggtagtgcagaagattgatggaaggttgggacctcagtatggtttggacctggtgtggacggagtcggtggagcgaagagccgaccagaggaaggagaaactagagaatgaacttaatgcttacaggacaaatttaatcaaagaaagcataagaatgggatacaatgacttcggagatttttactatgcccacggtttacttgcggatgcttttaagaattatgttcgaactcgtgactattgtactacatcaaagcatatcattcatatgtgtttgaatgcaattttggtcagcattgagatgggtcagttcactcatgtcacaagctatgttagcaaagcagaacaaacccctgaggcactggaccctgttacagttgcaaagctgcgctgtgctgcaggattggctcatttggaagctaaaaagtacaagcttgctgctcgcaagttcttggaaacaggtgctgaactggggaacaactacacagaagtgattgctccacaagatgttgctacctatggtggtctttgtgcacttgcaagctttgaccgtacagagctgaagaataaagttatagacaatctcaacttccggaacttcttagagttagtacctgaagtaagggagcttattcatgatttctattcaagccattatgcatcatgtcttgattaccttggaaatctcaaaacaaacctgttacttgacatccatttgcatgaccatgttgaaatgctgtataatcaaatccgccacaaagccctcatccagtatacgcatcccttcgtgtctgttgacctgcggatgatggctaatgctttcaaaacgagtgttgcagggctggagaaagagcttgaagctttgattactgacaaccaaatacaggctcggatcgactcacataacaaaattctctacgcacgacatgcagatcaaaggaatgcaactttccaacgggttttgcagacaggcaacgagtttgatcgtgacgttagggcaatgctgctgcgagcaaacctcctcaagcatgaatacaatcttagggcatcaaggaaaccataaacatcaatatcccggaggattaggtgttaccatgttgattaagtccagacttggtcagctagtatgggagatgtggagaaccaaaatcctttgaaaagaggggaatgaaaaatgacccatgctctatagctgttttcattttgatgggtgcaggaagggtgtttgtggaactatgaccaacattgatggattatatgttgtgtatatactcaaaattattcaccttagttgccacattgattctttctcatatctttggttctctcatcttcttctcctttccaaacagggactgaaatttgacacttaacgaatttgccagaaccctacccttagactctcttttgtaacctttttgtcgcagtgcaatattattccacttggggaaa

SEQ ID NO: 1416 - DNA, 2040 bp, Sorghum bicolor
atcaccagaagctgcaagctctccttacaaagcctccaaggcctcttctccagccgcccaaccacagccagctagtagtgatctctctctcgggagcacacagctaaggcacagcacctgtgctaagctcctgtttcgtcgcggccaagctttctgatcctcggtaggaacaaccgacgtcaaatggccggtggtagaagtgccgagcatcagctcctctccaggattgccgccggcgatggccacggcgagaactcgtcctacttcgacggctggaaggcctacgacatgaaccctttcgacctgcaccgcaaccgcgacggcgtcatccagatgggcctcgccgagaaccaactgtcgcttgacctgatcgagcaatggagcatggagcacccggaggcgtccatctgcacggcgcagggcgcgtcggagttccggaggatagccaacttccaggactaccacggcctgccggagttcagagaggcgatggctaagttcatggggcaggtgaggggcgggaaggtgacgttcgaccccgaccgcgtcgtgatgagcggaggagccaccggcgcccaggacactctggccttctgcctcgctgacccaggcgacgcctacctcgtgccgacgccatattacccagctttcgaccgtgattgttgctggaggtcaggagtgaagctgctgcccatcgaatgccacagctcaaacaacttcaccctcacacgggaggcgctggtgtgggcctacgacgacgcgcggagacagggcatccgcgtgaggggcatcctcatcaccaacccctccaacccgctgggcaccaccatggaccgcgccacactggcgatgctggccacgttcgccacggagcaccgcgtccacctcatctgcgacgagatctacgcgggctccgtcttcgccaagccggacttcgtgagcatcgccgaggtcatcgagcacgacgtccccggatgcaacagggacctcatccacatcgcctacagcctctccaaggacttcggcctcccggggttccgcgtcggcatcgtctactcgtacaacgacggcgtcgtggcctgcgcgcgcaagatgtccagcttcggcctcgtctcctcgcagacgcagcacttcctggcgaagatgctctccgacggcgagttcatggcgcgcttcctcgcggagagcgcgcggcggctggcggcgcgccacgagcgcttcaccgaggggctccgcgaggtcggcatcgcgtgcctgccgggcaacgcggggctcttctcgtggatggacctgcggggcatgctcagggacaagacgcccgacgcggagctggagctgtggcgggtcatcatccacgaggtgaagctcaacgtgtcgccaggcacgtcgttccactgcaacgagcccggatggttccgcgtctgccacgccaacatggacgacgacaccatggaggtggcgctccgcaggatccaccacttcgtgcgccagcaccagcagcagcagcagcagcagagcaaggccaaggccgagcgctgggcggccacgcgccgcctgcgcctcagcttgccgcgccggggagctgcttcgcacctcgccatctccagccccttggcgttgctgtcgtcgccgcagtcgcccatggtccacgccagctaagtcaccgagcattcggcaagactggctgtagggtgcgtgtgcccgtacatccgtacgtgcaccttttttttccagtcacatgactacaagcaagtctatgtgatcgttgagaaaaagattagacaagagtaaatgggcgtacgtagctagtttgacgttatacagagacgttctgcaggtatcggtagtcaagcaggacacattgtcctcgattcattcgtgcatatgtttttttttttggcgaaaaaatcgcgtatatggtttggtttgacgttagtataaagcatggtagaataacgatcggatatggtaatttaatcctgccgatcaattgttgttgtaaacctctgaaggaagtttataacagaagcacagtaccac

SEQ ID NO: 1417 - DNA, 1464 bp, Saccharum hybrid cultivar SP80-3280
  misc_feature (897)..(897): n is a, c, g, or t
atggccggtggtagcagtgccgagcatcatctcctctccaggatcgccgccggcgatggccacggcgagaactcgtcctacttcgacgggtggaaggcctacgaaatgaaccgcttcgacctgcgcgacaaccgcgacggcatcatccagatgggcctcgccgagaaccaactgtcgcttgacctgatcgagcaatggatcatggagcacccggaggcgtccatctgcacggcgcagggcgcgtcggaattccggaggatagccaactaccaggactacaacggcctgccggagttccgagaggcgatggccaagttcatggggcaggtgaggggcgggaaggtgacgttcgaccccgaccgcgtcgtgatgagcggaggagccaccggcgcgcaggacactctggccttctgcctcgctgacccaggcgacgcctacctcgtgccgacgccatactacccagctttcgaccgtgactgttgctggaggtcaggcgtgaagctgctgcccatcgaatgccacagcgcaaacaatttcaccctcacacaggaggccctcgtgtcggcatacgacgacgcgcggagacagggcatccgcgtgaagggcatcctcgtcaccaacccctccaacccgctgggcaccatcatggaccgcgccacgctggcgatgctggccacgttcgccacggagcaccgtgtccacctcatctgcgacgagatctacgcgggctccgtcttcgccaagccggacttcgtgagcatcgccgaggtcatcgagcgcgacgtcccgggctgcaacagggacctcatccacatcgcgtacagcctctccaaggacttcggcctcccgggcttccgcgtcggcatcgtctactcgtacaacgacgacgtcgtggcntgcgcgcgcaagatgtccagcttcggcctcgtctcgtcgcagacgcagaacttcctggcgaagatgctctccgacgcggagttcatggcgcgcttcctcgcggagagcgcgcggcggctggcggcgcgccacgaccgcttcatcgcgggcctccgcgaggtcggcatcgcgtgcctgccaggcaacgcggggctcttctcgtggatggacctgcggggcatgctccgggacaagacgcacgacgcggagctggagctgtggcgggtcatcatacacaaggtcaagctcaacgtgtcgcccggcacgtcgttccactgcaacgagcctggctggttccgcgtctgccacgccaacatggacgacgagaccatggaggtggcgctcgaccggatccgctgcttcgtgcgccagcaccagcagagcaaggccaaggccgagcgctgggcagccacgcggcccctgcgcctcagcttgccgcgtcggggaggcgccaccccttcgcacctcgccatccccagccccttggcgttgctgtcgccacagtcgccgatggtccacgccagctag

SEQ ID NO: 1418 - DNA, 3034 bp, Zea mays
gccggtggtagcagtgccgagcagctcctatccaggatcgcctccggcgatggccacggcgagaactcgtcctacttcgacgggtggaaggcctacgacatggaccctttcgacctgcgccacaaccgcgacggcgtcatccagatgggcctcgccgagaaccaagtacgtgacgtagccctgccgcatgcagctacagctacaccctttcgacctgcgcaacaaccgcgacggcgtcatccagatgggcctgctgtcgatggaatgctcatgtaattaaaccaccggccggggcgtgttttgcagctgtccctggacctgatcgagcaatggagcatggagcacccggaggcgtccatctgcacggcgcagggagcgtcgcagttcaggaggatagccaacttccaggactaccacggcctgccggagttcagagaggtattaattaagttaactaacagctcggctaaggaaacgccagaatcattgattaggtttgctgctctctaatggcgactgcgaaaacgacggagcagctaccggccagccggccggcggttagctagcactagcagccgccttcctgacagatcatccatgacgttttgattgttgcaggcgatggccaagttcatgggccaggtgagggccgggaaggtgacgttcgaccccgaccgcgtcgtcatgtgcggaggcgccaccggcgcgcaggacactctcgccttctgcctcgctgacccgggcgacgcctacctcgtgccgacgccatactacccagcgtatgtctcgaccaacgtcatccttgtacttgtaccaaaattagtcacccgttgacacgaaagttggtaagagggtaagagcagggaaaggcagagctaaggccctgtttggtttgaggtgactaaagtttagtgactaatatttagtcacttttagtctctaaagaagtaaacatggtgactaaagtgaagtgactaaattttagttctttagtcactaagaggctgactaaaagggactaaagtagtatttttaccttatttgtcctctccactttcttcttatagcaaacatctattaattaatagggataaaataatcattattcacagcaattaatgccctttagtccggtttagtcactggaaccaaacgggatactttagcgactaaactttagtcactaaaatttagtctagtgactaagggaaccaaacaggacctaattcgagtgtgatgtcaacaagacaacaaataatagccaattgtagcccctcgccatctttccttgtttgggtaacgtttcaaaatttagggggtgtttggtttctagggactaatgtttagtcccttcattttattccattttagtatataaattgtcaaatataaaaaccaaaatagagttttagtttctatatttgacaattttagaactaaaatgaaataaaatgtagggactaaagtataaactaaacacccccttacctcgatcacgaacctctaaaagtaagtagcaccctcctcccccacagtcaaatcaacataatacagtacaatagaccttgttagtcgcatggatgattgtcgtcaagtgggcaacgcaatctagtcacgtaaggaaaaccatgcacgttgttcatacacggtctgtttccatgcgactttaatttccacgcacgtttgcatcgttgaccaaccaactgaacgtgcctgtaggtcccgcacagcaacgtaagcatatgcatgcacgtacgacgtacggcacgggaaaaaaattctgcacaccgtattttacagctcttcatatccaccacatgtagcggccccacaaaaaacagattaaaatttgcaacttaatccttaagtaatttgtttttcttctatttatatagattatcagttgatggatgtgtgaagttgtaaaagagattatttgtatccaggattaaaataattttccgtacggcacgcctgcagtactcattctcgccagccctgagcccctgatatatgacacgcttttcattgttcacacagtttcgaccgtgactgttgctggaggtcaggcgtgaagctgctgcccatcgaatgccacagctcaaacaacttcaccctcacacgggaggcgctcgtgtcggcctacgacggcgcgcggaggcagggcgtccgcgtcaagggcgtcctcatcaccaacccctccaacccgctgggcaccaccatggaccgcgccacgctggcgatgctcgccaggttcgccacggagcaccgtgtccacctcatctgcgacgagatctacgcgggctccgtcttcgccaagccggacttcgtgagcatcgccgaggtcatcgagcgcgacgtcccgggctgcaacagggacctcatccacatcgcgtacagcctctccaaggacttcggcctcccgggcttccgcgtcggcatcgtctactcgtacaacgacgacgtcgtggcctgcgcgcgcaagatgtccagcttcggcctcgtctcctcgcagacgcagcacttcctggcgaagatgctgtcggacgcggagttcatggcccgcttcctcgcggagagcgcgcggcggctggcggcgcgccacgaccgcttcgtcgcgggactccgcgaggtcggcatcgcgtgcctgcccggcaacgcggggctcttctcgtggatggacctgcggggcatgctccgggacaagacgcacgacgcggagctggagctgtggcgggtcatcgtacacaaggtgaagctcaacgtgtcgcccggcacgtcgttccactgcaacgagcccggctggttccgcgtctgccacgctaacatggacgacgagaccatggaggtcgcgctcgacaggatccgccgcttcgtgcgccagcaccagcacaaggccaaggccgagcgctgggcggccacgcggcccatgcgcctcagcttgccgcgccggggaggcgccaccgcttcgcacctccccatctccagccccatggcgttgctgtcgccgcagtccccgatggttcacgccagc

SEQ ID NO: 1419 - DNA, 2345 bp, Zea mays
gccggtagcagcgcggagcagctcctctccaggatcgccgccggcgacggccacggcgagaactcgtcctacttcgacgggtggaaggcctacgacatgaaccctttcgacctgcgccacaaccgcgacggcgtcatccagatgggcctcgccgagaaccaagtacgtacctatagcgtgtacctacccttccgatctgtagtactgcccacacttgctgcatgctgctgccgatccaagtccaatgctcatgtaaactggcgtgctgcagctgtcgttggacctgatcgagcaatggagcgtggaccacccggaggcgtccatctgcacggcgcagggcgcgccgcagttccggaggatagccaacttccaggactaccacggcctgccggagttcagagaggtaactaactagtagtgattaacaagcaaataaacgccaggatcactgcatcgattagctaggtttgctgctgctgctgctgctgtctaatataatggcgactgcacgcgaaaagcgacggagcagctaccggccggcggctagctagctagctggcactggcagcgcagtcgccttcatgagtccacgcacgcgcggctacgtcttaatgatcgatcggctcgtcgtttgttgcaggcgatggccaagttcatggggcaggtgaggggcggcaaggtgacgttcgaccccgaccgcgtcgtcatgtgcggaggagccaccggcgcgcaggacactctcgccttctgcctcgctgacccgggcgacgcctacctcgtgccgacgccttattacccagcgtatgttctgacgtcacccttgtactgccaaactactactcaggtcctagtcatatccgtagacacgaaagggtgggtgggtctgggttgttggttggtcaagagcacgcaaaattgagctaattcgactacgtacgtgtcaatgtcaactagccacttatctttccttgtttgggtaaagtttcaaaacttattaactcgatcaggaacctctctaaaaagcattcacctatttttcccccgtaaggcggtaaccaaatctaaacgatatacccttgttagtcgcactgatgactgcattgtcgtcaagtggacaacgcaatctagtcacgcgacctctaaggaaaaccacgcacgtatacgcacttcgtgcacggtctgttccacgcgactttagtttccatgcacgtttacatcgttgaccatccgcagtccgcacagcaacgtaagcataaacatgcacgcacgacgtacggcacaccgtacctgttcctctcgagggctgagaccctgacacgtttttttcgttgtgtggtgatcacagtttcgaccgcgactgttgctggaggtcaggagtgaagctgctgcccatcgaatgccacagctcgaacaacttcaccctcaccagggaggcgctcgtgtcggcctacgacggcgcgcggaggcagggcgtccgcgtcaggggcatcctcatcaccaacccctccaacccgctgggcaccaccatggaccgcggcacgctggcgatgctcgccgcgttcgccacagagcgccgcgtccacctcatctgcgacgagatctacgcgggctccgtcttcgccaagccgggcttcgtgagcatcgccgaggtcatcgagcgcggcgacgccccgggctgcaacagggacctcgtccacatcgcgtacagcctctccaaggacttcggcctcccgggcttccgcgtcggcatcgtctactcctacaacgacgacgtggtggcctgcgcgcgcaagatgtccagcttcggcctcgtctcgtcgcagacgcagcacttcctggcgatgatgctcgccgacgcggagttcatggcacgcttcctcgcggagagcgcgcggcggctggcggcgcgccacgaccgcttcgtcgcgggcctccgcgaggtcggcatcgcgtgcctgccgggcaacgcgggcctcttctcgtggatggacctgcggggcatgctccgggagaagacgcacgacgcggagctcgagctgtggcgggtcatcgtacacagggtgaagctcaacgtgtcgcccggcacgtcgttccactgcaacgagcccggctggttccgcgtctgctacgccaacatggacgacgacaccatggaggtcgcgctcgaccggatccgccgcttcgtgcgccagcaccagcacagcaaggccaaggccgagcgctgggcggccacgcggccccttcgcctcagcttgccgcgccggggagcaaccaccgcttcgcatctcgccatctccagccccttggcgttgctgtcgccgcagtccccgatggtccacgccagc

SEQ ID NO: 1420 - DNA, 1745 bp, Zea mays
ccagaagcagccagcaagctcatgcccttcaaaagcctccggcagcccagcgccccagccagctagtggtgatctctcatctcagcagcgcgcctgaacgtgtgctccctgctaagctctgcgcctcgataggcaaaggaaaatcaaaccgatcgtcgtcagattaaatggccggtagcagcgcggagcagctcctctccaggatcgccgccggcgacggccacggcgagatctcgtcctacttcgacgggtggaaggcctacgacatgaaccctttcgacctgcgccacaaccgcgacggcgtcatccagatgggcctcgccgagaaccaactgtcgttggacctgatcgagcaatggagcgtggaccacccggaggcgtccatctgcacggcgcagggcgcgccgcagttccggaggatagccaacttccaggactaccacggcctgccggagttcagagaggcgatggccaagttcatggggcaggtgaggggcggcaaggtgacgttcgaccccgaccgcgtcgtcatgtgcggaggagccaccggcgcgcaggacactctcgccttctgcctcgctgacccgggcgacgcctacctcgtgccgacgccttattacccagctttcgaccgcgactgttgctggaggtcaggagtgaagctgctgcccatcgaatgccacagctcgaacaacttcaccctcaccagggaggcgctcgtgtcggcctacgacggcgcgcggaggcagggcgtccgcgtcaggggcatcctcatcaccaacccctccaacccgctgggcaccaccatggaccgcggcacgctggcgatgctcgccgcgttcgccacagagcgccgcgtccacctcatctgcgacgagatctacgcgggctccgtcttcgccaagccgggcttcgtgagcatcgccgaggtcatcgagcgcggcgacgccccgggctgcaacagggacctcgtccacatcgcgtacagcctctccaaggacttcggcctcccgggcttccgcgtcggcatcgtctactcctacaacgacgacgtggtggcctgcgcgcgcaagatgtccagcttcggcctcgtctcgtcgcagacgcagcacttcctggcgatgatgctcgccgacgcggagttcatggcacgcttcctcgcggagagcgcgcggcggctggcggcgcgccacgaccgcttcgtcgcgggcctccgcgaggtcggcatcgcgtgcctgccgggcaacgcgggcctcttctcgtggatggacctgcggggcatgctccgggagaagacgcacgacgcggagctcgagctgtggcgggtcatcgtacacagggtgaagctcaacgtgtcgcccggcacgtcgttccactgcaacgagcccggctggttccgcgtctgctacgccaacatggacgacgacaccatggaggtcgcgctcgaccggatccgccgcttcgtgcgccagcaccagcacagcaaggccaaggccgagcgctgggcggccacgcggccccttcgcctcagcttgccgcgccggggagcaaccaccgcttcgcatctcgccatctccagccccttggcgttgctgtcgccgcagtccccgatggtccacgccagctaggtagtcaccgagcgttcggtaagactggctgtaggttgtgccctcacatgactgcaaacaagtggacaaaaaaaaaagacaagactaataaagggcgtacgtagctagcttgacatt

SEQ ID NO: 1421 - DNA, 1966 bp, Zea mays
ccacccccagccagctagtggtgttctctcagcagcgcgcccgaacgtgtgctccctgctaagctctgcgcctcggtaggcaaggaaaatcaaacagatcgtcgtcagattaaatggccggtagcagcgcggagcagctcctctccaggatcgccgccggcgatggccacggcgagaactcgtcctacttcgacgggtggaaggcctacgacacgaaccctttcgacctgcgccacaaccgcgacggcgtcatccagatgggactcgccgagaaccaactgtcgctggacctgatcgagcaatggagcgtggaccacccggaggcgtccatctgcacggcgcagggcgcgccgcagttccggaggatagccaacttccaggactaccacggcctgccggagttcagagaggcgatggccaagttcatggggcaggtgaggggccgcaaggtgacgttcgaccccgaccgcgtcgtcatgtgcgggggagccaccggcgcgcaggacactctcgccttctgcctcgctgacccgggcgacgcctacctcgtgccgacgccttattacccagctttcgaccgcgactgttgctggaggtcaggagtgaagctgctgcccatcgaatgccacagctcgaacaacttcaccctcaccagggaggcgctcgtgtcggcctacgacggcgcgcggaggcagggcgtccgcgtcaggggcatcctcatcaccaacccctccaacccgctgggcaccaccatggaccgcggcacgctggcgatgctcgccgcgttcgccacggagcgccgcgtccacctcatctgcgacgagatctacgcgggctccgtcttcgccaggccgggcttcgtgagcatcgccgaggtcatcgagcgcgacgccccgggctgcaacacggacctcgtccacatcgcgtacagcctctccaaggacttcggcctcccgggcttccgcgtcggcatcgtctactcctacaacgacgacgtggtggcctgcgcgcgcaagatgtccagcttcggcctcgtctcgtcgcagacgcagcacttcctggcgagcatgctctccgacgcggagttcatggcccgcttcctcgcggagagcgcgcggcggctggcggcgcgccacgaccgcttcgtcgcgggcctccgcgaggtcggcatcgcgtgcctgccgggcaacgcgggcctcttctcgtggatggacctgcggggcatgctccgggagaggacgcacgacgcggagctcgagctgtggcgggtcatcgtacacagggtgaagctcaacgtgtcgcccggcacgtcgttccactgcaacgagcccggctggttccgcgtctgctacgccaacatggacgacgacaccatggaggtcgcgctcgaccggatccgccgcttcgtgcgccagcaccagcacagcaaggccaaggccgagcgctgggcggccacgcggcccctccgcctcagcttgccgcgccggggagcaaccaccgcttcgcacctcgccatccccagccccttggcgttgctgtcgccgcagtccccgatggtccacgccagctagctagtcaccgagcgttcggtaagactggctgtagggtgtgccctcacataactgcaaacaagtggacaaaaaaatattagacaagactaataaagggcattagtagctagcttgacattacacagagacgttgcacaggcgtcagcaggcgtcggcggtaagcagctagtcaagcaggacgcatttgtcctcgattttttcgtgtatatatgttcttttttctgttttgccaaatcgcatgtatggtttggtttaacgttagtaatcacggtagaataacgatcgggtatggtaatttagacctcccgatcaattgttgttgaaaacctgtcacgtaacttcaggacacagaaggcgtagctcaagggtgaataaaagaccagtttacatatcat

SEQ ID NO: 1422 - DNA, 2009 bp, Hordeum vulgare subsp. vulgare
gatccatctccctccctccctcgccagctcaagctcaagaagcttcaccaatctccctagcaagctcaagaagcttcatcctcagctagattagcgcataacattcttggcctctcttcttgtccgtctctgtctctgcttctgctcatccatcgacctttagctagctcatcttgagaaacccgatagcgcagatggcaagcaaatccgccgagcttctgtcgaggatggccgccggcgacggccacggcgagaactcgtcctacttcgacgggtggaaggcgtacgacaagaaccccttccacctgcaggacaaccccgatggtgtcatccagatgggcctcgccgagaaccaactctcgctggacctgatcgaggagtggagcaaggcacacccggaggcatccatttgcacggcggagggcgcctcgcagttcaagaggatcgccaatttccaggactaccacggcctcccggagttcagacaggcgatggcccagttcatggggcaggtgagggggtggaaggccaggtttgacccagatcgcgtcgtgatgagcggcggcgccaccggcgcgcaggagacgctcgccttctgcctcgccaaccccggcgaggctttcctcgtgcccacgccttactacccaggattcgaccgcgactgctgctggaggtcgggggtgaagctgctgccgatcgagtgccacagctccaacgacttcaagatcaccagggaggccgtggtgtcggcgtacgagagcgcgcggagcaacggcgtccgcgtgaagggcatcctcatcaccaacccgtccaacccgctgggcacgaccgcggaccgggccacgctggccatgctcgccaccttcgccacggagcaccgcgtccacctcatctgcgacgagatctacgcggggtcggtgttcgccaagccggagtacgtgagcatcgcggaggtgatcgagcacgacgtccccggcgtggtcgacagggacctgatccacatcgcctacagcctctccaaggacttcggcctcccggggttccgcgtcggcatcgtctactcgtacaacgacgccgtggtgtcctgcgcgcgcaagatgtccagcttcgggctggtgtcgtcgcagacgcagctcttcctggccaagatgctcggggacgaggagttcatggcgcggttcctgggcgagagcgcgcggcggctggcggcgcggcacgagctgttcacgtcggggctgcgcgaggtcggcatcgggtgcctgggcggcaacgccgggctcttcacgtggatggacctgcggggcatgctccgggagaagacggcggaggcggagctggagctgtggcgggtgatcatccgcaaggtgaagctcaacgtgtcgccggggacgtcgttccggtgccgggagcccgggtggttccgcgtctgccacgccaacatggacgacgagaccatgggggtggcgctggaccggatccggctcttcgtgcgccagcaccagcagcagaaggccaaggcccggcgctgggcagccaggggccagctccacctcagcctccagcgccacggcgccatgccttcgcagtaccacgcgctctccagccccatggcagcgctgctgtcgccccagtctccgctcgtccacgccgccagctaagtcactagtcaccacggtcggtcaagtgagccgtacgtacgtacacgcttttttcgatcacatgcatgcatgcatgcaggggcctggccttggtgtctgggcgctccgctggtgcatacatggatgcgattgtttgggaaggtttaggcatgcaaaatgcatgcggatgcagcatgtagctgtagattaacgttttacctactgatgtagggtaagccgtgtgttaccacgtaggatattacgatcctctttgttttgcttgtttatggtttggtctggtctgatcggatcaaggcttcccgatcaggtgctgtaataaacttgtacactgaggtacaagattgatgttgt

SEQ ID NO: 1423 - DNA, 2112 bp, Oryza sativa Japonica Group
aaacaagccagctcaatcaatcatcgagctagctgagctagctaagtgccatattgcacgtactcgttgtctgtccgatcatccttttttttttcttgtgggggtctgtccgatcatccttgcgtggctaggcaggtagagtagctacctgctcggctgctcgcgttccagccagggtccgggcttcggatatcctcggagtccgacaccaaatcaatggcgtaccagggcatcgaccttctctcgacgaaagccgcaggcgatgaccacggcgagaattcatcgtacttcgacgggtggaaggcctacgacacgaacccgttcgacctgcggcacaatcgcgggggtgtcatccagatgggtctcgccgagaaccagctttctctggacctgatcgaggaatggagcaagaaccaccccgaggcatccatttgcacaccggagggcgtctcgcagttcaagaggatcgccaatttccaggattaccacggcctcccggagttcagaaaggcgatggcccagtttatggggcaggtgaggggaggcaaggcaacgtttgaccccgaccgtgtcgtcatgagcggcggcgccaccggcgcccaggagacgctcgccttctgcctcgccaaccccggcgaggccttcctcgtgcccacgccatactacccagctttcgaccgcgactgttgctggaggtcaggaataaagctgctgccgatcgagtgccacagcttcaacgacttcaggctcaccaaggaggccctcgtgtcggcgtacgacggcgcacggaggcagggcatctccgtcaaggggatcctcatcaccaacccgtccaacccgctcggcaccatcaccgaccgcgacacgctggccatgctcgccaccttcgccaccgagcaccgcgtccacctcgtctgcgacgagatctacgcggggtcggtgttcgccacgccggagtacgtgagcatcgccgaggtcatcgagcgcgacgtgccgtggtgcaacagggacctgatccacgtcgtgtacagcctctccaaggacttcggcctccccggcttccgcgtcggcatcatctactcgtacaacgacgccgtcgtggcggccgcgcgcaggatgtccagcttcgggctcgtctcgtcgcagacgcagtacttcctcgccaggatgctctcggacgaggagttcatcggccgcttcctccaggagagcaagtgtcggctggtggcgcggcacgagcggttcacctctggcctccgcgaggtcgggatcggctgcctgcgcggcaacgccgggctgttctcgtggatggacctgcgccgcatgctccgggagaagacggccgaggcggagctggagctgtggcgggtgatcgtacaccaggtgaagctgaacgtgtcgcccggcacgtcgttccactgccgcgagcccgggtggttccgcgtctgccacgccaacatggacgacgagaccatggaggtcgcgctcggccggatccacgacttcgtgcgccagcaccagcagcgcagggtcaaggccgagcgctgggccgccaataggcagctccgcctcagcctgccgcaccaccaccacctcagcccagcccatctctccagtccattggcgctcctgtcgccgcagtccccgatggttcgcgccaccagctgattaagccagcagtgcacttgctctgctaatgctgcgccttactacgtcgactacattttcataaccatttttttctcgatcgcatcgtcgcacggcggcacggggccgtatggtgttctttccgatgcaggtacgtgtgatcgtttgtggaaactaggctacacgtgcacggcaccgtacatgtagcttggcttttttgtagagacgtgcgttagtgcgtacaggcgtcgccgcgtcgggtgtacataggtaattttagtagcgtgtgtaacaggggtatcggagattcggagtcctcgattcttttgtgtatggtttggttaattcagatggcaaggaataatgatcggattaaggcgttaagccccccgatcggctcttgtaaactgtaaagtgtaaacacgttacacttacaataaggcttaggattgaatcgatccggat

SEQ ID NO: 1424 - DNA, 2030 bp, Oryza sativa Indica Group
atggcgtgccagggcatcgaccttctctcgacgaaagccgcaggcgatgaccacggcgagaattcatcgtacttcgacgggtggaaggcctacgacacgaacccgttcgacctgcggcacaatcgcgggggtgtcatccagatgggtctcgccgagaaccaggtacgcgcacagacctgtgtatactcatttctgaattaaggatcgttctcgacaaagtgctaatccgtctttgttgccctgtaaatgtcacagctttctctggacctgatcgaggaatggagcaagaaccaccccgaggcatccatttgcacaccggagggcgtctcgcagttcaagaggatcgccaatttccaggattaccacggcctcccggagttcagaaaggtaaggccaatcaatcgctgacatcacatcagcatattagacaagctatataacatcatagaaaattcgataaaaatattgagaaccagatagatgacaaagctgctgcttgcgaccgtgaaagcaacgcagcaactagcgttcgggaggtcatattgttaacaactgaatgtgattgtgatgttgcaggcgatggcccagtttatggggcaggtgaggggaggcaaggcaacgtttgaccccgaccgtgtcgtcatgagcggcggcgccaccggcgcccaggagacgctcgccttctgcctcgccaaccccggcgaggccttcctcgtgcccacgccatactacccagcgtatgtcccgtcaaccttaactatcacaactgaaactgaatttgttctcttccgctcgtagaagtcttctgtttcctctgaatatctagtagttcgtcaaacgaggaaaagatatccgagtgtcaactaagaaaatcagataacattctctccgagatttgagttacgttttaaaattggcttggagagaaaagatggattaattttcccgtgattgaatcaaactgcgacctaattatggatgccgttgaagtcaaatgactaaatctagtcatgcaagcaaacgcatgcacgatgttcgcacacggtcgtagtcaatgcaattttaactctgatgcatgtttacaatgtaacatagctgaggtagctaagcctaaggcctgacgacatgtgcttccgttgacagtttcgaccgcgactgttgctggaggtcaggaataaagctgctgccgatcgagtgccacagcttcaacgacttcaggctcaccaaggaggccctcgtgtcggcgtacgacggcgcacggaggcagggcatctccgtcaaggggatcctcatcaccaacccgtccaacccgctcggcaccatcaccgaccgcgacacgctggccatgctcgccaccttcgccaccgagcaccgcgtccacctcgtctgcgacgagatctacgcggggtcggtgttcgccacgccggagtacgtgagcatcgccgaggtcatcgagcgcgacgtgccgtggtgcaacagggacctgatccacgtcgtgtacagcctctctaaggacttcggcctccccggcttccgcgtcggcatcatctactcgtacaacgacgccgtcgtggcggccgcgcgcaggatgtccagcttcgggctcgtctcgtcgcagacgcagtacttcctcgccaggatgctctcggacgaggagttcatcggccgcttcctccaggagagcaagtgtcggctggtggcgcggcacgagcggttcacctctggcctccgcgaggtcgggatcggctgcctgcgcggcaacgccgggctgttctcgtggatggacctgcgccgcatgctccgggagaagacggccgaggcggagctggagctgtggcgggtgatcgtacaccaggtgaagctgaacgtgtcgcccggcacgtcgttccactgccgcgagcccgggtggttccgcgtctgccacgccaacatggacgacgagaccatggaggtcgcgctcggccggatccacgacttcgtgcgccagcaccagcagcgcagggtcaaggccgagcgctgggccgccaata

SEQ ID NO: 1425 - DNA, 2173 bp, Triticum aestivum
ccgccggcgacggccacggcgagaactcgtcctacttcgacgggtggaaggcgtacgacatgaaccccttccacccgcaggacaaccgcgggggcgtcatccagatgggcctcgccgagaaccaagtacgtgctatagtccttgttgaacacagtgttagtaatatttgctgttcatctttcgccattacaaagcatgaagctaatcgtcggtgttgctgcagctctcgctggacctgatcgaggagtggagcaaggcccacccggaggcgtccatctgcacggcggagggcgcctcgcagttcaagaggatcgccaatttccaggactaccacggcctcccggagttcagacaggtgagcagaaacacgcataagacaaagtagccggtgatataattggacaagattaatgataagatagctgctgacgagcgcgaaagcgacggagcagcgcccctgacggatcatttttgctaaccaatatgcgatttgtctctgttgctgcaggcgatggcccagttcatggggcaggtgagggggtggaaggccaggtttgacccggatcgcgtcgtgatgagcggcggcgccaccggcgcgcaggagacgctcgccttctgccttgccaaccccggcgaggccttcctcgtgcccacgccttactacccagggtacgcttcattcgtcaaccccttgacagcaactgaattcggtgcatgtccgcctctcgtgcacgtagaagtcaatcggcagaccctgaaaatcgggtcaaaatttagacaatgtgtacatgtcaggaaaatcattttgggctcggaaggaagactaatctagtgtcaacgaggaatagctagccttccagacgaaaaggccgacagcttttcagtctccttgaaataaaatcaaatccaagtaggatcctaagttcttggtttcatgccttcaagttcaagttgagtggcgcaacctagcctgcatatacagcagccggtctggtctttggtgaccttttggttaacgcatgttaacgtctctgacctacgcacggtcaattgatgaccaataaaattcaaatggagtaaagatgcatagcgcaacaacgtacgcatgcatgcacgcgacgagttgtttcatcaggcctgacgtacgtgcgctttcgtttccgatcacagattcgaccgcgactgctgctggaggtcgggagtgaagctgctgccgatcgagtgccacagctccaacgacttcaggatcaccagggaggccgtggtggcggcgtacgagggcgcgcggagcagcggcgtgcgcgtcaagggcatcctcatcaccaacccgtccaacccgctgggcacgaccgcggaccgggccacgctggccatgctcgccaccttcgccacggagcaccgcgtgcatctcatctgcgacgagatctacgcggggtcggtcttcgccaagccggagtacgtgagcatcgccgaggtgatcgagcacgacgcgcccggcgccgaccgggacctcatccacatcgcctacagcctctccaaggacttcggcctcccggggttccgcgtcggcatcgtctactcgtacaacgacgccgtcgtggcctgcgcgcgcaagatgtccagcttcggcctggtgtcctcgcagacgcagctcttcctggccaagatgctcggggacgaggagttcatgtcccggttcctgcgcgagagcgcgcggcggctggcggcgcggcacgagctgttcacgtcggggctccgcgaggtgggcatcgggtgcctgggcggcaacgccgggctcttctcgtggatggacctgcggggcatgctccgggagaagacggcggaggcggagctggagctgtggcgggtgatcatccgcaaggtgaagctcaacgtgtcgccggggacgtcgttccactgcggcgagcccgggtggttccgcgtctgccacgccaacatggacgacgagaccatgggggtggcgctgagccggatccgggacttcgtgcgccagcaccagcagcagaaggccaaggcccagcgctgggccgccaggagccacctccacctcagcctccagcgccacgggcccatggcgtcgcagtaccacgcgctctccagccccatggccgcgctgctgtcgccccagtctccgctcgtccacgccgccagc

SEQ ID NO: 1426 - DNA, 1299 bp, Zea mays
cctactgcagctcaggttgtttctgatagtcttctcttctgccgtccatccggcctgcgcgctcgctctcctgctcttctgcgccaactgggcgaccgccgacgccaacgccgacgacctacgccaggtgctgggatttttgtcggttccttcggcagctttcgtcgcgtccttcgccggcgacgagcactcaccaggtccgctcctgaagaagactgggatattttgcatacacagaggatcatctgtgtagaggacattcagttttctccagttctccagttcctggatagcaatggcaaatgagtttcctgatgaagttcttaagtctgttttcccattgctggatggtaaagatctagtattctgcatgcttgtatgccgtcaatggcatgaaatcgcaagggatgattacttctggaaatgcatttgctcacggaagtggccgtccatttgcaaacagcccccttctggcgcaaactacaaaaagctttacttaaccttctctaagccacgggagatgcagaacctccctgtgccaaggcttacattcgaggatattgttttctacattgatatgtggctcgaaggatcgctcatcttttctcaagcagtttcaggccgcactctccgagcaggcctacagggcgctccccctcctggcattccagatatacttgcagcacatttgagttcccaagactgcatcttgatgctggaagtagagcccaagttggcagttcccatggggccagccatcactgtatctgtccttgccaaccgcaaggattcaaacaagatggcttgcatcataaacaagtcaacgtttgattacatcgatagtaatgcagcgcgggctctggcttatgagtatcttaggttttcgcccagacaccctttcacatccgacatccgggcatggatgtcgttacttttcctgtgcaaaggggcgaacaccattgaggtgtttggtatcgagctagatttctgtgacgccgcgaagtcagagaaagaaatcttgtggctcctagacatgcttgattggaaatagaagctccttatcccctttggggtttgacacatgtaaagcctgttcatggttagtcgttcctttcctgttggaccatgtacgctactactccctccgtttctttttagttgtcgctggatagttcaattttgcactattcagcgacaactaaaatgaaacggagggagtactgaactacataatctcctgagaaaatgtaataaatgtcacctgctactccatgtgctaacaaggcgaggttattttgt

SEQ ID NO: 1427 - DNA, 1164 bp, Zea mays
ctccgcgctcgctctcctgctctcctgcgccaactgggcgaccgccgacgccaacgccgacgacctacgccaggtgctgggatttttgtcggttccttcggcagctttcgtcgcgtccttcgccggcgacgagcactcaccaggtccgctcctgaagaagactgggatattttgcatacacagaggatcatctgtgtagaggacattcagttttctccagttctccagttcctggatagcaatggcaaatgagtttcctgatgaagttcttaagtctgtttttccattgctggatggtaaagatctagtattctgcatgcttgtatgccgtcaatggcatgaaatcgcaaaggatgattacttctggaaatgcatttgctcacggaagtggccgtccatttgcaaacagcccccttctggcgcaaactacaaaaagctttacttaaccttctctaagccacgggagatgcagaacctccctgtgccaaggcttacattcgaggatattgttttctatattgatatgtggctcgaaggatcgctcatcttttctcaagcagtttcaggccgcactctccgagcaggcctacagggcgctccccctcctggcattccagatatacttgcagcacatttgagttcccaagactgcatcttgatgctggaagtggagcccaagttggcagttcccatggggccagccatcactgtatctgtccttgccaaccgcaaggattcgaacaagatggcttgcatcataaacaagtcaacgttcgattacatcgacagtaatgcagcgcgggctctggcttatgagtatctcaggttttcgcccagacaccctttcacatccgacatccgggcatggatgtcgttacttttcctgtgcaaaggggcgaacaccattgaggtgtttggtatcgagctagatttctgtgacgccgcgaagtcagagaaagaaatcttgtggctcctagacatgcttgattggaaatagaagttccttatcccctttggggtttgacacatgtaaagcctgttcatggttagtcgttcctttcctgttggaccatgtacgctactgctgaatttggttcagcttttttctaaccagcttttctgaaaaaaaaaaaaaaaaaaaaaaaaagaaaaaaaaaaaaaaaa

SEQ ID NO: 1428 - DNA, 1415 bp, Zea mays
gcgtgtaaggtgtaactatcgcctactgcagctcaggttgtttctgatagtcttctcttctgccgtccatccggcctgcgcgctcgctctcctgctcttctgcgccaactgggcgaccgccgacgccaacgccgacgacctacgccaggtgctgggatttttgtcggttccttcggcagctttcgtcgcgtccttcgccggcgacgagcactcaccaggtccgctcctgaagaagactgggatattttgcatacacagaggatcatctttccgtttgatgaactcacgggaatggtgatgctcattttctaaaggaccggtcccctttttgtttaatttccaaaggtgtagaggacattcagttttctccagttctccagttcctggatagcaatggcaaatgagtttcctgatgaagttcttaagtctgttttcccattgctggatggtaaagatctagtattctgcatgcttgtatgccgtcaatggcatgaaatcgcaagggatgattacttctggaaatgcatttgctcacggaagtggccgtccatttgcaaacagcccccttctggcgcaaactacaaaaagctttacttaaccttctctaagccacgggagatgcagaacctccctgtgccaaggcttacattcgaggatattgttttctacattgatatgtggctcgaaggatcgctcatcttttctcaagcagtttcaggccgcactctccgagcaggcctacagggcgctccccctcctggcattccagatatacttgcagcacatttgagttcccaagactgcatcttgatgctggaagtagagcccaagttggcagttcccatggggccagccatcactgtatctgtccttgccaaccgcaaggattcaaacaagatggcttgcatcataaacaagtcaacgtttgattacatcgatagtaatgcagcgcgggctctggcttatgagtatcttaggttttcgcccagacaccctttcacatccgacatccgggcatggatgtcgttacttttcctgtgcaaaggggcgaacaccattgaggtgtttggtatcgagctagatttctgtgacgccgcgaagtcagagaaagaaatcttgtgtctcctagacatgcttgattggaaatagaagctccttatcccctttggggtttgacacatgtaaagcctgttcatggttagtcgttcctttcctgttggaccatgtacgctactactccctccgtttctttttagttgtcgctggatagttcaattttgcactattcagcgacaactaaaatgaaacggagggagtactgaactacataatctcctgagaaaatgtaataaatgtcacctgctactccatgtgctaacaaggcgaggttattttgcaaaaaaaaaaaaaaaaaa

SEQ ID NO: 1429 - DNA, 1377 bp, Zea mays
attctaaactctactgccgtacagtctatgcaacgcctgaagagcacggcgctgcccggagaaggatgcgtgtaaggtgtaactatcgcctactgcagctcaggttgtttctgatagtcttctcttctgccgtccatccggcctgcgcgctcgctctcctgctcttctgcgccaactgggcgaccgccgacgccaacgccgacgacctacgccaggtgctgggatttttgtcggttccttctgcagctttcgtcgcgtccttcgccggcgacgagcactcaccaggtccgctcctgaagaagactgggatattttgcatacacagaggatcatctgtgtagaggacattcagttttctccagttctccagttcctggatagcaatggcaaatgagtttcctgatgaagttcttaagtctgttttcccattgctggatggtaaagatctagtattctgcatgcttgtatgccgtcaatggcatgaaatcgcaagggatgattacttctggaaatgcatttgctcacggaagtggccgtccatttgcaaacagcccccttctggcgcaaactacaaaaagctttacttaaccttctctaagccacgggagatgcagaacctccctgtgccaaggcttacattcgaggatattgttttctacattgatatgtggctcgaaggatcgctcatcttttctcaagcagtttcaggccgcactctccgagcaggcctacagggcgctccccctcctggcattccagatatacttgcagcacatttgagttcccaagactgcatcttgatgctggaagtagagcccaagttggcagttcccatggggccagccatcactgtatctgtccttgccaaccgcaaggattcaaacaagatggcttgcatcataaacaagtcaacgtttgattacatcgatagtaatgcagcgcgggctctggcttatgagtatcttaggttttcgcccagacaccctttcacatccgacatccgggcatggatgtcgttacttttcctgtgcaaaggggcgaacaccattgaggtgtttggtatcgagctagatttctgtgacgccgcgaagtcagagaaagaaatcttgtggctcctagacatgctccatcggcaatagcagctccttctcccctttggggtttgacacatgtaaagcctcttcatgcttagtcgtccctttcccgttggaccatgtacgccactactccctccgtttctttttagttgtcgctggatagttcaattttgcactattcagcgacaactaaaatgaaacggagggagtactgaactacataatctcctgagaaaatgtaataaatgtcacctgctactccaaaaaaaaaaaaaaaaaa

SEQ ID NO: 1430 - DNA, 1481 bp, Zea mays
attctaaactctactgccgtacagtctatgcaacgcctgaagagcacggcgctgcccggagaaggatgcgtgtaaggtgtaactatcgcctactgcagctcaggttgtttctgatagtcttctcttctgccgtccatccggcctgcgcgctcgctctcctgctcttctgcgccaactgggcgaccgccgacgccaacgccgacgacctacgccaggtgctgggatttttgtcggttccttcggcagctttcgtcgcgtccttcgccggcgacgagcactcaccaggtccgctcctgaagaagactgggatattttgcatacacagaggatcatctttccgtttgatgaactcacgggaatggtgatgctcattttctaaaggaccggtcccctttttgtttaatttccaaaggtgtagaggacattcagttttctccagttctccagttcctggatagcaatggcaaatgagtttcctgatgaagtttcttaagtctgttttcccattgctggatggtaaagatctagtattctgcatgcttgtatgccgtcaatggcatgaaatcgcaagggatgattacttctggaaatgcatttgctcacggaagtggccgtccatttgcaaacagcccccttctggcgcaaactacaaaaagctttacttaaccttctctaagccacgggagatgcagaacctccctgtgccaaggcttacattcgaggatattgttttctacattgatatgtggctcgaaggatcgctcatcttttctcaagcagtttcaggccgcactctccgagcaggcctacagggcgctccccctcctggcattccagatatacttgcagcacatttgagttcccaagactgcatcttgatgctggaagtagagcccaagttggcagttcccatggggccagccatcactgtatctgtccttgccaaccgcaaggattcaaacaagatggcttgcatcataaacaagtcaacgtttgattacatcgatagtaatgcagcgcgggctctggcttatgagtatcttaggttttcgcccagacaccctttcacatccgacatccgggcatggatgtcgttacttttcctgtgcaaaggggcgaacaccattgaggtgtttggtatcgagctagatttctgtgacgccgcgaagtcagagaaagaaatcttgtggctcctagacatgcttgattggaaatagaagctccttatcccctttggggtttgacacatgtaaagcctgttcatggttagtcgttcctttcctgttggaccatgtacgctactactccctccgtttctttttagttgtcgctggatagttcaattttgcactattcagcgacaactaaaatgaaacggagggagtactgaactacataatctcctgagaaaatgtaataaatgtcacctgctactccatgtgctaacaaggcgaggttattttgtaaaaaaaaaaaaaaaa

SEQ ID NO: 1431 - DNA, 1235 bp, Sorghum bicolor
agtcctgatttacgccggccggaccaggatccgtgtagctaccgcctactgcagctttggccttcggaggaccatccggctctctctcgtgcggcaactcggcgaccgccgacgccgacgccgacgccctacgccgaggttcccggatttttgtcggtcccttcgccggccttcgtcgcgtccttgccggcgacgagcacccaccaccaccagtgtttgtacacccatgtgctttactaggtccgcccctggagaagactgggatattttgcatacacaaaggatcatctaatcttgcctcctggaggtgtagaggacattcagtttccttcagttcttggatagcaatggcaagtgaatttcctgatgaagttcttaagtctgttttcccattattggatgggaaagatctagtattctgcatgcttgtatgtcgtcaatggcgtgaagttgcaaaggatgattacttctggaaatgcatttgctcgcggaagtggccgtccatttgcaaactgcccccttctgacacaaactacaaaaagctttatttaaccttctccaagccacgggagatgcagaaccttcctgtaccaaggctcacatttgaggatattgttttctatattgatatgtggcttgaaggatcactcatcttttctgaagcagtttcaggctccaccctccgagcaggcctacactgcgctccccatggcattccagatatccttgcagcacatttgaattcccaagactgcatcctgatgcttgaagtggagcccaagttggaaattcccctggggccaaccatcactatatctgttcttgcccaccgcaaggattcaaacaagatggcttgcatcataaataagtcaacatttgattacattgacagtaatgcatcacgctcactggcttatgagtatctcaggttttcacccagacacccattcatatctgacattcgggcatggatgtcattgcttttcctgtacaaaggagcaaacatcattgaggtatttggtattgagctagatttctgtgacgcagcaaggtcagagaatgaaatcttgtggcttctagatatgcttgattggaaatagaagtttttccccacattgggagttgacacatgtaaagcatgttcatggttgtcttatcctttcctgttggagcatgtatgctactgaactatataatctcctggaaaaactggaataaatatcacttgctactcc

SEQ ID NO: 1432 - DNA, 1223 bp, Oryza sativa Japonica Group
gtcttctctccctctctcctcatcctcctccgtgttcctgatctgcgcacgcacggccgccctcctcctcctccccccgcgcttcgcttcctcgcgcgcgcgcgtcatcgaagctggcctagagactcctcggcgagaggacggttctcccccctctcccgccccccgcgcgcgcgcggcaggtttgggagatcgacggtggtcggtggcctcctccctcctgtcctgcccggttcgagtcgaattgaaaggcacagctggttctgtcatttggctgttcagaagcctggaggctgggccatttgatatcctgaagttttgagtaagaatggagaatgggctgtccgatgaagttcttaaagcagttttccctctactggatggtcaagacctagtcttttgcatgcttgtatgtcgtcaatggcgagaaattgcaaaggatgactacttctggaaatgcatatgtgcgaggaagtggccttccatttgcaagcaacctccttcagatgcaaactaccagaagctctatttaaccttctccaaaccacggacgccacagcaccttcctgtaccaaagctcacattcgaggatcttgtgttttacattgacatgtggcttgacggatcactcatcttctctcaagctgtttcaggctgcatccttcgaggaggtctgcagaatacaccttgtggcattccggatgtacttgtagcacatttgactgctcctgactgcattctgatgatggaggttgaacccaagctggaaataactatggggccatccatcactgtgtctgttcttgcccaccgaaaggatacaaagaagatggcttgcgtcattaataagtcaacttttgattacatcgacagcaacgcagcacgggcattggcatatgaatatctccagttttcaccaagatacccttttatatcagacatccgagcatggatgtctttgcttttcctgtacaaaggaacaaacgtcatcgaagtatttggtatagagctagacttttgtgatgcagcaaggtcggagactgaaattctttggctcttagacatgcttgattggaaatagaagctttaatcgttttttctgttgtgatttgacgcatgtaaagaatgttcatggttaattcttgttatccagttgaagcatgtgtactactgaaccatatgtactgttggaaatttggaataaaaatggttcacgccactcc

SEQ ID NO: 1433 - DNA, 1327 bp, Sorghum bicolor
aaaggctcggacggatggtggcagtggcacgccgcagctacctctcccctccccctcgccgccaaggccaacaacacaaccgggcaccacgcaagaaatggagctgagcctccccctcctcctcgccgcctcccaagctcctcctgctccgcgcgcgtagccgcgccgcacctcccagtcctaaaaacacgcccgcgagctccggtccccgcgcgaggtgctgtttgagccctgaagatggcggccatgactgcttacaagtatcaagctcaggcgatgatgagagactacttgctagctgatccgctcgttccctacacctctgtgctcattggcgttgtcctctgcaagatggcttatgatttcactcgaatactgagctccttttatttcaagggctatacttcattgacaaagatacagcgcatcgaatggaacaataggggtatgtccagcgcacatgcaatttttatcacggctgtatcattatatcttgtcatgtcgactgatcttttctccgaccgcatcaagggacctattacattccgtaattcaataatatccacttctgcattaggggtttctgttggctacttcatcactgatcttgcaatgatcttctggctgtatccttcccttggtggaatggaatatgtcctccaccatactctttccttggttgcgatagcttacacaatgttgtctggggaaggacagttttacacatacatggttctcatttcagagacaaccacccctgagatcaacatgagatggtttcttgatactgctggactgaagaaatcaaatgcttatttggttaatggaattctgatgtttgttgcatggctggtggcaaggatatttttgttcatgtatgtattttaccacatctatttgcactacagtcagataatgcagatgcatgcctttgggtactacctgacatttgttgtgccatcagtgctctttgtaatgaacacaatgtggttcatgaagatcttaaaaggtgtgatgaaaacactggcaaaatggccttgatggatgaagccaagaggatcccagaactatcaacaggatttggtctttctggcatcagtgcgtgaccttaatctgtaaagttatggatatcagggtaactagagaaagttaatatgtaaagtattagcaaacaagctagattaggtgaaattgccccgtttttagcaaagctggaagtttataaccagtttggtttgtaccggagatccagcatgctgttctgcttaccccatctgtgccatgtgtatatttgaagagcattttaatggatggtttgttaaacagt

SEQ ID NO: 1434 - DNA, 1330 bp, Zea mays
ggcagtggcacgccgcagctacctctcccctccccatcgccgccaacgccaaggccaacagcacaaccatcgcaccacccaagaaatggagctgagtgtgccccttctcctcctcgcggctccccaagctcctgctccgcgcgcgtagccgcgcggcacctcccagtcccaacacgcccgcaagctccgctcaccgcgaggtgctgtttgaaccgtgaagatggcggcgatgactgcttacaagtatcaagctcaggccttgatgagggactatctgctagctgatccactagttccgtacacctctgtgctcattggcattgtcctctgcaagatggcttacgatttcactcgaatattgagctccttttatttcaagggctacactttactgacaaaaatacagcgcatcgaatggaacaataggggtatgtccagcgctcatgcaatttttatcacggctgtatcattatatcttgtcatgtcaactgatcttttctccgaccgcgtcaagggacctattacattccgttattcgataatatccacctctgcgttgggggtttctgtcggctacttcatcactgatcttgcaatgatcttctggctgtatccttcccttggtggaatggaatatgtcctccaccatactgtttccctggttgcaatagcttacacaatgttgtctggggaagggcagttttacacatacatggttctcatttcagagacaaccacccctgaaatcaacttgcgatggtttcttgacactgctggactgaagaaatcaagtgcttacttggttaatggaattctgatgtttgttgcatggctggtggcaaggatatttttgttcatgtatgtattttaccacatctatttgcattacggtcagataatgcagatgcatgcctttgggtactacctgacatttgttgtgccatcagtgctctttgtaatgaacacaatgtggttcatgaagatcttaaaaggtgtgatgaaaacactggcaaaatggccatgacgtggatgacgccaagaggatctcagaactatcaacaggatttcgtctttctggcatcattacgtgaccttaatctgtgaagttatggatatcagggtaactagagaaacataatatgtaaagtattagcaaacaagctatattaggtgaaattgccctattttcagtcgagctggaagttcataaccggtttggtttgtaccggagatccagcacgctgttctgcttaccccacctgtgccatgtgtatatctgaagagaattttaatgggtggtttgttcaacagtacaatcccagtgctgtgt

SEQ ID NO: 1435 - DNA, 1376 bp, Zea mays
aaaaatttaaccgcagaggccaacagcacaacgagcgcaccactccccaagaaatggagctgacccaactcctcctcctcaccggcaccgcctcccgagctcctgctccgcgcgcgtagccgcgccgcagttcccagtaataacacgcccgcaagctccgcagtccgctccctgcgcgaggttacgtacattgcctttgcgtaccatgtggcgcttcggtttggtgttgctgtgcctgtgcatggagatctacttgtgtcaccgacaccgagccgacccgatgatgtcttgtgggtgttgtttgagccatgaagatggcgacgatgactgcttacaagtatcaagctcaggcgttgatgagggactacttgctagctgatctactcgttccgtacacctctgtgctctttggcattgtcctctgcaaggcttatgatttcactcgaatactgagctccttttatttcaaggggtatactttattgacaaaaatacagcgcatcgaatggaacaataggggtatgtccagcgcacatgcaatttttatcacggctgtatcattatatattgtcacgtcgactgatcttttctccgattgtgtcaaggggcctattacattccgtaattcgataatatccacttctgcattgggggtttctgttggctacttcatcactgatcttgaaatgatcttctggctgtatccttcccttggtggaatggaatatgtcctccaccatactctttctctggttgcaatagcttacacaatgttgtctggggaagggcagttttacacatacatggttctcatttcagagacaaccacccctgaaatcaacttgcgatggtttcttgacactgctggactgaagaaatcaagtgcttacttggttaatggaattctgatgtttgttgcatggctggtggcaaggatatttttgttcatgtatgtattttaccacatttatttgcattacagtcagataatgcagatgcatgcctttgggtactacctgacgtttgttgtgccatcggtgctctttgtaatgaacacaatgtggttcatgaagatcttaaaaggcgtgatgaaaacactggcaaaatggtcatgatggatgatgccaagaggatcccagaactatcaacaggatttggtctttctggcatcattgatctgtaaagttatggatatcagggtaactagagaaagttaatatgtaaagtattagcaaacaagctagattaggtgaaattgccctattttcagcagtgctggaagttcataaccagtttggtttgtaccggagatccagcacgctgttctgcttacccccaatgccatgtgtatatctggagcaaaaaaaaaaaaaaaa

SEQ ID NO: 1436 - DNA, 1426 bp, Oryza sativa Japonica Group
agcaaaaagcaagcaacctcaccgaggaggggaatggaatggagctgagccttctccccgccccacgcgtgtagccgccgccgccggcgagcaggtttggagtgggggcgacgcggccgtggagagcaggtctcgtgtccggatcgaatcgaagggcgtttctagtgtcaaaaagagaggagggatggcgatgacggggtacaagtaccaagctcaggagttgatgagagactacttgctggctgatccactggttccgtacacctcggtgctcgtaggcattgccctgtgcaagatggcatatgatctcacaagggtactgagctcattttacttcaagggatattcttcactgacaaagatacaacgtgttgaatggaacaacaggggtatgtccagtgcacatgcgatctttatcacagctatatcattatatcttgtcatgtctacagatcttttctctgatcgccttaaggggcctatcacattccgcaattcaatcatctccacttttgcattaggggtttctgtgggctacttcatcgctgaccttgcaatgatcttctggttgtatccttcccttggtggaatggaatacatcgtccatcatactctttctctagttgcaatagcttacacaatgttgtcaggggagggtcagttctacacatacatggttcttatttcagaaacaaccacccctgaaattaacttgagatggtttcttgacacagctggactgaaaaagtcaagtgcttacttggttaatggtattctgatgttcgttgcatggctggttgcaaggatacttctgttcatttacgtattctatcacatctatttgcactacagtcaggtaatgcagatgcatgcttttgggtactacttgacatttattgtgccatcggtgctctttgtcatgaacacaatgtggtttatgaagatcttgaaaggcgtgaagaaaacattggggaagtggtcatgatcgatccaggaatgcagatcctagaaccgccaacaagagttggtattccagcgatcatccgtatgatcttgatgtgtaaagttatggacatatatcaggttaactaggtaaagcgaatatgtaaagtgctagtagcaaaaacaagtttagattaggccaaattgccgctattttcagcaagctggaatttcctagcctgtttggcacggtactgaagttcccagcacgctgtttctcccctcccgcatcgtgtgtatatctgaagaaatttctgtggatcagttgcccaacagtacaacctcaaatgctatagtatttgtgacaattacagtatttacctgttctcgctcaactcctgtaggaaaagacatgtaaaaacggtagcatatctcgttgctgatgtttgaattcgccaaaacacgtcctatgaaaattaatcat

SEQ ID NO: 1437 - DNA, 1496 bp, Hordeum vulgare subsp. vulgare
gggtggtggactcagcttttccttcttcaagcaaccatttttttcccctccagccgctctgctcccccccttccctccgcttggtgaggtcgccgccagcccgggacagcgccaccccagctcaccaccacagcaatggagccggcccttctccccaccgtccccgcggcgaccaagtagcggccacccccccccctccaccccccgcgcggctcctcctcctccactgcaagaggcgttttgatccgcgaggacgatggcgatgacggcctacagctaccaagcgcaggccatgatgagggactacctgctagccgacccgctcgtcccctacacctccgtgctcatcggcgttttcctctgcaagatggcttatgatctcacacggatactgagctcattttacttcaagggctattcttctttgacaaaaatacaacgtgttgaatggaacaacaggggtatgtccagtgcacatgcgatcttcattgcagcagtatcagtatatcttgttgcgtctacagatcttttctctgatcgcctcaatgggcctattacgttccgcaattcgatcatctccacctctgcattaggggtttctgtgggttacttcatcactgatcttgcaatgatcttctggttgtatccttcccttggtggaatggaatatgtactccatcatactctttctctggttgcaatagcttacacaatgttgtcaggggaggggcagttttacacatacatgattcttatttcagaaacaaccacccctgaaatcaacatgagatggttccttgacaccgctggactgaagaagtcgagcgcctacctgatcaatggtattttgatatttgttgtatggctggtggcaaggatatttttgttcctgtatgtgttttaccacatctatctgcactacagccagataatgaagatgcatgcatttggctattacctgacactaaccgtgccgtcggtgctctttgtcatgaacgtgatgtggtttatgaagattttgaaaggggtgatgaaaacactgtcgaaatggtcgtaatcggatcaaggctttgcggaccagaagcacaaccaacgtaatttggtgttcctgccgagctgcgtgtgaccatataatatgtaaagttatggatatatgaattaggctttgcggaccagaagcacaacacctggtgttcctgcagtgctgcttgagacctttgatgtgcaaagctatgaacatatcgacgtaactagggaaagtgaatatgtaaaatactgtagcaaacaagttagattaggctaaatcgtgcaattttccggcgagctggaatttcctggccagctttcctgttccaagcaatcctgcaatgtgtatatcaggccaggagaaaattccatttcatctcttattcatgataaattcagtgatctaattcgagacattatattcgctgttgttattcctgggatatgcaaagatgggcagatttgtgtcc

SEQ ID NO: 1438 - DNA, 1279 bp, Zea mays
caacagcacaacgagcgcaccactccccaagaaatggagctgacccaactcctcctcctcaccggcaccgcctcccgagctcctgctccgcgcgcgtagccgcgccgcagttcccagtaataacacgcccgcaagctccgcagtccgctccctgcgcgagggtgttgtttgagccatgaagatggcgacgatgactgcttacaagtatcaagctcaggcgttgatgagggactacttgctagctgatctactcgttccgtacacctctgtgctctttggcattgtcctctgcaaggtggcttatgatttcactcgaatactgagctccttttatttcaaggggtatactttattgacaaaaatacagcgcatcgaatggaacaataggggtatgtccagcgcacatgcaatttttatcacggctgtatcattatatattgtcacgtcgactgatcttttctccgattgtgtcaaggggcctattacattccgtaattcgataatatccacttctgcattgggggtttctgttggctacttcatcactgatcttgaaatgatcttctggctgtatccttcccttggtggaatggaatatgtcctccaccatactctttctctggttgcaatagcttacacaatgttgtctggggaagggcagttttacacatacatggttctcatttcagagacaaccacccctgaaatcaacttgcgatggtttcttgacactgctggactgaagaaatcaagtgcttacttggttaatggaattctgatgtttgttgcatggctggtggcaaggatatttttgttcatgtatgtattttaccacatttatttgcattacagtcagatgcatgcctttgggtactacctgacgtttgttgtgccatcggtgctctttgtaatgaacacaatgtggttcatgaagatcttaaaaggcgtgatgaaaacactggcaaaatggtcatgatggatgatgccaagaggatcccagaactatcaacaggatttggtctttctggcatcattgatctgtaaagttatggatatcagggtaactagagaaagttaatatgtaaagtattagcaaacaagctagattaggtgaaattgccctattttcagcagtgctggaagttcataaccagtttggtttgtaccggagatccagcacgctgttctgcttacccccaatgccatgtgtatatctggagcattttgcttaccccaatgccatgtgtatatttggagcattttaatggatggtttgttc

SEQ ID NO: 1439 - DNA, 2143 bp, Sorghum bicolor
aacacaccttcggcgcgtttccccctcctcctcctcctcctcctccccctgtccccgacccgacccgaccccacccacacaccctctcatcctccgatcccatctcacaattcccattccccactcgccgtcgccgcgggtcgcgcactccagctccagcgcgccgcgcggtgctgctctccccgcccatgtgacgctcgcgagtcgcgctcccccccccccccccccagtcagcagtcccagaccccaatccgcggcgccgggcggggaacccggagcgggcaataaagacccgaggattccgttctccgtggcggggatggggcaggaggggatggggtacagcagcaagggcggaggaggaggaggaggagggggagcgggagggctgccgatgacggcgccgcggccgcggggcgcgtcgccgctccaccaccacagccggtcgcgcaagatccaccgcactttcaacaacctcaagattaccgtgctctgcggcctcgtcaccatcctcgtcctgcggggcaccatcggcctcaacctctccctcccctcgcagccctccgacgccgacgcgctcgccgacgccaaggccgtcgaggacatcgaccgcatcctccgcgagatccgctccgactccggccccgaccccgacgacgagggcgacttcagcgccgcctccgggttcaacgcctccgcgctcagcgccaccgaggccgacgcggcgtacgcggccgcggtcggcagatacgcgctgggccccaagatctccgactgggacgcgcagcggcgacgctggctagcacggaacccgggcttcccggccaccgttgccgggggcaagcctaggattatgctcgtcaccggctcgcagccggggccctgcgacaacccgctcggtgaccattacctgctcaagactaccaagaacaagatcgattactgccgcatccatggcatccagatcgtccacaacctcgcgcaccttgacaacgagctcgcgggatactgggccaaattgccgctgctgcgacgcctcatgctctcccacccggaggtcgagtggatctggtggatggacagcgacgcgctcttcaccgacatggcgttcgagctgccactgtcgcgctacgatggtcacaacctcatcatccacggctaccaggacctcctctttgagaagcactcttggattgctctcaacaccggcagtttcctcttcaggaattgccagtggtcgcttgacctactggacgcgtgggcgcccatgggccccaagggcttcatccgcgaccaggccggcaaggtactcacggcgaacctcaagggccggccagcattcgaggccgacgaccagtcggcactgatttacctcttgctctcgcaaaaggacaagtggatggacaaggtgttcatagagaattcctactacttgcatggcttctgggctgggctggtggacaagtatgaggagatgatggagaatcaccacccaggccttggtgacgagcggtggccttttgtgactcactttgttgggtgcaagccatgtgggagctatggggactacccagtggagcgctgcctcaggagcatggagcgagcgtttaattttgccgacaaccaggtgcttcggctatatggtttctcacacaaggggctggaaagccccaagatcaagagaaccagggatcagacaaccagaccgattaatgatgtggagaacttagatatgaaggccaaaatatccacagtttcctgaaagttcagatgagagttggtggtttggcagttggatacttgctttgactatcaacaaggtcagagcattttgtgatatgggggatatggttgttctagtttccactctcttgctctctctttcctttttgttcaccaatctttattgttatgtgacagctagagattgcaagctttgtttattatggagttaaacacgataggatctcaaatcagatggaaatagtctcgcttttgtactctgccatttcatttttgtgctaggttcttgtggaacatgcatcactgatatgtggagtttgtgcatgatattagactagttgttctctatttagttgttacctttcttatcttccatggttgaattatgaagcctattgct

SEQ ID NO: 1440 - DNA, 2130 bp, Zea mays
tcaacagccgacagcccattgtccagactcataagagagacgaagcccataaagaaaagggattcaccggctcaccgctcacataaacacacaccccgcttcctctttcccctattcccgacaccactcacacggtcacaccctcgcatcctgcgatcccatatcaattcccgtccccactcgccgtcgacgcaggtcgcactccagctccagcgcgccgcgcggtgctgctctccccgcccatgtgacgcgagtcgcgccccgccccccacagtcagcagtccgagaccccaatccgcggcgccgggcggggggaaccaggagtgggcaataaaaaaccgaggattccgtcctctgtggcggggatgggccaggaggggatggggtacaacagcaaggggggaggaggaggcggcggcggcgggggagggctgccgatgacggcgccgcggccgcggggcgcgtcgccgctccaccacagccggtcgcgcaagatccaccgcactttcaacaacctcaagattaccgtgctctgcggcctcgtcaccatcctcgtcctccggggcaccatcggcctcaacctctccctcccctcgcagccctccgacgccgaagcgctcgcggacgccaaggccgtcgaggacatcgaccgcatcctccgcgagatccgctccgactccggccccgaccccgacgacgagggcgacttcggcgccgcctctggcttcaacgccaccgcgctcagcgccaccgaggccgccgccgcgtacgcggccgcggtcggcaaatacgcgctcgggcccaagatctccgactgggacgcgcagcgccgacggtggctggcccagaaccctggcttcccggccacccttgccgggggcaagcccaggattatgctcgtcaccggctcgcagccggggccctgcgacaacccgctcggcgaccactacctgctcaagactaccaagaacaagatcgattactgccgcctccatggcatcgagatcgtccacaacctcgcgcaccttgacaacgagctcgccggatactgggccaaattgccgctgctccgccgcctcatgctctcccacccggaggtcgagtggatctggtggatcgacagcgacgcgctcttcaccgacatgtcgttcgagctgcccctgtcacgctacgacggccacaacctcatcatccacggctaccaggacctcctcttcgagaagcactcctggattgcactcaacaccggcagcttcctcttcaggaattgccagtggtcgcttgacctcctggacgcgtgggcgcccatgggccccaaggggttcatccgcgatcaggcgggcaaggtactcacggcaaacctcaagggccggccagcatttgaggccgacgaccagtcggcactgatttacctcttgctctcgcaaaaggacaagtggatggacaaggtgttcattgagaattcctactacttgcatggcttctgggctgggttggtggataagtatgaggagatgatggagaatcaccacccaggcctcggcgacgagcgctggcctttcgtgactcactttgttgggtgcaagccatgtgggagctatggggattacccagtggagcgctgcctcaggagcatggagcgagcgtttaattttgccgataaccaggtgcttcggctatatggtttctcacacaaggggctggaaagccccaagatcaagagattcagggatcagacaactagaccaattaatgatgtggagaacttagatatgaaggccaaaatatctacaatttcctgaaagttcagatgagagttggtggtttggcaattgcatacttgctttggctatcaacaaggtcagagcattttgtgatatgggggacatggttgttctagtttccactctcttgctctctctctttttctttttcgttcaccaatctttattgttatgtgacagctagagattgcaagctttgtttattatcgtggttgaacatgatagaagctcaaatctgatggaaatagtctcgcttttgtactctatgccatttcttttttttgttctaggttcttgtggaacatgcattactgatatgtggagtttgtgcatatgttagtagact

SEQ ID NO: 1441 - DNA, 1893 bp, Hordeum vulgare subsp. vulgare
ggttcgtccacctcttccaaatcaccccgccccacttttccccactcgacccagcgtccggatcccatctcaccgagcggcgctcatgtgacactccggcttgcgctcttgctcacgctcacgctctgcaaaccaccccaccccccgacgcggcaattccaactggagcttgggcgcatctaattagtccaccgggttggaatcgggggcgatggggcaggaggggatggggtacaacagcggcaaggccggcggcggcggtggaggggccctaccgatgacggcggcgcgggcgcgtggggcgtcgccgcttaacacccaccatcggtcgcgcaagatcagccgcaccttcaacaacgtcaagatcaccgtgctctgcggcctcgtcaccatcctggtcctccggggtacaattgggctcaacctctccctcccgtcccaaccctccgaggccgatgccctcgcaggcgccaaggccgttgaggacatcgaccgcatcctccgcgagatccgctccgactccgacccctccgaccccaccgacagcgaactcgactcttccagcgtcctttcgaacgctaccgcactcaacacctcagaagccgccgtcgcctatgccgccgccgtgggcaactacgcgctcggtcccaacgtctctggctgggacgagcagcgccgacggtggctcacgcagaaccagggcttcccagccaccgtcccgggcggcaagcccaggatcctgcttgtcacggggtcacaaccaggcccctgcgacaacccgcttggcgaccactacctgctcaagagcaccaaaaacaagatcgactactgccgcttccacgacatcgagatcgttcacaaccttgcgcacctcgacaaggagctcgctggttactgggccaagctgccgctgctccgccgacttatgctctcccacccggaggtcgagtggatctggtggatggacagcgacgccctattcaccgacatggcctttgagctgcccctctcgcgctatgacaaccataacctcatcatccacgggtatcaggatctcctcgttgagaagcactcttggatcgcgctcaacaccggcagcttcctcttccggaactgccagtggtcgctcgatcttctcgatgcatgggctcctatggggccgaagggcttcatccgcgaggaagccgggaagatactcaccgcatacctcaagggtcgcccagcattcgaggctgacgaccagtctgcgctgatatacctcttgctctcgcagaaggagaagtggatggacaaggtgtatatagagaattcatactacttgcatggtttctgggctggattggtggacaagtacgaggagatgatggagaaccaccatccagggcttggggatgagcggtggccatttgtgacacactttgtcgggtgcaagccatgcggaagctatggtgattatccagttgaccggtgtctcaagagtatggagagagcatttaattttgccgataaccaggtgctacgcctgtatggtttcgcacacaaggggctggaaagccccaagatcaagaggatcaggagtcagaccacaaagccaattaatgacaaggagaaccttgatgtgaaggccaagatgccgaccacttcttgaagctactgaagataaggcaatagcattggtctcttcaaggtcagcttttgtcacttggttgctgttctagtttctactatttttttttgcctttttgcttgtggatttttttcttgttatgtgtaacagttagagattgcacacggtatgtttatcgtgaactcaaacgtggtaggagctcaaatcagacggaaatatctcagttttgtactcaatttcatttcagtgctactttcttgcgggac

SEQ ID NO: 1442 - DNA, 1907 bp, Oryza sativa Japonica Group
gccccagaagccaacaataacgggagaaaagaaaaaaaattgagccgcggaaggccggaaggggactccccgtcgcctcctctcctccaaatcccaacccacctcaccgatcccatctcaattctcaccgcctcaccgcgcccgcgccagcgcctcgcccatgtgatgtgagtgagccactcacactccccctctctatcgccgcgcccccgattcgcgagccgccccgatccctcccgcgcggctgataaatccgaggcggctagggttgggggtggaatggggcaggaagggatggggtacaacaacggcaaggggggaggaggcggtggcggcgggctgccgatgacggcgccgcggccgcgtggggcgtcgccgctgagcagccacggccaccaccaccgctcgcgcaagatccaccgcaccttcaacaacgtcaagatcaccgtgctctgcggcctcgtcaccatcctcgtcctccgcggcaccatcggcctcaacctctccctccccaaccagcccaccgacgccgacgcgctcgccggcgccaaggccgtcgaggacatcgaccgcatcctccgcgagatccgctccgacggcggcgccgacgacgacgccgccgccgccggggacctcgccggctccttcaacgccaccgcgctcaacgccacggaggcggcggcggcctacgcctccgctgtcgaacgctacgcgctcggccccaagatctccgactgggacggtcagcgccgccgctggctcaggcagaaccctgggttcccgtccaccgtcgccggcggcaagcccaggatcctgctcgtcacgggctcgcagccggggccctgcgacaacccgctcggcgaccactacctgctcaagaccaccaagaacaagatcgactactgccgcctccacggcatcgagatcgtccacaacctcgcccacctcgacaccgagctcgccgggtactgggccaagctgcctctgctccgccgcctcatgctctcccacccggaggtcgagtggatctggtggatggacagcgacgcgctcttcaccgacatggctttcgagctgcccctctcgcgctaccaagaccgcaacctcatcatccatggataccaggatctcctctttgagaagcactcatggatcgcgctcaacaccggcagcttcctcttccggaattgccagtggtcgcttgatcttcttgatgcgtgggcgcctatgggtcccaagggattcatccgagatgaagccgggaagatacttactgccaacctcaagggacgcccggcatttgaggctgatgatcagtctgctttgatttacctcttgctctcgcaaaaggagaagtggatgaacaaggtgttcatagagaattcgtactacttacatggcttctgggctggtctagtagataagtacgaggagatgatggagaaccaccatccggggctcggggatgagcggtggccattcgtgactcattttgtcgggtgcaagccatgtggaagctatggggattatcctgtggagcggtgtctcaggagtatggagcgagcatttaattttgccgataaccaggtgctgcggctctatgggtttgctcacaaggggctcgaaagccccaagatcaagagggtcaggaatcagaccacaaagcctattgatgacaaggagaatcttgatgtgaaggccaagatatcgaccacttcttgaaaagtcctgatgagagttggtatggcaatagcatacttgctttggctctcttcaaggtcagagcattttgtgacttggggatggtgttgttttattttccactctttttttctattctttttgttcatggaattgttattgttatgtaacagttagaggttgcaatctaatgtttatcatggagt

SEQ ID NO: 1443 - DNA, 1304 bp, Zea mays
cacacagtcagtcgatcgtcctctccaacataccctctgcttcctgccttcctccacgagctgccttggaagcctcgaccatgcaggaagctctcgtatctccggccaatgccggccgccttcgctttcgctcggccttggagctcaagccgttcgccttcggggaccagcgcctcgcctcgccgcgctacctcaacctcaacctcaacctcggcggcgccgatgacgcgctgttccgctgctcgtcgccgacgttcagccccagcttcggcttctcctcctcgccgtcgccgctcgccacgtcctccgtctcgctctcgccgacctcctccgcctccctcgccgacgacggctgcgacggcgccggcaccgacgccgacgccgacgccgccacgggccacacgctccggctcgcccgcctcgcgctgcagtaccaggaggtggccgaccgctacgagctctgcctcgcccgcctcgccgacgccgcggacgacgcggcggcgctccgccgcgagaacgccgagctccgcaacgccaacgccgacctcacgcgccgcctcgcgctcctcagcggcattggaaagcaggtcgccgccgccgccgccgccgccgaggaggcccgccggctccgcttcggggagcccaaggccgtcccggccgccaaggattgcgctaccgagaagcccgccgtgctgccgcccaagagcatttccgtccgctccattgacttcctcctcaagatgaaccagcccaaacaggtacagccccccgccaccacgccggccgcaagcaaccgcaagcatcgcgcgtccaacccgaccaaaccaagctcgcgcgtgtacaagggcaatggcggtgaaaaaaaagacgaggaattacccaaggagcaacacgcggcgggcggcgtggagctggaggtgttcaaccagggcatgttgaagacggagctgtgcaacaagtgggaggagaccggggcgtgcccctacggcgaccagtgccagttcgctcacggcgtcgccgagctccgccccgtcatccgccacccacgctacaagacccaggtctgccgcatggtgctcgccggcgaggtctgcccctacggccaccgctgccacttccgccacacgctcacccccgccgaacgcctccacctagcctgcccttagcaatggcaggcacgcggcagagcgcagccaaggccagcctttcgccgcgctggaaccgttggtttttgtttcgtctaaagtcagcaagtgcagtatgtaaatcacacgaaaaatgtataaaaatacgaacagcaatgt

SEQ ID NO: 1444 - DNA, 1504 bp, Zea mays
cctcgatcgtcgtctccaacgtaccctctgcttccgtctcttcgtccacgagaggccgagtagccgagtactcctcgtctctgccttggaagcctccctcgaccatgcaggaagctctcgtatctccggccaatgccggccgccttcgctcggccttggagctcaagccgttcgccttcggggaccagcgcctcgcctcgccgcgctacctcaacctcgcctccgtcgccggcggcggcggcggcgacgacgcgctgttccgctgctcctcgccgttcagccccagcttcggcttctcctcgccgtcgccgctcgccacctcctccaccatctcgctctcaccgtcctcctcctcctccctcgtcggcgactgcgactgcgacgacgacgccgacgccgacgccgccacgggccacaggctccagctcgcccgcctcgcgctgcagtaccaggaggtggccgaccgctacgagctctgcctcgcccgcctcgccgacgccgcggacgaggcggcggcgctccgccgcgagaacgccgagctccgcgtcgccaacggcgacctcacgcgccgcctcgcgctcctcagcggcattggcaagcaggccgccgccgccgcgatcgccgacgaggtccgccggctgcgcttcggggagcagaaggccgccaaggagcgcgctcccgggaagcctgccgtgctgcccaagagcatttccgtccgctccaacgactacctcaagatgaaccagccgcaacaggtacaggcccccgccacgccggccgaagacaaccgcaagcctcgcgcgtcgaacccgaccaccaaccgaagctcgcgcgtgtacaagggcaatggcggcgacaagagaagcgaggaacccaaggagcatcgcacggcgggcggcgtggagctggaggtgtacaaccagggcatgttaaagacggagctgtgcaacaagtgggaggagacgggggcgtgcccctacggcgaccagtgccagttcgctcacggcgtcgccgagctccgccctgtcatccgccatccgcgctacaagacccaggtctgccgcatggtcctcgccggcgaggtctgcccctacggccaccgctgccacttccgccatacgctcacccccgccgaacgcctccacctgccccgcccttaacaaagcccggcacgcggcagggcacggcgaagggcagtcttccgcagcgctggaaccgttggtttctgtttcatctgaagtcaagtcaagtatgtgtttcacacgaaaatgtatagaaatacgaacaacgtaagcaaggtacatgtatatgagtaacatacataagagcataaagtaaacctgatggtacaattagttttcaggcaatgtgaatattcacacacaatatagcttcaccgtcgatcagctgtgggttctcaggtgcttaaattgtgtcttctgttctgtctatgtaacccttttttttaaacgacatgtaatctatttttggggtgtatttgttt

SEQ ID NO: 1445 - DNA, 1583 bp, Sorghum bicolor
cgatcttaccatggcttccctcgccatcgtcctgctcctcgcgcgcatctccagctccattgccatcccatccaactacatctcaaggagcgccgagcagcaggtcatcgccaccgtcgcgccggccatagttcctgacatcgacggccagagcgcccagccgttcctcacgtcaccctccggatcgtacgccgcatacctccgccgcgccgtggatggcgccgccgtcggccacggaggggacgcgtgctatgtccaaatccagcaagctggcgccagcggcagcgtgtgggagtcggactgcaccccggtgggcggcgctgacgcgtgcgacctggcattctcgccggtggggctcgagctcttcgccggagggcactcattgtgggacaccggagtcgacgccgatccgggaacgctgagcctcgacgacggtggagacatgaagattgttagcaaggaaggtgtgacggtgtggacggcgagcggcgagccatggacggggcagcagtgcggggcacccttgccaccggtgtcaaccgcgccttcggtggaggcgctccctccgccgtcgactgccagtgccagcacaaaactcgtgacgccgccagcagcgactcttgctggtgcggggagcacggactttcctgtcggagaccaaccaccgccgccgccactcgacacgttgccggacttgccggtccagccgccagttgacacggcacccgaacaaccactgccaccgccgcccgcgtctcccgacttgccggacctgtcgatgccaccgccgccagcttacacgactcccgactcgccggaccagccgctgatggcgcccccgccagctgacatgttgccggaccagccgctgtactcgtcgccacctccagctccagccacctttggccctcaaacgccattattgccacctttcggcgtgccactcgccgccccgccgaccggcgacacaatcccaggcacgacgaccacgccatcgggcgagccaggatcaccaggcagcgtgcccttctcgggaccatctccagtcggcgtgccacacccgcacgggcatccacaccagctgccccttggagcctcgccgccgctgccggacgcgctggcgccgggcggcgtccacggcgcgggagcgggagccgggcagcccggtgccccctttggccatgggcagcagcaggcggggcagggcgtgttcggccagcagccacagctgctcaacggcgaggggcagccgttggaggacagcgccggtgggtggtcaagaacaagaagtgagagcggcagagtggcggcgtgcatggccttgttcgctctggtgacactgggctttggcttttagtttcttccccttttgtgttttggttttaatttgggattggattggtctttatgtactgttgttctccgttggtctggtctgggtggtttttttttgtggattgtagtaaattgtgtgtaaaacatgttatatggtccgctggctgattcattctgtagggtagcatgatctatagtatgtacgatgtttcatctgtgtattattatcgtgtataaatgtcaaattt

SEQ ID NO: 1446 - DNA, 1646 bp, Zea mays
acccctaccattgcctagctcaccagatcgatcttaccatggctttcctcaccatcctcctcctcgcgcgcatttccagctccattgccatctcgtccaactacatctcaaggagcgccgagcagcaggtcatcgccaccgtcgcgccggccattgttcctgacatcgacggccagggcgcgcagccgttcctcacctcgccctccggatcgtacgccgcgtacctccgccgcgccgtggacggcgccggcggcctcggcggggacgcgtgctatgtccaagtccagcaagatggcgccagcggcagcgtatgggagtcggactgcaccccggtgggtggcgctgacgcgtgcgacctggcgttctcgccggtgggcctcgagctcttcgccggagggcagtcgctgtgggacaccggggtcgacgccgatccgggaacgctgagccttgacgacggcggcgacatgaagattgttagcaaggaaggtgtgacggtgtggacggcaagcagcgagccatggacggggcagcagtgcggggctcccttgccggtgtcaacgaccgcgccttcaatggaggcgctcccaccgccgccgtcgactgccactgccactgccagcacaaaactcgtgacgccaccagcagcgactcttgctggtgcgggaagcgcggtctctccttacggagaccaaccagtagtgccgccacctgtcgacacgttgccggactttccgggccagccgccagttgacacggcacccgaacagccactgccaccgccgccagcagacgcgtctcccgccttgccggacctgtcgctgccaccgccgccagcttacacgcctcccgactcgccggaccagccgctgctggcacccccgccagctgacatgttgccagacgagccgctgtactcatcgccgcctccagctccagccacctttggccctcaaacgccattgccgccattcggcgtgccactcgccgccccgccgaccggcgacacagtcccggacacggccacgccatctggcgagccaggatcgcctggccgcgtgcccttctcggggccatctcctgccggcatgccgcgccagcacgggcatccacaccagcagccccttgtaggatcgccgccgctgccggacgcgctggcgccgggcgtccacggtgcgggagccgggcagcccggtacccccttcggccatgggcagcagcaggcggggcagggcgtgttcggccagcagccgcagctgctcaacggcgaggggcagccgttggaggacagcgccgccggtgggtggtcaagaacaagaagcgagagcggcagggtggccgcgtgcgtggccttgttcggtctcatgacgttgggctttgccttttagtttgtttcccttttgtgttgtgttttggtttttgggattgcatggtcatttctgtagtactgtttattctccgttggtctgataggaggggtctttttgtggattgtagtaaaaaaatttgtgtgtaaaacctgtcatacggtgcgctgtctgattcattctgtaggatagcatgatctaccgtatgtacatctgtgtattatcgtgtgtaaatgtcaaatttatgctcgatttgtggtcgtaccaaaaaaaaaaaaaaaa

SEQ ID NO: 1447 - DNA, 2366 bp, Sorghum bicolor
ccgcacgtccgcaaaccccttcacaacacgcagctgcgacccaacccgacccctcccgaggccgccagccttatcctctcctccgcctccgcgatcccctccgtctccaatccatccgcaagcgcagcaaggtagacatggcttcgacattcggtgccacttctacagttggccttatggctgctccagcagggaagaatgtgcgccttcagaggagggctaacttcagagtaaaagcagccaaggagctgtacttcaacaaggatggctcagctatcaagaagctccagactggagtcaataagcttgcagacctagttggagttacacttggaccaaagggaaggaatgtcgttttggagagcaagtatggctctcctaagattgttaacgatggtgttacagttgcaagagaggttgagctggaggaccctgtggaaaacattggagctaaattggtcaggcaagctgcagctaagaccaatgatctagctggagatgggacaaccacctccgtggtccttgctcagggactgattgctgagggtgttaaggttgtggcagctggtgctaatcctgttcagattactcgtggtattgagaaaacagcgaaagcactagttgaagaactacgtaagttgtccaaggatgttgaagatagcgagcttgcagatgttgctgcagttagtgctggcaacaactatgaaatcggtaacatgatagcagaggccatgagcaaggttggtcggaagggtgtggttacccttgaagagggaaggagttctgagaactttctctatgttgtggagggaatgcagtttgaccgtggttatatctctccctactttgtaacagacagtgagaaaatgtctgccgagtacgagaactgcaagcttcttttggttgacaagaagatcaccaatgcaagggatcttatcaacgttttggaagaagccatcagaggtgcatacccaatcctgataattgctgaggatattgagcaggaggctcttgctactcttgttgtcaacaagcttagaggatcattgaagattgctgccatcaaagcccctggttttggagagcgcaagactcagtacttggatgatattgccatccttactggagcaactgtaatcagagatgaagttgggctgtcacttgacaaggctgacaaatcagtccttggaacagctgcaaaggttgttcttaccaaagagtcaacaacaattgttggtgacggcagcacccaggaagaagttactaaaagggttgcgcagattaaaaatctgattgaggcagcagaacaagaatatgaaaaggaaaagctcaatgagaggatagctaagcttgctggtggtgttgctgtcattcaggtgggagcacaaacagaaactgaactaaaagagaagaagttgagagttgaggatgccctaaatgcaactaaggctgctgttgaggaaggtattgttgttggtggagggtgcactcttttgcggcttgcagctaaagtcgatgccatcaaagatacactggagaatgatgagcagaaggttggagctgaaatagtaagaagggccctgagctacccacttaaattgattgctaaaaacgctggtgtcaatggcagcgttgtcactgagaaggtcctttctaacgataacttcaagtatggttacaatgctgctactggacagcacgaggacttgatggctgctggtatcattgaccccaccaaggtggtgagatgctgcttggagcatgccgcatcggtggccaagaccttcctgacatcagatgttgtggtcgtcgatatcaaggagccggaggccgcgcccctcgctaacccgatggacaactctggctatggatactgatgaagtgatgagatgatatggccaagccgcagttgccccatgggacgaaggtgatcaccatattattttttggtaggcgagacgtcgggtccaggtagtttcagataaaaatgtgagtttgttgtacggccaaaaggtgaaaataaggggaggatctgtagccccaaatctgtgatgtaaactgcatcaggacagcagctaaatcaagcagaaattgctgagagattttgtaactgattgcagctatgttgaatgaatgcagtttgcacacgactaaaacacaaatttaaaatgtgcctggcaatacaagtgtttgtgctgcattgaaagttttgaaactgattttgaaactgctatgctggagttgtctcggggagcattacatattttccaagcttttttgatttgatgaacagctccgatctgttatgttcataaaagacagtattagtattgggaaaagtcagtagaagtatatattttgtgacc

SEQ ID NO: 1448 - DNA, 2732 bp, Zea mays
gatcgacacacgcagccgcgacctgacccgaccctcccgaggccgccagccttatcctctccgcctcccgccgtcccccgcgacccatccgcaagcgcgaggtgagtccgcagcccgtgctcccgcgctccttcctcgcctccccctctaattagaggctcctccgcgctctcggcaggggtttagctgccgtggtctgaggattgggtgagtgtggaactggatgccagcgccgcacagctccagttcggtggccggtgggtgtgggtcttgggtttcggggcgaggtggtttgggttcgtccgtgtagatagcgtatagagagtggtggcgagtgggtttggtcatctgctgcgttagtgagtgtccttttcctctccatttgcaccagagctagcgtatgtccgaccgtagcaggtgttcaattgttcggtaaaaaaaatgtgctttccatttgcatcagagatagcgttactcccttttgcttgagagatggttaggaggctggctatggattatgtgtctgcttcgatcgttttctcatgctaatgtgactcctgccgcacatgcagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggaggaccctgtggaaaacattggagctaaattggtcaggcaagctgcagctaagaccaacgatcttgctggagatgggacaaccacctctgtggtccttgctcaggggctgattgctgagggtgttaaggtcgtggcagctggtgctaatcctgttcagattactcgtggtattgagaaaacagctaaagcactagttgaagaactaaggaagttgtctaaggaggttgaagatagtgagcttgcagatgttgctgcagttagtgctggcaacaactatgaaattggtaacatgatagcagaggccatgagcaaggtcggtcggaagggcgttgtcacccttgaagaggggaagagttctgagaactttctctatgttgtggagggaatgcaatttgaccgtggttacatctctccgtactttgtaacagacagtgagaaaatgactgcagagtacgagaactgcaagctgcttttggttgataagaaaatcaccaacgcaagggatcttatcaacgttttggaagaagccatcagaggtgcatacccaatcctgataattgcagaggatattgagcaggaggctcttgctacccttgtcgtcaacaagctcagaggatcactgaagatcgctgccatcaaagcccctggttttggagagcgcaagactcagtacttggatgatattgccatccttactggagcaactgtaatcagagatgaagttgggctgtcacttgacaaggccgacaaatcagttcttggaacagctgcaaaggttgtccttacgaaagagtcgacaacaattgttggtgatggcagcacccaggaagaagttactaagagggttgcacagattaaaaatctcattgaggcagcagaacaagaatatgaaaaggaaaagctcaatgagaggatagcgaagcttgctggcggtgttgctgtcattcaggtgggagcacaaacagaaactgaactaaaagagaagaagttgagagttgaggatgccctaaatgcaactaaggctgccgttgaggaaggtattgttgttggtggagggtgcactcttttgcggcttgcagctaaagtcgacgccatcaaggatacactggagaacgacgagcagaaggttggagctgaaatagtaaggagggccctgagctacccacttaaattgattgctaaaaacgccggtgtcaatggcagtgttgtcactgagaaggtcctttctaatgataacttcaagtatggttacaatgctgctactggacagtacgaggacctgatggctgctggtatcattgaccccaccaaggtggtgagatgctgcttggagcacgccgcgtcggtggccaagaccttcctgacatcagatgttgtggtcgtcgatatcaaggagccggaggctgcacctgtcgcaaacccgatggacaactctggctatggatactgatgagatgctatggccatgccccatgggacgaaggtgatcaccatattaattttttggtaggcgaggagtcgggtcgaggtagctttttagacgaccgaaaggcgaaaataagttgaggatctgcatcccaaatttgtgatgtaaactgagacagaacagcagccaaatgaagcagagatttgctgaaagattctgtaactggttgcagctaatgttgaatgcagtttgcacacgaccaattcaaatggctccggcaacgtcagattatgctgcgtcgaaactgatttgaaactgatacaccggagcggtctcctctctgggagcgatccatatttttgtgtactttctgatttgatgaacgactccatctgtttgtttctagaagataatgtatttgagggcgtctgttttt

SEQ ID NO: 1449 - DNA, 2032 bp, Zea mays
cgcagccgcgacctgacccgaccctcccgaggccgccagccttatcctctccgcctcccgccgtcccccgcgacccatccgcaagcgcgagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggaggaccctgtggaaaacattggagctaaattggtcaggcaagctgcagctaagaccaacgatcttgctggagatgggacaaccacctctgtggtccttgctcaggggctgattgctgagggtgttaaggtcgtggcagctggtgctaatcctgttcagattactcgtggtattgagaaaacagctaaagcactagttgaagaactaaggaagttgtctaaggaggttgaagatagtgagcttgcagatgttgctgcagttagtgctggcaacaactatgaaattggtaacatgatagcagaggccatgagcaaggtcggtcggaagggcgttgtcacccttgaagaggggaagagttctgagaactttctctatgttgtggagggaatgcaatttgaccgtggttacatctctccgtactttgtaacagacagtgagaaaatgactgcagagtacgagaactgcaagctgcttttggttgataagaaaatcaccaacgcaagggatcttatcaacgttttggaagaagccatcagaggtgcatacccaatcctgataattgcagaggatattgagcaggaggctcttgctacccttgtcgtcaacaagctcagaggatcactgaagatcgctgccatcaaagcccctggttttggagagcgcaagactcagtacttggatgatattgccatccttactggagcaactgtaatcagagatgaagttgggctgtcacttgacaaggccgacaaatcagttcttggaacagctgcaaaggttgtccttacgaaagagtcgacaacaattgttggtgatggcagcacccaggaagaagttactaagagggttgcacagattaaaaatctcattgaggcagcagaacaagaatatgaaaaggaaaagctcaatgagaggatagcgaagcttgctggcggtgttgctgtcattcaggtgggagcacaaacagaaactgaactaaaagagaagaagttgagagttgaggatgccctaaatgcaactaaggctgccgttgaggaaggtattgttgttggtggagggtgcactcttttgcggcttgcagctaaagtcgacgccatcaaggatacactggagaacgacgagcagaaggttggagctgaaatagtaaggagggccctgagctacccacttaaattgattgctaaaaacgccggtgtcaatggcagtgttgtcactgagaaggtcctttctaatgataacttcaagtatggttacaatgctgctactggacagtacgaggacctgatggctgctggtatcattgaccccaccaaggtggtgagatgctgcttggagcacgccgcgtcggtggccaagaccttcctgacatcagatgttgtggtcgtcgatatcaaggagccggaggctgcacctgtcgcaaacccgatggacaactctggctatggatactgatgagatgctatggccatgccccatgggacgaaggtgatcaccatattaattttttggtaggcgaggagtcgggtcgaggtagctttttagacgaccgaaaggcgaaaataagttgaggatctgcatcccaaatttgtgatgtaaactgagacagaacagcagccaaatgaagcagagatttgctgaaagattctgt

SEQ ID NO: 1450 - DNA, 2130 bp, Oryza sativa Japonica Group
cccaaacccctcctcacccgcagcgccccaacccaaccctccccgaggtcgcagccttatcctctcctctcccctccgcgaggaaatcatggcttcaacattcggtgccacttctacggttggcctcatggctgcgccaaccggaattgtatcagacaagaagccatcttctctatcttcggtgtcatctgtttctgttgccagccgaccacgcaatgcacgccttcagaggaagtgcaacttcagggtaaaagctgccaaggagttgtacttcaacaaggatggctcggctatcaagaagcttcagactggagtaaacaagcttgctgaccttgttggagttacactgggaccaaagggaaggaatgttgttttggagagcaagtatgggtcccctaggattgtcaatgatggtgttacagttgcaagagaggttgaactggaggatcctgttgaaaatattggagctaagttggttaggcaagcagcagcaaagaccaatgatttagctggagatggcacaactacttctgttgtgcttgctcaggggctgattgctgagggtgttaaggtcgttgcagctggtgccaatcctgtgcaaattacacgtggtatcgagaaaactgcgaaagcactagttgaagagctaaagaaattgtcaaaggaggttgaagacagtgagcttgcggatgttgctgcagtcagtgctggcaacaattatgaaatcggtaatatgatagcagaggctatgagcaaggttggcaggaagggtgtggttacccttgaagaagggagaagttctgagaataatctctatgttgtggagggaatgcagtttgaacgtggttatatctccccgtattttgtaactgacagcgagaaaatgtctgcagaatatgagaactgcaagcttcttttggtggacaaaaaaatcaccaacgcaagggatcttatcaatgttttggaggaggccataagaggtgcatacccaattctgataattgctgaggatattgagcaggaggctcttgctactcttgttgtcaacaagcttagagggtcattgaaaattgccgctatcaaagcccctggttttggtgagcgcaagacccagtacttggatgatattgccattctaactggagcaactgtaatcagggatgaagttgggctgtcacttgacaaggcagacaaatcagttttaggaacggctgcaaaggtggtccttaacaaagagtcaacaacaattgttggtgatggcagtacacaggaagaagtgactaagagggttgcacaaataaaaaatctcatcgaggctgccgaacaagaatacgagaaggaaaagctcaatgagaggattgcaaagcttgctggtggtgttgcagtcattcaggtgggagcacaaacagagaccgaactaaaagagaagaagttgagagttgaggatgccctaaatgctaccaaggctgctgttgaggaaggtattgttgttggtggagggtgcactcttctgagactggcagctagagttgacgccatcaaggacaacctggagaatgatgagcagaaggttggagctgaaattgtaaggagagcgctgagctacccgcttaaattgattgctaagaatgctggtgttaatggaagcgttgttaccgagaaggttctctctaacgataacttcaagtttggttacaatgctgcaactggacagtacgaggatttgatggctgctggtatcattgaccccactaaggtggtgagatgttgtcttgagcatgctgcgtcggtggccaagacattcctcacatcggatgtcgtcgtcgtcgagatcaaggagcctgagcctgcgcccgtcaccaacccgatggacaactccggctacgggtactgatgactaagttacagttacttgttctccgggaaggtcactggccgtcaatttttgggtagtaggcttgaatctgaattttggtgagatttgagtagtttcgagacaatttgatttgttcccatgggaagtgaaataaacagggtcactatagcaaaatttgtggtgtaactggaacggctgtcaaattacgaaggaagatatttgaaagatttcatgctctctggggtttaccgttg

SEQ ID NO: 1451 - DNA, 2309 bp, Oryza sativa Japonica Group
attgattgagcagccggcggcggcgatctttgcttaaaccctaatctcagacgctgcctttgagagaggagaggggggagatcttcttcttcgcttacggcgggtgcagacaatatggcctcagcattcgggagcacctcagcatgtggcatcaagatcactcctaccgcttttgccaccaagaaacatctttgcctggttccacccccagtcgtttcacttccccggaaaaataggcctcagaggaagtgtaatttcagagtaaatgctgccaaagagttatatttcaacaaggatgggttggctatcaagaagctgcaaaatggagtcaataagcttgctgatctcgttggagtcacccttggtccaaaaggacggaatgttgtccttgagagcaagtatggatcacctaaaattgtcaatgatggtgttaccgttgcaaaggaggttgagctggaggaccctgttgaaaatattggagccaaattagtccggcaagctgcagccaagacaaatgatttggctggtgatgggacaacgacttctgttgtccttgctcaagggatgatcacagagggtgttaaggttgtggctgctggtgctaatccagtacagattacccgtggtatagagaaaacggccaaagcacttgtgagtgaactccaaaaaatgtccaaggaggttgaagacagcgaacttgctgatgttgctgcggtaagtgctggaaataactacgaaattggcaacatgatagctgaagctatgaacaaggttggacgacagggggtggtcacacttgaagaaggaaagagtgctgaaaataatctctatgttgttgagggaatgcaatttgatcgcggctatatttctccctactttgtaactgacagtgaaaaaatgtcagtggagtatgagaattgcaagttgctccttgtggacaagaaaatcaacaatgccagagatcttataacaattctggaggatgctattaggggtgggtacccaatcctaatagttacggaggatattgagcaggaagctcttgcaactcttgtggtcaacaggcttaggggtgcattgaagattgctgctattaaagctcctggttttggagaacgcaagagtcaataccttgatgatattgctactcttactggaggtactgtcatcagggaagaagttggcttgtccctagacaaagctgatagagatgttctaggaacggccgccaaggttgtagttaccaaggattcaacaacaatagttggggatggtactacccaggacgaagtaaacaaaagggtgacacaaatcaagaaccagattgaggttgctgaacaggaatatgagaaagaaaaactgaatgagagaatagctaagctctctggtggtgttgctgtcatccaggtaggagcacagacagaaactgagcttaaggaaaagaaactgagggttgaagatgcactgaatgcaaccaaggcggctgttgaggaaggtattgttgttggaggtggctgtacgcttttgcggcttgcatcaaaagttgatgccattatagaaacacttgagaatgatgaacagaaggttggggctgaaatcgtaaggaagtccttgagttacccacttaaattaatagcaaaaaatgctggtgttaacggcagtgttgttactgagaaggtccttgccaatgataacttcaggtatggttacaatgccgctacaggaaaatatgaggatttgatggctgctggtattattgatcccaccaaggtggtgagatgttgcttggagcatgctgcgtcggtggcgaaaacattcatcacatcagatgctgttgtggtggacatcaaggagcctgagaaagcagctgctgctgggaacccaatgggtggatcaggttttggattttagtttagaagaagaggagtaccctttttggcagttggcaaccatttttacactggaggcaggcagaatttcacagttgcatctgagacgttttttcttttcctgtgtgtaattgttgcgtacgtcaatgtggcagatgagaggagtagtaggttatgaatggccagcattatgacagtttattgttgctcgaccttacagaagagctgaaacagtgcaacataatgtttttaaggttgagaattatgcaagctgaagtagttggtaataaccgggagaggattgtgttgtcgttggagtagatgatgattttactagctagttagatcgagttacaaacatataattaattaattaagggggcattggcagattacaataataaataaattatttacatg

SEQ ID NO: 1452 - DNA, 2215 bp, Vitis vinifera
gagattaatcagaagcttcaagagcaaaaagggccgtttccttatatcaaaagggtaaacctaacgctaggtcgctaacttcatagtagtcgcttcagatatacctgcgcacccccggcgccccttatccatacccctcttaaaccctagcttctcttccgtttttaaggagtaaatggcatcggctttcactaccatgtcttctgttggctccttggctgctcctggtggtcgtgggatggataagaaacttgcaacttcatcagacagattatcatcttttgcttccatatcttcaagctcatttggtaggagacaaaatgttgttctacgaaggacacgatctcccaggatcaatgctatggcaaaggatttgtatttcaacaaagatggctctgctatcaagaagctgcagactggagtaaataaacttgctgatctagtgggagttactcttggtccaaaaggcaggaatgttgtcctagagagcaagtatggctccccaaaaattgttaatgatggtgtaactgtggccaaagaggttgagttggaggatcctgttgagaatattggtgctaaattagtgagacaagcagctgccaagaccaacgacttggctggggatgggacaacaacatctgttgttcttgcacaagggcttattgctgaaggtgtcaaggtggtagcagctggtgcaaaccctgttctaatcactcgaggcattgagaagaccacaaaatctctagtggctgagcttaagctgatatcaaaagaggttgaagacagtgagctagcagatgttgcagctgttagtgcaggaaacaaccatgaagtgggaaatatgattgccgaagcaatgagtaaagtgggtcgaaagggtgtggtgacccttgaagagggaaaaagtgcagagaaccacctgtatgttgttgaaggaatgcaatttgaccgtggttatatctcaccttactttgtcaccgatagtgagaaaatggcagttgaattcgagaactgcaagttgcttcttgtagacaagaagataacaaatgcaagagatctcattaatgttctggaagacgctattaggggtggatacccaatcttgataattgcagaagatattgagcaggaagctttggcaacactggttgtgaataagcttagagggtcattaaagattgctgcacttaaagcccctggatttggagagcgcaagagccagtacctggatgacattgcaattctgactggaggaactgtaattagagatgaggtggggctcaccctagacaaagctgagaaggaggttttaggccatgctgcaaaggtggtgcttaccaaggatacaaccaccattgttggagatgggagcacccaggaagcagtaaataagcgagttgcacaaattagaaacctcattgaggcagcagagcaagaatatgagaaggaaaaacttaatgaaagaattgcaaaattgtcaggtggtgttgctgtgattcaggttggagcacaaactgagacagagcttaaagaaaagaaactgagagtagaagacgctctcaatgcaacgaaggcagctgttgaggaagggattgttgtaggtggtgggtgcactctcctgagacttgcctcaaaggtggatgccatcaaggacacgcttgataatgatgaggaaaaggttggagctgatattgtcaagagagctttgagttaccctctgaagttaattgccaaaaatgctggtgttaatggaagtgtggtcagtgagaaggtgctctccagtgacaatccaaaatatgggttcaatgctgcaacaggaaaatatgaagatctaatggctgctggaataattgaccctactaaggtggtgaggtgttgcctggagcatgcatcatcagtggccaaaactttcttgatgtcagattgtgtagtggtggaaatcaaagagcctgaaccagtggttgcaggaaatcccatggacaattcaggttatggatactaggttgtgacaacccagcagaatgatgataggcacttggttttaatttttcacctctttatttttggggtagaattgaatggttttatggtggtagaaaatataactccaggtgagattgggtcgccggagttcggcttgtatcgacttgcaattcagtgtataaggttataaaaaccatttttgcatatgctttttgtcaagtatttttagaaa

SEQ ID NO: 1453 - DNA, 2056 bp, Populus trichocarpa
gtattaaagaataaaaatggcatcgacttttacggccatgtcctcggttggaaccttggctgctcccaatggccgtgttatggataagaagtttgtattttcttcaaacaagttgtcatctttcgcttccatttctgcaagtcgatttggtaggccacagaatgtagttctaccaagatcacgtcctctcaaggttaatgctgccaaggagctgcacttcaacaaggacggttctgcaattaagaaattgcaaactggtgtgaacaagcttgcagatttagttggggttacccttggacctaaaggccggaatgttgttcttgagagcaaatacggttcgcctaaaattgttaatgatggcgtgactgttgctaaagaggttgaattggaggatccggttgagaatattggtgctaagttagtgagacaagctgctgccaagacaaatgacttggctggtgatgggactacaacatctgttgttcttgcgcaaggccttattgcagaaggtgtcaaggttgtggctgctggtgcaaaccctgttttaatcactagaggcattgagaagacaacaagagctctcgtaaacgaacttaagttgatgtcgaaagaggttgaagacagtgaacttgcagatgtggcagctgttagtgctgggaacaactatgaagttgggaatatgatagctgaagctatgagcaaagtcggtcggaagggagtggtcacccttgaagagggaaagagtgctgataacagcctctatgttgttgagggaatgcagtttgaccgtggttatatctcaccttactttgtcactgatagtgaaaaaatgtcagttgaatatgagaactgcaagttgcttcttgttgacaagaaaataacaaacgcaagagatctaatctccattttggaagatgcaattagagctggatatccagttttgataattgctgaagacattgaacaagaagctttagcaactcttgttgtcaataagcttaggggtgctttgaagattgctgccctcaaagctcctggttttggggaacggaaaagtcagtaccttgatgacattgctattctgactggaggaactgttgtcagagaagaggtggggcttgccttggacaaagtaggcaaagaggtcttgggacatgcttctaaagtggttcttaccaaggacacaaccaccattgttggtgacggaagcacccaagaagcagtaaataagagagttgctcaaattagaaatcttatcgaggctgctgaacaagactatgaaagggagaaactcaatgaaagaattgctaagctgtccggcggtgttgcagtgatacaggttggagcacaaaccgagacagagcttaaagaaaagaaactgagagttgaagatgctcttaatgcaaccaaggcagccgttgaggaaggtattgtggttggtggtggatgcaccctgctgagactggcatcaaaggtggatgctatcaaggacagtctcgagaacgatgaagaaaaggtgggagcagacattgtaaagagagctctgagctaccccctgaagttaattgccaaaaatgctggtgttaatggaagtgtggtcagcgagaaggtgctctcaactgacaatcctaaatttggatacaatgctgcaactggaaattatgaagatctgatggctgctggaatcattgatccaacaaaggtggtcagatgttgcctggagcatgcatcatcggtagcaaagacgttcttgatgtccgactgtgtagttgttgagattaaggagcctgaatcagtgcctgctggcaaccccatggataactcaggatatgggtactaggaaggcagctgtgcaacacataagaggatcaaataagatcaggggccctcatatttgtaaatttgattaccaatgttggtagaaattacagattctggtgagggtagcttgccggaatacggcgtgtattattctgcaattaattgtacaattgcaatgattttgaacctcgttgctccacaattgctaaatctgacgatctgttgatatcaccat

SEQ ID NO: 1454 - DNA, 1818 bp, Ricinus communis
atggcgtcaacctttactgctatgtcttcggttgggtccttagttgctcctaatgtggataagaaattcgcctctacttcaaataggttgtcatcttttgcctcaatttctggaagtgcatttggtaggaggcaaaatgtagttctacgtagatcgcgatctcccaagatttgtgccatggcgaaggatttgcatttcaacaaggatggatcagcaattaaaaagttgcaaactggtgtaaacaaacttgcagatctagttggggttacccttggacctaaaggccgaaatgttgttcttgagagcaagtatggctccccaaaaattgttaatgatggtgtgactgtcgctaaagaggttgaattggaggatccagttgagaatattggtgcgaagttggtaagacaggcagccgccaagacaaatgacttggctggtgatggcaccacaacatctgttgttcttgctcaaggccttatagctgaaggtgtcaaggttgttgctgctggtgccaaccctgtattgattactaggggtattgagaagacctcaaaggctctagtgactgaacttaagtctatgtctaaagaggttgaagacagtgagcttgcagatgtagcagctgttagtgcaggaaacaactatgaagttgggaatatgatagctgaagctatgagtagagtgggtcgaaagggcgttgtgacacttgaagagggaaaaagtgcggagaacagcctctatgttgtcgagggaatgcaatttgatcgtggttatatctcaccttattttgtgactgacagtgaaaaaatggcagttgaatatgagaactgcaagttgcttcttgttgacaaaaaaataacaaatgcaagagatctcattaacattctggaagatgcaattagaggtggataccctattttggtaattgctgaagacattgagcaggaggctctagcaacacttgttgtgaataagcttaggggtgctttgaagattgctgctcttaaagctcctggttttggagagcgcaaaagccagtatcttgatgacattgctattttaactggaggaactgttgtcagagaggaggtagggctttcattggacaaagttggcaaggagatcctaggcaatgcatctaaagtggttctcaccaaggatactactacaattgtgggtgatggaagcactcaagaggcggtaactaaaagagttgcacaaattagaaatctcattgaggctgctgagcaagactatgagaaggaaaaactcaatgagagaattgcaaaactgtcaggtggtgttgctgtgatacaggttggagcacaaactgagacagagcttaaagaaaagaagttgagagttgaagatgctctcaatgcaacaaaggcagctgtggaagaaggtattgtagttggtggtggatgcaccctactgaggcttgcatcaaaggtggatgccattaaggatagccttgacaatgatgaagaaaaggttggagcggatattgtgaagagagctcttagctatccactcaagctgattgccaagaatgcgggagtaaatggaagtgtggtcagtgagaaggtgctctctagtgacaatccaaggtttggatacaatgccgcaactgggaactatgaagatctaatggctgctgggatcattgatccaactaaggtggttagatgttgcctggagcatgcatcatctgtagcgaagactttcttgatgtctgactgtgtagttgtggaaatcaaggagcctgaagcagtgcctgcaggcaatcccatggacaattcaggatacggatactaa

SEQ ID NO: 1455 - DNA, 2055 bp, Arabidopsis lyrata subsp. lyrata
aaaagcaccttccaagcgagagtgaggagataaacctacttccttgcttcagctcccgttttcttatccggaaaacaaaaacttccggtgatagaacctcaatcgtcatctctctacttcttggaaaaaatggcgtcaactttcactgccacgtcttccattggttcaatggttgctccaaatggtcacaaatctgataagaagcttatgaacaagttgtcttcaagctcttttggaaggagacaaagtgtgtgtcctagacccagaagatctggttctgcaattgtatgtgcagccaaggaattacatttcaacaaagatgggactaccataaggaaacttcaagctggtgtcaacaagctcgcagaccttgttggtgttacactaggacccaaaggacgaaatgttgtccttgagagcaagtatggatcgccaagaattgttaatgacggtgtgactgttgcaagagaggttgagttggaagacccggttgagaacattggtgctaagcttgtgaggcaagcggctgccaaaaccaatgacttggctggtgacggtacaacaacatctgttgttcttgcacaaggttttattgctgagggtgtcaaggtggtagctgctggtgcaaaccctgttttgatcaccagaggtattgagaagacagcaaaggctttggttaccgagctcaagaaaatgtccaaggaggtggaagacagtgaacttgcagatgttgcagctgttagtgcgggtaacaacgacgaaattggaaatatgattgctgaagcaatgagcaaagtgggcaggaaaggtgtggtgacccttgaggagggtaaaagtgccgaaaacaacctctacgtcgtagaaggaatgcaatttgatcgtggttatatctccccttactttgtgacagacagcgagaaaatgtctgtcgagttcgacaattgcaagttacttctcgttgataagaaaattaccaatgcaagagatcttgttggtgttttggaggatgcaattagaggcggatacccaatattaataattgcagaagacattgaacaagaagctttagctactcttgttgtaaacaagcttagaggtacactgaagattgcagctctcagggctccaggatttggagagcgtaagagccaataccttgacgatattgccattctaactggagcaactgtgatccgagaggaagttggtctttcacttgacaaagctggaaaagaggttcttggtaacgcttcaaaggtcgtcctcacgaaggagacttcgaccatagtgggtgatggaagcacacaggatgcagtgaaaaagcgtgttacacagattaaaaatcttattgagcaagcagagcaagattatgagaaggaaaaactgaatgagagaattgcaaagctctctggtggagttgctgtgattcaggttggagcacaaactgagacagaactcaaagagaagaagttgagagttgaagatgctcttaatgctacaaaggccgctgttgaggaaggtattgttgttggtggtggttgcactctgcttcgtcttgcttccaaggttgatgccattaaagccactcttgacaatgatgaagaaaaggttggagcggatatcgttaaaagagcactgagttatccccttaaactgatcgccaagaatgctggtgttaatggaagcgtagttagcgagaaggtactttccaacgataacgtgaaattcggttacaatgctgcaaccggcaagtacgaggatttgatggctgcaggaatcatcgatccaacaaaggttgtgagatgttgcttggaacacgcagcttcggttgcaaagactttcttgatgtcggactgtgttgttgttgagatcaaggaacctgaaccagttcccgtcggcaacccaatggacaactcaggatatggatactaagaggagataggctaatattgaaacggagtactttagcttgcgagtgtaatgattttgaacaagagaatgtgtaatgtgaaactgaaattttgaatcaatcatcatatgaataaatcatgattc

SEQ ID NO: 1456 - DNA, 504 bp, Sorghum bicolor
atggaagccgccggcgcagcctcgccgcccacggagccgccgccgactcacccggcggtggcgccgctggccttcctgctggggaagtggcgcggggaaggcgagggcagcttccccaccatctcctccttccggtacggcgaggagctcctcttctcgcatcatccctccaagccggtgatctcgtacacgcagaagacgtggaaggcggcgtctggcgagccgatgcacgccgagagcgggtactggcggccccgccctgatggctccgtcgacgtggtcatcgcgcagagcactggcctcgccgaggtccagaagggttcatatgacgctgaaaagaaaacagtgacactccaaagtgaactagttggaaatgcatcaaaggtgaagcagatcacgagaacttttcaagtggcagatggggagctctcgtacgtcgttcagatggcaacaatcacaactagcctacagccacatctcagggcccttcttaagaggatttga

SEQ ID NO: 1457 - DNA, 808 bp, Zea mays
gctgacttgttgaccaacgggaagtccagtacccaagcggagccaccaaggaaaggaggaatggaagccaccggcgcagcctcgcagccctcggcgccgcagacaactcacccggcggtggcgccgctggccttcctactggggaagtggcgcggggaaggcgagggcagcttccccaccatatcctccttccggtacggcgaggagctcctcttctcgcatcatccctccaagccagtgatctcgtacacgcagaagacgtggaagacggcgtctggcgagccgatgcacgccgagagcgggtactggcggccccgccctgacggctccgtcgacgtggtcatcgctcagagcactggcctcgccgaggtccagaagggttcatttgatgctgaaaagaaaacagtgacactccaaagcgaactcgtagggaatgcatcaaaggtgaagcagatcacgagaacttttcaggtggcagatggggagctctcgtacgtcgttcagatggcaacgatcacaactagcctacagccacatctcaaggcccttcttaggaggatttgaagttgaccggcaaaatctcctacaacgacgtcgctgcggctaaccacaaccgagggacacctgtaatacagagcatacttctggtgattmctacgtagttattagtgaatgaacttacaggttaaataaagctcattttcaaaaacagaggttccgctgataggaactaccgtatatgtaaacggcttaccattcagcccatgctccacaaatcgagattattatttaaaaaaaaaaaaaaaaa

SEQ ID NO: 1458 - DNA, 2383 bp, Triticum aestivum
tcgtttctgctgggcaagtggcgcggcgagggcgaggggaccttcccctccatcgccccgttccgctacggcgaggagatcctcttctcccaccacccttccaaggtacaccgccgtctccgggccgtatgcgtcccctccgtggcagaaactttgccttcggttggccgatccttagagcttttcatgcctttgcttgactcggcgtgggtgcgcgcagccggtgatctcgtacacgcagaggacgtggaaggcggcgtccggcgacccgatgcacgccgagagtgggtactggcggccccgccccgacggctccgtcgaggtggtcatcgcccagagcacaggcctcaccgaggtccaggtgtgttcgtactgactgcccattgagttcttgcaagcatcgttctgtctgatgctagattgagtatggtatgcattttggaggcagctgcaaatggcaactctgtttggatattgcctcttggtattcgttataggccatcgcaatcccagtttataatttgcacggcaggtgtctgcatgctgcagttatattgttcatatctgaagattctgaactggatactgaacaacattctagcatagttgcttgcaacagtaggtgggttaattatccttatctcacctgcgaagctgcgcaaagaagggtcaaaggagcattgatgtcattgcaatattaatactgatttatgtggagttgtgttgatctcttatgtactccctcagtaccataatataagacgtttttgcagtaaaatttgaactgcaaaaacgtcttacattatggtaccaagggagtagaatagaaaggaatgtgatatacaaataggaagcgagttgacgcctgcaatatttggatcctttaatattgcaaaagaataaatggcacaaacctatagttattatgtcaaaatttatcagaaaactaacaaatacctttagtatttttacaaactataccaaagtatattttaaatttacattttaaaggtgaaagtgtagtttcgtcaccatgaaatgtctgcttgaagttaaatgtatatttatgttttaatttttgactaaagatagtgtaggcttgagatattcgctctctttgcaaattcgttgcaactggtggtccctttttccctttattttcgctaaacaactgttaattcaaataccaaaaactagcactggaggcttgctgataaatgattttagagagggcacatccaaacaatagtggtcctcttatatatgttgcttatagggccaaaggtactcgcaaggccatagctcataactcacgcgggcattgtaagaattaggtttcatcggagtgtgatttatatcactaagcaaaacaagtttttttgtgagaactaaataaattggtttgttactttagttatttatgtttctttattttagctaaactgttatttgttgccacaactttgcttctaaaatgcagacaggttcatatgatagtgaaaagaaaacggtgacactccaaagcgaacttattggcaatgcagcaaaggtacttctcctaggacgattatatatgatgtctcttgttatcatctattccgactatctttattactatggcacatgatgttctgagggtcaattttactttgactactacccgcaaaaaaaataaattactttgactatgtggcaatatttttgtttttgcattcaacctaccatggccgaatatttgtcaaaagagtgtaatctgactcttaagttggatgggatagtgtattttgttttctgcgaatcaggatgggatgacgttgctcacctgtccaggtgatgaactcgcgatatactaagcttttatctcgtcttctatgagctaatagaaatttatatttgcacccatatatctatatttaacaagggataaatctgcatgtaaagtttctgaactctggaagcagtgccctgcttccatctgcagttgtctttttgtttaaaactcagaaactatgacacttagatctgcttttgtgttcatgaaccgaagtaggaggggtattgactcatcttgctggcggcacttcattgtattttttgtcatagatttgcaacactcaagtctcgaccatcatgtacattgtctttccatgttggagttgctaaacttcgtaggaaggtcatcttcagggttatccactcgcttacggagtcttgcagacgcccaagttgcctgaatctcctaagaaatcttgtataattttgtcaggtgaagcagatcacgagggcttttcaggtggtggatggggagctctcgtacgtcgttcagatggcaacaatcacaaacagtctacagccgcatctgaaagcgcttctcaagaggatc

SEQ ID NO: 1459 - DNA, 780 bp, Oryza sativa Japonica Group
aggaatcgaaacggagaccccgaggaaatggaaggcggcggagcaaccgcacccgccgcgccgcacccggcggtggcgccgctggcgttcctgctggggaagtggcgcggggaaggcgaggggagcttccccaccatctcccccttccgctacggcgaggagctcctcttctcccaccacccctccaagccggtgatctcgtacacgcagaggacgtggaaggcggcgtcaggcgagccgatgcacgccgagagtgggtactggcggccccgccccgacggctccgtcgaggttgtcatctcgcagagcactggtctggccgaggttcagaagggttcgtttgatgctgaaaagaaaacagtgacgctccaaagcgaacttgtggggaacgcatccaaggtgaaacagatcacaagagcttttcaattggtagatggggagctctcatatgttgttcagatggcaacaatcacaaccagtctacagccacatctcaaagcccttctgaagaagatttgaacgatactgcgcccctctaggggcgcagtgcggcggcgtctgtggcacttctggatttttatgttaaaataataatggtatttttgcctattatatctgggaattggggcaacctgcccctactagtttgacataatagacgctgaaaatacgcccttcagagttcagataatgtccatgcgagttcgggcttgttcatgcgcatgagagttcaaactttgttgcgttaaacttaatttaatttaccatcagtattttcac

SEQ ID NO: 1460 - DNA, 735 bp, Hordeum vulgare subsp. vulgare
gacgtgagaccagtccgaaaatccaaccggagacttcaaagaaatggaacccgccggcccaccagcgcagccgccggcgccgcacccactggtggctccgctgtcgttcctgctgggcaagtggcgcggggagggcgaggggaccttccccaccatcgccccgttccgctacggcgaggagatcctcttctcccaccacccttccaagccggtgatctcgtacacgcagaggacgtggaagacggcgtccggcgacccgatgcacgccgagagtgggtactggcggccccgccccgacggctccgtcgaggtggtcattgcccagagcacaggcctcaccgaggtccagacaggctcatatgatactgaaaagaaaacagtgacactccaaagcgaacttattggcaatgcatcaaaggtgaagcagatcacaagggcttttcaggtggtggacggggagctctcgtacatcgttcagatggcaacaatcacaaacagtcttcagccccatttgaaagcccttctcaagaggatctgagcaatctccttgggtgcgatcgctattgcaacatactgtatctaagttctactccctcggtaccgaaatacaagacgtttttgctgttcaggtacagaggtagtagattatttgggaaacctaaaatttagctaataaggaacttctgtgtattattgagaacatgaaaatctatcatttgcgggaatctgaagatt

SEQ ID NO: 1461 - DNA, 3423 bp, Oryza sativa Japonica Group
acgagcagaaataagtccaggaatcgaaacggagaccccgaggaaatggaaggcggcggagcaaccgcacccgccgcgccgcacccggcggtggcgccgctggcgttcctgctggggaagtggcgcggggaaggcgaggggagcttccccaccatctcccccttccgctacggcgaggagctcctcttctcccaccacccctccaaggtaaacgacctcctcgcctgtatctgtatatctctttcgctcgccaaagcttttaccttttctcgaccatgccgcacgcagccggtgatctcgtacacgcagaggacgtggaaggcggcgtcaggcgagccgatgcacgccgagagtgggtactggcggccccgccccgacggctccgtcgaggttgtcatctcgcagagcactggtctggccgaggttcaggtgagctcctactgccaatcgagttattattctaaacgtggcctgatgttaagagtctatcttgcacctgcaatgctccttgagaacaatcgcaaattgctatgctggtagctgcagtctgcagagtatgtgctgactggtgagtgaattgattctcttgtgctacgccaagagccattaggaggaacactcgatatcattgaaatgtgaccttaactggtgtgaaacttgtgttgacccacatttagctatccataattggaaagagcaatgcctgctactatgtattaggaaacccagaacccgaagagatcggcagcaagaacttgaacaaaaacaacacacgtgaacactgtagtccaggggcggagcttgggcaagcctaattaaaaccgttacccatatattcaacagttaaaaaacaacatttttattagaaaaatggactattagtatgtgtggtctcctacatggatgcttaggcaccgattaattcacataactaatttttctggccttaagtgcatgcacaaacagactcaaccaaatgcgcatgcatgcaaaagcaaaaatcaagcacccatcttgctgcttgcattgaaaatatggcactctatgaggtttttaactgacactttgcctggaaagacaacaaattagtgtagagaaatcagtcgatctcaatggatcgcacatgcggagaaccctagccggacaatgaatccgctgcactatagtcaatcctgcatgctaggaaatttgtgctgcgaacaagctgcaacgttttctagttttcttgctactttccatggcatttggcttgcccagctccttggcgatttcaagaacactaaatttggcatcgttgagctgaaggtgcacaataagtctagcttggccctcatgaagaatacaattttccatgatagaagcaagcacatccaaacgaagtttcattttattcatgatgcattggagaatggagaaattcagctagatttcatcagcactagaggtcaacgcgcagatatcctgaccaaggcgctaccttatgcaagatttcaagaactgcaagatcaaattagtatggtttcaattgattaggcacactagtttagagggagatttgttagaataaacatgtgtgcctaatttatttaagttagttttctctccgttgctttgcgttggtctatatacacaagctcacaagttgtgtggttgtcatgtgtgcgagttgtttggggcgttcgagattagctcatggttggccacgtcccacgccatgaccgagacacacgtcgtgcaccatgcacatggatgcgacactagcacgacatgagaatcgctcttgccttagttatttccgttgttaccaactgtctttagatagcaagaaaaccagaaaactgtgcagcttgtccacagcacaatttccgcagcttgtccatagcacaatttcctagcgtgccgaattgaccatagtgtacgttgtgtttgtcttcatcagcagcagcagcagatagccagttgagtctcccgcctctttgacgacgcggtgtataaccagcctgtggtcgctcccgaagcatggcagtcagagcctccaggagcacgtgcggttggtgacgctgactgctgacacagagagtgagtgcatcctcgagacatgaacatgttgtaaagagcacgatctcaagtccaagccttgaacctcgctctgatatcaattgttaggaatccccaatagatcggcggcaagaactcgaacaaacacaacgcacacaaacattgtagtcaatccggcactctagaaaaatttgtgctgcgaacaagctgcagcgttttctggttttcttgctatatctaaaggcagttggttacaacggaaataacaacacgagagcgattcacacgccgcgctagtgccgtgtcccgcatgacgtgtgtctcgttcatggagtgagatgctggcagccacgagataatctctgatgccccaaataaactcgcacgcacggcaaccgcacaactcgtcagctcgtgcatatagacctatgcaaagcgacagaaagagaactaaactaaatcaggcagacatgttgattctaacactatgatcattcatcagcctgcaatcttctgatgtttccattttgcatattcttgtcaatgttatggtttgctcggtccttcccctctatttcagaaatcgttccaagaatctctccaaacatgtttgtgaatatagttcaatgcccaaatgatagttgtcattctgtacatctatggttaatacggccaaaaggtaatgacgaatcagctagtaggttttgaattcggattaatcattccattaataatttttcttatgtcacattccattgataatgtttcttatgtcacttagcgagagctcttttaatttatatgtcttcctaattgtgtttcgatttatctccatgcattcacttccaaattgcagaagggttcgtttgatgctgaaaagaaaacagtgacgctccaaagcgaacttgtggggaacgcatccaaggtacttttgttctgctcacaagaatattgcagatgaattaccaatctatagttttcttcaaatgcactaatttaatttgcttaataccgtgcactacattgaaataacattgccatatgattttactgcattatcggcacacttgaaccaccaggtctccgagattatgtccaactgctacagcctcagtagcctgaaaactctggagtggtttactagatacttctacaatttggatacttctaaaatgatactgagatgaatttagcttgtgttttttcattattacagtttttgacaaaggtcttgtgtgttcttgtcaggtgaaacagatcacaagagcttttcaattggtagatggggagctctcatatgttgttcagatggcaacaatcacaaccagtctacagccacatctcaaagcccttctgaagaagatt

SEQ ID NO: 1462 - DNA, 1390 bp, Zea mays
tgccagtatgccagttgccaccgaggtaaacagcatagcgacggctcagcatagagacaagtccagcgctcaagagagagagagcaagcctttcggcctcgcgtgatgcagcagcagcagccgtccgtccgcgccgtcaccatccccttcgccgaccttaaggatcggggcaaggacctgggcggcttcatcgaggaaggcttcgggcctcaggggctcggcatcgtctccatcgccggcgtacccggttacccagagctcaggaaaaggctgctgcgcttggcgccaaggatcgtcagccttcctgatgatgtgaagaaacaactggaggacccagatagcagataccactttggttggagtcgtgtagaagagaaattcgagtctgaaagatgggacacagccaaaggctcctacttcgccaacccagtttttgatgtcccaacaactgatgatgagcttgtaactagatacccatcatactgccgaccaaacatatggccaaaggatcatcttcctgagcttgaaatagcattcaaaggtcttggaaaactgatgttggaagttggcttgatgttggctcatcattgtgatcgctatgtaatacagcgaggggtgggacagtacattggtgaaagccttgagaagacacttgctaggtcaaggtgtcccaagggtcgtctgctgtactacttccccaaatcgtttagcaaacaggacgaagtttcgtcatggtgtggatggcatactgactatggatttttgacaggacttacatgtggcttgttcacgagaaaatcagaggaggtcccctgtcctgatattggaactgggctgtatgttcggactcgtgataatcaagtcgtcaaggtcacacttgtggatgatgagttggtctaccaaattggggagactgctgaaatactatcaagagggcatctatgtgcaaccccacactgtgtgaaggctcccagcagcgaagatgcttctgacgttggtcgctcaactttcgttctgtttattcagccaaactgggatgagccgctgaagcttcctagtgaaatacgctatcaccaggagtgcattccaccaaccaggacacttgcgtacggcgagtactccgaaagagtcttggcgagttttagcggcaagagcgtggaacaaaccttgatgccacagtaagaggctccagccagatgaatactccctctgtttctttttatttgtcgctggatagttcaattttatactatccagcgacaattaaaacgaaacggagggagtatatcatatgtatgataccataccattcaagctacagataagtggacagaagcatatgctgttgtgggatggatgaatcgcacgcagcttaaaataatgcaacaat

SEQ ID NO: 1463 - DNA, 1319 bp, Zea mays
atagcgacggctcagcatagagacaagtccagcgctcaagagagagagagcaagcctttcggcctcgcgtgatgcagcagcagcagccgtccgtccgcgccgtcaccatccccttcgccgaccttaaggatcggggcaaggacctgggcggcttcatcgaggaaggcttcgggcctcaggggctcggcatcgtctccatcgccggcgtacccggttacccagagctcaggaaaaggctgctgcgcttggcgccaaggatcgtcagccttcctgatgatgtgaagaaacaactggaggacccagatagcagataccactttggttggagtcgtgtagaagagaaattcgagtctgaaagatgggacacagccaaaggctcctacttggccaacccagtttttgatgtcccaacaactgatgatgagcttgtaactagatacccatcatactgccgaccaaacatatggccaaaggatcatcttcctgagcttgaaatagcattcaaaggtcttggaaaactgatgttggaagttggcttgatgttggctcatcattgtgatcgctatgtaatacagcgaggggtgggacagtacattggtgaaagccttgagaagacacttgctaggtcaaggtgtcccaagggtcgtctgctgtactacttccccaaatcgtttagcaaacaggacgaagtttcgtcatggtgtggatggcatactgactatggatttttgacaggacttacatgtggcttgttcacgagaaaatcagaggaggtcccctgtcctgatattggaactgggctgtatgttcggactcgtgataatcaagtcgtcaaggtcacacttgtggatgatgagttggtctaccaaattggggagactgctgaaatactatcaagagggcatctatgtgcaaccccacactgtgtgaaggctcccagcagcgaagatgcttctgacgttggtcgctcaactttcgttctgtttattcagccaaactgggatgagccgctgaagcttcctagtgaaatacgctatcaccaggagtgcattccaccaaccaggacacttgcgtacggcgagtactccgaaagagtcttggcgagttttagcggcaagagcgtggaacaaaccttgatgccacagtaagaggctccagccagatgaatactccctctgtttctttttatttgtcgctggatagttcaattttatactatccagcgacaattaaaacgaaacggagggagtatatcatatgtatgataccataccattcaagctacagataagtggacagaaacaaaaaaaaaaaaaaaa

SEQ ID NO: 1464 - DNA, 1554 bp, Sorghum bicolor
gtgcacgtgacggctcaacctctccgtctccatctacctccgccgggtgccgccaaaaccaaggtcgtcgccccaacccaagtacccaaccgaatccaacgggacacgagagcgacgtcatggtggtggaagtgggcaccgccgtggggacacgaaccacctccacttggcctgcaggtccagccgcccggcgcagttcacggggccaggtcgtctccttcgccttcgccttcgccctcgcccccgagtcgtcccgccgggtccgggtccgggtccggtgccgcgcgatgcagcaggaggagcggcggccgccgaccgtccgcgcggtcaccatccccttcgccgacctcagggagacggacaaggacctcggcggcaagatcgaggaaggcctgggtccccatgggctcggcatcatcaccattgccgatatacctgagtttccagagctaagaaaaaggctgctgcggttggcaccaaggattgcaaaccttcctgaagaggtgaagaaacagcttgaagatccagatagcagatataactttgggtggagtcatgggaaggagaaactcgagtctgggaaacttgacacatttaaaggttccttttatgcgaaccctgttttggatgtccctactactgatgatgtgcttgtaagtaggtatccatcatattgccgaccaaatatatggccaaatgagaatcttcctgaacttgagatagcatttaaagctcttgggaagctgatgatggaagttggtttgatgttggctcatcattgtgatcgctacgtaatggggcaaggagtgggatcatatgatggtgacagtcttgagcagacgattgcccgttcaaggtgtcacaagggtcgtctgttgtactatttcccacgacagtttagcaagcagatagacgttgagtctgtttcatcatggtgtggatggcacactgatcatggatctctaacaggtctcacatgtggcttgtttacgaagaattctgtggaggtaccatgtccagatagtgcagctggactatacattcggactcgtgataaccaagttgttaaggttgtgtttgatgaggatcagctggcttaccaaattggggaaactactgaaatactgtcaagagggtatctgtgtgcaacgccacactgtgtgcaggcacccaacagtgaaaatgcttcaaatgttgaccgctctacttttgccttgttcatgcaaccagattggaatgagaagcttaagtttccgagcgaaatcccctatcaccaagagttgattccaccaaacggaacgctgactttcggggaatactctgaaaggctagtaaacaagtattaccagacaacaacgtagagcatacctcaagaaaagctaccgttgtacatacattggtgtcatcaagcgtgttcttgtgtattcatattagctctgatccaaactttctgtacaaatagtcgatcagcgaataccagaacagactgcagaataagatcaactgtatcacccacagcttacaataatgtaccaccagtttaaactcgctccg

SEQ ID NO: 1465 - DNA, 1323 bp, Zea mays
acacgaaccacctccacttcggctgcaggtccagccgcccggcgcagatcacggggccaggtcgtctccttcgccctcgctcccgcgtcgtcccgccgggtccggctccgttgccgcgcgatgcagcagcacgaggaggagcaggagcggccgccgaccgtccgcgcggtcaccatccccttcgccgacctcagggtgccggacagggaccttggcgacaagatcgaggaaggtctgggtccccatgggctcggcatcgtcaccattgccgatgtacctgagtttccagagctaagaaaaaggctgctgcgcttggcaccaaggattgcaaaccttcctgaagaggtgaagaaacagcttgaagatccagatagcagatataactttgggtggagtcatgggaaggagaaactcgagtccgggaaacttgacacatttaaaggttccttttatgcgaaccctgttttggatgtccctactactgatgatgtgcttgtaagtaggtatccatcatattgccgaccaaatatatggccaaacgataatcttcctgagcttgagatagcatttaaagatcttgggaagctgatgatggaagttggtttgatgttggctcatcattgtgatcgctatgtaatgaggcaaggagtagggtcatatgatggtgacagtcttgagcagacaattgctcgttcaaggtgtcacaagggtcgtctgttgtactatttcccacgacagtttagcaagcagacagacttcgagtcggtttcatcatggtgtggatggcacactgatcatggatctctaacagggcttacctgtggcttgtttacgaagaattctatggaggtaccatgtccagacagtgcagctggactatacattcggactcgtgataaccaagttgttaaggttgtgttcgacgaggatcagctggcttaccaaatcggggaaactactgaaatactgtcaagaggttatctatgtgcaaccccacactgtgtgcaggcacccagcagcgaaaatgcttcaaatgttgaccgctctacttttgccttgttcatgcaaccagattggaatgagaagctgaagtttccaagcgaaatcccctatcaccaagagttgattccaccaaacggaacgctgactttcggggagtactcagaaaggctggtagacaagtattaccagacaacaacgtagagcatacctcaagtgtgttcttgtgtattcatttttagctttgatcataactctgtacaaaatatagtcgatcatcgaatcgaataccagaacaaaccgcggataaaaaaaaaaaaaaaa

SEQ ID NO: 1466 - DNA, 1462 bp, Zea mays
actacaccgccccaaaccaaaaaccttccccgtattggagtccgcatcgctcgctagtcacctaccgcaccgccaccgccaccgccgccgccgccagcgcgcccgtctcgcacgcgcagcacaggacgcgcgcgatcccctcgctccggatcgccatggcctccacggcgttcgccgccgccaagtacttccccgcgcacctcgactcctccccgcgcatcgcgccccgccgcgccgcgcccaccgcgagcctctccttctccccgctctccgccagcccgtcgtccctgctccgcctccggtccccctgcccgtccggcccggggggcaggctgcccccgcccccgccgccgcgatcgtacggcggcggcggcggatctggtggcgacgccgcggactccggcggcggccgccgcggcggggggatcctcgggctsttcctcgcsgggggggscgsccgggkcgccgcggacccgcagttccctttcraggtgctcatggaggagctsgtgggcgtcaccgcgtgcgtgctgggcgacatggcctcccgccccaacttcggcctcaacgagctcgacttcgtcttctccaccctcgtcgtcggctccatcctcaacttcgtcctcatgtacctcctcgcccccaccgccgccgcgtcgtccgccgcctccgcgctccccagccacatgttcgagcccggcgccttctcgctcggctcccgcgtcgccacgctcgtgtccaagggcgccaccttcgcggtggtcggcttcgcggccgggctcgcgggaaccgcgctctccaacggccttatggcgatgcggaagcgcatggacccggcgttcgagacgcccaacaagccgccgcccacgctgctcaacgcggccacctgggcgctccacatggccggcagcagcaacctgcggtaccagacgctgaatggggtcgagtacatgctcggcaaggtcgcaccggcgccggtgttcaaggcgtccgtcgttgttctccgatgcttgaacaacgtgcttggtggggtgtccttcgtgctgcttgctaggttgaccggggcgcaaaaatcagataagccggcgacggtcgcggaagagaaggagaggttgatagctgtgggcaatgctgtagcagatgccatcggtgaggcaagagatggagaggagggtaagtaagtggtagaggagaggaacagtaagatgatggtgcatcgtcccacgctcttttgcaagaaacctgtagagttggttggaatggaataaggagtgaggctcaacttcttttcttaaagtcggtttgtggtttgtcgctgttgatgattacttcctccgtttcgttttagttgtcgctggatagtataaaattaaactattcagcgataactagaaagaaacaaagaaacggagggagtatatgcttagaatgaagtttttctctcaaaaaaaaaaaaaaaaaa

SEQ ID NO: 1467 - DNA, 1383 bp, Zea mays
caccgccgccgccgtctcgcacacggggcacaggacgcgcgcgatcccctcgagtccggattgccatggccaccacggcgttcgccgccgccaggttcttccccgcccacctcgactcctccccacgcatcgcgccccaccgcgtcgggcccaccgcgaatctctccttctcaccgctttccgccaactcctcgtccctgcgccgcctccattccccctgcccatccggccccgggggtaggctgcccccgccgccgcgatcgtacggcggcgccggcggatctggcgacgccgcgaactccggtggcggcgaaggccgccgcggaggcatcctcgggctcctcctcgccgggtgggccgcccgcgtcgctgcggacccgcagttccctttcaaggtgctcatggaggagctcgtcggcgtcaccgcttgcgtgcttggcgacatggcctcccgccctaacttcggcctcaacgagttggacttcgtcttctccacgctcgtcgtcggatccatcctcaacttcgtcctcatgtacctcctcgcccccaccgccggcgtcgccgccgccgcgtcgtccgccgcgtccgcgctccccagccacatgttcgagcccggcgcgtactccctcggctcccgcgtcgccacgatcatgtccaagggcgccaccttcgcggtggtcgggttcgcggccgggctcaccggaaccgcgatctccaacgggctgatcgcgatgcggaagcgcatggacccggcgttcgagacgcccaacaagccgccgcccacgctgctcaacgcggccacctgggcgctccacatgggtgtcagcagcaacctgcggtaccagacgctgaatgggatcgagtacctgctcggcaaggtcgcaccggcgccggtgttcaaggtgtccgttgttgctctccgctgcatgaacaacgtgctgggtgggatgtccttcgtgctgcttgccaggctgaccggggcgcagaaatcagacaagccagcgacggtcgcggaagagaaggagaggttgatagctgtgggcaatgccgcagcagatgccatcaacgaggcgaggcatggagagggtaagtaggtggtagaggagagagacgagtaagttgatggtgcatcatctcagactcgtttgctggttcttggacatagaccaagaaactcacctagtcacctgtagagttggttggaataaggagtggagtgaggttcagaacttcttttttaaaaaactctgtttgtggtttatcggtgttgatgatgacatgcttagtgatggtagaataaagttttttttcctctcatgctcatttgatcgttgactcgatgggtagcctgtttgttaaataccttcagtttttgcatgcagt

SEQ ID NO: 1468 - DNA, 1340 bp, Sorghum bicolor
ctctcttttccccatctgcaggctgcaggcgctgctgctctcgtcctccgccagcgaccgaatcgctggctcgacgccgcggcgggaggttggtatctcgcctttcgatcaggttcacggccaaattcgttgctgcgtgaggctttggagtctggagccaatcttgcgccttagagggcggtggcagcgcctggtgggcaccatgagcttcgtcttccgagggagcagggccgacatcgaggccggtggcttcccggggttcgcccccgagcgccgcgccatgcgaattcatgcagggagcaggccggtgaatagcaattccttggcttttcttctaactgttcttgttttgttcatggtactgaactcacaccagatgtctcccaatcttttgctttggcttgtcttgggagtcttcctaatggccacaagccttagaatgtatgccacgtgccagcagcttgctcatgctgcagctgccaacaattttcttggacacactgagctgcgtgtgcatgtaccgccgaccattgcccttgctacgagaggccggttacagagccttagacttcaactggctcttcttgatcgtgaatttgacgatttagattatgacactctgagagcattggatgctgacaatagcccgcatactccttctatgagtgaagaagaaataaattctcttcctgtattcaaatataaagttcaggcgcagcaggggaatgcccctgcccagaaaagtgatgggccatctcagctatcggtttcttcaactggatctggcaatgagaagaagcaggatggtttaaaatcagatggaaccagcaaaactccagaggatgaactaacatgtagtgtttgcttagagcaagtcgccgtgggtgatctgttgagaagcctaccatgcttgcatcagtttcacgtaaactgcatcgacccatggctgcgccaacagggtacatgcccaatctgcaagcaccaggtgagtgatgggtggcatgccacaggcaacggtgaagaggatgcctcttacatggtgtaagtagctgcctaggagtaggccataggtaactagtagtagctgctaacagaatccgtggaacgctgttttggaggtgacggttttggagtgatttcatgcaatctagggatgtggtctaagcctgtctatcctaacaaaaccaagtgtggaaccagctgtctagtgcgctgagttcttgtacaactaatgtttctctcattctatgtgatgctgatgcataaaaaggttgatgataatctttgtaacatcatggcccagggcttaataggattaacaagttataactttttttttt

SEQ ID NO: 1469 - DNA, 1376 bp, Zea mays
ctcgcactcgaaaccgctgaacggcagaaaacccaggcctttctagcttctgctatcctgctgctgcccctctttcccccaatctgcaggctgcaggcgctgctcctttcgccctccgctagcgagcgaatcgctggctcgaccccgcggcgggaggtatcccgccttcgatctggttcactggccaattcgttgcttcgtggggctttggagtttggagccaatcttgccccttaaagtgtcggtggcagcgttctgtgatcatcatgagctttgtgttccgagggagcaggaccgacatcgaggccggtggcttcccagggttcgctcccgagcgccgcgccatgcgaattcatgcagggagcaggccggtgaatagcaattccttggcttttcttctaactgttcttgttttgttcatggtactgaactcgcaccagatctctcccaatcttctgctttggcttgtcttgggagtcttcctaatggccacgagcctcagaatgtatgccacgtgccagcagcttgctcatgctgcagctgccaacagttttctcggccacactgagctgcgtgtgcatgtaccgccgtccattacccttgctacgagaggccggttacagagccttagacttcaactggctcttcttgatcgtgaatttgacgatttagattatgacactctgagagcattggatgctgacaatagcccacatgctccatctatgagtgaagaagaaataaattctcttcctgtcttcaaatataaagttcaggcacaacagaggcatccccctgcccgaaaaagtgatgggccatctcagctatcggtttcttcaactgggtccggcaatgaggaaaagcaggatggtttaaaagcagatggaaccagcaaaccttcagaggatgaactaacatgtagtgtttgcttagagcaagtcacggtgggtgatctgttgagaagcctaccatgcttgcatcagtttcacgtaaactgcatcgacccatggctgcgccaacagggtacatgcccaatctgcaagcaccaggtgagcgatgggtggcatgctacaggcaacggtgaagaggatgcttcttacatggtgtgagtagctgactaggagtaggccatagctaactaccagtagctgctaactgaatccgtggaacatagttttcgaggtgacgggttggactgatctagggatgtgatctaatccctttctatcctaacaaaaccgcgtgtggaaacagttgtccagtacggttcttttacaggtaacgctcatttcaatcattctctgtaacggggcgtttggatcccttcattttagaggaattggaattcactcaataaagtaacttatttagtttgg

SEQ ID NO: 1470 - DNA, 1314 bp, Zea mays
ctctcttccccgtcctgcaggctccaggcgctgctgctctcgtcctccgctagcgagcgaatcgctgacgctggcccgacgccgcggcgggaggtatctcgctttcgatcaggattttggttggggcgtcgttctccggtgcttatctcatttctatttatcggtgcctcgggttcacggccaaattcgctgctgcgtggggctttggagattggagccgattccttaaagtggcggtggcagcgtctggtgggaaccatgagcttcgtgttccgaggaagcagggccgacatcgaggccggtggcttcacagggttcgcccccgagcgccgcaccatgcgaattcatgcagggagcaggccggtgaatagcaattccttggtttttcttctaactgtttttgttttgttcatggtactgaactcacaccagatgtctcccaatcttttgctttggatagtcttgggagccttcctaatggccacgagccttagaatgtatgccacgtgccagcagcttgctcatgctgcagctgccaacagttttcttggccacactgagctgcgtgtgcatgtaccgccgaccattgcccttgctacgagaggccagttacagagccttagacttcaactggctcttcttgaccgtgaatttgatgatttagattatgacactctgagagcactggatgctgacaatagcctgcatgttccttctatgagtgaagaagaaataaattctcttcctgtcttcaaatataaagtccaggcacagcagggaaatgcccctgcccgaaaaagtgatgaggcatcgcagctatcggtttcttcaactggctccggcaatgagaaaaagcaggatggtttaaaagcagatggaactggcaaaactccacaggatgaactaacatgtagtgtttgcttagagcaagtcatggtgggtgatctgttgagaagcctaccatgcttgcatcagtttcacgtaaactgcatcgacccatggctgcgccaacagggtacatgcccaatctgcaagcaccaggtcagtgatgggtggcatgccacaggcaacggtgaagaggatgcttcatacatggtgtaagtagctgcccaggagtaggccataggtaactagtagctgctaacagaatccgtggaacgctgttttggaggtgacggtttggacttgcaatctagggatgtggtctaatccctgtctaccctaacaaaaaaccgagtgtggaatcagctgtccagtgcactgagttcttgtacaactcatgtttatttctctcattctctgtgatgttgatgc

SEQ ID NO: 1471 - DNA, 1391 bp, Zea mays
gctgttagtgctgttcccctctctcttccccgtcctgcaggctccaggcgctgctgctctcgtcctccgctagcgagcgaatcgctggcccgacgccgcggcgggaggtatctcgctttcgatcaggattttggttggggcgtcgttctccggtgcttatctcatttctatttatcggtgcctcgggttcacggccaaattcgctgctgcgtggggctttggagattggagccaattccttaaagtggcggtggcagcgtctggtgggaaccatgagcttcgtgttccgaggaagcagggccgacatagaggccggtggcttcacagggttcgcccccgagcgccgcaccatgcgaattcatgcagggagcaggccggtgaatagcaattccttggtttttcttctaactgtttttgttttgttcatggtactgaactcacaccagatgtctcccaatcttttgctttggatagtcttgggagtcttcctaatggccacgagccttagaatgtatgccacgtgccagcagcttgctcatgctgcagctgccaacagttttcttggccacactgagctgcgtgtgcatgtaccgccgaccattgcccttgctacgagaggccagttacagagccttagacttcaactggctcttcttgaccgtgaatttgatgatttagattatgacactctgaaagcactggatgctgacaatagcctgcatgttccttctatgagtgaagaagaaataaattctcttcctgtcttcaaatataaagtccaggcacagcagggaaatgcccctgcccgaaaaagtgatgaggcatcgcagctatcggtttcttcaactggctccagcaatgagaaaaagcaggatggtttaaaagcagatggaactggcaaaactacacaggatgaactaacatgtagtgtttgcttagagcaagtcatggtgggtgatctgttgagaagcctaccatgcttgcatcagtttcacgtaaactgcatcgacccatggctgcgccaacagggtacatgcccaatctgcaagcaccaggtcagtgatgggtggcatgccacaggcaacggtgaagaggatgcttcatacatggtgtaagtagctgcccaggagtaggccatatgtaattactctctttgtttctttttagttgtctttggatagtgcaaaattaaactatccagcgacgattaaaaagaaacagaaggagtactaactagtagctgctaacacaatccgtggaacgctgttttggaggtgacggtttggacttgcaatctagggatgtggtctaatccctgtctatcctaacaaaaaaccgagtgtggaatcagctgtccagtgcactgagttcttgtaaaaaaaaaaaaaaaa

SEQ ID NO: 1472 - DNA, 1077 bp, Hordeum vulgare subsp. vulgare
ggggcgctgctgcgtgggctagtcaaagtttttgttgccgcgaggggaaggaaggcgctgctttggaacccatcttacacctggtggtagtggtggtggtggtggtggtggtggccggtggacaccatgagctttgtgttccggggcagcaggtccgacatcgaggccggtggcttcccagggttcgccacggagcgccgtgccatgcggattcatgccggggggcggccggtgaacagcaattccttagcttttcttgtaactgttcttgttctgttcatggtactgagctcacaccagatgtctccgaactttttgctttggatggtcttaggtgtgttcctattggccaccagccttagaatgtacgctacatgccagcagctccaagcgcaggcacaagctcatgctgcagacgccaacggcttccttggacgcactgagttgcgggtgcatgtcccgccaaccatagctcttgcttcgagaggccggttgcaaagccttagactccaacttgctctgcttgaccgcgagtttgatgatttagattatgatgctctcagagcgctagataccgacaatagcccacatgctccttctatgactgaagaagaaataaatactctgcctgttttcagatacaaatttcaggcgcaacagaggagcaccccttctcgaaaaagtagtgatgggccatctgaaccattggtttcttctcctgaatccggcaaggagaaaaagcaagatgcagatgcaacaagcaaaatgacagaggatgagttgacgtgcagtgtttgcttagagcaagttgttgcgggtgatctattgagaagcctgccatgcttgcatcagtttcatgtgaattgcattgatccatggttgcgccaacaaggaacatgcccgatctgcaagcaccaagtgagcgacgtgtggcgtggcgccggcagcggtgaactggatgccatggtataacatgacatgagcttcagttcttaacctaatatcactaggcggtagtactaacggaaatcccatggaattgtggacgagctgtttagtcatgctgagagtttctgt

SEQ ID NO: 1473 - DNA, 840 bp, Triticum aestivum
atgagctttgtgttccggtgcagcagggccgacatcgaggccggtggcttcccagggtttgccgcggagcgccgttccatgcggattcatgccggggggcggccggtgaacagcaattccttagcttttcttgtaactgttcttgttttgttcatggtactgagctcgcaccagatgtctccgaactttttgctttggatggtcttaggtgtgttcctattggccaccagccttaggatgtacgctacatgccagcagctccaagcgcagtctcaagctcatgctgcagacggcaacggcttccctggacgcacagagttgcgggtgcatgtcccgccaaccatagcccatgcttcgagaggccggttgcaaagccttagactccaacttgctctgcttgaccgcgagtttgatgatttagattatgatgctctcagagcgctagatactgacaatagcccacatgctccttctatgactgaagaagaaataaatactctgcctgttttcagatacaaatttcaggcgcagcagaggagcaccccttctcgaaaaagtagtggtgggccatctgaaccattggtttcttctcctgaatccggcaaggagaaaaagcaagatgcagatgcaacaagcaaaatgacagatgatgagttgacgtgcagtgtttgcttagagcaagttgtcgcgggtgatctattgagaagcctgccatgcttgcatcggtttcatgtgaactgcattgatccatggttgcgccaacaaggaacatgcctgatctgcaagcaccaggtgagcaacgtgtggcatggcgccggcagcgaaatggatgccatggtg

SEQ ID NO: 1474 - DNA, 1205 bp, Zea mays
ctgcaggctccaggcgctgctgctctcgtcctccgctagcgagcgaatcgctgacgctggcccgacgccgcggcgggaggtatctcgctttcgatcaggattttggttggggcgtcgttctccggtgcttatctcatttctatttatcggtgcctcgggttcacggccaaattcgctgctgcgtggggctttggagattggagccgattccttaaagtggcggtggcagcgtctggtgggaaccatgagcttcgtgttccgaggaagcagggccgacatcgaggccggtggcttcacagggttcgcccccgagcgccgcaccatgcgaattcatgcagggagcaggccgtcttgggagccttcctaatggccacgagccttagaatgtatgccacgtgccagcagcttgctcatgctgcagctgccaacagttttcttggccacactgagctgcgtgtgcatgtaccgccgaccattgcccttgctacgagaggccagttacagagccttagacttcaactggctcttcttgaccgtgaatttgatgatttagattatgacactctgagagcactggatgctgacaatagcctgcatgttccttctatgagtgaagaagaaataaattctcttcctgtcttcaaatataaagtccaggcacagcagggaaatgcccctgcccgaaaaagtgatgaggcatcgcagctatcggtttcttcaactggctccggcaatgagaaaaagcaggatggtttaaaagcagatggaactggcaaaactccacaggatgaactaacatgtagtgtttgcttagagcaagtcatggtgggtgatctgttgagaagcctaccatgcttgcatcagtttcacgtaaactgcatcgacccatggctgcgccaacagggtacatgcccaatctgcaagcaccaggtcagtgatgggtggcatgccacaggcaacggtgaagaggatgcttcatacatggtgtaagtagctgcccaggagtaggccataggtaactagtagctgctaacagaatccgtggaacgctgttttggaggtgacggtttggacttgcaatctagggatgtggtctaatccctgtctaccctaacaaaaaaccgagtgtggaatcagctgtccagtgcactgagttcttgtacaactcatgtttatttctctcattctctgtgatgttgatgcat

SEQ ID NO: 1475 - DNA, 1446 bp, Oryza sativa Japonica Group
actgctcgctctcgttttccccatccgcaccggctgctcctcgtcgcgccgacgcctccgcgcgccagcgaatcgccgcctcgagaggcccctcgtcgccgatcaggggcgtggcctcgtcgagtttttttgttcctcggaggggcggcaaggaggcggatttggagcaattcgtaagactagtggtggtggtggtggtggtggctggttggcgccatgagcttcgtgttccgggggagcagaggtgacatcgaggccggaggcttcccggggttcgccccggagcgccgcgccatggtgagcgtttctgcttaaatcggattcatgcgggtggtcggccggtgaacagcaacctggcttttcttgtcactgttcttatgttgttcatggtactgaactcacaccagatgtctccgaactttttggtttggctggttttgggtgtgttcctaatggccaccagcctaaggatgtacgccacatgccagcagctccaagcgcaggcgcaagctcacgctgcagctgccaacggcttccttggacacactgagctgcgggtgcatgtcccgccgaccatagctctcgccacacgaggccgtttgcagagccttaggctccaacttgcgctacttgaccgcgagttcgatgatttagattatgatgcccttagggccttggatgcagacaatagccctcatgctccttcgatgagtgaagaagaaataaatgctcttcctgtattcaaatacaaggttcaggcacatcagggaagtgcctctttccgaaaaagtgatggaccatctcaaccatctgtttcttctactgaatctggcaatgagaaaaagcaggatcgtttcaaggctgatgcaactgacaacaccctggaggatgagttgacatgcagtgtttgcttagaacaagtcgttgtgggtgatctattgagaagcctaccatgcctgcaccagtttcatgcaaactgcatcgatccatggttgcgccaacagggaacatgcccagtttgcaagcaccgtgtaagcgatgggtggcatggtgaagcagatgcttctaacatggtataagctgctgggagtggccagcaggtcttaagctaaaactactgacttaacccacggaatgaggattagctgtttagtcttgaggagtgtttttgtacataaaaaaacgttcacttctctgtgatgtttatgcatcaaaaggttgtgatatttttggttgacctgtaccctgttcagtatgaactcacatacaatcctttttactctgtttccgtggggaaattggcgtattatgggtgtttaaggctgaagatcagtagaggatttaagatccaagagtagtggtctggtctctattagtcttaagtaaaaatgatcttaactgttagtattatcacaagtaaaaaggagaaactgatttatgagttct

SEQ ID NO: 1476 - DNA, 1568 bp, Zea mays
agaaacaaatatgtaacatgatagaattgtcacttgcgaggttgccgcacccgtagtttgtaaaacagaccgatgatttctctgaatttgtaaaacatcaccaggcaaataaccgacagcagttaatggcggcgtcggcccaactgagcccgcatcagaggacgcgcagaaatcgcctcctgattttgtgcgtggttgtttgggcggggcgtgcaattccccgattcgagcggaactcctcccatccgatccggcggcggaggacaatataaaagcgagccaatcggcgtctagctgtagcacctctgcgtctcaagattagagatccattagctgtagcacctctgcctcccacgaatcgattcgacgacatcttgctggtacaacctaccatcatggtgggcatgctattgaacgccggccgcagcaatggccgcggcggcaggaggactagcatccagtcaccaccgcaggtcctctcctctgttcccttactcgtctacgagtacgaggatcccgccgttgttcatccagcaggctctactcctaccgctgccgcaaagatgctcatgtacagcctgcctgagcggagcatcgtctacacgcacgacagcaggcctcaggccatggagggcaacttcttcagcacgcctcaaggctggctggtcatccttggacaagtgacgtcggaggcctccatgtggcatccgctcaccggggagaccatcaccctcccacccatacacgacgaccactacatccccaccaactgcaagtgcctgctcacccacaactccgccgcccacccggactgcgccgtggtgctcctcgacgtcgccgatcctctcatgtggttctgccgtgtcaatggcggggctgaccggaggtggggacagcacacctacgacattggcgactacgagttcctcgatgagttccgcaccccctctacgcccaccaagaaagtcatcggaagcgtcgccgcgcttaaagggaagctgcatttttgcttcatggaatcgcaccaaaacaagatgtgcgtcgttgacttagatttcccgtccgatcatggtcaccctcccaccgcagagttccacgagtttgatgtctccccagagttcggcatcaagtttcctgacggcatctgctccatccacttggtagagtccatggacgagctttttgccgtctgcgtcttctatgtcggttttgatcccaccaacgtcagtgctgctcgaatcttcaagatggaggactcctgcagcgaggaaaccgtggcctggcaccgggtggatgatatcggtgacagggcttttctcttgaccggcaccaacatggcaacttggtgctctgcaagcaccaataacctgaaaggcagcaccctctatttcttcttagacttcttacttggcgacagggatctatacatctatgatgtccaggagcagtccatggagactgtccaggttcacgaccagctagattctaaggtcgtgcacacagaaccatactggattaatgtacctccgttttagtattagcccattacatcaaaaaaaaaaaaaaaa

SEQ ID NO: 1477 - DNA, 1339 bp, Zea mays
caagattagagatccattagctgtagcacctctgcctcccacgaatcgattcgacgacatcttgctgcaggtacaacctaccatcatggtgggcatgctattgaacgccggccgcagcaatggccgcggcggcaggaggactagcatccagtcaccaccgcaggtcctctcctctgttcccttactcgtctacgagtacgaggatcccgccgttgttcatccagcaggctctactcctaccgctgccgcaaagatgctcatgtacagcctgcctgagcggagcatcgtctacacgcacgacagcaggcctcaggccatggagggcaacttcttcagcacgcctcaaggctggctggtcatccttggacaagtgacgtcggaggcctccatgtggcatccgctcaccggggagaccatcaccctcccacccatacacgacgaccactacatccccaccaactgcaagtgcctgctcacccacaactccgccgcccacccggactgcgccgtggtgctcctcgacgtcgccgatcctctcatgtggttctgccgtgtcaatggcggggctgaccggaggtggggacagcacacctacgacattggcgactacgagttcctcgatgagttccgcaccccctctacgcccaccaagaaagtcattggaagcgtcgccgcgcttaaagggaagctgcatttttgcttcatggaatcgcaccaaaacaggatgtgcgtcgttgacttagatttcccgtccgatcatggccaccctcccaccgtagagttccacgagtttgatgtctccccagagttcggcatcaagtttcctgacggcatctgctccatccacttggtagagtccatggacgagctttttgccgtctgcgtcttctatgtcggttttgatcccaccaacgtcagtgctgctcgaatcttcaagatggaggactcctgcggcgaggaaaccgtggcctggcaccgggtggatgatatcggtgacagggcttttctcttgaccggcaccaacatggcaacttggtgctctgcaagcaccaataacctgaaaggcagcaccctctatttcttcttagacttcttacttggcgacagggatctatacatctatgatgtccaggagcagtccatggagactgtccaggttcacgaccagctagattctaaggtcgtgcacacagaaccatactggattaatgtacctccgttttagtattagcccattacattatattctactcttttagttaatatagcttcctgctactcttttagttaatattgattcagtaaaaataaataaataatttgctccggttttggcact

SEQ ID NO: 1478 - DNA, 1483 bp, Zea mays
cgcgcagaaattgcctcctgattttgtgcgtggttgtttgggcggggagtgcaattccccgattcgagcggaactcctcccatccgatccggcggcggatgactatataaagcgagccaatctgcatctagctgtagcacctctgcgtctcaagatttggagatccattagctgtagcacctctgcctcccacgaatcgattcgacgacatcttgctggtacaacctaccatcatggtgggcatgctattgaacgccggccgcagcaatggccgcggcggcaggaggactagcatccagtcaccgccgcaggtcctctcctctgttcccttactcgtctacgagtacgaggatcccgccggctctactcctaccgctgccgcaaagatgctcatgtacagcctgcctgagcggagcatcgtctacacgcacgacagcaggcctcaggccatggagggcaacttcttcagcacgcctcaaggctggctggtcatccttgggcatggagaagtgacgtcggaggcctccatgtggcatccgctcaccggggagaccatcaccctcccacccatacatgacgaccaccacatccccaccaactgcaagtgcctgctcacccacaactccgccgcccacccggactgcgccgtcgtgctcctcgacgtcgccgatcctctcatgtggttctgccgtgtcaatggcggggctgaccggaggtggggacagcacacctacgacattggcgactacgagttccccgatgagttccgcaccccctctacgcccaccaagaacgtcatcagaagcgtcgccgcgcttaaagggaagctgcatttttgcttcatggaatcgcaccaaaacaagatgtgcgtcgttgacttagatttcccgtccgatcatggccaccctcccaccgcagagttccacgagtttgatgtctccccagagttcggcatcaagtttcctgacggcgtctgctctgccagcatccacttggtagagtccatggacgagctttttgccgtctgcgtcttctatgtcggttttgatcccaccaacgttagtgccgctggaatcttcaagatggaggactcctgcggcgaggaaaccgtggcctggcaccgggtggatgatatcggtgacagggcttttctcttgatgggcaccaacatggcaacttggtgctctgcaagcaccaataacctgaaaggcagcaccctctacttcttcctccacttcttacttggcgacagggatctatacatctatgatgtacaggagcagtccctggagactgtccaggttcacgaccagctagatttgaaggtcgtgcacacagaaccatactggattaatgtacctccgttttagtattagcccattacattatattctactcttttagttaatatagcttcctgctactcttttagttaatattgattcagtaaaataaataaataatttgctcccgttttggcact

SEQ ID NO: 1479 - DNA, 1423 bp, Zea mays
ctagagccttcgtcgcagagaccttgcgggccatcgccattgcagagagagagagagagagagagagagagagccgccgcacccagaattcgccgacgccgccggagattttatctcgccgccgttccacacacaccgcgacgtggacagccagcaccgctgttattcttgaaccacggtaccgtaccgtcatgggcatgttgatgaacaacgacgacagcagcagcagcaggactagcatgcatccacggccgcaggtccttgcttccctgcccttgctggtctacgaatacgaggatcatcccaatgccacaacaaggatgctcatatatagcctacccgagcggagcattgtctacacgcacaacagcagtaggccccagatgatgatgatggagggtaacttatccttcagcacccctcaaggatggctggtcatccttggacaagcgtcagaggcctcgatctggcatccgctcaccggagagaccatcacgctcccaccaatacacggcgaccaccgtatccccgatagctgcaagtgtctgctcacccgcagctccgtcgcccacccggactgcgccgtcgtgcttctcgacgtcaacgatcctctcatgtggttctgccgggtgaatggcggggccgacaggatgtgggtgcagcacgcctacgacattggcgaccactacttccccgaggagttccgcactccctccacgcccaccaagaatgttgtcgacgacgtcgccgcgctgggagggaagctgtattttcgcttcaccgaatcagaccaagacttcatgggcgtctttgacttcgatttccatggccatactcccgccgtggagttttacgagtttgatgtctccgaagagttcaacctcaagtttcccgagggcgtgtgctctgcctccatccacttggtggagtccatggatgagctttttgctgtctgcatcttctatgtcgattttgatcccaccaacattagcgccgctcatatcttcaagatggaggaaatctgcgacgaggaacccgtggcctggcaccgggtggatgatattggcgacagggctttcctcctgacgggcaccaacatgtcaacttggtgctctgcaagcacgaataacctgaaagggaactccctctactttctaggccacttagtagctggccacaggaatctctgcatctatgatattcaggagcaatccatggagattgtccaggttcacgaccaagaagatatggagatcgtgcgcacaccgccatactggattaatgtacctccgtgctagtattagcctattacaatgtaatttgcttaattaatgtagcttgcttgctagctagtgctatttactgctgccactactatatagtatattgaatcaataaaaatagagtttgctcgggtttttgc

SEQ ID NO: 1480 - DNA, 1732 bp, Sorghum bicolor
caagttcttgctcgagtagattcacttcgccactccgttgccaccgccgccgccgccgccggccgcccgatcctttcccgtctgagatggcatccccggcaccggcgtcgcttaaggacaccgtgggcagcctcgaccgcgacggcttcgtcggcctcctctccaagctgatcggcgagaccgcgcacctgcagaacgacccgccgacccacaggcctcaggaggagcgcgtggcgcagcacgtcgtcgacgtgctccgcccggtgtccgcggacaccgggggcggccctctcctcgtgcggaagatcagctacgtcgagggcaggagcaacgtcatcgtcgagtaccccggcaccgtccccggccgcgttgtctccttcgtcggcatgcacatggatgtcgtccctgccaacgccagcgagtgggactttgatcctttctcactaacctttgatagcgaggataaggacaagctttgcggacgtgggacaactgactgtcttggacatgttgcactggtggctcagctaatgcggcggcttggtgaggtcaagccacccttgaagcattctgtcatcgctgtgtttattgccaacgaggagaactcatctgtcactggcattggtgttgatggcctcgtgaaggatggattgcttgacaagctcaagacaggacccttgttttggatagatacagctgataagcagccgtgcatcggcactggtggaatgattccatggcatctcatggcaacagggaagctgttccacagtggccttgcacataaggccataaatgcaatggagatgaacatggaagcgctgaaagtaatccaaaaacggttttacactgacttccctccacacgagaaagagaagctctataagtttgctactccatcgacaatgaagccaactaaatggagctatccaggtggggggcttaatcaaattcccggggaatgcacaatttcaggggatgtaaggttgactcctttctatagcacttctcatgtcatagagaagttgaaggaatatgtagaggacatcaatcagagatttgagacaatacttgatactcgtggtcctgtgtccaaatatattcttcctgatgaaaatctacaaggaaggcttgaaatcacttttgatggagatgtgatgaatggggtggcttgcaatctggagtctcgaggctatcatgcattatgcaaagcaaccaaggaaatagttggccaagtggagccatattccatcaccgggagtctacctctgattcgggaattacaggatgaaggatttgatgttcaaacagctggatatggcttactgaagacgtaccatgcgaagaatgagtactgcctgttttcagacatggcccagggctttgaggtgtttctgagcatcatttcacaactggaagaagaggtctgagccttcttgctgggatagaccaatacctccaatttaaattactcgttgctcagtgatatctgtttgtaactcttatcaagaggccgcgacacggacatctaacaataagattagttggccttcgagcgtctgtttcacgttgagactggagacatttcacctttgtgcaattgttctgcaactctacggtagctgcaagagaggtgggcgtttggacttcatgtctataccagtccctatgacctaaagaaagtcaattctattttttccctagtcaaatcatgataaattttattgaaatt

SEQ ID NO: 1481 - DNA, 1782 bp, Zea mays
gcagtcacgccctccgcaaaactcccccactccacgcccggccgcacctctcctatcttgctccaagtagcaagttccaactcgagtagattcacttcgccactccgttgccctctcctccgccgcccgatcctttccccgtctgagatggcatctccggcatcggcgtcgcttaaggaagccgtgggcagcctcgaccgcgacggctttgttggtctcctctccaacctcatcggcgagaccgcacacctgcagaacgacccgccgacctacaggcctcaggaggagcgcgtggcgcagcacgtagtcgacgtgctccgcccggtgtccgcggacaccgggggcggccccctccttgtgcggaagataagctacgccgagggcaggagcaacgtcatcgttgaataccccggcaccgtcccaggccgcgttgtctccttcgtcggcatgcacatggacgtcgtccctgccaacggcagcgagtgggactttgatcctttctcactaacctttgatagcgaggataaggacaaacttcggggacgtgggacaaccgactgtcttggacatgtcgcactggtggctcagctaatgcggcggcttggtgaggtcaagccacccctgaaacattctgtcattgctgtgttcattgccaatgaggagaactcatctgtcactggcattggtgttgatggcctcgtgaaggatggattacttgacaagctcaaaacaggacccttgttttggatagatacagctgataagcagccatgcattggcactggtggaatgattccatggcatctcaaggcaacagggaagctgttccacagtggccttgcacataaggccataaatgcaatggagatgaacatggaagcactaaaggtaatccaaaaacggttttacactgacttccctccacatgagaaagagaaggtctataaatttgctactccatctacaatgaagccaactaaatggagctatcctggcggggggcttaatcaaattccgggagaatgcacaatttcaggggatgtaaggttgactcctttctatagcacttcgcatgtcatggagaagttgaaggaatatgtagaggacatcaatgagagatttgaaacagtacttgatactcgtggtcctgtgtccaaatatattcttcctgatgaaaatctacaaggaaggcttgaaatcacttttgatggagatgtgatgaatggggtggcttgcaatctggagtctcgaggctatcatgcattatgcaaagcaaccaaggaaatagttggccacgtggagccatattccatcaccgggagtctacctctaatccgggaattacaggacgagggatttgatgttcaaacagctggatatggcttactgaagacgtaccatgcgaagaacgagtactgtctgttttcagacatggcccagggctttcaggtgtttctgagcatcatttcacagctggaagaagaggtctgagccttcttgatgggatagaccaatactccctccgtttcgttttagttgtcgctggatagtgcaaaattgaactatccagcgacaactaaaaagaaacggagggagtacctccaatttacattactcgktgctcagtgatctgtttaatacctccaatttacatcactggttgctcagttgtctgtttacaactcttttcaagattccgggacacggacatctaacaagccttcgaggttgtctgtcacccgttgaaaacggagccatttcaccacaaaaaaaaaaaaaaaa

SEQ ID NO: 1482 - DNA, 1711 bp, Oryza sativa Japonica Group
gacggagaagtagtttgggaaggtgttttctctcactcaatctcccagcaacgaatagcaacctaggttcccatcgcaactgaccgatccccagccgccgccgccgccgccgccgccgctcaaggaagcgcatcagatggcatcgccgtcgctcagggacgccgtgggcggcctcgaccgcgaccccttcgtctccctcctcgggaagctcatcggcgagtcccgccgcctgcagaacgacccgccggccctcgtcccgcaggaggacctcgtggcgcagcacgtggtcgacgcgctcctcccggtgtccatggagaccgggggcggcccgctcgtcgtgcggaaggtgagctacgccgagggccggagcaacgtcatcgtcgagtaccccggcaccgtccccggccgcgccatctccttcgtcggcatgcacatggacgtcgtccccgccaaccccgacgaatgggatttcgatcccttctcactaacgtttgacagtgaagacaaggacaaacttaggggccgtgggacaaccgactgccttggccatgtggcgctggttgctcagctcatgaggagacttggtgaggtcaagccggtgctgaaacattcggtcattgcggtgttcattgccaatgaggaaaactcacttatcactggcattggtgtcgatggccttgtgaaggatgggttgctggataagctcaagaatggacccttgttttggatagatacggccgataagcagccttgcatcggcaccggtggagtgattacatggcatctgaaggcaattgggaagctattccacagtggcctcgcacataaggccataaatgccatggagttaaatatggaagcactgaaagaaatacagactatgttttacaacgatttccctccacatgagaaagagaagctctataagtttgctaccccatctacgatcaaaccaacaaaatggagctatcctggtgggggtctgaatcaaattcctggagaatgtacaatttcaggggatataaggttgactcctttctacagcacgacatctgtagtgaagaaattacaagagtatgtacatgatataaatgagaacattgaaaagcttcctactcgtggtccggtatctaaatatgttcttcctgatgaaaacctccgaggaaggcttgagatcactattgatgaagatattatgaatggggtggcctgtaatctcgagtcgcgaggctttcaagcattatgcaaagcaactgaggaaattgtcggccacgtggaaccatattccattactgggagtctgcccctgattagggaattacaggatgaagggtttgatgttcagactgctgggtatggcttactcaagacataccacgcaaagaacgagtactgtctattttcagatatggcccaaggctttcaagtatttctgagcatcatttcacagttggaagcagatgtttgagtcttgttttagggaggaaaaaaatgagcgttcactggtacttattcctgttacttgttgctctaataaaggcactcacagtgcaagctacccaaaatgaggaacctcaggctaaggccacacctcctctcccacggtgcaaagatgctttagggtgttcttagtttttcatgtaaacccttgtcatcttctattctagtcctcacatgttttcaaacaacataacatacaaaatttaccact

SEQ ID NO: 1483 - DNA, 1047 bp, Sorghum bicolor
atgccggccctcgccctgcccacgatggagtcggagctgagcgctctcgcgtgggcgacgctgctcgccccggcgtgcgcggtgtacgcacggttcgccgctcgccgccttcgcccgggcatcccgcgcctggccgcgctcttcccgacgttcccagtgctcgtgtacatgccctggatgttcagctccctccacctgcgcctcttctcctccttcttccacacctggctcgccgtcaacaagctcgtcctcctcgcgctcgacctcggcccactccacccacgcctcccgctcctgccgttcgtcctctgcgccggcctccccatcaaggtctgccgtctcaggcagcagagccagcagcatcctcccggcgccgagttcttgaggccgtgcgcccgcagcgccttgctcctcagctgcctcgccatggcgtacccctacacggggtggctcccgctctacgcgctccactatctctactgcgtccagatcttcctcacgctggacctcgtcttctcctgcgtcatgctcgtctccgcggcgctcatgggcggcgcgagccttgagaggcagttcaacgcgccgctcgccgtcgcgtcgctgaacggcttctggggccggcagtggaacctgatggccgtcgacctcctccgggagtcggcgtacgagcccgtgcgcgctaggtggggacgggacgccggcgtgctggccgcgttcctgatgtcgggcctgctccacgaactcctgtactggtacctgacgctgcagcagcccagaggtgagatgctgctcttcttcatgttccacgccgcgttccagatcgccgagcgatgggccagggcggctggcctgtggcggccgcccagagcggtggcgtacctcgttgtcacggccttcatggtggtcaccgtatcggagatgttcttcgggccatttgtgagagccggcacagacgtgcgcttgaaggaggaaaccatggcggtggtggaactgatttggggtgccaggaagtatctactccgtccgtttagggtgccttcaagctag

SEQ ID NO: 1484 - DNA, 1232 bp, Zea mays
atgatcgatcgatcgaccccgcgcgccagccatgcagatgcaggccctcgccctgcccacgatggagtcggagctgagggctctcgcgtgggcgacgttgctcaccccagcgtgcgcggtgtacgcgcggttcgccgctcgccgccttcgccccggcgtcccgcgcctggccgcgctcttcccgacattcccggtgttcgtgtacatgccctggatgttcaactccctccacctgcgcctcttctccaccttcttccacacctggctggccatcaacaggctcgtcctcctcgcgctcgacctcggcccgctccacccgcgcctcccgctcctgccgttcgtcctctgcgccggcctccccatcaaggtccgtctccagcagccgacgaagaaccaagcgtcgtcgtcgtcgtcgtcgtcgtcaccacccagcgccgagttcctgaggccatgcgcccgcagcgtcctgctcctcagctgtctcgccatggcgtacccctacacgaggtggctcccgctctacgcgctccactacctctactgcgtccagatcttcctcacgctcgacctcgtgttctcctctatcgcgctcgtctccgcggcactcatgggcgcgagcctggagaggcagttcagcacgccgctcgccgtcacctcgctgaacagcttctggggccgacagtggaacctaatggccgtggacctcctccgcgagtcggtgtatgcgcccgtgcgcgccaggtggggccgggacgtcggcgtgctggccgcgttcctaatgtcgggcctgctccacgagttcctgtactggtacctgacgctacagcagcccaggggtgagatgttgctcttcttcatgttccatgccgcgttccagatcgctgagcgacgggccagggcggccgggatctggcggccgcccaggccagcggcgtatctcctcgtcacagccttcatggtggtcaccatatcggagatgttcttcgcgccgttcgtgagagccggcacagacgtgcgcctcaccgaggaaaccacggcgatggtggagctcatttggggtactaggaaatatctgagccatccgtttagggtggcctcaagctagaggcgtaaggtcgatttatggttgctacattgcagggaatcaactcgcagatgagcaattgtatatgtctaatatgatacagtactatattactacatgagtctgaagcataaaaaaaaaaaaaaaa

SEQ ID NO: 1485 - DNA, 1429 bp, Zea mays
acgaattcaattaccgcgatgatggtgctaagtttctgaagcccaccttagatggtgccatatttgcaaaattctcccccgcaggtatataaatacgtgtgttcatcgtattcaataacatgatcgatcgatcgatcccgcgcgtcaaccatgcaggccctcgccctgcccacgatggagtcggagctgagggctctcgcgtgggcgacgttgctcaccccagcgtgcgcggtgtacgcgcggttcgccgctcgccgccttcgccccggcgtcccgcgcctggccgcgctcttcccgacattcccggtgttcgtgtacatgccctgcatgttcagctccctccacctgcgcctcttctccaccttcttccacacctggctggccatcaacaggctcgtcctcctcgcgctcgacctcggcccgctccacccgcgcctcccgctcctgccgttcgtcctctgcgccggcctccccatcaaggtccgtctccagcagccgacgaagaaccaagcgtcgtcgtcgtcgtcatcaccaccacccagcgccgagttcctgaggccatgcgtccgcagcgtcctgctcctcagctgtctcgccatggcgtacccctacacgaggtggctcccgctctacgcgctccactacctctactgcgtccagatcttcctcacgctcgacctcgtgttctcctctatcgcgctcgtctccgcggcactcatggacgcgagcctggagaggcagttcagcacgccgctcgccgtcacctcgctgaacagcttctggggccaacagtggaacctaatggccgtggacctcctccgcgagtcggtgtatgcgcccgtgcgcgccaggtggggacgggacgtcggcgtgctggccgcgttcctaatgtcgggcctgctccacgagttcctgtactggtacctgacgctacagcagcccaggggtgagatgttgctcttcttcgtgttccatgccgcgttccagatcgctgagcgacgggccagggcggccgggctgtggcggccgcccagagcagcggcgtacctcctcgtcacagccttcatggtggtcaccatatcggagatgttcttcgcgccgttcgtgagagccggcacagacgtgcgcctcacggaggaaaccacggcgatggtggaactcatttggggtactaggaaatatctgctccatccgtttagggtggcctcaagctagaggcgtaaggtcgatttatggttgctacattgtagagaatccactcgcagatgagcacttgtatatctctaatactccctccgtttctttttatttgtcgctgaatagtgtaattttacactatccagcgacaaataaaaagaaacggagggagtactatattactacatgagtctgaagcataaaaccattgagtcgaaaaaaaaaaaaaaaa

SEQ ID NO: 1486 - DNA, 1047 bp, Oryza sativa Japonica Group
atggcgtcggagctgagggcgatggcatggacggtgctgctcgtcccggcgtgcgcgtggtacgcgcgctcggcctgccgccgcctacggccaggactgccccgcctcgccgcgctcgccccgacgttccccgtcttcgtctacctgccgtgcctgttcaactccctccacttccgcctcttcagcaccttcttccacacctggctcgccatcaacaagctcgtcctcctcgcgctcggcatcggcccgctacacccgtccctccccctcgtcccgttcgtcctctgcgccagcctccccatcaagctccgcctcagccagcagccgcccgccgccaagcgttctccttcgtcgccgccgccaccgcccctcgctgacttcctccgtccctgcgcccggagctttttcttcctcagctgcctcttcgtggcgtacccgcacacgggctggctacccgtgtacgccgtccacttcctatactgcgtccaggtcttcctcacgctcgacctcgtcctctcctccgtcgcgctcgcctcggcgaccgtcctggacgccggcctggagaggcagttcagcacgccgctcgccgtcgcgtcgctgaacgacttctgggggcggcagtggaacctgatggcggtggacctcctccgggcgtcggcgtacgagcccgtgcgcgcgcggtggggccgcgacgccggcgtgctggcggcgttcctcatgtcgggcctgctccacgagctcctctacctgtacctgacgctgcggcggcccaggggggagatggtgctcttcttcatgctccacggcgtgtcccagatcgccgagcgctgggccagggcggccgggctgtggcggccgcccaaggtggcggcgtacctcctcgtcagcgccttcatggtcgtcaccatatcggagctcttcttcgggccgttcatgagggccggggccgacgtgcggctgatggaggaggccgcggcgatgctgcagttgatcatgggcgtctcgaggcgtctgctccgaccgtttggggtggtttcgagcctctaa

SEQ ID NO: 1487 - DNA, 1504 bp, Hordeum vulgare subsp. vulgare
tggggctactcattaattgactccgtggcattggcatccgcaggctcatcgatcgctccgatcactgccggccggctcgcaccgcgtacccgtggcgctcgccatgcaagccctcgggcaccccacctctgcgtcggaactgagggcgctcgcctggacgacggtccttgttccgatgtgcacggtgtacgcgcggtccgccagccgccgcctccgtccgggctggccccgcctcgccgcactcctgccgacgttccccgtcttcatctacctgccgtgcatgttcaactccctccacctccgcctcttctcaaccttcttccacacctggctcgccgccaacaagctcgtcctcctcgcgttcgacctcggcccgctccacccatccctcccgctcctcccgttcatcctctgcgccggcctccccatcaagctccgcgccggtccgcagcctaccgagcagtctgcgccgccaggaccgcccgtcgccgatttccttgtcccctgcggtcgcagcgttctcttcctcaccggcctcgcgctgctcttcccacacactggttcgctccctctctacgtcgtccactacctctactgcgcacaaatcttcctcacgctcgatctcgtcttctcttctgtcggcctcgtcgccgctgccgtgctgggctcggccatggagaggcagttcagagcgccgctcgtcgtcgcgtcggttaacgacttctggggccggcagtggaacctgatggcggtggacctgctccgagcgtcggcgtacaagccggtgggagcacggtggggccgggacgctggcgtgtttgccgcgttcctcatgtcgggcgtcctgcacgagctgctctactggtacatgacgctggagccgcccacgggcgagatgctgctcttcttcacgctccaggccgtgttccacgtcgccgagcggtgggcgagggtggccggcctgtggcgaccgcccaaggcggtggcgtaccttgttggcaccacccttatggtcgtcaccatatcggagctcttcttcgggccgttcatcagagccggcatagacgtgcgtatgattcaggaggctgccgaggcggtggagttggttagaggcgtcgctaagcgtctcatcgtccgtctatttggggctggttcaaattaggggtaaaagagtgggggataataacattcagctgtcacgataattagctccatatatgtagtctctcgggcttttcttacgaataatgctacatctacaaaggcttacttaaagatcttacatacaaactgatgtgtaggattataattggtcattgggggatgagggccccatcctcattaaaaatcagggacgaaaaaaaaaattagttttaaaggttaagtaaacctttgtaagtttttgtaggtgtagcattattgttttcttactgttaagattaattaacattgtaattaagggattaatccctgcttgtaataacagttggcaattgttttctgc

SEQ ID NO: 1488 - DNA, 1640 bp, Sorghum bicolor
ctccccgcgacgacgcttcccgagctctctcctctgttccctctcatccccgcgattctcctctgccgctctccgctagggttttgccgccgacctctcgctcgctcgctcccggctccgcgaggcaaccgtccggccggtcgaaatggtggatgtggaggaggtcgggaacaagatgcaatcgcagatgcgcctgcacgccgagccggaggacgacgccgccgccgacctccccctgccggccctcttcgacagggcgtcgcggatccacgccctcgcctccagctccgccctcgaccaggatgggatccgcacgggggttgatctgctgcggcgctgcgacgagatggtcagcaagctcggccttttctcccccaacgagaccaaggaagacgtctccaccgcaaacctcaagtacctactcgttccatattaccttgcggaaatgactgagaagatagcacaagaggatcggatcccggttcttaaggcgtcacaggaccacttgaaggaattcattgctctatgtgaagtactagagcttattccagaggatgagctagaattgtctaggcagaagcagcctgatactatggcaaacaggagagcacagaaggttgcccggttcaaacgtcaaaaggctgcagaaacgaagctccaagagatcagagagagaaaagaaaggcgtggacgctcattgagagcagctgctttatctgccccaattgaagctggagaggaagatgacctggaggatgatggagaggaagaaagagaggcttggttagctaccatctcattggctctctgcaaggcgtttgatcttctcgacatgctaaagaaggaagaagaaatgcttctagctgtaaaggaaaggaaggcaaaggacgggaatgcatttgctcgtgaaatgctcgatgaacgaacaaagaaggctgaagcatggcaccacaatgctgccaaccgtgtggtatattccaaaccagctgatccaatcacttgcgcaacatttgctcaagatgtcattgaaggtagagcaagcgtttcacaagctcacgagcacaaacaccagcccctgatatttggacctgcaagtcttgttggtggtggtctaaccagtgaaagggaaagaatggcagcacaagtttttcagcctagttacaggatgccaacaatgagcatagaagaagctggtttgcgcgagatgaaaataatggagaaatggcaggaaaggaccgccgagataatgaaagaagcaaactccgcgtggcacaaggatggcaccagctcggcccaagaggacgaggacgccgaggaggcgaaagcaagagcgtgggacgactggaaggatgacaacccccgtggcgcaggcaacaagaagctcacgccctgtggctaatttgtgaaacgcgcgctgtatcgataaatacttcacatggaacacgatgctcatgtagatcatacgatgtttgatttgatcaatatttagtctgcgtcttttctagtgatgttcagtgtattatagcctgtttgtgtaagtgctatatgtcctttccagtacgatgcatttttctggagcatgagaaaccgtattcccgtatgcaactgtcatgcagctcggtgctgtctggctgcttctg

SEQ ID NO: 1489 - DNA, 1470 bp, Zea mays
ccgaccggtcggaatggtggatgtggaggagaccgggaacaagttgcaatcgcagatgcgcctccacgcggagccggaggacgacgccgccgacctccccctcccggccctcttcgatagggcgtcgcggctccacgccctggcctccagctccgctctcgaccaggatgggatccgcacgggggttgacctgctgcggcgctgcgacgacatggtcagcaagctcggcctcttctcccccaacgagaccaaggaggacgtctccacagcaaacctcaagtacctactggtcccatattaccttgcagaaatgaccgaaaagatagcacaggaggatcggatcccggttcttaagacgtcacaggaccatctgaaggagttcattgctctatgtgaagtactagagcttatcccagaggatgagctagaattgtctaggcagaagcagccagatactatgacaaacagaagagcgcagaaggttgcccggttcaaacgtcaaaaggctgcagaaacgaagctccaagagatcagagagagaaaagaaaggcgtggacgctcattgagagcagctgctttgtctgccccaattgaagctggagaggaagatgacctggagaatgatggggaggaagaaagagaggcttggttagctaccatctcattggctctctgcaaggcatttgatcttctcgacatgctaaagaaggaagaagaaatgcttcaagctgtaaaggaaaggaaggcaaaggatgggaatgcatttgctcgtgaaatgctcgatgaacgaacgaagaaggccgaaacatggcaccataatgctgccaaccgtgtggcatattccaaaccagctgatcctatcacttgtgcaacatttgctcaagatgtcattgaaggtagagcaagcgtttcacaagctcacgagcacaaacaccagcccctgatatttggacctgcaagtattgttggtggtggtctaaccagtgaaagggaaagaatgacagcgcaagtttttcagcctagctacaggatgccaacaatgagcattgaagaagctggtttgcgcgagatgaaaatgatggagaaatggcaagaaaggaccgctgagctgatgaaagaatcaacctccgcgtggcacaaggatggcagcagctcggcccaagaggatgaggacgccgaggaggaaaaagcaagagcgtgggacgactggaaggatgacaaccctcgtggcgcaggcaacaagaagctcacgccctgtggttaatttgtgaaacacgctgtgtattgatactccacatggaacatgatgctcatgtagacggtaggatgtttaattttatcattgttgctgtgttttttctgtagtgatgttgagtgtatcgtagcctgtttgtgcaagtgcgatatgtcctccctaatacgacacgtttttctggagccaaagaaatcgtatgcctgtctgcaattgtc

SEQ ID NO: 1490 - DNA, 1607 bp, Zea mays
attatttttttaataaatcttcccaggcgtccagcgtcctcccggcgacgacgcttcccgagctctctccttcccgcgaccctctcctctgccccgctccgctagggttttgccgcagacctctcgctcgcttccggttccgcgaggcaaccgtccgaccggtcggaatggtggatgtggaggagaccgggaacaagttgcaatcgcagatgcgcctccacgcggagccggaggacgacgccgccgacctccccctcccggccctcttcgatagggcgtcgcggctccacgccctggcctccagctccgccctcgaccaggatgggatccgcacgggggttgacctgctgcggcgctgcgatgacatggtcagcaagctcggcctcttctcccccaacgagaccaaggaggacgtctccacagcaaacctcaagtacctactggtcccatattaccttgcagaaatgaccgaaaagatagcacaggaggatcggatcccggttcttaagacgtcacaggaccatctgaaggagttcattgctctatgtgaagtactagagcttatcccagaggatgagctagaattgtctaggcagaagcagccagatactctgacaaacagaagagcgcagaaggttgcccggttcaaacgtcaaaaggctgcagaaacgaagctccaagagatcagagagagaaaagaaaggcgtggacgctcattgagagcagctgctttgtctgccccaattgaagctggagaggaagatgacctggagaatgatggggaggaagaaagagaggcttggttagctaccatctcattggctctctgcaaggcatttgatcttctcgacatgctaaagaaggaagaagaaatgcttcaagctgtaaaggaaaggaaggcaaaggatgggaatgcatttgctcgtgaaatgcttgatgaacgaacgaagaaggccgaaacatggcaccataatgctgccaaccgtgtggcatattccaaaccagcggatcctatcacttgtgcaacatttgctcaagatgtcattgaaggtagagcaagcgtttcacaagctcacgagcacaaacaccagcccctgatatttggacctgcaagtattgttggtggtggtctaacaagtgaaagggaaagaatgacagcgcaagtttttcagcctagttacaggatgccaacaatgagcattgaagaagctggtttgcgcgagatgaaaatgatggagaaatggcaagaaaggaccgctgaggtgatgaaagaatcaacctccgcgtggcacaaggatggcagcagctcggcccaagaggatgaggacgccgaggaggaaaaagcaagagcgtgggacgactggaaggatgacaaccctcgtggcgcaggcaacaagaagctcacgccctgtggttaatttgtgaaacacgctgtgtattgatactccacatggaacatgatgctcatgtagacggtaggatgtttaattttatcattgttgccgtgttttttctgtagtgatgttgagtgtatcgtagcctgtttgtgcaagtgcaatatgtcctccctaatacgacacgtttttctggcaaaaaaaaaaaaaaaa

SEQ ID NO: 1491 - DNA, 1644 bp, Zea mays
cgcgaagacgcttcccgagcttctccttcgttcctcctcttccccgcggctctcctctgccccgcaccggcaccgctagggttttgccgccgacctctcgctcgcttccgggctccgcgaggcaaccgtccggaccggccggtcgaaatggtggatgtggaggaggtcgggaacaagatgcaatcgcagatgcgcctgcacgcggagccggatgacgccgccgccgacctccccctcccggcgctcttcgacagggcgtcgcggcttcacgccctggcctccagctccgccctcgaccaggatgggatccgcaccggggttgagctgctgcggcgctgcgacgagatggtcggcaggctcggtcttttctcccccaacgagaccaaggacgacgtctccaccgcaaacctcaagtacctactcgtcccatattaccttgcggaaatgaccgagaagatggcgcaggaggatcggatcccggttcttaaggcgtcgcaggaccatttgaaggagttcattgctctatgcgaagtactagagcttattccagaggatgagctagaattgtctaggcagaagcagtctgatactatggcaaacagaagagcacagaaggttgcccggttcaaacgtcaaaaggctgcagaaacaaagctccaagagatcagagagagaaaagaaaggcgtggacgctcattgagagcaactgctttgtctgccccagttgaagctggagaggaagatgacctggaggatgacggggaggaagaaagggaggcttggttagctaccatctcattggctatctgcaaggcttttgatcttctcgacatgttaaagaaggaagaagaaatgcttctagctgtaaaggaaaggaaggcaaaggacgggaatgcatttgctcgtgaaatgctcgacgaacggacaaagaaggctgaagcatggcaccacaaagctgccagtcgtgtggcgtattccaaaccagccgatccgatcacctgtgcaacatttgctcaggatgtcattgaagggagagcgagcgtttcacaggcccacgagcacaaacaccagcccctgatatttggacctgcaagccttgttggcggcggtctgaccagtgaaagggaaagaatggcagcgcaagtttttcagcccagttacaggatgccaacaatgagcatagaagaggctggcttgcgcgagatgaagatgatggagaggtggcaagagaggaccgccgagatgatgagagaagcaaactccgcgtggcacaagggcggcgacagcagcagcagctcgatgccgcaaggggagggcggggacgaggatgccgaggaggccaaggcacgagcgtgggacgactggaaggacgacaaccctcgcggcgctggcaacaagaagctcacgccctgtggctagactgcaaatcgaagcacgctcgctgtgtgatcgtacggtgtttgactcgaccagtatttagtttgtatctgacgatcagtgtatttattatataggctgcttctgtaacagtgtgtttatacaccatccactgcagcttcttcacacaggtgtttccgaagttaactgggttagacaaactgtgttgtccaagcaagagtatctaacaaatagctacgtaacttt

SEQ ID NO: 1492 - DNA, 1257 bp, Oryza sativa Japonica Group
atggtcgaggtggaggaagtcagcaacaagatgcaggcgcagatgcgcctccaccccgcggcggcggcggaggaggaggacgccgacctcccgctccctgccctcttcgacaaggcgtcccacctccactccctcgcctccagctcctccctcgatcaggaagggatccgcaagggggtcgacctgctgcggcggtgcgacgagatggtcagtaagctcggcctcttctcctccaacgagaccaaggatgacgtctccactgccaacctcaaatacctactcgtgccgtactaccttggggaaatgactgaaagggtagcgcaggaagatcggatcccagtccttaaggcgtcgcaggatcatttgaaggaattcatttctatctgtgaagcactggagcttatatcagaggatgagcttgaattgtctaggcagaagcaacctgataccatggcaaatcgaagagcacagaaggttgcacggttcaagcgccaaaaggctgcagaaacaaagctcctagaaatcaaggagaggaaagaaaggcgtaggcggtcattgagagcagctgctttatcagctcctattgaagctggggaggaagatgcttttgaggatgatggagaggaagaaagagaggcatggttagctactatctcattggctctatgcaaggcttttgaccttcttgacatgttaaagaaggaagaagaaatgcttctggcagtaaaagaaaggcaagcgaaggatggtaatgcatttgctcgtgaaatgcttgatgaacgtacaaaaaaggctgaagcatggcaccataatgctgccaaccgtgcaccatattccaagccagctgatccaatcacttgtgcaacatttgctcaagatgtcattgaaggtagagcaagtgtttcacaagcacatgagcacaaacaccagccgctgatatttggccctgcaagtcttgttggtggaggactaaccagtgaaagagagagaatggcagcacaagtttttcagccaagttacaggttgccaacgatgagcatagaagaagctggcttacgtgagatgaaaatgatggagaaatggcaagaaagaactgctaagatgattcaagaatcaaactccgcatggcacaaggatggcagtcggtcagcccaagaggatgaggacgctgaagaggagaaagcaagagcatgggatgactggaaggacgataaccctcgtggtgcaggcaacaagaagctcactccctgtggctag

SEQ ID NO: 1493 - DNA, 1257 bp, Oryza sativa Japonica Group
atggtcgaggtggaggaagtcagcaacaagatgcaggcgcagatgcgcctccaccccgcggcggcggcggaggaggaggacgccgacctcccgctccctgccctcttcgacaaggcgtcccacctccactccctcgcctccagctcctccctcgatcaggaagggatccgcaagggggtcgacctgctgcggcggtgcgacgagatggtcagtaagctcggcctcttctcctccaacgagaccaaggatgacgtctccactgccaacctcaaatacctactcgtgccgtactaccttggggaaatgactgaaagggtagcgcaggaagatcggatcccagtccttaaggcgtcgcaggatcatttgaaggaattcatttctatctgtgaagcactggagcttatatcagaggatgagcttgaattgtctaggcagaagcaacctgataccatggcaaatcgaagagcacagaaggctgcacggttcaagcgccaaaaggctgcagaaacaaagctcctagaaatcaaggagaggaaagaaaggcgtaggcggtcattgagagcagctgctttatcagctcctattgaagctggggaggaagatgcttttgaggatgatggagaggaagaaagagaggcatggttagctactatctcattggctctatgcaaggcttttgaccttcttgacatgttaaagaaggaagaagaaatgcttctggcagtaaaagaaaggcaagcgaaggatggtaatgcatttgctcgtgaaatgcttgatgaacgtacaaaaaaggctgaagcatggcaccataatgctgccaaccgtgcaccatattccaagccagctgatccaatcacttgtgcaacatttgctcaagatgtcattgaaggtagagcaagtgtttcacaagcacatgagcacaaacaccagccgctgatatttggccctgcaagtcttgttggtggaggactaaccagtgaaagagagagaatggcagcacaagtttttcagccaagttacaggttgccaacgatgagcatagaagaagctggcttacgtgagatgaaaatgatggagaaatggcaagaaagaactgctaagatgattcaagaatcaaactccgcatggcacaaggatggcagtcggtcagcccaagaggatgaggacgctgaagaggagaaagcaagagcatgggatgactggaaggacgataaccctcgtggtgcaggcaacaagaagctcactccctgtggctag

SEQ ID NO: 1494 - DNA, 3560 bp, Oryza sativa Japonica Group
aagggatccgcaagggggtcgacctgctgcggcggtgcgacgagatggtcagtaaggtcggcctcttctcctccaacgagaccaaggatgacatctccaccgccaacctcaaatacctactcgtatgtttgtttcctgcactacatctgcgtttatattcgtttctcttaccgtatcatgtttgtgcatctgcgacatgtggttatatctgtgattccgattgattttcttcaggtaccgtactaccttggggaaatgactgaaagggtagcgcaggaagatcggatcccagtccttaaggcgtcgcaggatcatttgaaggttatatcagtttgtcctgtcacatttagttgatttggtgcatatttgtcatgtctttcttatgcccttttcaattgggagcactctgtcatcacaacactcatgtttctcatgttttaatcactacggttacacaggaattcatttctatctgtgaagcactggagcttatatcagaggatgagcttgaaatatctaggcagaagcaacctgataccatggcaaatcgaagagcacagaaggtgagccttgacgaaatatttttctcaaatatgttaaaggggtcatcaatcattctgcaatttacgaacacaataaactgggatccaaatctattattgagactgcaaaatctgggactcataatctgcttgaccttttccaaagtcggttaatttccactctaattttcttgtttgccgaacctaggttgcacggttcaagcgccaaaaggctgcagaaacaaagctcctagaaatcaaggagaggaaagaaaggcgtaggcggtcattgagagcagctgctttatcagctcctattgaagctggggaggaagatgcttttgaggatgatggagaggaagaaagagaggttagcagttagcaccaggcatttagaacccatttacgtagcaaatctgatcttgtttaccaaatggaaacatcgtgatatattcttaaattaccacatagcatatttgaaaataccccaaactaaaattagctacaatgtactagaagtggaagaagaatatttactttttccagaaaagagaaggaaaggaaaggctttgttctgttcaataaaagatggaatttgacaaatttgatgattcaagataagttttaaaaaatcccatagggaactgatcacatttcctgaattgacccatttttgttcaaatgaaacacacagcgtatttattctgtactggcagattgtcaccaccaatctttttcctgtaacaatatgatgctcattgcctttcctgtgctttttatatacgatctcttacttttgtgggcaatcaaccttttgggatctgtcgatgtgtgcttccaaagtttgggttccatgccatgcctgtcataactcactttgatgtacaaatgataaatggttatgccgtggttttgattctttttttttttgttctatgttgcaggcatggttagctactatctcattggctctatgcaaggtttgtgttttatgggcaagaatgattctcttatactgcttgggatgtttatttgcattcttttaagctactgtgctcgctttggttatcctgatcatcagacgcactcatttctacttcattttataggcttttgaccttcttgacatgttaaagaaggaagaagaaatgcttccggcagtaaaagaaaggaaagcgaaggtaaaacaaatgaataaagtttgccaatttctcgtcaatagtatctttggttgatcctttccagtatcatattggccttttaacttttcttctataaccgttctgtacatttctggttgtgtttttactgatacaattattgaacttcgctttgccttgagcttatgttgtagtagagcttaccttcaccaagtagaccatgaccaagtaggtagctggatagttgtatacagtaattctgtttgaaaaaaattatacaccggattctgagttaggagatacaattaaattaattgtcataatatgataataacttgccattgcaagtatttcatcacacttctctctctctctctctctctctcagtgtctgcagagtgctgagtgttttgttgttactacatgcaagtaatattagatgtttgattttgttttcatgatccttttatagcactcgatggtagatgttctaccgtaagaaaaaaacaattagatttttttttatctttgcttcctttgtgttgcatgtctgtttcaataaattctgcacttacatggaggtttcctttagtaatgaaataatttcctgctcatgatgttttaggatggtaatgcatttgctcgtgaaatgcttgatgaacgtacaaaaagggctgaagcatggcaccataatgctgccaaccgtgcaccatactccaaaccagctgatccaatcacttgtgcaacatttgctcaagatgtcattgaaggtagagcaagtgtttcacaagcacatgagcacaaacaccagccgctgatatttggccctgcaagtcttgttggtggaggactaaccagtgaaagagagagaatggcagcacaagtttttcagccaagttataggtatgctttaaaatactactacatacctggctgaaactgcactgcttctttttattgtgatggtgaacttcggttatggcagaatgtggaggggcattatttgtggcaacctttaatgcatcatactagtcatactttgatatatttgtaggaactttgacctcctttttcgttgagcattactcgatgagcaaattatttcttggtaaatttgtaaagtggtcctttacattgtatttgcttcaccacattagtatgtgaccatgtttattcaatcgtaggtgtttccttgtcctgttgttgcatgttctgccataagtccgtgacaaattcgtggtttacactgttgatatcattcatttttttcatgctggaaaggcaccatgtttaaatttgctattcagtgcaatactagattcactgacaataaactgttgtcttgtactctgttgtgactacgaacacttggtgcaatcgtatagatgctgagatagtgattcgtaggtgtgaccttatgtttagtcataatctatgaaaaattccaagaaatgatactattctgctgcaatttctacatttgctcataaaaaacattagatttcccctgcagcaattaagtgttgagctatagatcatctctattaaagtgatcttgcattgttcagtcctaaaagttagtgaaaatatgcatatgagactatcctttgatccaataattcttaggttgccaacgatgagcatagaagaagctggcttacgtgagatgaaaatgatggagaaatggcaagaaagaactgccaagatgattcaagaatcaaactccgcatggcacaaggatggcagtcggtcagcccaagaggacgaggacgccgaagaggagaaagcgagaggatgggatgactggaaggacgataaccctcgtggtgcaggcaacaagaagctcactccctgtggc

SEQ ID NO: 1495 - DNA, 1759 bp, Zea mays
tgaataccagtatccgcagtgtaaaagcttcattttattacaaaaaaaaaatcttcgtcctccccgcgaagacgcttcccgagcttctccttcgttcctcctcttccccgcggctctcctctgccccgcaccggcaccgctagggttttgccgccgacctctcgctcgcttccgggctccgcgaggcaaccgtccggaccggccggtcgaaatggtggatgtggaggaggtcgggaacaagatgcaatcgcagatgcgcctgcacgcggaccggatgacgccgccgccgacctccccctcccggcgctcttcgacagggcgtcgcggcttcacgccctggcctccagctccgccctcgaccaggatgggatccgcaccggggttgagctgctgcggacgctgcgacgagatggtcggcaggctcggtcttttctcccccaacgagaccaaggacgacgtctccmccgcaaacctcaagtacctactcgtcccatattaccttgcggaaatgaccgagaagatggcgcaggaggatcggatcccggttcttaaggcgtcgcaggaccatttgaaggagttcattgctctatgcgaagtactagagcttattccagaggatgagctagaattgtctaggcagaagcagtctgatactatggcaaacagaagagcacagaaggttgcccggttcaaacgtcaaaaggctgcagaaacaaagctccaagagatcagagagagaaaagaaaggcgtggacgctcattgagagcaactgctttgtctgccccagttgaagctggagaggaagatgacctggaggatgacggggaggaagaaagggaggcttggttagctaccatctcattggctatctgcaaggcttttgatcttctcgacatgttaaagaaggaagaagaaatgcttctagctgtaaaggaaaggaaggcaaaggacgggaatgcatttgctcgtgaaatgctcgacgaacggacaaagaaggctgaagcatggcaccacaaagctgccagtcgtgtggcgtattccaaaccagccgatccgatcacctgtgcaacatttgctcaggatgtcattgaagggagagcgagcgtttcacaggcccacgagcacaaacaccagcccctgatatttggacctgcaagccttgttggcggcggtctgaccagtgaaagggaaagaatggcagcgcaagtttttcagcccagttacaggatgccaacaatgagcatagaagaggctggcttgcgcgagatgaagatgatggagagktggcaagagaggaccsccgagatgatgagagaagcaaactccgcktggcacaagggcggcgacagcagcagcagctcgatsccgcaaggggaggscggggacgaggatgccgaggaggccaaggcacgagcgtgggacgactggaaggacgacaaccctcgcggcgctggcaacaagaagctcacgccctgtggctagactgcaaatcgaagcacgctcgctgtgtgatcgtacggtgtttgactcgaccagtatttagtttgtatctgacgatcagtgtatttattatataggctgcttctgtaacagtgtgtttatacaccatccactgcagcttcttcacacaggtgtttccgaagttaactgggttagacaaactgtgttgtccaagcaagagtatctaacaaatagctacgtaactacttaaaaaaaaaaaaaaaaaaaaaaaaaaaaaaaagaaaaaaaaaaaaaaaa

SEQ ID NO: 1496 - DNA, 1472 bp, Sorghum bicolor
catccattgtgatacttcagacagacacttcttcttgcctactaagctctcttgtgttcttgccttctgcctgtgctgtgactgatggccagcctcaccgatctcgttaacctcgacctgagtgattgcaccgacaagatcattgccgagtacatctggattggaggatccggcatagacctcaggagcaaagcaaggacggtgaaaggccccatcaccgatccgagccagctgccaaaatggaactacgacggctccagcaccgggcaggctcccggagaggacagcgaagtcatcctctaccctcaagccattttcaaggacccgttcaggaagggcgacaacatccttgtgatgtgtgactgctacacgccacaaggcgagccaatccctactaacaagaggtacaatgctgccaaggttttcagccaccccgacgttgcagctgaggtgccatggtacggtattgagcaggagtacactctccttcagaaggatgtgaactggccccttggctggcctgttggtggataccctggtccccagggaccatactactgcgctgccggtgccgataaggcctttgggcgcgatgtggtcgacgcccactacaaagcctgcctctacgccggcatcaacatcagcggcatcaacggcgaagtcatgcctggccagtgggagttccaagttggcccgtccgttgggatatctgccggtgacgaaatatgggttgcccgctacattctcgagaggatcactgagattgccggaattgttctctccttggacccgaagccaatccagggtgactggaacggcgccggtgcccacaccaactacagcaccaagtcgatgagggaggccggtggctacgaggtgatcaagaaggcgatcgagaagctggggaagaggcacacggagcacatcgccgcgtacggcgagggcaacgagcgccgcctcacgggccgacacgagaccgccgacatcaacaccttcaaatggggcgtggcgaaccgcggcgcgtccatccgcgtgggccgcgacacggagagggagggcaagggatacttcgaggaccgcaggccggcatccaacatggacccctacgtcgtcaccggcatgatcgccgagaccaccatcctgtggaacggaaactgataaagccacggttgttcctcttctgcacaacgctactacgcctgcaatgcacgcatccgctctgatgtcatgtcagtttggttttgcgatttcggttccccgtcgtggggtgtcctaaaattttttacttcggtctccggtgtactgcttggaaagtctgaataatggctgcaaatggattttgctttcgtcataggggtacctagctacctttagctgttctttcctgtttattggatatgtataatgtaatgtaatactattactacgtgattttatatgaaaagaatcattgtcgttttgttcgcgatcac

SEQ ID NO: 1497 - DNA, 1422 bp, Saccharum officinarum
cttcagacagttcttcttgcctactaagctctcttgtgttcttgtcttctgcctgtgctgtgagtgatggccagcctcaccgatctcgttaacctcgacctgagtgactgcaccgacaagatcatcgccgagtacatctggattggaggatccggcatagacctcaggagcaaagcaaggacggtgaaaggccccatcaccgatccgagccagcttccaaaatggaactacgacggctccagcactgggcaggctcccggagaggacagcgaagtcatcctctaccctcaagccattttcaaggacccgttcaggaagggcgacaacatccttgtgatgtgtgactgctacacgccacaaggcgagccaatccctactaacaagaggtacaatgctgccaaggttttcagccaccccgacgttgcagctgaggtgccatggtacggtattgagcaggagtacactctccttcagaaggatgtgagctggccccttggctggcctgttggtggataccctggtccccagggaccatactactgcgctgccggtgccgataaggcatttgggcgcgacgtggtcgacgcccactacaaagcctgcctctacgctggcatcaacatcagcggcatcaacggcgaagtcatgcctggccagtgggagttccaagtggggccgtccgttgggatctctgccggtgacgagatttgggttgcccgctacattctcgagaggatcactgagattgccggaattgttctctccctcgacccaaagccgatccagggtgactggaacggtgccggtgctcacaccaactacagcaccaagtcgatgagggagcccgggggctacgaggtgatcaagaaggcgatcgagaagctggggaagaggcacaaggagcacatcgccgcgtacggcgagggcaacgagcgccgcctcacgggccgacacgagaccgccgacatcaacaccttcaaatggggcgtggcgaaccgcggcgcgtccatccgcgtcggccgcgacaccgagcgggagggcaagggatacttggaggaccgcaggccggcattcaacatggacccctacgtcgtcaccggcatgatcgccgagaccaccatcctgtggaagggaaactgatcacgcatgcattcgagccacgcgatccacggttcttcttcttctgcacaacgctacgcctgcacgcatccgccctgatgtcatgtcagtttgattttgcgatttcggttcccgtcatggggtgtcctaaaattttttacttcggtctccggtgtactgctcggaaagtctgaataacggctgcaatggattttgctctcgtcataggggtacctttagctattcttcccgtttattggatcatgtataatgtaataatactacgtgatttatatgaagaaa

SEQ ID NO: 1498 - DNA, 1416 bp, Zea mays
cttcctcttcttcttcttgcctactaagcaagctctctctcgtgttcttctcgtcttctgcccgagtgatggccagcctcaccgacctcgtcaacctcgacctgagtgactgcaccgacaggatcatcgccgagtacatctggattggaggaaccggcatagacctcaggagcaaagcgaggacggtgaaaggccccatcaccgacccgagccagctgccgaaatggaactacgacggctccagcacagggcaggctcccggagaggacagtgaagtcatcctctaccctcaagccattttcaaggacccgttcaggaagggtaaccacatccttgtgatgtgtgactgctacacgccacaaggcgagccaatccccaccaacaagaggtacagcgccgccaaggttttcagccaccccgacgtcgcagctgaggtcccgtggtacggtattgagcaggagtacaccctccttcagaaggacgtgagctggcccctcggctggcctgttggtggataccctggtccccagggaccatactactgcgccgccggtgccgacaaggcctttgggcgcgacgtggttgacgcccactacaaggcctgcctctacgccggcatcaacatcagcggcatcaacggcgaagtcatgcctggacagtgggagttccaagtggggccgtcagttgggatctctgccggcgacgagatatgggtcgcccgctacattctcgagaggatcaccgagatggccggaatcgtcctctccctcgacccgaagccgatcaagggcgactggaacggcgccggcgcccacaccaactacagcaccaagtcgatgagggaggccgggggatacgaggtgatcaaggcggcgatcgacaagctggggaagaggcacaaggagcacatcgccgcgtacggcgagggcaacgagcgccgcctcacgggccgccacgagaccgccgacatcaacaccttcaaatggggcgtggcgaaccgcggcgcgtccatccgcgtcggccgcgacaccgagagggagggcaagggctacttcgaggaccgcaggccggcgtccaacatggacccctacgtcgtcaccggcatgatcgccgagaccaccatcctgtggaatggaaactgatcaagcatgcgcattctcgagggagcccactgttttggttctgcacaacgcatccgccgtggtgtcgctttggttttgaaatttagtttccgttgtcctaaaatttatcactacggtctccggtgtattgctcgggaacaatgaataacgactgcgatgttttttttttgcttgcgtcgtagatgtacgtttggctgtgcttccagtttattgggtaaatgaaaaaaatgtaatggtctatcggtcttaaaatagtagtcattttagctctaac

SEQ ID NO: 1499 - DNA, 1433 bp, Zea mays
ctgcgatacttcagacagctcttcttgcgttgcctactaagatctctctctctctctctctcttttgtgttcttgccttctgcctactacgagtgatggccagcctcactgacctcgtcaacctcgacctgagtgactgcaccgacaggatcatcgccgagtacatctgggttggaggatccggcatagacctcaggagcaaagcaaggacggtgaaaggccccatcaccgatccgagccagctgccaaaatggaactacgacggctccagcaccgggcaggctcccggagaggacagcgaagtcatcctctaccctcaagccattttcaaggacccgttcaggaagggtaacaacatccttgtgatgtgtgactgctacacgccacaaggcgagccaatccccagtaacaagaggtacaaagctgccacggttttcagccaccccgatgttgcagctgaggtgccatggtacggtattgagcaggagtacactctccttcagaaggatttgagctggccccttggctggcctgttggtggataccctggtccccagggaccatactactgtgctgccggtgccgataaggcctttgggcgcgacgtggttgacgcccactacaaagcctgcctctacgccggcatcaacatcagcggcatcaacggcgaagtcatgcctggacagtgggagttccaagtcgggccgtccgttgggatctctgccggcgacgagatatgggtcgcccgctacattctcgagaggatcactgagatggccggaatcgttctctccctcgacccgaagccgatcaagggtgactggaacggcgccggcgctcacaccaactacagcaccaagtcgatgagggaggccggtggctacgaggtgatcaaggaggcgatcgagaagctggggaggaggcacagggagcacatcgccgcgtacggcgagggcaacgagcgccgcctcacgggccgccacgagaccgccgacatcaacaccttcaaatggggcgtggcgaaccgcggcgcgtccatccgcgtcggccgcgacaccgagaaggagggcaagggatacttcgaggaccgcaggccggcttccaacatggacccctacgtcgtcaccggcatgatcgccgacaccaccatcctgtggaagggaaactgataaaaccactgttcttctcctgcacgcatgcatccgccccgtgctgtcactttttgttttttcaaatttcgattcccgtcctaaagtttgttaccacttattattacggtctccagtgtactgctcggaaagtccgaataaaaacggctctaatgattttgttttttttaaaaaaaaatttgccttcgccataggtgtacgattggctgcgcttcccgtttattgggtactagtacaattgatatgaatcaattgccattaacg

SEQ ID NO: 1500 - DNA, 1358 bp, Zea mays
accatccactgcgatacttcagacagctcttcttgcgttgcctactaagctctctctctctctctttctctcttgtgttcttgccttctgcctactacgagtgatggccagcctcactgacctcgtcaacctcgacctgagtgactgcacagacaggatcatcgccgagtacatctgggttggaggatccggcatagacctcaggagcaaagcaaggacggtgaaaggccccatcaccgatccgagccagctgccaaaatggaactacgacggctccagcaccgggcaggctcccggagaggacagcgaagtcatcctctaccctcaagtcattttcaaggacccgttcaggaagtgtaacaacatccttgtgatgtgtgactgctacacgccacaaggcgagccaatccccagtaacaagaggtacaaagctgccacggttttcagccaccccgatgttgcagctgaggtgccatggtacggtattgagcaggagtacactctccttcagaaggatgtgagctggccccttggctggcctgttggtggataccctggtcctcagggaccatactactgtgctgccggtgccgataaggcctttgggcgcgacgtggttgacgcccactacaaagcctgcctctacgccggcatcaacatcagcggcatcaacggcgaagtcatgcctggacagtgggagttccaagtcgggccgtccgttgggatctctgccggcgacgagatatgggtcgcccgctacattctcgagaggatcactgagatggccgggatcgttctctccctcgacccgaagccgatcaagggtgactggaacggcgccggcgctcacaccaactacagcaccaagtcgatgagggaggccggtggctacgaggtgatcaaggaggcgatcgagaagctggggaggaggcacagggagcacatcgccgcgtacggcgagggcaacgagcgccgcctcacgggccgccacgagaccgccgacatcaacaccttcaaatggggcgtggcgaaccgcggcgcgtccatccgcgtcggccgcgacaccgagaaggagggcaagggatacttcgaggaccgcaggccggcttccaacatggacccctacgtcgtcaccggcatgatcgccgacaccaccatcctgtggaagggaaactgataaaaccactgttcttctcctgcacgcatgcatccgccccgtgctgtcactttttgtttttcaaatttcgattcccgtcctaaagtttgttaccacttattattacggtctccagtgtactgctcggaaagtccgaataaaaacggctctaatgattttgttcaaaaaaaaaaaaaaaaaa

SEQ ID NO: 1501 - DNA, 2005 bp, Oryza sativa Japonica Group
tggaaaactgacccactatattttgctcctccttttagttgtaaacatccttctggaaatacatatgtgcacaagcacagtgctcacataattcatgagttggacaccagatgaaaaaaaaccccaagaaaataataagtggagtaaacttccatccaacttaagttaccacggtccacggttaattcctattgactacgaacaaattgttttactatgttaaccatgtttttttagacaatagtgtcaaattatcatattacgtatgaatttatgattacacctcttctttctccctgaaaatactgcagcatcctctcgatttgagatgattacttcagtttcttgccacaccagaggtaatccattcccttgatttttgttaaaagataaagataatatagacgctatctttttaaacggccaatatcattattaatcaaataactgaaaaaaaaatgtctctgaatgatacttgcccctacttcgctatccacagttgcgatttgcgacttgcaagcacaccgtagctaacttctctccttctgggtataaatatccctctcctctccctgtttctcctcatccctgcttcctcttctacacctcattttccgcttgcatcttgctcattcagatctcttctgctttgagcaatggccaacctcaccgacctcgttaacctcaacctcagcgactgcagcgacaagatcatcgccgagtacatctgggttggaggatcgggcatagacctcaggagcaaagcgaggactgtgaaaggccccatcaccgatgtgagccagctgccgaagtggaactacgacggctccagcaccgggcaggctcccggcgaggacagcgaagtgatcctctaccctcaagccattttcaaggacccgttcaggaggggcgacaacatccttgtgatgtgcgactgctacacgccacaaggtgagccaatccccactaacaagaggcacagtgccgccaagatcttcagccaccctgatgttgttgctgaggtgccatggtacggtattgagcaggagtacacactccttcaaaaggatgtgaactggccccttggctggccagttggtggcttccctggcccacagggaccatactactgcgctgccggtgccgaaaaggcgttcggccgcgacatcgtggacgcccactacaaggcctgcatctacgccgggatcaacatcagtggcatcaacggggaagtcatgcccggccagtgggagttccaagttggcccgtcagttggcatcgccgctgctgaccaagtgtgggttgcccgctacatcctcgagagggtcacagaggtggccggagtcgtgctctcccttgacccgaagccgatcccgggtgactggaatggcgctggtgcccacaccaacttcagcaccaagtcgatgagggagccgggaggctacgaggtgatcaagaaggcgatcgacaagctcgcgctgaggcacaaggagcacatcgccgcctacggcgagggcaacgagcgccgcctcaccggccgccacgagaccgccgacatcaacaccttcaaatggggcgtggcgaaccgcggcgcgtccatccgcgtggggcgcgacacggagaaggagggcaaggggtacttcgaggacaggaggccggcgtccaacatggacccatacgtcgtcaccggcatgatcgccgagaccacgctgctgtggaagcagaactaagccgtccggcgggcctctcccgtgcatttctgcgcccaaaaaaaacaaaaaaaagaaacgtacgcgtgcgtgcatcagccgtgatgtgtcaacgttggatttcggtctcggtctatccttggcgtcgacaaggccctttgaattttattactagtctgtcctgttcaccgagtgtcattttgtgtactctgaataataatgctttgtaaaacggatttgctttttccgtagggacggatgttcttgattttcctatatcgtgatttatatatatg

SEQ ID NO: 1502 - DNA, 1397 bp, Triticum aestivum
tcgagctgcacacctcatctcatctcatctcagtcttcccccacattgccattccctccttgcgagtagcagcagcaatggccagcctcgccgacctcgtcaacctcgacctcagcgactgcaccgacaagatcatcgtcgagtacctctgggttggaggatccggtatcgacatcaggagcaaagcaaggacggtgaacggccccatcaccgacgcgagccagctgcccaagtggaactacgacggctccagcaccggccaggctcccggagaggacagcgaagtcatcctctacccccaggccattttcaaggacccgttcaggaggggtgacaacctccttgttatgtgcgactgctacacaccccaaggtgtgccaatccccacgaacaagaggcacaacgctgccaagatcttcaacaccccgaaggttgcagctgaggagacatggtatggaattgagcaggagtacactctcctccagaaggacgtgaactggcctcttggctggcccattggtggctaccctggtccgcagggaccatactactgcgccgccggcgcggacaaggcgttcgggcgtgacatcgtggacgcccactacaaggcctgcctctacgccgggatcaacatcagcggcatcaacggggaggtcatgcccggccagtgggagttccaagttgggccgtccgtcgggatcgcggcgtccgaccagctgtgggtggcgcgctacatcctcgagaggatcactgaggttgccggggtggtgctgtccctggacccgaagccgatcccgggcgactggaacggcgcgggcgcgcacaccaactacagcaccaagtcgatgcgggaggccggcgggtacgaggtgatcaagacggccatcgagaagctgggcaagcggcacgcgcagcacatcgccgcctacggcgagggcaacgagcgccgcctcacgggccaccacgagaccgccgacatcaacaccttcaagtggggcgtggcggaccgcggcgcgtccgtccgcgtgggccgcgacaccgagaaggacggcaagggctacttcgaggaccgcaggccggcctccaacatggacccctacgtcgtcacctccatgatcgccgagaccacgctcctcctctgagccacccacccacggccatgcctaccgccgccagatcatgacacccaggctctcgactctctcgatcgagggtggcgattgattaatttctgcaaaacgtttcgtgtttccatttcttttgcaaggtctagtctgtttttggggcgtgcctttggtgtctttcactttactcgttcagataagagtaagagtcttcagtctactctgaaaataatgttgttttcgcattccgataaatgaaatcatggagccggt

SEQ ID NO: 1503 - DNA, 1341 bp, Triticum aestivum
ccctccttgcgagtagtagcagcagcaatggccagcctcgccgacctcgtcaacctcgacctcagcgactgcaccgacaagatcatcgtcgagtacctctgggttggaggatccggtatcgacatcaggagcaaagcaaggacggtgaacggccccatcaccgacgcgagccagctgcccaagtggaactacgacggctccagcaccggccaggctcccggagaggacagcgaagtcatcctctacccccaggccattttcaaggacccgttcaggaggggtgacaacctccttgttatgtgcgactgctacacaccacaaggtgttccaatccccactaacaagaggcacaatgctgccaagatcttcaacaccccgaatgttgcagctgaggagacatggtatggtatcgagcaggagtacactctcctccagaaggacgtgaactggccccttggctggcccattggtggctaccctggtcctcagggaccctactactgcgcggccggcgcggacaaggcgttcgggcgtgacatcgttgacgcgcactacaaggcgtgcctctacgccgggatcaacatcagcggcatcaacggggaggtcatgcccggccagtgggagttccaagtcgggccgtccgtggggatcgccgcgtccgaccagctgtgggtggcgcgctacatcctcgagaggatcacggaggttgccggggtggtgctgtccctggacccgaagccgatcccgggcgactggaacggcgccggcgcgcacaccaactacagcaccaagtcgatgcgggaggccggcgggtacggggtgatcaagacggccatcgagaagctgggcaagcggcacgcgcagcacatcgccgcctacggcgagggcaacgagcgccgcctcacgggccaccacgagaccgccgacatcaacaccttcaagtggggcgtggctgaccgcggcgcgtccatccgcgtggggcgcgacacggagaaggacggcaagggctacttcgaggaccgcaggccggcctccaacatggacccctacgtcgtcacctccatgatcgccgagaccaccctcctcctctgagccagcagcagatgacacacgcacacgctttcttcctctacctcggagtgagagagggcgacgatgaatttctttctgcaaaacgtctcctgtttccatttcttttgcaaggtctagtctgtttttggggcgtgcctttcgtgtctttcactttactcgttcagataagagtcttccgtgtactctgaaaataatgttcttctttccgcattccgataaatgaaatcatggaaccggttgtgattccgt

SEQ ID NO: 1504 - DNA, 1380 bp, Sorghum bicolor
atggcattcctcggcgagtacagcagccaggagctgctccagggtcagctcctgctctggcaccagtccctcggcttcttcaagtccctcgcgctcgcggtcgccatggacctccgcatcgccgacgccatccaccgcctcggtggcgccgccacccttccacagataatcgcggaggccgggatcaagatcgacccgcgtaacaacaagctccgcgacctgcgccgcgtcatgcgggcgctcaccgtctcgggcatcttcaccgtccagcgaccagcctcggcggtggtggcggcggcggcggacggcggcgcagaagcagaaggtccggtctacaagctgacggcagcctcccgcctcctcgtcgttggagagaagaagagctcgacgacgacgacgatgccgacgccttctctgactgtgcagctctttctcgaaacttgtcggggatccgcgttcagcaggggcatgcgcgcgtggttccggccgcaggacgagcagcaccaacaccaggagcagccggccggcctgtccccgttcgccatggcgtgcggcggccagacgatctgggagcgagccgagcgcgacgccgacgcgttcccgttcgacgacgccatggcgtcggacaccgccttcctcatgccgatcgtgctcagggaatgcggcgacgaggtcttccgtggcctcacctccctcgtcgacgtcgccggcggcctcggcggggccgccgccaacatcgcggcagcgttcccggacctcaagtgcacggtgctggacctcccgcaggtcgtcgccaaggctgctgctggcagtaacgagaaggtccagtacgtcggcggtgacatgtttgagagtattcctccggcggacgctgtgttgctcaagtggattctgcacgactggagcgacgacgagtgtgtgaagatactgaagaagtgcaagcaggctatacctccacgagctgcaggagggaaggtaataatcatagacatggtggtcggatcagccgatgagccgtcgccggagtcggacgtgaggcacgtggagacgcaggtgttgtttgacctgttgatcatgtgcatcaatggcgtcgagcgagacgagctggagtggaagaagatcttctcggaggctgggtttcacgactacaggattataccggttctcggcgttcgatccatcatcgagctctatcctaattagttgaaagctaagccttgctggactgtaaacgtcatcgtcgtcgtcggtaggtagcagcgcgtgtctgcgtacgtgtcgagcatgcgtgtattgatcagctgagtcaaagcagcgcgagctcgttcgcttgtgttcttataataaatcaactgaacaatatttttaatcataattttt

SEQ ID NO: 1505 - DNA, 1496 bp, Zea mays
ctttatgtgaagcttacttgagctgaattgtagaagtgaaacataaatttatggagttggagttggacctatgtcaaccagggcctgatgatagtactatatatatgtaaacacccacaagctaaacacctcagcaaagaagaagaatggcgttgctcggcgagtacagcagtcaggagctcctccagggtcagctccagctctggcaccagtccctgggcttcttcaagtccctcgcgctcgcggtcgccatggacctccgcatcgccgacgccatccaccgcctcggtggcgccgccacccttccccagatactcgcggaggccgggatcaagatcgacccgtgcaacaacaagctccgcgacctgcgccgcgtcatgcgcgcgctcaccgtgtcgggcatcttcaccgtcgtccagcgaccagcgtcgtcgtcagatggaggcggcaggcgtggcgcagaagcggaaggtccggtctacaagctgacggcggcctcccgcctcctcgtcgtcggagagaaggagagctcgacgacggcgacgacgaggcagctgcctcctcctccttctctgaccgtttatgtgcagctcttactcgaaacctgccgaggatccgcgttcagcagggccgtgcgcgagtggttccagttccagcagccgccgcaggatgatgggcagcaccagcagccggctggccgcctgtcgtccccgttcgccctggcgtgcggcgggcagacgatctgggagcgagccgagcgcgacgcccacgcgttcccgttcgacgacgccatggcctcggacaccgccttcctcatgccgatcgtgctgagggagtgcggcgacgaggtgttcggccgtggcctgacctccctcgtcgacgtcgccggcggcctcggcggggctgccgccaccatcgcggcggccttcccggacctcagctgcaccgtcctggacctcccgcatgtcgtcgcaaaggcagctgccggcaccaccgacagcaacgtccagtacgttgccggtgacatgtttcaatgcatcccaccggcggacgcggtgttgctcaagtggattcttcacgactggagcgacgacgagtgtgtgaggatactgaagaactgcaagcaagccatacccccacgagcggcgggagggaaggtgataatcatagacatggtggtggccggaccaggatcaggatccgcggacgatgagccgtcggagtcggacttgaggcacgtagagacgcagatcttgtttgacctcttgatgatgtgcgtcaacggagtggagcgagacgagcaggagtggaagaagatcttctccgaggctgggtttcaggactacaggattatgccgcttctgggcgttcgatccatcatcgagctctatcctaattaaaattagtatactgaattgaaagctaagctcgccactcgcgacaagcttgttgtggttgtggctgggcgtgtggtggtgatcgaacgtgtgtttgcc

SEQ ID NO: 1506 - DNA, 1539 bp, Sorghum bicolor
aacaagaagaagacatacccatcgcaatcgcaacacgcgatctgcacaagcacacagcaatcagcaatggcattcctcggcgagtacagcagtcaggagctgctccagggtcagctcctgctctggcaccagtccctcagcttctttaagcccgtcgcgctcgcggtcgccaaggacctccgcatcgccgacgccatccaccgcctcggtggcgctgccacccttccccagataatcgcggaggccgggatcaacccctgtaagctccgtgccctgcgccgggtcatgcgcgtgctcaccgtctcgggcatcttcaccgccgtccagcagccagcgacagcaacggccgcggcggcgtcgggtggcggcggcacagaaggtcctgtctacaagctgacggcagcctccagcctcctcgtcgtcggagagaagagctcgacggcggcggcggcggcgacgacgaagagccagctgcctccttctctgagcgtgcaggtgcagctctttctcgacccttgccggggatccgcgttcagcagtggcatacgcgcgtggttccggcaggacgagcaccagcagccggccggtctgtccccgttcgccttggcgtgcgatggccagacgatctgggagcgagccgagcgcgacgccgacgtgttcccgttcgacgacgccatggcctcggacaacgccttcctcatgccgatcgtcctcaaggagtgcggcgacgtcttccgtggtctgacctccctcgtcgatgttgccggcggccttggcggggccgcctccaccatcgcggcggcgttcccggacctcaagtgcaccgtcttggatctcccacaggttatcgccaaggctccctctgctgctggtaccagtgtgcagtatgttgctggtgatatgtttcaaagtattccaccggccgacgctgtgttcctcaagtggattctgcacgactggaatgatgatgactgtgtcaagatactaaagaactgtaaacaagctatacctccacgagatgtaggaggaaaggtaataatcatagatatggtggttggatctgagtcgtcagataacaggcacgtggaaacacaagttttgtttgacctcttggtcatgactatcgatggagcagagcgagatgagcaagagtggaagaagattttcttggaggctggatttgaagactataaaattataccagtcctgggtgttcgatctatcatcgagctctatccttgaaagcttgatgctaaactaataagaaacaatgtttcaaacagccggccatagccaccgttttagctggatttagcctgctggaagctaatccacttttagcgctaaacacttttgctgctattagccggatttagcctgctaaattcgttaaatagcaccccatttgccctgctaatcagggggaaaccgaaacaagaggttgtcgaaccaattaagcaaagacaatccactttgaacttatgtgtatatcgtgtatgatttattcgttttcgagactatcacttgatagttgatatt

SEQ ID NO: 1507 - DNA, 1435 bp, Sorghum bicolor
atagaacaaccagccatcagaaattcaagatcgatccatccatctgcacaataatggcattgctggatgagtacagcagcgatgagctactccaggctcagcttcagctctggcaccaggccctcggcttcttcaagtctgtcgcgcttgcagtcgccttagacctcggcatccccgacgccatccatcgcctcggtggtgctgcaacccttcctcagatactcgcagaggctggggtcaacccccgtaagcttcgcaacctgcgtcgcatcatgcgtgtgctcaccttatctggcatcttcagcatcaaacaggcagcaacggcggcgtcagacggagaaggtccagtctacaagctgacgacggcatcccgcctcctcgtcaaagacgagagcttgacgaggagccagcagctgcctcctgttctatacacgcacctcatgctcacaccttgccgagaatccacggccggcatgggcataaacgcgtggttccggcaggagcaggatcagccgcagccagcggcgggtccattcgccctcgagtacaatggccagacggtctgggaaagagcagagcacgacgccacgacgttcccgttcgacgacgccatggcctccgacacggcctttctcatgccgatcgtcctcaaggagtgcagcgaggttttccatgggttaacctcgcttgtcgatgttgctggtgggcttggcggggccgctgctaccatagtggcggcgttcccggatttgaagtgcaccgtgctggatctcccacatgttgtcgccaaggctcccactgacaccaacgtgcattacgttgctggtgacatttttcaaagtattccaccggcaaacgcagtgttcctcaagtggattctgcatgactggcacgatgatgagtgtgtcaagatactgaagaactgcaaacaagcaatacctccacgagatgcaggagggaagataataataatagatatggtggttggatctgagccgtcagacctcaaacacatagagacacaggttttgtttgacctcatgatgatgaatgtcaatggggtcgagcgagatgagaatgagtggaagaacatcttcttcgaggcaggattcaaggactacaaaatcataccacttcttggtgttcgttctattatcgagctctatccttaaagctcagtgaaaccatccataacaataagagcatcgatgggaacatgcatcaatagctgtggactgttgttttttatattgatagagtaacaccgaataagaggatctcctatagatatggagggattcgtatctggccgggcatctggtcagctcttcttggacctagctagagtcttattatagacaaaagtttgcacacatatatatgagtgcgacctccaactgtaaactggcgaatgacaaaatgagtttgtcttttg

SEQ ID NO: 1508 - DNA, 1457 bp, Sorghum bicolor
ataacatagaacctacaatcaggcatcgcaatatcgatccatcatctgcacaacaatggcattgctggatgagtacagcagccaggagctactccaggctcagcttcagctctggcaccaggcccttggcatcttcaagcctgtcgcgctcgcgctcgccttagacctccaaatccccgacaccatccatcgcctcggtggtgccgccacccttccccagatactcttagaggctgggatcaacccctgtaagctccacgacctgcgtcgcataatgcgtgtgctcaccttttctggcatcttcagcgtcaaacaggcagcaacggtggcgtcagacgacaacgacaggcatgacggagaaggtccagtctacaaactgacgacagcgtcccgcctcctcgtcagagacaagagcttgacaacgacccaacaactgcctgctcttatgtacgtgcagctcatgctctcaccttcccgagaatccccgctcggcaagggcctatatgcatggttccggcaggatcaggatcagccgcagccggcgggactgtccccgtttgctctgtcgtacagcggccagacaatctgggaaagagcagagcgcgatgccaccacgttcccatttgacgacgccatggcctcggacacagcctttctcatgccgatcgtcctcaaggagtgtggcgaggtcttccatgggctaacctcgcttgtcgatgttgccggtgggcttggcggtgccgctacaaccatagcagcggcgttcccggatttgaagtgcaccgtgctggatctcccacaagttgtcgccaaagctcccactgacaccaacgttcagtacattgccggcgacatgtttcaaagtattccaccggcgaacgctgtgttcctcaagttagttctgcacgactggaacgatgatgagtgtgtcaagatactgaagaattgtaaaaaagcaataccttcacgagatgccggagggaagataataataatagatatggtggttggatctgagtcgtcagatccgtcagacatcaaacacatagagacacagattttaaaagacctcatgatgatgaatatcaatggagtcgagcgagatgagcaagagtggaagaagatctccttcgaggcgggattcaaggactacaaaatcataccacttctcggtgttcgttctattattgagctctatccttgaaagcttggtgaactaaaaacaatccaaaacaataagaatatcacaacatgtatcggttgtcatttgtgttttttactagcaaacatgttcgtgctttgcaacaaaatttatatcatatgtacatcatcatctcttccagttgagctacatcccctcatattccatcttttgtagtaccttttagatttacacttcgtatcgtggctggatgtatgttattttaactcgtataaaagcgggtgtgagtttgaag

SEQ ID NO: 1509 - DNA, 1422 bp, Sorghum bicolor
atagaacttacaatcagccatcacaatatcgatccatctgcacaataatggcattgctggatgagtacaacagccaggagctactccaggctcagcttcagctctggcaccaggccctcggcatcttcaagcctgtcgcgcttgcgctcgccttagacctacacatccccgacgccatccatcgcctcggtggtgccgccacccttccccaaatactcttagaggctgggatcaacccctgtaagctccacgacctgtgtcgcataatgcgcgtgctcaccttctctggcatcttcagcgtcaagcaggcagcaacggtgacgtcagacgacgacgacagacatgacggagaaggtccagtctacaaactgacgaccgcatcccgcctcctcgtcagagacgagagcttgacaacgacccaacaactgcctgctcttatgtacgtgcagctcatgctctcaccttcccgagaatccccgctctgcaagggcctacatgcgtggttccggcaggatcatcaggatcagccgcagccggcgggactgtccccgttcgctctatcgtacagcggccagacgatctgggaaagagcagagcgcgatgccaccgcgttcccgtttgacgacgccatggcctcggatacagccttcctcatgccgatcgtcctcaaggagtgcggcgaggtcttccatgggctgacctcgcttgtcgatgttgccggcgggcttggcggggccgctgcaactatagcggcggcgttcccggatttgaagtgcaccgtgctcgatctcccacaggttgtcgccaaagctcccactgacaccaacgtgcactatgttgctggcgacatgtttcaaagtattccgccggcaaacgctgtgttcctcaagttggttctgcacgactggaacgatgatgagtgtgtcaagatactgaagaactgcaaaaaagcaatacctccacgagatgcaggaggaaagataataataatagatatggtggttggatcagagccatcagagccgtcagacatcaaacatatagagacacagattttaaaagacctcatgatgatgaatatcaatggactcgagcgagacgagcaagagtggaagaagatctccttcaaggcggggttcaaggactacaaaatcataccacttctcggtgttcgttctattattgaactctatccttgaaaacttggtgaactaaaaactattccaaacaataagaacatcggaacattgattagttgttatttgtggtttttttactagcaaacatgttcgtgctttgcaacaaaatttgtatcatatgtatgtcatcatttcttcctgttgagctacattctcccatatgtcatctcttgtaagaattacacttcatatagtggttggatatacactattttaacgtgcc

SEQ ID NO: 1510 - DNA, 1886 bp, Sorghum bicolor
agcctacgtacgctaggcacagttgtggctgtgcagaactgcacaagagcacgtcgcctcgcctccaccaccacgaacggagaaggcggcggccggccatggccatggaggaaacgagcaagataacgggcaggaagaagggtggtcttagaacaatgcccttcatcttcgccaacgaggtggcggagaagctcgccgtggtgggcttctcgaccaacatgctgacgtacctcaccacgcagctgcacatgccgctggcgaaggccgccaccacgctcaccaacttcggcggcacctccgccgcgacgcccctcatcggcgccttcctcgccgacgcctgcatcggccgcttctggaccatcgctgccgcctccgtcgtctaccaagtcggcatggcgctcctgacggtgtcagcggcgctgccgcagttccgccctccgccgtgcaagcccggcggcgcggtgacgtgccaggaggcggcgccgtggcagctggcggtgctgtacgtgtccctgctcctcaacgcggtgggcgccggcgggtaccgcccctgcatcgtggcgttcggggcggaccagttcgacgagtcgcgggcggcggagcgcgcccggagctggggcttcttcaactggtactacttctgcaacggcgcgtccatgctgctggccgtcacggcggtggtgtacgtgcaggacaacgtgggctggggctggggcctcggcgtgccggccttctgcatgggcgtctccgtcgccgccttcgtggccgggtaccccatgtaccggaggctggagcccgcggggagcccgttcacgcggctcgcgcaggtggtcgtcgccgccgtcaagaagcgccggctgccggcggcggacgtcgtccccgcgaggctgtacgagaacgacgacctcgacgcgcccatctccatgtacggcaagcttgtgcacacggatcagctcagcttctttgaccgcgcggcgatcgtcaccgacggcgacatggtcacgcagacggacgccgactccggcaagccgtcggcggcccccgtcccgaacccgtggcgcctgagcacggtgcaccgcgtggaggagctcaagtccgtgatccgcatggggcctatctgggcggcgggcatcctggtgatcacgggttcatcgacgcagcacaccttctccctgcagcaggcgagcaccatggaccgccgcctggcgccgggcctgtccacgttccagatcccggcggggtccatgaccgtcttcgcgctgctcgccatgctcctcaccctgttcctctacgaccgcgtgctcgtccgcgtggcgcgccgcttcacggggctggaccgcggcatctccttcctgcaccgcatgggcgtcggcttcgccatcagcgtggtcgccaccctggtggccggcttcgtggagcggcaccgcagggacgccgcggcggcggtggccggcgccacggacgccggcacgtccccgctgtcggcctactggctggtgccgcagtacgcgctgcacggcgtggccgaggccttcacctccgtggggcacctcgagttcatgtacgaccaggcgcccgagagcatgcgcagcacggcgacggcgctcttctggctctccatctcgctgggaagctacgccagcacgctgctggtggacgccgtgcaccactggagcgcaggccccggcggcgccaactggctgccggacaacatcaatcacggcaggctggactacttttactgggtcgtcaccatgctgcaggtcatgaacttgatatactacgccatttgtgccaagcggttcaggtacaagccagtgcagctccataagaaagaggaggaagaaagcggcaaggcacttgtggagctgcaagagaaggtttga

SEQ ID NO: 1511 - DNA, 2167 bp, Zea mays
gcaccgttgtggctgtgcggaactgcacaagagcgtttcgcctcggccaccacgaacggagaaggcggcagccatggccatggaggaagcggggaagatgacatgcaggaagaagggtggtctgagaacaatgcccttcatcttcgcaaacgaggtggcggagaagctcgccgtggtgggtttctcgaccaacatgctgacgtacctgaccactcagctgcacatgccgctggcgaaggccgccaccacgctcaccaacttcggcggcacctccgccgcgacgcccctcatcggtgccttcctcgccgacgcctgcatcggccggttctggaccatcgccgccgcgtccgtcgtctaccaagccggcatggcgctcctgacggtgtcagcggcgctgccgcggttccggccggcgccgtgcaagcccggcggcgcggtggcatgccaggaggccgcgccgtggcagctggcggtgctgtacgtgtccctgctcctgaacgcggtgggcgcgggcgggtaccgcccctgcatcgtggcgttcggggcggaccagttcgacgagtcgcgggcggcggagcgcgcgcggagctggggcttcttcaactggtactacttctgcaacggcgcgtccatgctgctggccgtcacggcggtggtgtacgtgcaggacaacgtgggctggggctggggcctcggcgtgccggccttctgcatgggcgtctccgtcgccgccttcgtggccgggtacccgatgtaccggaggctggagcccgcggggagcccgttcacgcggctcgcgcaggttgtcgtcgccgctgtcaagaagcggcggctgccggcggcggacgtcgaccccgcgttgctgtacgaggacgacgagctcgacgcgcccatctccatgtacggcaagcttgtgcacacggatcagctcagcttctttgaccgcgcggcgatcgtcaccgacggcgacctggtcacgctgacggacgcggactccggcaagccgtcgacggcccccgtcccggacctgtggcgcctgagcaccgtgcaccgcgtggaggagctcaagtcggtgatccgcatgggtcctatctgggcggcgggcatcctggtgatcacggggtcgtcgacgcagaacaccttctccctgcagcaggcgagcaccatggaccgccgcctcgcgccgggcctctccacgttcgagatccccgcggggtccatgaccgtcttcgggctgctggccatgctcttcaccctcttcgtctacgaccgcgcgctcatccgcgtggcgcgccgcttcacggggctggaccgcggcatctccttcctgcaccgcatgggcgtcggcttcgccatcagcgtgctcgccaccctggtcgccggcttcgtggagcggcaccgcagggacgcggcggcggcggccggcgccacggacgccggcacgtccccgctgtcggcctactggctggtgccgcagtacgcgctgcacggcgtggccgaggcgttcacctccgtggggcacctcgagttcatgtacgaccaggcgcccgagagcatgcgcagcacggcgacggcgctcttctggctgtccatctcgctgggaagctacgcgagcacgctgctggtggacgctgtgcaccgctggagcgcggggcccggcggcgccaactggctgccggacaacatcaatcacggcaagctggattacttttactgggtcgtcacggtactgcaggtcatgaacctggtgtactacgccatttgcgccaagcggttcacgttcaagccagtgcagctccacaagaaagaggaagaagaaggcggcaaggcacttgtggagttgcaagagaaggtttaatttgagcagcatgcactttcagctatgtgcaggtacatgtctaatagaaaggaagtactcatcagtgctaggaagatcctcagaaaaactcccaaggtattactatataaatctatgtgagcatcttcccctgtattagtcaagtagatcaagaatgcaggaaggttgttcaggcaagcaacctcagaaattgtcaaggatcacatgacagctttgtggatggcagaagctatctggtctggtcctgagacttggcacaggtgcaaaacacaactgactatatttgtaattagaaagcaggcacgaggc

SEQ ID NO: 1512 - DNA, 2107 bp, Hordeum vulgare subsp. vulgare
ggtataccaccacaaattcacgatgcagcgaggagtggctgcatgtagtacaaccgagtgcaccaccgcgccgctaccaccacaggcgcaaacaatggcggttgaggcggccatggatgggaagaagagcaagaggaagggcggcctaagaacaatgcccttcatctttgccaacgaggtggcggagaagcttgccgtggtgggcttctcgacgaacatgctgacctacctcacccagcagatgcacatgccgctggccaaggcggccaccacgctcaccaacttcggcggtacctccgccatgaccccgctcatcggcgcctacctcgccgacgcctgcatcggccgcttctggaccatcgccggcgcctccgtcgtctaccaattcgggatggccctcctgacggtgtcggccgcgctgccgcagttccggccggcgccgtgcaaggccgcggaggcggcggggggcgcgtgcgagcaggcgctgccatggcagctcgccgtgctctacgtgtcgctgctcctgaacgcggtgggcgccggcgggtaccggccgtgcatcgtggcgttcggcgccgaccagttcgacgaatcgcagacggcggagcgcgcgcggacgtggggcttcttcaactggtactacttctgcaacggcgcgtcgcagctggtggccgtgacggcggtggtgtacgtgcaggacaacgtggggtggggatggggcctcggcgtgccggccttctgcatgggcgtctccgtcgtcgccttcgtcggcgggtacccgatgtaccgccggctcgacccggccggcagcccgttcacgcggctcgcgcaggtggtcgccgcggccgtccggaagcgccgcgtccacagggtggacgaccccgggaggctgtacgagaacgacgacatggacgcgcccatctccatgtatggcaagctcgtgcacaccacccagctcagcttctttgaccgtgctgccatcgtcagcgatggtgacctactcacggcggatgcatcctccggcaagcaaccaccgtcccaagtccccaacctgtggcggctgagcacagtacaccgcgtggaggagctcaagtcagtggtccgcatgggcccgatctgggcggcgggcatcctggtgatcacggcgtcatcgcagcagcacaccttctccctgcagcaggcgagtaccatggaccgccgcatcgctccgcactcgtccttcgagatccccgcaggctccatgaccgtcttcaccatgctcgccatgctcgccaccctcttcgtctacgaccgcgcgctcgtcccgctggcccgccgccgcacggggctggaccgtggcatctccttcctccaccgcatgggcgtcgggttcaccatctccgtggcggcctccctcgtcgcgggcttcgtcgagcgccaccgtagggaggccgcggcggccgggggcaccactgacgctgggacggcccctctgtccgtgtactggctggtgccgcagtacgcactgcacggggtggccgaggcattcaactctgtggggcacctggagttcatgtacgaccaggcgcccgagagcatgcggagcacggcgacggcgctcttctggctgtccatctccctgggcagctacgtgagcacgctgctcatcaccatcgtgcaccggtggagcgccggttccgacggatccaactggctcccggacaacatcaaccgcggcaagctggactacttctactgggtcgtgacgctgctgcaggtcatgaacctggtgtactaccttatatgtgctaggcagtacacgtacaagcccgtacagctctacaaggaagaggatggggaggacaagtccatggtggagctgcaacagaaggtttgagcgagtaacactatgcaatgtagtgtgatgtatcagtgtatgcaggtactggcctagctagctagaagaaggttgtgaagatggatgtgaatgtgtatatgccattcagggtttgtatggagatcaggaacagagaaatgtatctagctcactggcaagttgagctaataccaggtttctacgaatgtgtaactctgcttgttatgttcgtagttgatcgcggttatttgg

SEQ ID NO: 1513 - DNA, 1997 bp, Oryza sativa Japonica Group
ggaggcagccatggcggaggaggaggaggcgaagaagagcaagatgaggaagaagggtgggttcagaacgatgcccttcatcttcgcgaacgaggtggcggagaagctggccgtgctggggttcacgacgaacatgctcatgtacctgacgaggcagctgcacatgccgctcgccaaggccgccaccaccctcaccaacttcggcggcgtctccgccatgaccccgctcatcggcgccttcctcgccgactccctcgtcggccgcttctggaccatcgccgccgcctccctcatctaccaagtcggcatgctcctcctgacggtgtcggcggcgatgccggtgttccggccgccgccgtgcagcggcgccggcggcgcgggcgcgtgcgacgaggcggcgccgtggcagctggcggtgctgtacgcggcgctgctgctgaacgcgctgggcgccggcgggtacaggccgtgcgtggtggcgttcggcgccgaccagttcgacgagtcggaggcggcggagcgggcgcgcacctggggcttcttcaactggtactacttctgcaacggcgcgtcgcagctggtcgccgtcacggcggtggtgtacgtgcaggacaacgtcggctggggctggggcctcggtgtgcccaccttctgcatggccgtctccgtcgtcgccttcgtcgccggctacccgctctaccggaggctccacccgtcggggagccccttcacgcggctcgcgcaggtggtcgtcgccgccgtcaggaagcggcgggtgccgacggacgccgacgacgccgcggcgctgtacgagaacgacgacatggacgcgcccatctcgctctacggcaagctcgtccacaccgaacaactcagcttttttgaccgagcggccatcgtcaccgacggcgacctgacgacggacacctccaacggcaagccgtcgttgtctcccatccccaagccgtggcggctgagcacggtgcaccgcgtcgaggagctcaagtcgctgctccgcatgggcccgatctgggcagcgggcatcctggtgatcacggcgtactcgcagcagcacaccttcgccctgcagcaggcgagcaccatggaccgccgcctcgcgccggggctgtcgtcgttccagatcccagcaggctccatgaccgtgttcaccctgctcgccatgctcaccacgctccttgcctacgaccgtgtgctcgtcccgctagcgcgccgcgtcacgggactggaccgtggaatctcctacctccaccggatgggcgttgggttcgccatctccgtggcggctaccctcgtggccgggttcgtggagcgccaccggagggagtccgctgccgccgcgggcaccaccgacgcggggacgtcgccgctgtcggcgtactggctggtgccgcagtacgcgctccacggcatggcggaggcattcaactccgtgggtcacctcgagttcatgtacgaccagtcgccagagagcatgcggagcatggcgacggcgctgttctggctgtccatctcgctggggagctacgtcagcacgatgctcatctccgccgtgcatcgatggagcgccggcgccgacgggtccaactggctccccgacaacatcaaccgcggcaggctcgactacttctactggatcgtcgcgctgctccaggtgctcaacctggcatactacgccatttgcgctaggtgctacttgttcaagcccttgcagctccgtgaggtggacgatgatgccaagccccaaattgagctgcaagaaaaggcttcacctttgagtcattgagccagtgaaagtgcaagaaaaaggcttcacctttcagtcattgggccagtgaagagcattgatgtatctgagatgcaggtctagctagaatcaagtaggtaggttgatcaactttgaggtatatatcactatatgtatggatttgtatgtacatcaggaacaaaccagagaggaatgcatcactcgaattgag

SEQ ID NO: 1514 - DNA, 2133 bp, Sorghum bicolor
gccgcacgtcttgcgggttgcggctcctgcccggtcattgctctttccgagttccgaccgcccgagcccgaagccgaagccttaaacccccttaatctgagatccgacggcccagatctctcgtttctccctatccccgtccgttccccatcttcccgccctctccccatgtcgccgccggtggccggcgcggccgccacctccggcgacgggtcgccgcgcgagctctacaccatcccggcatcatccggttggttccggtgggacgggatccacgagacggagcggcaggcactgccggagttcttcggcggggccggcggtgctgggttcgggacggcgacgaggaacccgcgaatctaccgcgagtaccgcgacttcatcatcgccaagtaccgggaggacccggcgcgccgcctcactttcaccgaggtccgcagggcgcttgtcggggacgtcacgctcctcaggaagctcttcgccttcctcgactcctccggcctcatcaacttctcggcctcctcctcgtcctcgggccccgcgtcacggaagcaggaggtgggggtcgttgtggaggcgcccgtgggtctgcaggtgacgccgcggccgccagcgtcctactttgccgaggagaagcgtggggccgtgggcggggagaaggagaacggattccggttgccgccactgacctcctacagtgatgtgtttggggaatgggcacctgggaaggcgcctatatgtggtttttgcggtgaggagtgcaatggtgcgaaagttgagacgctgcaggatggttttaaagtttgttcaaaatgttccaaaagcaataatgataataataaggaagaagcgaataaatgtccgggtgacaagaaggagagtatggaaaaatcttccggtgcatggacagacgcggaaacattactccttttagaaggagtcctaaaacatggagatgactgggatcttatcgcccagcatgtccgtacaaagaataaatcagaatgcatagcaaggcttattcagttaccttttggcgaacatatgctgggcacaataaatggtaaatccgctagcaggctccacataaaccaggcaactgatggaaaaacaaaccagcacattatgaaggagccttcaagccacacaactgaaatggctgacggcatgcagattgatggaaatgaagatagtgctgataaatcagttgaagaatatcctacaaaacgcagacggttattttcttccatggatgctaccacttcattaatggagcagttagcgctcctgaccacaacagctagcccagatgttgttgctgcagctgctgatgctgcaattaaagcgttcagcaatgaaaacccacaagcaaagaaagcctttcgcctcagcgagcgagaatataagactaaggccttcggttctaatcatgtccaacagatcgaccgcaaaatcggcgataaggatgtgaaaatgcatggccagcctggttctgataagcaggaaaagaagttcattgctaatgcatatcaattgagggcagctgttgctactgctgttggtgtagctgctgcccgtgctaaaatgcttgcagaccaggaggagcgagaaatggagctcctaatggcatctgtgattgaaactcagttaagaaagatgcaatacaagatcaaacactttgaggagctagagtcagtcatggatcaagagtacaccactatacaacaaatgaaaggatccctcatgaatgaatggctaaaggtccttgagcatgcattccgggctggagtctcactaccgagagatgaattgctcacaaagctgttcctgaactagcccaccccatgaggaagctggctgtagtctgagtagccctcctctgatgtgcatcatcctgactgttgctggtagatagcttcctgcgtgtatgagggtgcgtctgtaaaggtgctgattgagctttcgatttcacagaattttgggcccggggatcccaacaaccctttgtaacatctttgccctgttgtaccaactaggttagatggcataattgctgaaattttcctgtagttgttgacatgtatggtttcgttcctatggatggatggatgtgaaaatgttacttcagttttg

SEQ ID NO: 1515 - DNA, 2168 bp, Zea mays
ccgcccaccgcaggccgcaagtcttgcggctcctgcccggcctagcccggccattgctccttcccagttccgagttccgacctcccgagcccgaagccagaccacgccttaaaccccgtcaatccgagatccgacggcccagatctttcgtctctgcctctccccgtctgttccccatcttcccgtccccccgccatgtcgccgccggctgccggcgcggccgccaactccggcgatgggacgcctccgtcgccgcgcgagctctacaccatcccggcatcatccggttggttccggtgggacgggatccacgagacggagcggcgggcgctgccggagttcttcggaggggcaggcggcgctgggttcgggacggcgacgcggaacccgcggatctaccgcgagtaccgcgacttcatcatcgccaaataccgggaggacccggcgcgccgcctcactttcaccgaggtccgcagggcgcttgtcggggacgtcacgctcctccggaagctctttgccttcctcgactcctccggcctcatcaacttctcggcctcctcgtcctcggtccccgcgtcgcggcagcaggaggtgggggtcgtcgtggaggcgcccgtgggtctgcaggtgacgccgcgtcctccagcgtcctacttcgccgaagagaagcgtgtagcggcgggcggggagaaggagaacgaattccggttgccgccgctgacctcctacagtgatgttttcggggaatgggcacctgggaaggcgcctatatgcggtttttgcggtgaggagtgcaatggtgcggatgttgagacgctgcaggatggttttaaagtatgttcaaaatgttccaaaagcaataatgataatatcaaggaagaggcgaataaatgtcctggtgacaaaaaagagaatatggaaaatcatgcttccagtgcatggacagacactgagacgttactccttttagaaggagtcctaaaacatggagatgattgggatcttatcgctcagcatgtccgcacaaagaataaatcagaatgcatagcaatgcttattcaattaccttttggcgaacatatgctgggcacaataaacggtaaattcgttagcaggctccacataaaccaggcagatgatggaaaaacgaaccagcacattatggagtcttcaagtcactcaaccgaaatggctgatggcatgcagattgatggaagtgaagatagtgctgataaatcagttgaagaatatcctacaaaacgcagacgattgtttttttcaatggatgctaccacttcattgatggagcagttagctatcctgaccacagcagctagcccagatgttgctgctgctgctgctgatgccgcaattaaagcatttggcaatgaaaacccgcaagcaaggaaagcctttcgcctcaacgagcaagaatataagactaaggcttttgcttctaatcatgtccaacagattgaccacaaagttggcaataaggatacggcgatgcatggccagagtggttctgataagcaggaaaagaagttcattgctagcgcatatcaattgagggcagctgttgctactgctgttggtgtagctgctgcccgtgctaaaatgcttgcagaccaggaggagcgagaaatggagctcctaatggcgtctgtaattgaaactcagctaagaaagatgcaatacaagatcaaacactttgaggagctagattcactcatggatcaagagtacaccgctatacagcaaatgaagggatccctcatgaatgaatggataaaggtccttgagcatgcattccgggctggagtgtctctaccgagagatgaattgctcaccaaactgttgctgaactagccgcccatcccatgaggacctggctgtagtcgagtagttctctgatatgcgtcacccccttgactgttgctggtagatagcttcctgcgtgggtgcgtctgtaaaggtgccgattgtgctttcgatttctcagaattttgggtatcagaacaacccttcgtaactctttgccctgttgtaccaactaggttagatggcaaaattgctgaaattttcttgtagctgttgacatgtatggtttcgttcgtatggatgtgaaaatggtacctcagttttggagtaacaaaaaaaaaaaaaaa

SEQ ID NO: 1516 - DNA, 2136 bp, Oryza sativa Japonica Group
gacggcccagatcgctccccccctaattcccgccttgccccctcctccccatgtcgccgccggtggccggcgccgcctcctccggcgacgggccgccggggcgcccgccgcgcgagctctacaccatccctgcctcctcgggttggttccagtgggatgagatccacgagacggagcggcgggcgctgccggagttcttcggcggcgccggggggagcgggttcgggacggcgtcgcggaacccgcggatctacagggagtaccgcgactacatcatcagcaggtaccgcgaggacacctcccgccgcctcaccttcaccgaggtccgcaaggcgctcgtcggcgacgtcacgctcctccggaagctcttcgccttcctcgactcctcgggcctcatcaacttctccgcctccccctcccgccccgaggcgcagcagcagcagcggcagacggaggcggaggccgtcgtggaggcgcccgtggggctgcaggtgacgccacggccgccgccgtcgtacttcgcggaggagaagggaggagggggcaacgagaacggattccgtttgccgccgctgacctcgtatagtgatgtatttggagagtgggcgcctgggatggcgcctatatgtgggctctgtggcatggagtgcagagacgggaatgcccaaatattgaaggatggttttaaagtatgctcaaaatgttatgccaataatgataataagggtgaagcaaatatacatccaggtgacaaaaaggagcggatcgacaatcattcttctagtgcatggacagatgcagaaactctccttctcttggaaggtgtactaaaacatggagatgactgggatctcatcgcccagcatgtccgcacaaagaataaatcagaatgcattgcaaggctaattcagttgccttttggtgaacatatgctgggcacagtaaatggtaaattggataacagactccataaaatccaaacaaccgatggaaaagtgaacaagtccactgtgaaggagtcttcaagtcaaccaactgaaacagttgatgacatgcagattgatggaaatgaagatggcgctgataaatctgttgaagaacatcctacaaaacatagacggttgttttcttcaatagatatcactgtctcattaatggagcagttagcgcatcttaccacatcgacaagcccagatgttgttgctgcagctgctgatgccgcaattaaagcactgggtaatgaaaacccccaagcaaggagagcttttcaactcagtgagaaagagtaccaaaccagggcattctcttctaaccatgcccggcagagtgatgatgttggtggtggtgatcgggatgtagaaatgcacgggcacccagataaaaagcaggggaagatgtttatttctaccacatatcaagtaagggcagctgttgctacgtccataggtgtagctgctgcccgtgctaaaatgcttgcagaccaggaagaacgggaaatggagctcctaatggcgtccataatagaaactcagctaaaaaagatccaatacaagatcaaacactttgaggagctagagttgatcatggatcaggaatacgctactctacagcaaatgaagtcttcccttgtcgatgaatggcaaaaggtcctcaagcgagcatttgagactggagtaccaatatcgagggatgaagtgcttataaagttgttccaaaacaagccaaatctgtagagaaattgaccaaagtcggttagatctccatgagggagcattggaggttgggatatctgtactgagggatgtgctgttcgagtaacatccctattccttagagaagttgactggagtcgattatccctcctctgatctgcctctccatagagcagtcatctagcagtttaacattgtggtgtcagagcgtggctgtaaatgtgctgattgagctttgggttgatctcaaaattttgcgtttgagatcacatcgatcctctgtagtttgtatcatcctatgcgattgcacgtgattgctccgttatactatccaactaggttagacaagtagtgttgctaatagcttcctgtacctgtctacatttcgttgatttcatttgttgggatgtgcaaatcttcctcc

SEQ ID NO: 1517 - DNA, 3787 bp, Oryza sativa Indica Group
tcgcaggttggttccagtgggatgagatccacgagacggagcggcgggcgctgccggagttcttcggcggcgccggggggagcgggttcgggacggcgtcgcggaacccgcggatctacagggagtaccgcgactacatcatcagcaggtaccgcgaggacacctcccgccgcctcaccttcaccgaggtccgcaaggcgctcgtcggcgacgtcacgctcctccggaagctcttcgccttcctcgactcctcgggcctcatcaacttctccgcctccccctcccgccccgaggcgcagcagcagcagcggcagacggaggcggaggccgtcgtggaggcgcccgtggggctgcaggtgacgccacggccgccgccgtcgtacttcgcggaggagaagggaggagggggcaacgagaacggattccgtttgccgccgctgacctcgtatagtgatgtatttggagagtgggcgcctgggatggcgcctatatgtgggctctgtggcatggagtgcagagacgggaatgcccaaatattgaaggtactatcgagttataaagttcctttttgcattagctgggataaatgtgggatatcaaggaggaatgcggtatcaattattaagaaaatggaggtgatgagtggctacgtcatcgaacgcaggctggcgcaaagctcttggcagctatctggcaactgagctgtgcgccattctctctccgtttgcattaggttgtcttctttagcaaattttgggttagtaatcatgtcttgctagatttaggatgctaatggttacagcgctactgtgtggcaatcaaatgattggtttgaactttgtatcatgcatgcaaaaaatgtccaaaggtttaaattctaggctttaggaatgcaagtatttaacattttacaacctacagttttgaataaattacttgtcgtcttgtggagaaatagattcgtgaatatgttatgaaataacagttcttacaaaatattaaaggatatttggctctgaaataggtaaagcgtttagattatagattggatcgccatgtatgtgtctagcatgatgtccttctgcactaatggttttcatggaatacatactccgagatgccattattattatttttattatagtatttcttgcagcatcattactctatttatggcattctgtgagatgtatctattattgttttattataggatttcttgcagcatcgctactttatttatggcatcctgtttatgttgtcgtactccttgacatgatttttgttgcttatgcttcatagcacaccaagcttcgacgggaataatctgagaaaagtacatgttatatgtttgttaacatttggtatgcttgcttttcaggatggttttaaagtatgctcaaaatgttatgccaataatgataataagggtgaagcaaatatacatccaggtgacaaaaaggagcggatcgacaatcattcttctagtgcatggacagatgcagaaactctccttctcttggaaggtgtactaaaacatggagatgactgggatctcatcgcccagcatgtccgcacaaagaataaatcagaatgcattgcaaggctaattcagttgccttttggtgaacatatgctgggcacagtaaatggtaaattggataacagactccataaaatccaaacaaccgatggaaaagtgaacaagtccactgtgaaggagtcttcaagtcaaccaactgaaacagttgatgacatgcagattgatggaaatgaagatggcgctgataaatctgttgaagaacatcctacaaaacatagacggttgttttcttcaatagataccactgtctcattaatggagcaggtaataaataaataacaaacagataacaaaaaactcgtgtgtgaggacacatagattttaaatggaacgaactgatgattgctattggtacctcagttagcgcatcttaccacatcaacaagcccagatgttgttgctgcagctgctgatgccgcaattaaagcactgggtaatgaaaacccccaagcaaggagagcttttcaactcagtgagaaagagtaccaaaccagggcattctcttctaaccatgcccggcagaggtaaagatatggtatatattgttcttatttgccagtatcagtgcagtttgtttgtattaactgttagggattattgcagtgatgatgttggtggtggtgatcgggatgtagaaatgcacgggcacccaggtaggccaaatatttggatcattggatggctaactatcacagaattctttctatatctcttggtgcagttgatccaaccggatctgttattatgttgtctagacttgatctgaatcaccacgaccaactattaagaattacaatcagcgtgaaatttgtcatctcttgttattaacgatgagtagatgacaaatctgaacataaattattactaccagttcagaatcttggttttgagcctcctggcttgagttaatgttattatctactccctccgtttcatattataagactttctagcattgcccacattcatatatatgttaatgagtctatatatatatatatatatgaatgtgggcaatgctagaaagtcttataatatgaaacggaggaagtatttgtgtttatactgtgatcgtctaaaaggtatatcctttcttcatgtaatcatgtttcagataaaaagcaggggaagatgtttatttctaccacatatcaagtaagggcagctgttgctacgtccataggtgtagctgctgcccgtgctaaaatgcttgcagaccaggaagaacgggaaatggagctcctaatggcgtccataatagaaactcaggttaaatctcttgacctattcttatttacatctgcgggtatagtttaagttcgtagttctaacactgtttattcatctgaaagttacatatctgacacatcatgtacattcctgcaaaccatttcagttcatgacttcactacctgaacactaccataattcaatctcctagctgtttttatgttctaaaaaacatgatattgtttagagagggatgatatcgcaaacatcgtgcttaaacggttggggaataaatatgcagcatgttcttctacatcaaatggcagagcggagggacataactctttttttagttctgttgtgtgagccatttcctttctatctgtgtgacatattgtaatgtggctaaagggaagaggtccgtctagttaagtctgttcacctagatatcatttttaacttcgttctggatcctgcaaaacctgatgaatcatgattcaagttatgggtttgatttctgctgctagctgaactcctaccatggtggcacagcacatgccccttcctttcacagggctcaaagaaatgaaattcttattgctacaaattcacaaccttattcttacactattactgctgtcttgatgattgtctgactgttttgtttcgaaacgaaataaactctgacagaccttatctatactttctgaatgtatttccttaatgaccgactgctgtctactttatgttgaccagctaaaaaagatccaatacaagatcaaacactttgaggagctagagttgatcatggatcaggaatacgctactctacagcaaatgaagtcttcccttgtcgatgaatggcaaaaggtcctcaagcgagcatttgagactggagtaccaatatcgagggatgaagtgcttataaagttgttccaaaacaagccaaatctg

SEQ ID NO: 1518 - DNA, 1330 bp, Zea mays
cttgggtttttgggttttgtgcccgccacctgatcgcgggagccgtcgccttccttcctcctccccgccgcctcagccctcatggtcatggagaccggagaccccgggaagctgttgcgcgggcattccctctctcgtgttcctcccgcttcccctttccctcggctcaggcctcagggagatttggttagggcaggggacgaacgagcgcgggcgtcaggtatgccgggagaggaggacgtccgcaaggtctcgcgcgaggacatacagcttgtccagaacctcattgagcgttgccttcagctatatatgaaccagaaagaagtggtggacaccctatctttccaggcaaaaatagaacctagtttcactgaaatcgtctggcagagactcgaggaagagaaccgtgatttttttaaggcatactatgcgaggctgatgcttatgaatcaaatagtgtccttcaataagcttcttgagcagcagcatcagattatgaataaagatcatcattatgggatgcctgctatgccttctactgctcctaatggctcaaactctaacatgttgaaccaagccgtgccatttctgccagacactatccccagtactgcaatgcaagataacttgtggagtaatggaagttctagtagtatagtaaatggtgctccatccgatgaccagtgtggctattctggtaaagttgctcatggccttcctggtgtcatggatgcttcatcaagccttctagcagcacacaaatcgacagttgggcagtttaatggacacgatggaacaacgacaaagacagagtctgactactcaagcaactcagattttggattcggcaatgagaccgtgttcctggagcagtcagttggagatatatcaggtggatcctttagcagctctgagttgaatggacaaccagtaggttcatcttcgtatggtttcttgagccagattccttgtaatttcagcctttcggattggacagattgtttcagccaaagctcagaaatttttgagaattacggtgggtcccctttcatcccttccgatgcaaataacatcccagagtctagcgctcgagaaaatacaggttgagcagtgttccatttgtacataatattttgggcagaaacaaaaatatctacagtcgtgatcgtggaactagctgacttggtggcaaccgtttctttttctgttataggttttgatgcttcttagagtagaagcatggatggcttcttttgaagggtaggaccaaataatctgtcattgaatggtgtcaacaaaatcatcttctgagggaaaaaaaaaaaaaaaa

SEQ ID NO: 1519 - DNA, 2059 bp, Zea mays
ctcacaatcactcaaccactgcctccagctccagcagcagctagctcagctcgatcgtcctcccgacccgatccatccaccccactccccgtgctccaccatctcggcatctcgctcgctcacttagctcgagctgcggcaaacagccggccggcagtccggcacacgggagatgatgaccgggaggctgaacgtggccacgtcgtcctcgccaggaggagacgacttcctgttcatgcccatgcagcagcatcagccgccgccgcctcctcctccgccctacgtcgggttcgagcacggccacggcgtggcgggaggcggcagccagcgcgttgccggaggggtgcagcaccacctctacgacggcctcgacttcgccgccgcggcgctgcagttccagcagcaggcggaggcgccgcacctgcaccagcagcagctgctcacgctgccgtccagtctcggccccatggcgccgccgcctccgccgccgccgccgctgcccatgcctatgcccgtgcccgggatgcccggcgaccacgtgtacccggcgctcgggatggtgaagcgcgagggcggcggcgcggacgggaggatcgggctcaacctcggccgccgcacctacttctccccaggggacatgatggccgtggaccgcctcctgatgcggtcccgcctcggcggaggcggcggcgcgttcgggctcggcttcggcttcggtttcggcggcgcgcaccaccaggctccccccgcgcgctgccaggccgagggctgcaaggccgacctctccggcgccaagcactaccaccgccgccacaaggtctgcgagtaccacgccaaggcctccgtcgtcgccaccggcggcaagcagcagcgcttctgccagcaatgcagcaggtttcacgtgctgtcggagttcgacgaggtcaagaggagctgccggaagcggctggccgagcacaaccgccgccgccggaagccgcccaccaccgcctcatccaaggacgccgcgtcgccgccggctaacaagaagcccaactgcggctccatcacaagctcttactccactgacaacaagaacctgaacacggccaagtcgaccatgtcatcgaacacgggcagcgtgatcagctgcctggaccaggccgcgggcaacaagcagctgcaggcgaggccgacgctgaccctcggcgcgtcgccggacaaggaccagcagcagcagcagcagctgagagccatgctccaggcccaagcggcggccggcggcggccaccaccaccaccaccaggagcagcacttcataacctctctgcaggttcacaacaacgacggctgcggcggcggcaacagcagcagcaacaacaacatcatcctgtcgtgctcctcggtgtgctccagcgcgctgccgtcggccaacggcgaggtctcggaccagaacaacgctggtggcatgcataacctgttcgaggtggacttcatgtagaccgtcgagatcggggcaaagcaaaaggcaggcaggcaagcaagcaagcacgggagtacgtccgtccttctggcaaggtgtccttggtgtgtatcagtgtaggtaaaaaggaataggagagagagagagagagagagcaaaacagctaggcatggagtgggaggagaaacaagacgagaaaagacacatagaaaagagagagagagagaaaggacgcagagaaggattctatccatccatcagtccatcacactccatgcatcagtagctagctagctagcagcaagctgcagagcctgcagcaagctgctgctggtctacaacctcttgttgcaaggttccatggccatagcaaagccatgcgtccgtcccgttgcattggctctctctctctatatatatacctgtacgtactgtcgtgctgcagctgctgccattgcaagcctttctacctttccatttcaagcggggaataataactgctatttcactttaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1520 - DNA, 1335 bp, Sorghum bicolor
atgatgagcgggaggctgaacgtggccacgtccgcctcgccgggcgacgacttcccgttcgcgtccatgcagcagcagcagcagccgccgcctcctcctccgcctccgccctacgtcgggttcgagcacggcgtggcgggcggcggcggtggccagcgcggcgccggagggatggggatgcagcagcagcagcacctctacgacgggctcgacttcgccgcggcgctgcagttccagcaggaggcgccccaccaccaccaccaccagctgctgacgctgccgtccagcctcggcccgatggcgccgccgccgctgccgatgccgatgccgatgccgctgcagatgccgatgccgatgcccgggatgcccggcggcgaccacgtgtaccaggcgctcgggatggtgaagcgcgagggcggcggcggcggcggcgcggacgccgggaggatcgggctcaacctcggccgccgcacctacttctcccccggggacatgctggccgtggaccggctcctgatgcggtcccgcctcggcggcgtgttcgggctcggcttcggcggcgcccaccaccagccccctcgctgccaggccgagggctgcaaggccgacctctccggcgccaagcactaccaccgccgccacaaggtctgcgagtaccacgccaaggcctccgtcgtcgccgccggcggcaagcagcagcgcttctgccagcaatgcagcaggtttcacgtgctgtcagagttcgacgaggttaagaggagctgcaggaagcggctggccgagcacaaccgccgccgccggaagccggccaccaccgcgtcatccaaggacgccgcgtcgccgccggccaacaagaagcccaacggcggctccatcacaagctcttactccaccgacaacaagaacctgagcacggccaagtcgaccatgtcatcgaacacgagcagcgtgatcagctgcctggaccaggccggcaacaagcagcagcagctggcgaggccgacgctgacgctcggcgcgtcgcaggacaacaaggaccagcaccagcaccagcagcagctgagcaccatgctccaggtccaagcggccggcggcggccaccaccaggagcagcacttcctaacctctctgcaggttcacaacaatggcggctgtgggggtggcaacaacaacaacatcctgtcgtgctcctcggtgtgctccagcggcgcgctgccgtcgtcggccaacggcgaggtctcggaccagaacaccaccaccaccactaccaacaacggcaacggtggcagcagcaacaacaacctgcataacctgttcgaggtggacttcatgtag

SEQ ID NO: 1521 - DNA, 1943 bp, Zea mays
ctcaaccactgcccgccagctagctccagcagctagatcaggtcgaccgtcctcccgatccacccccgtgctccgatccaccacacgagctggctagctagccagagcggcggcacgcaggagatgatgagcgggaggctgaacgcggccacgcccgcctcgccgggggacgacttctcgttcgcgcccatgcagatgccgccgccgccgccctacgtcgggttcgagcacggcggaggcggccagcgcggcgccggagcgatgcaggcgcagcagcaccacctctacgacggcctggacttcgcgtcggcgctccagttccagcaggaggcgtcgtcccactcccaccaccaccagctgctcacgttgccgtccagcctgggcccgatggcgccgccgatgccgatgccgatgccgatgccgctgccgatgcagatgcccgtgcccggcgaccacgtgtaccacccggcgctcgggacgatggtgaagcgcgagggcggcggcgcggacggcgggaggatcggcctcaacctcggccgccgcacctacttctcccccggggacatgctggccgtggaccgcctcctgatgcggtcccgcctcggtggcgtgttcgggctcggcttcggcggcgcgcaccagcaccaggtcccgcgctgccaggccgagggctgcaaggccgacctctccggcgccaagcactaccaccgccgccacaaggtctgcgagtaccacgccaaggcatccgtcgtcgccgccaacggcaagcagcagcgcttctgccagcaatgcagcaggtttcacgtgctgtcggagttcgacgaggtcaagaggagctgcaggaagcggctggccgagcacaaccgccgccgccggaagccggccaccaccgcctcatccaaggacgccgcgtcgccgcctgctgccaacaagaagaccaacggcggctccatcacatgctcttactccactgaaaacaagaacgacgacctgagctgcagggccaagtcgaccatgtcgtccaacacgagcagcgtgatcagctgccagctggaccagcccggcaacaagcaccagctggcgaggccgacgctgactctcggcgcctcgcaggacaacaaggaccaccagcaacagctgagcaccatgctccatgtccaagcggccggcggctaccaccaccaggagcagcagcacttcataacctctctgcaggttcacaacaacggcggtagcggcaacaacaacaacaacaacataatactgtcgtgctcctcggtgtgctccagcttgccgccgcccccgtcggcgcccaacggagaggtctcggaccagaacaccgccgccaacaatggcaacgggaacatgcataacctgttcgaggtggacttcatgtagaccgtggagatcgatccaaagcaagctaagcaagcacacaggagtacgttcttctggcaagctaggtgtccttggtgtgtaaaaggaataggagagagagagcaaaaaaggtatgaagtgggtggagaaacaaggagagaaagagagagagaagggtgcaagtgcaaggattccacccatccatcacactccatatcagtagcagcaagctgcagcctgcaggtctagcaaaggtagctacgtaccctcttgtttgcaaggttccatggctatagcaaagccatgcatccgggccggatggatggaaggcccccattacagtggctagctgcctctctcaaccagtctacctcgatctactgcgctgctgctgcagctgcatccatcgcaagcctttctacctttccatttcaagcgggggggaatagttaacagtggctgtgtttcacttgtttttctccactagtttttcttttcttgttgcaaggtgcacgagggtgcagtgtgtgtcgtactaataccaaactacctgttctactgtctcc

SEQ ID NO: 1522 - DNA, 1975 bp, Zea mays
cacactccgaccctcagtcctcactcaaccactgcccgccagctagctccagcagctagatcaggtcgaccgtcctcccgatccacccccgtgctccgatccaccacacgagctggctagctagccagagcggcggcacgcaggagatgatgagcgggaggctgaacgcggccacgcccgcctcgccgggggacgacttctcgttcgcgcccatgcagatgccgccgccgccgccctacgtcgggttcgagcacggcggaggcggccagcgcggcgccggagcgatgcaggcgcagcagcaccacctctacgacggcctggacttcgcgtcggcgctccagttccagcaggaggcgtcgtcccactcccaccaccaccagctgctcacgttgccgtccagcctgggcccgatggcgccgtcgatgccgatgccgatgccgatgccgctgccgatgcagatgcccgtgcccggtgaccacgtgtaccacccggcgctcgggacgatggtgaagcgcgagggcggcggcgcggacggcgggaggatcggcctcaacctcggccgccgcacctacttctcccccggggacatgctggccgtggaccgcctcctgatgcggtcccgcctcggtggcgtgttcgggctcggcttcggcggcgcgcaccagcaccaggtcccgcgctgccaggccgagggctgcaaggccgacctctccggcgccaagcactaccaccgccgccacaaggtctgcgagtaccacgccaaggcatccgtcgtcgccgccaacggcaagcagcagcgcttctgccagcaatgcagcaggtttcacgtgctgtcggagttcgacgaggtcaagaggagctgcaggaagcggctggccgagcacaaccgccgccgccggaagccggccaccaccgcctcatccaaggacgccgcgtcgccgcctgctgccaacaagaagaccaacggcggctccatcacatgctcttactccactgaaaacaagaacgacgacctgagctgcagggccaagtcgaccatgtcgtccaacacgagcagcgtgatcagctgccagctggaccagcccggcaacaagcaccagctggcgaggccgacgctgactctcggcgcctcgcaggacaacaaggaccaccagcaacagctgagcaccatgctccatgtccaagcggccggcggctaccaccaccaggagcagcagcacttcataacctctctgcaggttcacaacaacggcggtagcggcaacaacaacaacaacaacataatactgtcgtgctcctcggtgtgctccagcttgccgccgcccccgtcggcgcccaacggagaggtctcggaccagaacaccgccgccaacaatggcaacgggaacatgcataacctgttcgaggtggacttcatgtagaccgtggagatcgatccaaagcaagctaagcaagcacacaggagtacgttcttctggcaagctaggtgtccttggtgtgtaaaaggaataggagagagagagcaaaaaaggtatgaagtgggtggagaaacaaggagagaaagagagagagaagggtgcaagtgcaaggattccacccatccatcacactccatatcagtagcagcaagctgcagcctgcaggtctagcaaaggtagctacgtaccctcttgtttgcaaggttccatggctatagcaaagccatgcatccgggccggatggatggaaggcccccattacagtggctagctgcctctctcaaccagtctacctcgatctactgcgctgctgctgcagctgcatccatcgcaagcctttctacctttccatttcaagcgggggggaatagttaacagtggctgtgtttcacttgtttttctccactagtttttcttttcttgttgcaaggtgcacgagggtgcagtgtgtgtcgtactaataccaaactacctgttcaaaaaaaaaaaaaaaaaaa

SEQ ID NO: 1523 - DNA, 1840 bp, Zea mays
tgccaccgcggcggccccttctcttccctgtaataaacccccggcgagcgatgcggcggctggcgaaatccctcctcctcgcctccctctccaggaccctccgccaccgcccccagctcccgctgcttcacccttggcctccccagccccgtcgcccggagccccgcctcctccccttctccactcaaaccctagccccgggccctgctcccccgcctgcgcttgttgcggcgtcgacgggcgagcccacaggcctcgcgcttctagagtccgcggagctgcacgagtccgagggggaccaccaggaggccctcggcctcgccctcaaggcgctcgcgccgctgcaggcgtcccacggcgggtggtcgctccccgtcgcgcgcgcgctccgtctcgccggcgccgcggccacccgcgccggcagcctcagcgacgggctcgagtccctcggcgctgccgcggatatcgtcgactacctggcacccgcgcggcgcaagggggtgcctgcggaggtggcggtggtcggcgctgccgtgtacgagcagctggcgcgcgccaaaatggccatcgggcgccggtgggacgcggtgggcgacctccagcgtgcactggacctgaagactctgttcctggaggccgggagtgctgagcttgggaacgcctacagggacgtcgccgaggcctatgcgggtgtgctggacttcgacaaggcgctgccattgtgttctaaggcattggggattgcggagagacggtttggtgaggactcggcagaagtggctaagctacggcggcttctcatgtctgtctatactggtttgggtcgccatgaggaggctctggctcaaattgagcttgctaaggtggtatatgagcgattgggattgaatgttgaactttctcaggctgaaattgatggggctaatatccgtatcttgttggggagatcggaggaggcgctgaataacattaagagggtaatgcagcgggcagacaaggagagcgaggagcgtgcactagcatatgtcacaatggcaaagatattgatgtccgaggatacggttttggactcaaagcggtgcttggagatcgctcaggggatcatagatgcaaaggattccatcgaccctggtcggtttgctgaggcatatgctgagatatcaatgttgtatgagtcgttggcaaattttgaaacgtcttcgggctcgtttgaaatggcttcgaacttgatgaagaaaacactggcaattcttgagagcgccaaggagatgcatcacatcgaaggcagcatctcagcaaggctagggtggctcctcctgtatattaaaaatgttgatgagtctgtccaatatctggagagagcggttgataaattgaagaattgctttggaccacgacactttgggttaggttttgcttataggaatctggggcaggcctatcttgaaatgaaccaacatcaatcagctgtggagttcttcaaacttgcgcttgatattattgaagctacatttggaccgctacatgatgataccattgacacaaaacagtgcattgcaaatgcatacggactgatgaaaagctacaaacttgctatggagtttcaagaacaagtcatggatgcctacagtaggtgtggccatggtgccttggatgatttcaaggaagctgaaaggcttttagagcagatcaagatgaaggctcaaggattgcgtcatgcagtatttcctgcaaattcattgcctgattcagctctagctctagctcaacgcaacaaagacgattagttcttctgtatcagtgccaacttagatgagttaatggtaaactgttattttac

SEQ ID NO: 1524 - DNA, 1933 bp, Sorghum bicolor
ctttctcctcttgccaccgcggccccaacctgtaaaccccccggtgagcgatgcggcggctgccgaaatccctcctcctcgcctgcctctccaggcccctccgccaccgccccccgctccctctgctccacccttcgcctccacagcccccgcgcccgggggcccgcctactccccttctccactcaaaccctagccccggctcctcctcctcccccggcgcctgatgcggcgtcgacggccgagcccgcgggcctcgcgcttctggaggccgcggagcggcgcgagtccgagggcgaccaccaggaggccctcgccctcgccctcaaggcgctcgcgccgctgcaggcgtctcacggcgggtggtcgctacccgtcgcgcgcgcgctccgcctcgccggcaccgcggccacccgcgccggcagcctcagcgacgcgctcgagtccctcggcgccgctgcggagatcgtcgactacctggcccccgcgcggcgcgagggggtgcctaaggaggtggcggctgtcggcgccaccgtgtacgagcagctggcgcgcgccaagacggccatggggcaccggtgggacgcggtgggcgacctccagcgcgcgctggacctgaagctccagtgcctggagggagggagtgcggagcttggggacgcctacagggatgtcgccgaggcctatgcgggcgtgctggactttgacaaggcgctcccattgtgttccacggcgctggggattgcagagggccggtttggtgaggactcggcagaagtggctaagctccggcggcttctcatggctgtctatactgggttgggtcgccatgtggaggctctggagcaaattgatcttgctaagatggtatatgagcgattgggattgaatgttgagctttcccaggccgaaattgatggggctaatatccgtatattgttggggagatcagaggaggcgatgaatgacattaagagggtgatgcagcggtcagacaaggagagtgaggagcgtgcactggcatatgtcacaatggcaaagatattgatctccgaggagagggtttcagactcgaagcggtgcttggagattgcccgggggatcattgacgcaatggattctattgaccctggccggtttgctgaagtatatgctgagatgtcaatgttgtatgagtcgatgacacagtttgaaatgcctttgagcgcacttgacatgtctttgagcttgatgaagaaaacgcttgcagttcttgagagcgccaaggagatgcatcacattgaaggcagcatctcagcaaggatggggtggctcctcctgcatactcaaaaagctgatgagtctgttccttatctggagagagcggttgataagttgaagaattgttttggaccacgacactttgggttaggttttgcttacaagaatctggggcaggcctatcttgagatggaccaacatcagtcagctgtgaagttctacaaacttgcaaatgatattattgaagctgcatttggactgacacatgaggattctattgatacaaaacagtcccttgcaaatgcatacggactgatgggaagctacaaacttgctatagactttcaagaacaagtcgtagatgcctacagtaggtgtggcagtggtgcctttgaggacctcagggaagctaataggcttttagagcagctcaagaagaaggcacaaggattgcctcatgcagtatttcctgcatattcattgccggttctacctgaaaataatgattagtcctccatcagtgccaatttagatgacttactggtaaactgttactttacaagtgacccctcaagtttttttatttagtgctctttttgttcttatatatactccattacttggttgtggtagcgtcatctgcgtggtcagaattgacgtgttaaaatctctgt

SEQ ID NO: 1525 - DNA, 1372 bp, Sorghum bicolor
gagcacgcggttccatttccatcacagcggcctggctggctgctttggctgaaagggccgtgcgggaagccgccaaccaccgcgaaagcgccggggagtcgggcgaacgaagcaatccaagcgaacgaaacgaggaagaaaacagccggaaaagagagagagagggccggagaccgccggacacaggtcctcgtcggttcgtcccctccgtgggaccgtttcgccgtctcgtctcgtcccgacctcgccgcccgcccgcccgtccatggaggcgctgtggaagcaggcctccaggctcaaggaccaggtcgctcggcagggtgtgttcaagcagtttggctatgggaattctgataatgcgtttacagacgagtcagaggttaaactgcatcagagattggaaaagctttacttatccactcgtgctgctaaacattttcaaagggacattgttcggggtgtggagggctatatagtcacaggatccaaacaagttgaaatagggaataaattgtctgatgacagccagaaatatggtgttgaaaacacatgtacaagtggtgatactttatccaaagctgctacatacttcggaaaggcacgctcacagatggaaaaggagcgtggcaacatgttgaaagcgtttggcacacaggtggcagagccactgcgggcaatggtaatgggtgcacctttagaggatgccagacatctggcccagagatatgacagaatgaggcaagaagctgaagcacaggttgttgaagtatcaagacggcagaacagggtgagggaatcagctgggaatggagatatgatatctaagttggaagctgctgagtacaagcttgaagaattgaagtcaaacatggtgggattagggagggaagctatcgcagcaatgtcggctgttgagactcagcagcaacggttgaccttacagcgtctcattgcactggttgaggctgagagagcttaccataagagagttctggagatacttgaccagttggaacaagaaatggtgtctgagcgccaaaaaattgaagcacccccgactccagcagctgaaaattatatgccaccaccaccaccaccatcttatgatgaagttaatggagcatttgcatccacttctgttaatgagtcagtccaatctgtcgatttcttcctaggagaggcccccgagtccctcaaagcggagagagagtgtgagcgtgccctgtcagcgggggacactgtgagtgtgcgagaggggtcaagcaatggttgggcagaaggtgaatgcaagggcaaagcaggatggtttcctcatgcttatatcgaaaggcaagagcgtgttctagcaagcaaagttccacatatcttttag

SEQ ID NO: 1526 - DNA, 1472 bp, Zea mays
aaccgaacgaaccgacctaggtcgtcgtcggctcgtcccctccgcaggaccggttcgccgtctcgtcccgatctcgccgcctgcccgccgcgccctattaccgccatggaggcgctgtggaagcaggcctccaggctcaaggaccaggtctctcggcagggtgtgttcaagcagtttggctacgggaattctgataatgcgtttacagatgagtcagaggttaaactgcatcagagattggaaaagctttacttatcgactcgtgctgctaaacattttcaaagggacattgttcggggcgtggagggctatatagtcacaggatctaaacaagtcgaaatagggaataaattgtctgatgacagccagaaatacggtgttggaaacacatgtacaagtggtgatactttgtccaaagctgctacatatttcggaaaggcacgctcacagatggaaaaggagcgtggcaatatgttgaaagcatttggcacacaggtggcagagccactgcgggcgatggttatgggtgcacctttagaggatgccagacatatggcccagagatatgacagaacgaggcaagaagctgaagcacaggctgtcgaagtatcaagacggcagaacagggtgagggaatctactgggaatggcgatatggtatcaaaattggaagctgccgagtacaagcttgaagaactgaagtcaaacatggtgggattagggaaggaagctattgcagcaatgtcggctgttgaggctcagcagcaacggttgaccttacagcgtctcattgcactggttgaggctgagagaacttaccatcagagagttctggagatacttgacaaattggaagaagaaatggtgtctgagcgccaaaaaattgaagcacccccgactccagcagctgaaaattatataccaccaccagcaccaccatcttatgatgaaattaatggagcatttgcatccacttctgttaacgagtcagtccaatctgtcgatttcttccttggagaggcccttgattcatttaatgctgaaagtgagtttgagcttaccttgtcagctggtgacattgtaattgtccgaaagatctcaagcaatggttgggcagaaggtgaatgcaagggcaaagcaggatggttccctcatgcttatatcgaaaggcaggaacgtgttctagcaagcaaagttccacatatattttaggagtttctggcagtcgcattacacggttttcatttctattgttgggagctggaactgtatccatgttttcacttcctcttagtttccgcgatgtaattactggctgtcatgtgcatagattaaatttacttccctttttttagtctggaaaaggttttggatgtaacatatttttgagagaccaattggatatgggttaccttgatattgtgaaagagttaaaaactagctgttttatagatttttcttacctggacttc

SEQ ID NO: 1527 - DNA, 1552 bp, Hordeum vulgare subsp. vulgare
gaaaaggaggggagaccaaagcgtcgtcgcccgttccgttcgccgcctccccccgccgcgcgaccccttgggtccggccgccctccccgacccccccttcccctccgtctgccgcgccgcctcccgcgaatccgggccatggaggcgctgtggaagcaggcctccaggctcaaggagcaggtcgcccgccagggtgtgtttaagcagtttggggctggtggaaattctgataatgcattcacagacgagtcagaagttaaattacatcagagattggaaaaactttacttatcaactcgtgctgccaaacattttcaaagggacgttgttcggggtgtggagggctacatagtgacaggatctaagcagattgagataggaaacaaattgtctgatgacagccagaaatatggcagtgaaaacacatgtacaagtggtaatactttgtccagagctgctacatactatggaaaggcgcgttcactgatagaaaaggaacgcgggaacatgctgaaagcatttggtactcaggtggcagagcctctacgggcaatggtaatgggtgcccctctagaggatgctagacatctagcccagagatatgacagaataaggcaagaagctgatgctcaggtcgttgaagtttcaaggcgtcaaagcagagtaagagaatctgctgggaatagcgacgtgatatcaaagttggaagcagccgagtataaacttgaagaactgaagtcaaacatggtgggattaggaaaggaagctgtttcagctatggccgccgtagaggggcagcagcaaagattaacattacaacgcctcatagcaatggttgaggccgagagaacttatcatcagaaagtcctggagatccttgaccatttggaagaagaaatggtatctgagcgccaaaaaatcgaagcacctccaccccctgcagcagaaagttatacgtcaccgccaccaccatcatatgacgaagttaatggcatgtttgcctccacttctgctgatcaggcagtcaactctgtcgatttgttcctgggagaggccctcgattccttcaaggctgagagtgagtttgagctcaacttatcagttggtgacatcgttatcgtccgaaagatatcaagcaacggctgggcggaaggtgaatgcaagggaaaagcaggatggttcccacatgcttacgtcgaaaggcgcgagcgtgttctggcgagcaaagtcccgcatattttctaggggttttgaggaggaacataggttataggtgtttgattttaatagttgaacagtgtgctttcagacttccacagtattcatgtgtatagattgaattttcgccccgtgagccagtttttgcgaggatgatgtacatctgacatttcagaacaccaaactggcgccctaagcgagctctgtgttgttgtttgaaacgttgaattgctcaccggtggagttcatatagtctttttacatggttcattttccgcccgtataagagatgttgatgtgaaagaaaaaaacggccagttggcctgaaatggtc

SEQ ID NO: 1528 - DNA, 2513 bp, Oryza sativa Japonica Group
cagggcgtgtttaagccatttggagctgcctatggaaattcagaaaatgcgtttacagatgaatcagaagttaatctacaccagaggctggaaaaactttacttatcaactcgtgctgctaaagtatgagcaagacaaatttattagagaaacagtatctctttcctttctacctagattattttgataaacattggcatcttttggccagcattttcaaagggacattgtccggggtgtggagggatacatagtcactggatctaaacaagttgacataggtatgtttctccaactatatattagcttatcagaataattttagcttgacacaatattaattactcagtgtttacattactgtatgttgattagttgcaacctaaatttataggaaataaattgtccgacgatagccagaaatatggcactggaaacacatgtacaagtgataacactttatccaaggctgctatgtactatgggaaggctcgttctctgatggaaaaggaacgtgggaacatgttgagagcatttggtacacaggtctgttcatgacttcatgttgatcgacattttttaccttatgacatgtatgattagcatactagtagtttacctgtgcaactagttgttactatgtgcagaacaatgaggtccattcttatggtattgataaatgtgaatagaacgcataacttcagtaagagattgttggattgtaggtggcagagccactgcgagcaatggtcatgggtgcgcctttagaagatgcgagacatctagcccaaagatatgaccgaatgaggcaagaagctgaagcccaggtgaagtagtgtataacttttacttaagtctcttcaaggttatataacatcccaggatattgctctcagatgtacttacagcatatttgaaacaatatccattgacgagcaacctaagctatacaattaaaaaaatagtttgtgtattttatgattctacttccacacattcctaattccttgtaccgcaaggcttacagatgcatagtggagaaactgttattgggaaaggaaaaatgctatgaattctctgagaaccaggactatcccaaaatttctcaacatcacaatattttggaaagcatcacactatattatgtgtacggccagatcttgtcgaccttatttatctatagaatctccataacttgaaactctaaaatatggtcacttgcaagttgcaaagcaataataccagtgacattgccaagttgccttcagttgcacgcagactttgttatctaagatcctactatcttctcagatcatgtgattagttgagtcattccaaaacataagtaatttgtgttccttttctgtgcattgaccttttggtttaaactgaactgtttagcttatttttttctgttcgctttcctaggctgttgaagtttcaagacggcaaaacagagtaagagagtcagctccgaatggagatgtgataacaaagctggaagctgctgaatacaaacttgaagaacttaagtcaagcatggtaggattagggaaggaagctgttgcagcaatggctgccgttgaggctcagcaacaaagattgacattacagcgccttattgcgatggtaaccatgagctatacccgttaacgttacattttctggtgcatcatgctattgcatttatctgaaaattatatatagctgctaatcagtcttgctctgaaggttgaagccgaaagagcctaccatcagagagttctggagatccttgaccacctggaacaagaagtatgtatactccagcactatttacattttttttaaaacatggcctgttgacacagcccacacactgtcaagtgtgcagaagtcctatcttcatcaagttaatgattattttttgattggtttagatggtatcagagcgtcaaaagattgaagcacctccgaccccatcagcagaaaattacatggcacagccaccaccatcttatgacgaagtcaatggcatgtttgcatcctcctctgtcgatgattcagtgacatctgtagatttcttcctaggagaggtctggcattcttttcatgcaaaatctattgcaccatctgccaaatgaacatgaatttaccgatgttatgcttcttacataaattgtttggtcgttatgatgcaggcccttgattccttcaaggctgaaagtgagtctgagcttaacttgtcagctggagacattgttattgtccggaaggtaatatacctctgctgtccatgttttgtaatcttcaattgagttgccgatattgttccgatgtttctaaatacaagttcctggcagctaacatatcataattgagctgtcagtaatctaatgtggtcttgtccgaacacagatatcaaccaatggttgggcagaaggcgaatgcaagggaaaagcaggatggttcccacatggttatatcgaaagacgagagcgagttctagctagcaaggttccacatattttcta

SEQ ID NO: 1529 - DNA, 1420 bp, Zea mays
ccgaacgaaccgacctaggtcgtcgtcggctcgtcccctccgcaggaccggttcgccgtctcgtcccgatctcaccgcctgcccgccgcgccctattaccgccatggaggcgctgtggaagcaggcctccaggctcaaggaccaggtctctcggcagggtgtgttcaagcagtttggctacgggaattctgataatgcgtttacagatgagtcagaggttaaactgcatcagagattggaaaagctttacttatcgactcgtgctgctaaaggacattgttcggggcgtggagggctatatagtcacaggatctaaacaagtcgaaatagggaataaattgtctgatgacagccagaaatacggtgttggaaacacatgtacaagtggtgatactttgtccaaagctgctacatatttcggaaaggcacgctcacagatggaaaaggagcgtggcaatatgttgaaagcatttggcacacaggtggcagagccactgcgggcgatggttatgggtgcacctttagaggatgccagacatatggcccagagatatgacagaacgaggcaagaagctgaagcacaggctgtcgaagtatcaagacggcagaacagggtgagggaatctactgggaatggcgatatggtatcaaaattggaagctgccgagtacaagcttgaagaactgaagtcaaacatggtgggattagggaaggaagctattgcagcaatgtcggctgttgaggctcagcagcaacggttgaccttacagcgtctcattgcactggttgaggctgagagaacttaccatcagagagttctggagatacttgacaaattggaagaagaaatggtgtctgagcgccaaaaaattgaagcacccccgactccagcagctgaaaattatataccaccaccagcaccaccatcttatgatgaaattaatggagcatttgcatccacttctgttaacgagtcagtccaatctgtcgatttcttccttggagaggcccttgattcatttaatgctgaaagtgagtttgagcttaccttgtcagctggtgacattgtaattgtccgaaagatctcaagcaatggttgggcagaaggtgaatgcaagggcaaagcaggatggttccctcatgcttatatcgaaaggcaggaacgtgttctagcaagcaaagttccacatatattttaggagtttctggcagtcgcattacacggttttcatttctattgttgggagctggaactgtatccatgttttcacttcctcttagtttccgcgatgtaattactggctgtcatgtgcatagattaaatttacttcccttttttttagtctggaaaaggttttggatgtaacatatttttgagagaccaattggatatgggttaccttgatattgtgaaagagtt

SEQ ID NO: 1530 - DNA, 1595 bp, Oryza sativa Japonica Group
agaagaagaagaaagtagcaagccggagtcgagagcctctcaacccatcggccatcgcccaccaccgccattcgccaccacctcgcctccgattcagatctccctcccccccttccattccacgcccatcggattccctcccgattccgctccattcctccccgcctccgcccccatctccgccgacctcgtcgtcgtcggcgtcctcatccaggcagtctcggcggcgattcgatcgccgccacggtcgccgatggaggccatccggaagcaggcgtccaagctccgggagcaggtcgcccggcagcagcaggccgtgatgaagcagttcgggggcgggtacggcgcggacggcgcgttcgccgacgaggccgaggcgcagcagcactccaagctcgagaagctctacatctccacgcgcgccgctaagcacttccaaagggacatagttcgcggggtggagggatacattgtcacagggtcgaagcaggtcgaaatcggtaataagttatgcgaggatggcaagaagtatggagcggagaacacttgcaccagcggaagcacgctgtcgaaggcggcgttgtgtttcgccaaagcacgctcactgatggagaaggagagagggaacctgctgaaagcactgggtactcaggtggcagaaccgttgagggctatggtgatgggagctcctttggaagatgctcgccatcttgcccaaagatacgacaggatgcgtcaggaagccgaagcacaggctattgaagtctcgaagcgccaaatgaaattaagagaaacatctgggaatggtgatatgatttcaagattagaggctgctgaatcaaagttgcaagagttaaagtcaaacatgggggttctaggcaaggaagccgttgcatcaatgactgctgttgaagctcaacagcaaagactgaccttgcaacgactaattgcaatggtcgaatctgagagaagttatcaccagagggttctgcagattcttgatcaacttgaaagagagatggtatctgagcgccaaagaattgaaggagcacctcctccagctgttgagagttctatgccaccaccaccttcatatgaagaaattaacggtgttttcatgaggaatccaacagtcgctgaattggtggaaactgtggaattcttcttggctgaggccatccagtcttatcgtgctgagagtgaaactgagctcaacctggcagctggtgactatatagttgtccggaaggtgtcaaacaatggatgggcagaaggtgaatgcagagggaaagctggctggttcccttacgactacatcgagaaaagggaccgtgtgcttgcaagtaaagtcgcccaggtcttctaggcgttcaatgagccatacatacataaccctggtgttgtacactgtattatgatcgttcgtgatcttcaaagaccctctgatcagagaaatcacaaatattcttttgttctattattgtcattatcactaccccttttgtcaaaaccagtgcagccttttgtatgacatcttgttgcatggctagctttctgaatatttcaaaatatacagcggagaggacactgttcat

SEQ ID NO: 1531 - DNA, 2842 bp, Hordeum vulgare subsp. vulgare
ggaataatcacaacgacgagaacaaaagaaagggggaaagagaaagggtaacggagcaggccggaccggagcagcggaagcctcaagccaccaccaccatcctccgattcagatctcccctcccattccaccgaccggacccctctccgtctccatttctccacaccaaacgcctctccgacctcggtgacgacctcctcgtcgtacagggggccatcagcggcggcggcggaggccaatggaggccatccggaagcaggcatccaagctccgagagcaggtcgcccggcagcagcaggccgtgctgaagcagttcgggggcgggtacgcggacagcgtgttcgcggacgagggcgaggcgcagcagcactcgaagctcgagaagctctacatctccacgcgcgccgccaagcacttccaaagggatatagttcgtggggtcgagggctacatcgtcacaggctcgaagcaagtcgaattaggcaataagttatgtgaagatggcaagaagtatggtgttgagaatacctgtaccagtgggagtacactctcgagggcggcgttgagtttcgcgaaggcacgatcgttgatggagaaggagcggggaaacctgctgaaagcgtttggcacccaggttgcagagccactgagggctatggtgatgggagctcctttggaagatgctcgtcaccttgcccaaagatatgacagaatgcgtcaagaagctgaagcacaggctattgaagtttcaaagcgccagatgaaattaagagagacatctggaaatggtgatatgatttcaaggttagaggctgctgagtcgaagctgcaagagttaaaatcaaatatggggactctaggcaaagaagctgttgcagcaatgactgctgttgaagcccaacaacaaaggctgacattacaacgacttatcgcgatggttgaatctgagagaagttaccaccaaagggtcctacagattctagatcaacttgaaagagagatggtagctgagcgccaaagaattgaaggagcacctcctccagtcattgagaactctatgccaccgccaccttcatatgaagaagttaacagtatattcatgaggactccaacagttgccgaattggtggagacagtggagcacttcctggctgaggcgatccagtcataccgagctgagactgaaactgagctcaacctggcaaccggtgactacatagtggtccggaaggtgtcaaacaatggatgggctgaaggtgagtgcagggggaaagctggttggttcccttacgagttcatcgaaaagcgggaccgtgtactggcgagcaaagtcgcccaggtcttctagaagttcattgagccatacatgtccttggcgttgtacaatgtgcattataatgttctttcgcctccaaagacgttgatcagtgaagagctcgtggaaattccttttgttctatatatgttctttttgtcaagaagacatgtgcctgatggatggctttttgtgcctcatggctagccgtgtgcactgttgttatctgcatcctccccccaaatatgacactgacttgaccattttttccagaattcttttttgcgggaacccaaagtatatatatatgtcaaggggaggaatccatcaatgtttgaaagcaccaaaggcttttcttataaacaaatcagaaattccatacccttctcgatctggagattccttttcgaatccaattctcaacgggaattgaacatgtttgtatggcaacccagcgggaaatgtgcgtggtgttctcgtttgaatggcatagaactttgatcagacgctgacagatggggcccgagccttgagttctgatgagttgcttatctcctacctcgctcgctctgcctctgcagtaccccctgcttatcccctcccgagtccgtcgcctcctcggcattccgtcgaacaccatgacgagcgtggcggcggcggtcgccctcctccgcctccctctcgcccgcctctcctcccacctccggtccctccctgcccctcccgtcccgtccgctcgcctccgcctctccgccccccaccgccctctctgctccctcctcaccggccacggcctcgccgtagcggccgtgtccgaggcggtggccgcggcggacgaagaagagttcgaagcgacggaggagcagcaggaggaggaggcgcccccctccttcgtgctcccgcggctgccgcggccgaagctcgacgtgaaggagcggaaggagctcgcctcgtacgcgcacggcctcggcaagaagctcaagtcgcagcaggtcgggaagggcggcgtgacgcccaacctcgtcaccgccttcacggacaaccttgagtccaacgagctcctcaagctaaaaattcatgggaattgccctggagaactacctgatgtgatacgacaacttgaggagtcaaccggatccattgctgtcgaccaaattggccgctcagttattctatataggcctagctccagcaagatgaaaaagagggaagaagttgctagaaacagggaagagtatgcaagaaacaatccgaggtttggaaaatctgaaaatgcatttgaagaaggtcctaggaacaacagcgcaggcaggagattcgtaaaatctgggtcgacatttaggactcaacagaagcgaagaccggtagcatccaaggggtcgtcatacagccgagggtagcagcattgaaaataacagattgtttttcttattgtttggaggaatcatgtaaattttagaccaactagtagttgtataatggacattagtgtttaatttgtgctagtaaaccatgattccaagtctc

SEQ ID NO: 1532 - DNA, 1444 bp, Zea mays
aattagtccattcccattcccatcccgaccccgtcttgccaccggctacacgctctcggagtctcggtcgctgcttgccaccgaccacaccctctctatcgacgccgcccaaatggaggccatccggaagcaggcctcaaagctccgggagcaggtagctcggcagcagcaggcggtgatgaagcagttcgggggcgggtacggcgcagacggcgtgttcgctgacgaggctgaggcgcaccagcactccaagctcgagaaactctacatctctacgcgcgcggccaagcacttccaaagggatatagttcggggcgtcgagggctacatagtcacggggtcgaagcaagtcgagatcgggaacaagttatgtgaggatgggaagaagtatggcactgagaacacttgtaccagtggtagcacactgtcgaaggcggcattaagttttgctaaggcacggtccatgatggaaaaggaaaggggtaacctgctgaaagcccttggcacacaggttgcagaaccactgagagctatggttatgggagctcctttggaggatgcccgccacctcgcccaaaggtacgacagaatgcgtcaagaatctgaagcgcaggctattgaagtttcaaaacgccaaatgaaactaagagaagcatctggaaatagtgatatgatttcaaggctagaagcggctgagtcaaagctgcaggagttgaaatcaaatatggggggtttgggcaaagaagctttggccgcaatgactgccgttgaaggccaacagcaaagactgacactgcagcgtcttattgcattggttgaatcagagagaaactaccaccaaaaggtcctacaaattcttgatcaacttgagagagagatggtatctgagcgccaaagaattgaaggggcacctcctccggtggttgagagttccatgcctccaccgcctgcatatgaagaagtcaatggtatattcatgaggaatacggtcgcagagttggtcgagaccgtggagtatttcctggctgaggcaatccaatcatatcgagcagagagcgacactgagctcaacctttcagctggtgactacatagtggtccgaaaggtgtcgaacaatggatgggccgaaggtgaatgcagggggagagctggctggttcccctacgattacatcgagaaacgagagcgtgtgcttgcaagtaaagtcgcgcaagttttctaaaactaaaacttttgccgagacatccatatattcccggggatgtgcaatgtgtattatgcttgatcgtcagaagagaagatctgtaattttgctggaagctgcctgttggatggcttgttcctgcctggccgtctgcattgttcaaattcatgtggcaggaactgaacattattaatgcttaatcttcattcttcagttatcccgttaaaaaaaaaaaaaaaa

SEQ ID NO: 1533 - DNA, 1443 bp, Zea mays
cccgaccccgtcttgccaccggctacacgctctcggagtctcggacgccgcccaaatggaggccatccggaagcaggcctcaaagctccgggagcaggtagctcggcagcagcaggcggtgatgaagcagttcgggggcgggtacggcgcagacggcgtgttcgctgacgaggctgaggcgcaacagcactccaagctcgagaaactctacatctctacgcgcgcggccaagcacttccaaagggatatagttcggggcgtcgagggctacatagtcacggggtcgaagcaagtcgagatcgggaacaagttatgtgaggatgggaagaagtatggcactgagaacacttgtaccagtggtagcacactgtcgaaggcggcattaagttttgctaaggcacggtccatgatggaaaaggaaaggggtaacctgctgaaagcccttggcacacaggttgcagaaccactgagagctatggttatgggagctcctttggaggatgcccgccacctcgcccaaaggtacgacagaatgcgtcaagaagctgaagcgcaggctattgaagtttcaaaacgccaaatgaaactaagagaagcatctggaaatagtgatatgatttcaaggctagaagcggctgagtcaaagctgcaggagttgaaatcaaatatgggggttttgggcaaagaagctttggccgcaatgactgccgttgaaggccaacagcaaagactgacactgcagcgtcttattgcattggttgaatcagagagaaactaccaccaaaaggtcctacaaattcttgatcaacttgagagagagatggtatctgagcgccaaagaattgaaggggcacctcctccggtggttgagagttccatgcctccaccgcctgcatatgaagaagtcaatggtatattcatgaggaatacggtcgcagagttggtcgagaccgtggagtatttcctggctgaggcaatccaatcatatcgagcagagagcgacactgagctcaacctttcagctggtgactacatagtggtccgaaaggtgtcgaacaatggatgggccgaaggtgaatgcagggggagagctggctggttcccctacgactacatcgagaaacgagagcgtgtgcttgcaagtaaagtcgcgcaagttttctaaaacttttgctgagacatccatatattcccggggatgtgcaatgtgtattatgcttgatcgtcagaagagaagatctgtaattttgctggaagctgcctgttggatggcttgttcctgcctggccgtctgcattgttcaaattcatgtggcaggaactgaacattattaatgcttaatcttcattcttcagttatcccgttaatatgtatccatactttttgtttgtttgtttgaagcatacaacaagacgagaaatcaagcgctaattattctgtatc

SEQ ID NO: 1534 - DNA, 1482 bp, Sorghum bicolor
aagagaaagaacaccggagcgggagcctgaccctgacgccatctctccttcctcctccctgattcagatctctcaccggcccccgctccattcccaccctaactccgtctcccaccgaccagaccttctcgatcgccgccggccaatggaggccatccggaagcaggcctcgaagctccgggagcaggtcgctcggcagcagcaggcggtgatgaagcagttcgggggcgggtacggcgcagacggcgtgttcgcggacgaggccgaggcgcaacagcactccaagctcgagaagctctacatctccacgcgcgccgccaagcacttccaaagggatatagttcggggcgtcgagggctacatcgtcacggggtcgaagcaagtcgagattgggaacaagttatgtgaggatggcaagaagtatggcactgagaacacttgtaccagtggaagcacactgtcgaaggcggcattaagttttgctaaggcacggtccatgatggaaaaggaaaggggtaacctgctgaaagcccttggcacacaggttgcagaaccattgagggctatggttatgggagcccctttggaggatgctcgccacctcgcccaaagatatgacaggatgcgtcaagaagctgaagcacaggctattgaagtttcaaaacgccaaatgaaactaagagaagcatctggaaatagtgatatggttgcaaggctagaagcagctgagtcaaagctgcaggagttgaaatcaaatatgggggttttgggcaaagaagctgttgcagcaatgactgctgttgaagcccaacagcaaaggctgacactgcagcgtcttattgcattggttgaatcagagagaaactaccaccaaaaggtcctacaagttcttgatcaacttgagagagagatggtatttgagcgccaaagaattgaaggagcacctcctccggttgttgagagttccatgcctccgccgcctgcatatgaagaagtcaatggtatattcatgaggaatacagttgcagaattggtcgagactgtggagtatttcttggctgaggcaatccagtcatatcgagcagagagtgataccgagctcaacctttcagctggtgactacatagtggtccgaaaggtgtcgaacaatggatgggccgaaggtgaatgcagggggaaagctggctggttcccctacgactacatcgagaaacgagagcgtgtgcttgcaagtaaagtcgcccaagttttctaagttttctaagacttctgctgagccataacatatccccggggttgtacaatgtgtattatgcttgttatatcttcagagaagatctgtaattttgctgaaagctgcctgttggatggctcgttcctgcctggccgtctgcattgttcaaattcatgtggcaggaactgaacattaatgcttatatcattcttcagttatcctgtcaatatatacctatatatattttt

SEQ ID NO: 1535 - DNA, 2658 bp, Sorghum bicolor
atggcagggtggggatcgtccagggtggcggcgtgcgggccgtggggccgcggcgcggcgctggagagggagctgtcgcgggacggcagccactacagcatctccagcggcatcctgccgtcgctcggcgcgcggagcaaccgccgcgtcaagctcaggcccttcatcgtctcgccctacgaccgccgatacagatgctgggagacttttctcataattcttgtggtgtattctgcatgggtttccccatttgagtttggcttcattcggaaaccgacgggcgccctagctgcagtggacaatgtcgtgaatgcgttcttcgcagtggacatcatcctgaccttctttgtagcttacttggatagaatgacatacctgcttgaagatgatccgaaaaggatagcttggcggtatactaccagttggtttgtccttgacgtggcctccaccatcccaagtgaatttgctcggaggatactaccaccaaacctcaggtcatatggatttttcaacatgcttcgtctatggcgtctccgtagagtcagctctctctttgctagattggagaaagatagacatttcaattacttctgggttcgatgtgcaaagctcatatgtgtcacactttttgctgtccactgttcggcatgcttctactatcttctcgctgataggtatcctgtcccaacggatacgtggattggcaattcgatgccagattttcatcagcggggtttatggattcgctatgtaatatcagtatattggtcaatcactactcttaccactgtgggttatggtgatttgcacgcggagaacacaagggagatgatattcaacattttctacatgctattcaaccttggattgactgcctatttgattggtaacatgaccaatctggttgtccatggcaccagccgtactcgaaaatatagagatacaattcaagcagcaaccagctttgcactaaggaatcagttaccaagtcggctccaagatcagatgatctcccatcttagcttgaagttcaggacagattcagaaggtcttcaacaacaagagaccctcgatgcgcttcctaaggctataagatccagcatttctcagtatctgtttttcaatcttgtccaaaaggtctacttgtttgaaggggtgtccaatgacctgatttttcaactggtttctgagatgaaagctgaatattttccacctagggaagatgtgattctgcagaatgaagcacccacagacttttatattttagttactggtagcgcggagttggtagagttgcgaaatggcggagaacagatagctggagtggctaaggcaggagatgttgttggagaaattggggttctttgctataggccccaactattcacagttcgaacaaaatcattatgccagcttctgcgtatgaatcgcactgcctttctcagccttgttcaatccaatgttgcagatggaacaataataatgaacaaccttatgcagttactgaaagagcagaaagacaacagtgtaatggcgggtgttctgaaggagattgagaacatgctagcgcggggtcgtctggatttgccagttaccctctgctttgcagtaaataaaggagatgattttatgttacatcaacttttgaagcgtggtttggatccaaatgaatcagataacaatgggcatacagcactgcatatagctgcttccaaaggagacgaacaatgcgtcaagcttcttctagactacggagctgatccaaatgctagagattccgaaggaaaagtgcctctatgggaggctttatgtgaaaagcataatgcagtaatagagctgttagtagagagtggtgcagagctatcatctggagacacagccttgtatgcttgcatcgctgttgaggaaaatgatgctgagttgcttgagaacattatccgctatggtggcaacataaacagctcaacgaaagatggaaccacaccgctgcatcgtgcagtctgtgatggaaatgttcagatggttgagttgttgctggaacacggagctgacatcaacaagcaggacaacaatggctggtcagcaagagatctagctgatcagcaaggccatgatgacattcaggttctctttaaatcacgaaaagcacataggcagcatgcctcaaatggcagagtggcacctatgctgatagggaggttcaacagtgaaccctcaatgccaaatatgaaccatgaagacgccgaagtacgcagcaaagttgttccacagaagctcctcagaaagagggtcagtttccaaaattctcttttcggtgtcatttcttcatcccaggcccgccaggacacaggtggtctgctctcgaaaggccttgctggaacaggtggcccaagttgccatcacgactccctcatcagggtgacaatcagctgccctgagaaagggaatgctgcagggaagcttgtgcgcctaccacggtcgatgactgagcttctcgaactaggtgcaaagaagttcgacttcaagcctaccaaggtcctgacagttgggggtgctgagattgatgaggtggagcttatcagagacggtgatcatattgttctcgtcagtagtgactgggtgccagatgttgcacaaattagacctaacgatcaatga

SEQ ID NO: 1536 - DNA, 2664 bp, Zea mays
atggcagggtgcgcaccctccagggtggcgtcgtgcgggccgtggggcggcagagcggcgctagagagtgagctgtcgtgggacggcagccactacagcatctccagcggcatcctgccgtcactcggcgcgcggagcaaccgccgcgtcaagctcaggcccttcatcgtgtcgccctacgccgaccgatacagatgctgggagactttcctcataatccttgtggtatactctgcatgggtttccccatttgagtttggcttcattcagaaaccaacgggcgccctagctgcagtggacaatgtcgtgaatgcattcttcgcagtggacatcatcctgaccttctttgtagcttacttggatagaatgacatacttgcttgaagatgatccaaaaaggatagcttggcggtatactaccagttggtttgttcttgacgtggcctccaccatcccgagtgaatttgctcggaagatactaccaccagacctcaggtcatatggatttttcaacatgcttcggctatggcgtctccgtagagtcagctctctctttgctagattggagaaagatagacatttcaattacttctgggttcgatgcgcaaagctcatatgtgtcacactttttgcggtccactgttcggcatgcttctactatcttctcgctgatatgtatcctaccccaacagatacgtggattggtaattcgatgccagattttcatcagcggggtttgtggattcgctatgtagtgtcagtatattggtcaatcactacgcttaccactgtgggttatggtgatttacacgcggagaacacaagggaaatgatattcaacattttgtacatgttattcaaccttggattgactgcctatttgattggtaacatgaccaatctggttgtccatggcaccagccgtactcgaaaatatagagatacaattcaggcagcgaccagctttgcactaaggaaccagttaccaagtcggctccaagatcagatgatgtcacatctttgcttgaagttcaggacagattcagaaggtcttcaacaacaagaaacgctcgatgtcctccctaaggctataagatccagcatttctcagtatctatttttcaatcttgtccaaaaggtttacttgtttgaaggggtgtccaatgacctcatttttcaactggtttctgagatgaaagctgaatattttccacctagggaagacgtgattttgcagaatgaagcacccacagacttttatattttagttatcggtagcgcggagttgatagagttgcaaaatggcggagaacagatggttggagtggctaaggcaggagatgttgttggagaaattggggttctttgctataggcctcaactattcacagttcgaacaaaatcattatgccaacttctgcgtatgaatcgcactgcctttctcagccttgttcaatccaatgttgcagatggaacaataataatgaacaaccttattcggttattaaagcagcagaatgacaacagtgtaatgatgggtgttctgaaggagtacgagaacatgctagctcggggtcgtctggatttgccagttaccctctgttttgcagtaaataaaggagatgattttatgttacaccaacttttgaagcgtggtttggatccaaatgaatcggataacaatgggcatacagcactgcatatagctgcttccaaaggagacgaacaatgtgtcaagcttcttctagagcacggagctgatccaaatgctagagactccgaaggaaaggtgcctctatgggaggctttatgtgaaaagcagaatccagtggtagagctgctagtacagagcggtgcggggctatcatctggagacgtggccttgtactcttgcgtcgctgttgaggaaaatgaccctgagctgcttgagaacattatccgttacggcggcaacgtaaacagctcaatgaaagacggaaccacgccgctgcaccgcgcggtctgtgacgggaacgtccagatggttgagttgttgctggaacatggagctgacatcgacaagcaggacaacaatggctggtcggcgagagctctagctgaccagcaaggccatgatgacatccactctctctctcgatcgcggaaagcgcataggcagcagcacgcctccaagggcacagtggcacctgtgccgatatggaggttcaacagcgaacccacgatgccaaacatcaaacatgaagaagacgctgagctacgcggcaaagttgttccgcagaagctcctcagaaagagggtcagcttccagaattctcttttcggtgtcatctcttcgtcccacgcccgccaggacactggtcgtctgctctcgaaaggccttgctggaccaggtagtccaggttgcagccacggctccctcgtcagggtgacaatcggctgtcctgagaaggggaacgctgcagggaagctcgtgctcttaccgcggtcgatgactgaggttctcgaactaggcgcgaggaagtttggcttcaagcctaccaaggtcctgacgactgggggtgctgagattgatgaggtggagcttatcagagacggtgatcatgttgttctcgtcagtgatgactgggcgccagatgttgcacaattaagaccgaacgacaagtga

SEQ ID NO: 1537 - DNA, 3389 bp, Oryza sativa Japonica Group
aagctcgatcgaagctctcacctctcctctcttctcttctcttcttccgcgacacgtcttcgccgccgccgcagccgccgtcgggcgtcggctctcctccacttaccagaaaaccgaatcaccgagaacttctctctctagtattcaaggcgagagattcccaccccgcgattcccttgcaggccgccagatttgtgggccttgtgggggtgggcgctccattaaacccgagagaggggaggcacgcgcgcccgccgaggggcagcgcaatggcgaggtggggcgccgctcggatggcggcgtgcgggccgtggggccgcaaccggagggtcggcgccggcgacgcgttcgaggccagcgaggtgaggcgggacgggcgcagcaggatgatgcccgcgtgcgggccgtggggggcgggccatggcggcggggacccggcgctcgagagggagctgtcgcgggacggcagccactacagcatctccagcgccatcctcccgtcgctcggcgcgcggagcaaccgccgcatcaagctccgccgcttcatcatctccccctacgaccgccgatacagaatctgggagactttcctcatagttcttgtagtctactctgcgtgggtctcaccatttgaatttggcttcattccgaagcctacgggggctctagctacagccgacaatgtggtgaatgcattcttcgcggttgacatcattctgaccttctttgtggcttatttggataaaatgagctatatgcttgaagatgatccaaagaagatcgcatggcgttatagtaccacatggcttgttcttgacgtggcctccaccatcccatcagaatttgctcgcaggatactaccttcaaagcttaggtcatatggatttttcaacatgcttcgtctgtggcgtctccgcagagtcagctctctgttttctaggttggagaaggatagacacttcaattacttctgggttcgatgtgcaaagctcatttgtgtcacactttttgctgtgcactgtgcggcatgcttctactatcttcttgctgataggtaccccgtcccaacttctacgtggattggcaattacatggcagatttccatgaacggagcttatggattcgctacgtaacatcagtctattggtcaatcaccactcttaccaccgtgggctatggggatctacatgcagaaaatacaagggagatgatcttcaacattttctacatgctctttaaccttggtttgaccgcttatttgatcggtaacatgaccaatttggttgtccatggcactagtcgtactcgaaactatagggatacaatccaagcagcaacaagctttggagtaagaaatcagctaccacctcggctgcaagatcagatgatttcacatattagcttaaaatacaggacagattcagaaggtcttcaacaacaagagatccttgattcactgcctaaagctattaaatctagcatttctcaatatctgttcttccatctggttcaaaatgtttacctgtttcaaggagtctcaaatgatctgatttttcaactggtttcggagatgaaagctgaatattttccacctagggaggatgtgattttgcagaatgaagcacccactgacttctacatcttagtttctggtagtgtggagttagtagagcagcaaaatggtgcagaccaggtgatacaagtggctacgtcaggagaggttgttggagaaattggggttctttgctacagacctcagctattcacagttcgaacaagatccttgtgccagttgttgcgtttgaatcgtacagcttttctcagcattgttcaatccaatgttggggatggaactatcataatgaacaaccttattcagttccttaaagagcagaaggagaacagtgtaatggctggtgtcgtaaaggagatagagagtatgctagctcggggaaatctggatttgccaattacactctgttttgcagtaactagaggagatgattttttgttgcatcaacttcttaagcgtggtatggatccaaatgagtcagataatgacgggcataccgcactgcatatagctgcttccaaaggaaacgagcaatgcgtcaggcttctattagaatatggagctgatccaaatgccagagactcagaaggaaaagttccactgtgggaagcgctgtgtgagaagcacgccgccgtcgtgcaactattagtcgaaggcggcgcggatctgtcgtcgggtgacacgggcttatacgcttgcatcgccgtggaggagagcgacaccgagctgctcaacgacatcattcactacggaggcgacgtgaacagggctcgccgggacgggaccaccgccctgcaccgcgccgtctgcgacggcaacgtccagatggccgagctcttgctggaacacggagccgacatcgacaagcaggacggcaacggctggaccccgagagccctcgccgagcagcagggccacgacgacatccagctcctgttccggtcgcgcaaggcggcgacggcgagtggccaccatcacgtcccaagctccaccaccaccagggtggcgccggcggcggcggcggcatcactgatcgggaggttcaacagcgagcccatgatgaagaacatgatccacgaagacgccgacctgcccagccgggttctccccgagaagctccggaggaagcgggtcaccttccagaactccctcttcggggtcatctcgtcgtcgcaggcgcagcgggagaccgaccacccgctctcgaggggtggcctcgcggcgacgggctccccgaacccgagcagcggcagccgcaacgccgtcatcagggtgacgatcagctgccccgagaaagggaacaccgccgggaagctcgtgctcctgcctcagacgctggacatgctcctcgagctcggcgccaagaagttcgacttcgcgccaaccaaggttctcaccgtggagggcgccgaggttgacgaggtggagctcatcagagacggcgatcatcttgtgctcgtcagtaatgaatgggatgcagagaagatgaaaggcaagagctagtaaaggagttgtgtgtttttttttctttttcttttttggttgtttactgttgatttccaagaaaggggagatagaatttaccccggagtccaacggttagctaaggaataactggaaatcattggtatagttattccaccatgaagagatggtgaaattgatgggttacgtccggtgttcgtaagtagagaagcgtaagaatttgattttgttatagcgtgttgtgatgttagcctgtttttgttttagttggcaagttgatctgctggcatgtacagttttacgcttttctaatttttgaaggaaaagtcc

SEQ ID NO: 1538 - DNA, 3120 bp, Hordeum vulgare
cagcaacgcaactagggaaagaatccgacccggaccttttaattactacgcgccgcaccgcagaggttccgtggccctccgtccgtggcgttaaacccgcccggcggcgggttggtgagcggggcgccgcgccgcaatgtcgtcgaggtccggcgccgccaggatgcgggcgtgcgggccgtggggcgaagccagcggcagcggcgccgtcggggacgcgcacgcgctcgagagggagatgtcgcgggacggcagccactacagcctctccagcggcatcctgccgtccctcggcgcgcggagcaaccgccgggtcaagctccgccccttcatcatctcgccctacgaccgccgatacagattgtgggagactttcctcatagttcttgtggtctactctgcgtggatctccccattcgaatttggcttcattcggattcctacaggaggcctagctgcgacggacaatgccgtgaatgcaatcttcgcaattgacatcatcctgaccttctttgtagcttacttggacagactgacctatttgctggaagatgatccaaagaggattgcttggcgttatgctaccagctggttggttcttgacgttgcctccactatcccatcagaaattgctcgcaggatgctaccttcaaagctcagatcatatggattcttcaacatgcttcgtctatggcgtctccggagagtcagctctctctttgctagattggagaaggatagacacttcaattacttctgggttcgatgtgcaaagctcatttgtgtcacactttttgccgtgcactgtgcagcatgcttctactatctccttgctgataggtacccgaacccacaagaaacgtggattgggaataccatgccagattttcattccaagggcttgtggattcgctacgtaacatcagtatattggtcaatcaccacgcttaccactgtgggttatggggattatcatgcggagaacatacgggagatgattttcaacattttctacatgttctttaaccttggactgactgcctatttgattggcaacatgaccaacttggttgtccatggcaccagccgtactcgaaaatatcgggatacaattcaagcagcaaccagctttgcacttaggaatcagctaccacctcggttgcaagatcagatgatatcacatcttagcttaaagttcaggacagattctgaaggtcttcaacaacaagagactcttgatgcgctgcctaaggctattagatctagcatttcgcaatatctgtttctcaatctggttcaaaacatttacttgtttcaaggagtatctaatgatctgatttttcaactggtttcggagatgaaagccgaatattttccacctagggaggacgtcattttgcagaatgaagcacccactgacttctacattttagtttctggtagtgtggagttagtagaggttccaaatggtgcggaacatggtgcagaacaggtggttggagtggctaagtcaggagatgttattggagaaatcggggttctttgctataggcctcaactattcacagtccggacaagatcgttatgtcagcttctacgcatgaaccgtacggcctttctcagcattgttcaatccaatgttggagatggaactatcataatgaacaaccttattcagttactaaaagagcagaaagacggcgtaatggtaggtgttctgaaggagatcgagagcatgctagctcgaggtcgtctggatttgccaattacactcggctttgcagtgactagaggagatgaccatttgttgcatcaactacttaagcgtaatttggatccaaatgagtcagatcaagatgggcgtacagcactgcacatagctgcttccaaaggaaatgagcaatgtgtcaagcttctattggattatggagctgatccaaatgccagggattcggaaggaaaggttcccctatgggaggctgtgtatgcaaaacatgatacggttgtgcagctgttaatcaagggcggtgcagaactgtcagcaggggatacaagcttatatgcttgcaccgcagtcgagcaaaatgatatagaactgctcaagcaaatactcaagcatgtcatcgacgtaaacaggccatccaaagatggaaacattccgctgcaccgcgctgtctgcgacgggaacgttgagatggtcgagctattactgagacacggagcagacatcgataagcaggacagtaacggctggaccccaagagctctagctgagcaacaaggtcatgaagaaatacaaaacctgtttagatcagtggtagcaccaaggaaatacacatcaaacggtagggtgacaccaatgctgctaggcaggttcagcagtgatccctcgatgcaaaaggtgatccgtgaagatgctgagcagcaacccagcaaagttctaccacaaagaaggaaagtcagcttccacaactctctttttggtgtcatctcttcgtctcatccgcgccgagagactgatcatctgctctcaagaggtcttgcggcaacaggtggtccgagttatcctcaggcccatcacagaccactcatcagggtgacaatcggctgccccgagaaggggaacactgctgggaagcttgtgatcttgccggggtcgatgaaggagcttcttcagctaggtgcgaagaagtttgacatgatgcccactaaggtcctgacaattgagggcgcagaggttgacgaggttgagctcatcagagatggtgatcatcttgttcttgccagcgatgactgggtaccagacgatacacaaataagaggtgaaaattaggcacagaattaaattttccggtttactgtaatttggcacgcttgtaacaagagccaatggtgaaagaataactggaaatcaccaatggctactccacgtctccaccacgaaaaagatggtgaaatagggttatgcccagcaggtgaaatgtacaatcatttccaccctgtatagaaattcttttctgctgggcatgcggaattttcacaggctcttttgatttaatttaaaggctatccagagcaattattaaggttatctagcttcaaaaaaaaaaaaaaaaaaaa

SEQ ID NO: 1539 - DNA, 3300 bp, Triticum aestivum
ctggagtcgttctccctccatccctccgctcgcctctgcccagccacagccagagccagggccgtcgccgcccgcgccacgccactcccaacatctcccgcgctgctcttcccaagaaaacaaacccaaaccagcaacgcaagtagggaaagaatccgagtccgacccagacttttttaacaactacgcgccgcgccgcaagattccgtggccctccgtccgttaaacccgcccggcccggcggcggggtccggtgagtgagcgagctaggcgccgcaatgtcgtcgaggtccggggccgccaggatgcgagcgtgcgggccgtggggcgagggcggcagcggcgtcgtcggggacgcgcacgcgctcgagagggagatgtcgcgggacggcagccactacagcctctccagcggcatcctgccgtccctcggcgcgcggagcaaccgccgcgtcaagcttcgccgcttcatcatctcgccctacgaccgccgatacagattgtgggagactttcctcatagttctcgtggtctactctgcgtgggtctccccattcgaatttggcttcattcggattcctacgggaggcctagctgcgacggataatgccgtgaatgcaatcttcgcagttgacatcatcctgaccttctttgtagcttacttggacagactgacctatttgctggaagatgatccaaagaggattgcttggcgttatgctaccagctggttggttcttgacgttgcctccaccatcccatcagaaattgctcgcaggatgctaccttcaaagctcagatcatatggattcttcaacatgcttcgtctatggcgtctccggagagtcagctctctctttgctagattggagaaggatagacacttcaattacttctgggttcgatgtgcaaagctcatttgtgtcacactttttgccgtgcactgtgcagcatgcttctactatctccttgctgataggtacccggacccaaaggaaacatggattggcaataccatgccagattttcattccaagggcttgtggattcgctacgtaacatcagtatattggtcaatcaccacacttaccactgtgggttatggggattatcatgcggagaatataagggagatgattttcaacattttctacatgttctttaaccttggactgactgcttatttgattggcaacatgaccaacttggttgtccatggcaccagccgtactcgaaaatatcgggatacaattcaagcagcaaccagctttgcacttaggaatcagctaccacctcggttgcaagatcagatgatatcacatcttagcttaaagttcaggacagattctgaaggtcttcaacaacaagagacacttgatgcgctgcctaaggctattagatctagcatttcacaatatctgtttctcaatctggttcaaaacatttacttgtttcaaggagtatctaatgatctgatttttcaactggtttcggagatgaaagccgaatattttccacctagggaggacgtcattttgcagaatgaagcacccactgacttctacattttagtttctggtagtgtggaattagtagaggttccaaatggtgcggagcatggtgcagaacaggtggttggagtggccaagtcaggagaggttattggagaaattggggttctttgctataggcctcaactattcacagtccggacaagatccttatgtcagcttctacggatgaatcgtacggcctttctcagcattgttcaatccaatgttggagatggaactatcataatgaacaaccttattcagttactaaaagagcagacagacggcgtaatggtgggtgttctgaaggagatcgagagcatgctagctcgaggccgtctggatttgccaattacactctgctttgcagtgactagaggagacgaccatttgttgcatcaactacttaagcgtaatttggatccaaatgagtcagatcaagatgggcgtacggcactgcacatagctgcttccaaaggaaatgagcaatgtgtcaagcttctattagaatatggagctgatccaaatgccagggattcggaaggaaaggttccgctatgggaggctgtgtatgcgaagcatgatacggttgtgcagctgttagtcaagggcggtgcagaactatcatctggggatacgagcttatatgcttgcaccgcagtcgagcaaaacaatatagaactgctcaagcagatactcaagcatgtcatcgatgtaaacaggccatccaaagacggaaacattccgctgcaccgtgctgtctgtgacgggaacgttgagatggttgagttgttactgagacacggagcggacatcgacaagcaggacagcaacggctggaccccaagggctctagctgagcaacaaggccatgaagaaatacaaaacctgtttagatcagtgatagcaccaaggaagtacacatcaaatggtagggtgacacctatgttgctaggcaggttcagcagtgatccctcgatgcaaaaagtgatccatgaagatgttgagcagcaacccagcaaagttcttccgcaaagaaggaaagtcagcttccacaactctctttttggtgtcatctcttcggctcatccgcgccgggagactgaccatctgctctcaagaggtcttgcggcaacaggcggtccgacttatcctcaggcccatcacaacccactcatcagggtgacaatcagctgccccgagatggggaacactgctgggaagcttgtgatcttgccggggtcgataaaggagcttcttcaactaggtgcgaagaagtttgacatgatgcccactaaggtcctgacaattgagggcgcagaagttgacgaggttgagctcatcagagatggtgatcaccttgttctcgccagtgatgactgggtaccagatgatacgcaaataagaggtaaaaattaggcagagaattacgttttccggtttactgtaatttgggtaaaacggggaatgttgaaccacgcttgtaacaaaaaagccaatggtgaaaaaataactggaaatcaccaatggctactccacgactcatctccaccacgtctccaccgtgataaagatggtgaaatagggttatgcccagcaggtgaaattaataatctttttgaagtggtatagggtataccttgtatagaaattcttgtctgctgggcatgcagaattttcattgtatagaaattcttgtctgctaggcatgcagaattttcaaaaaaaaaaaaaaaaaaaaaaaaaa

SEQ ID NO: 1540 - DNA, 2899 bp, Oryza sativa
ctcccgtcgctcggcgcgcggagcaaccgccgcatcaagctccgccgcttcatcatctccccctacgaccgccgatacagaatctgggagactttcctcatagttcttgtagtctactctgcgtgggtctcaccatttgaatttggcttcattccgaagcctacgggggctctagctacagccgacaatgtggtgaatgcattcttcgcggttgacatcattctgaccttctttgtggcttatttggataaaatgagctatatgcttgaagatgatccaaagaagatcgcatggcgttatagtaccacatggcttgttcttgacgtggcctccaccatcccatcagaatttgctcgcaggatactaccttcaaagcttaggtcatatggatttttcaacatgcttcgtctgtggcgtctccgcagagtcagctctctgttttctaggttggagaaggatagacacttcaattacttctgggttcgatgtgcaaagctcatttgtgtcacactttttgctgtgcactgtgcggcatgcttctactatcttcttgctgataggtaccccgtcccaacttctacgtggattggcaattacatggcagatttccatgaacggagcttatggattcgctacgtaacatcagtctattggtcaatcaccactcttaccaccgtgggctatggggatctacatgcagaaaatacaagggagatgatcttcaacattttctacatgctctttaaccttggtttgaccgcttatttgatcggtaacatgaccaatttggttgtccatggcactagtcgtactcgaaactatagggatacaatccaagcagcaacaagctttggagtaagaaatcagctaccacctcggctgcaagatcagatgatttcacatattagcttaaaatacaggacagattcagaaggtcttcaacaacaagagatccttgattcactgcctaaagctattaaatctagcatttctcaatatctgttcttccatctggttcaaaatgtttacctgtttcaaggagtctcaaatgatctgatttttcaactggtttcggagatgaaagctgaatattttccacctagggaggatgtgattttgcagaatgaagcacccactgacttctacatcttagtttctggtagtgtggagttagtagagcagcaaaatggtgcagaccaggtgatacaagtggctacgtcaggagaagttgttggagaaattggggttctttgctacagacctcagctattcacagttcgaacaagatccttgtgccagttgttgcgtttgaatcgtacagcttttctcagcattgttcaatccaatgttggggatggaactatcataatgaacaaccttattcagttccttaaagagcagaaggagaacagtgtaatggctggtgtcgtaaaggagatagagagtatgctagctcggggaaatctggatttgccaattacactctgttttgcagtaactagaggagatgattttttgttgcatcaacttcttaagcgtggtatggatccaaatgagtcagataatgacgggcataccgcactgcatatagctgcttccaaaggaaacgagcaatgcgtcaggcttctattagaatatggagctgatccaaatgccagagactcagaaggaaaagttccactgtgggaagcgctgtgtgagaagcacgccgccgtcgtgcaactattagtcgaaggcggcgcggatctgtcgtcgggtgacacgggcttatacgcttgcatcgccgtggaggagagcgacaccgagctgctcaacgacatcattcactacggaggcgacgtgaacagggctcgccgggacgggaccaccgccctgcaccgcgccgtctgcgacggcaacgtccagatggccgagctcttgctggaacacggagccgacatcgacaagcaggacggcaacggctggaccccgagagccctcgccgagcagcagggccacgacgacatccagctcctgttccggtcgcgcaaggcggcgacggcgagtggccaccatcacgtcccaagctccaccaccaccagggtggcgccggcggcggcggcggcatcactgatcgggaggttcaacagcgagcccatgatgaagaacatgatccacgaagacgccgacctgcccagccgggttctccccgagaagctccggaggaagcgggtcaccttccagaactccctcttcggggtcatctcgtcgtcgcaggcgcagcgggagaccgaccacccgctctcgaggggtggcctcgcggcgacgggctccccgaacccgagcagcggcagccgcaacgccgtcatcagggtgacgatcagctgccccgagaaagggaacaccgccgggaagctcgtgctcctacctcagacgctggacatgctcctcgagctcggcgccaagaagttcgacttcgcgccaaccaaggttctcaccgtggagggcgccgaggttgacgaggtggagctcatcagagacggcgatcatcttgtgctcgtcagtgatgaatgggatgcagagaagatgaaaggcaagagctagtaaaggagttgtgtgttttttttccttttccttttttggttgtttactgttgatttccaagaaaggggagatagaatttaccccggagtccaacggttagctaaggaataactggaaatcattggtatagttattccaccatgaagagatggtgaaattgatgggttacgtccggtgttcgtaagtagagaagcgtaagaatttgattttgttatagcgtgttgtgatgttagcctgtttttgttttagttggcaagttgatctgctggcatgtacagttttacgcttttctaatttttgaaggaaaagtccaaag

SEQ ID NO: 1541 - DNA, 3098 bp, Puccinellia tenuiflora
ggcggaacgacacttccccaaaaatccgagattaccagtccacgccgcaagattttgtggtcttcgatccctccattaaaacccacccgacgaacgagtcttcactgccgccgcgccgctgcggtgagtgggggcgcaatggcgagattcggcgccaccaggatgcgggcgtgcgggccgtggggcgaaggcggcggcagcggcgccgtggggggcgcgctcgagagggagatgtcacgtgacggcagccagtacagcctctccagcggcatcctgccctcgctcggcgcccggagcaaccgccgcgccaagctccgccgcttcatcatctccccctacgaccgcaagtacagattgtgggagattttcctcatagttcttgtagtctactctgcgtgggtctccccattcgaatttggcttcattcggattcctacaggggcgctagctgcgacggacaatgctgtgaatgcaatcttcgcagttgacatcatcctgaccttctttgtagcctacttggacagactgacatatttgcttgaagatgatctaaagagaattgcttggcgttatactaccagctggtttattcttgacgttgcctccacaatcccatcagaaattgctcgcaggatgctaccttcaaagctcaggtcatatggattcttcaacatgcttcgtctatggcgtctccgaagagtcagctctctctttgctagattggagaaggatagacacttcaattacttctgggtccggtatgctaagctcatttgtgtcacactttttgctgtgcactgtgcagcatgcttctactatcttatagctgatcggtatccaaacccaaaggaaacgtggattggcagtaccatggaagattttcatcaacagggattgtgggttcgctacgtaacatcagtttattggtcaatcaccacgcttaccactgtgggttatggggattatcatgcggaaaacataagagagatgattttcaatgttttttacatgttctttaaccttgggttaattgcttatttgattgggaacatgaccaatttggttgtccatggcaccaaccgtactcgaacctatcgagatacaattcaagcagcaagcagctttgcaattaggaatcagttaccacatcggttacaagatcagatgatatcacatcttagcttaaagttcaggacggactcagaaggtcttcaacaacaagagactcttgatgtgctaccaaaggccattagatctagcatttctcactatctctttctccatctggttcagaacatttacctatttaaaggtgtatctaatgatctaatttttcaactggtttcggagatgaaagctgaatactttccacctagggaggatgtaattttgcagaatgaagcacccactgatttctacattttagtttctggtagtgtggagttacttgagctgcaaaatggtgcggaacatggtgcagaacaggtagtgggagtggccaagtccggagatgttgttggagaaattggggttctttgctataggcctcaactattcacagttcggacaaaatccttgtgtcagcttctacgcatgaaccggacagcgtttctcagcattgttcaatccaatgttggagatggaactatcataatgaacaaccttattcagttactgaaggatcagaaagacaatggcgtaatggtaagtgtgctgaaggagatcgagaacatgttagctcgaggtcgtctggatttgccaattacactgtcatttgcagtaactagaggagatgaccatttagtgcatcaactacttaaacgtaatctggacccaaacgagtcggatcaagatgggcgtacagcattgcacatagctgcttccacaggaaatgagcagtgtgtcaagcttctattagactatggagcggatccaaatgccagggattcagaaggaaaggttccactatgggaggctatgtatgcaaagcatgatacagttgtgcagctgttagtcaagggcggtgcagatttgtcattgggggatacaggcttatattgttgcctcgcaattgagcaaaacaatatagaactgctcgaggaaatactgaatcgcatccatgatgcaaacatgccatctaaagatggaaacattcctctgcaccgtgctgtctgcgacggaaacgttgagatggttgcgttgttactgaaacacagagctgacattgacaagatggacagcaacggctggactccaagagctctagctgagcaacaaggtcatgaagaaatacaagccttatttaaaccgttgacaccaccaataaaatacatctcaaatggcagggcgacacctatgctgctaggcaggttcagcagtgatccctcaatgcgaaatgtgatccgtgaagacactgagctaccgagcaaagttcttccacaaaagctaggcaggaggaaagtcagctttcagaactcccttttcggagtcatctcttcgtcacatccacacccacaccgagacactgaccagctactctcaagaggtcttgcagcaacaggtgctccgagttatcgtcaggaccatcacaagccacttgtcagggtgataatcagctgtcctgagaaggggaatactgctgggaagcttgcggttttaccgcggtcgatgcaggagcttcttcaactaggtgcaaagaagttcgacatgatgcctactaaggtcctgacgatcgagggtgctgaggtggacgaggttgagctcatcagagatggtgatcatcttgttcttgccagcaatgactgggtgccagatgtcatgcaaacaagatgaaagtttagcaagagaacttcggttttgtggtttactactatttgggtaaagagggatgttgaactaccacccttgtagcaaaagccaatgatgaaagaataactggaaatcaacaatagctagctactccaccatgaaacagatggtgaccttcggttatgccccaccaagagaaatgtataatcattttgaagtggtagagcatgccttgttgtctggtgggcatgcagaatttgtacaggcctcctcttttgttgtaaaaaaaa

SEQ ID NO: 1542 - DNA, 1646 bp, Zea mays; identical to SEQ ID NO: 1446

SEQ ID NO: 1543 - DNA, 1583 bp, Sorghum bicolor; identical to SEQ ID NO: 1445

SEQ ID NO: 1544 - DNA, 1409 bp, Sorghum bicolor
ttttaacgcagcaaagcgcgcaccaaattgcacctacccatttcgctaatctccctccacgaccacgagccgaccaaatcgaatcgaatcgcggggccgcgcgcaccgcgcagcagcgattgccggcgatggcgagcctcaccctgccgccggcgcccccgaacccacgccaggacgccatcgacctccacaaggccttcaaagggtttggctgtgatagtacagcagtgataaacatacttactcatcgcgattcagttcagcgtggacttattcaacaggaatacagggctatgtatcatgaggaactcttccatcgtatttcatctgaactcagtggaaaccacaagaaagctatgtcgctgtggattcttgatcctgctggacgtgatgcaactgttttgagagaagctctaagcggtgacactatggatctgagagcagccactgagattatatgttccaggacaccatcacagttgcaaataatgaaacagacttattatgctagattcggtacttatcttgagcatgacattggtcaccacacatctggcgatcaccagaagcttttacttgcctatgtggggattccacgctatgaaggtcctgaggttgatcctaccattgtgacacatgatgcaaaggatttgtacaaagctggtgagaaaaggctgggtacggatgagaagacctttatccgtgttttcactgaacgcagttgggcacacttggcatctgtttcttctgcttaccatcatatgtatgaccggaaattagagaaggttgtcaagagcgaaacatctggaaactttgaatttgcacttttgactatcctcagatgcgcggaaaacccagcgaagtattttgctaagctcttacgaaaggccatgaaaggtttaggcaccgatgagaagacacttacaagggtcgtggtgacgaggactgagattgacatgcaatatatcaaggcagagtacttcaagaagtataagaagccattagctgaggctatcaactccgaaacatcaggaaactatcgggcgttccttctttcacttgttggtcatggccattaggctatgtttcgaccatgggagatgatattccatcgatccaccctaaatgcagcgatctaccgggaaaacttatgatgttgccatttatctgtcgtgactcgtggattcgtctaactgccacatatgtggttcctagtatgcttgtctaatgtatttgtgtatatatttggattgaaagtgggtttcttgttggaaaattctggatggagcactagagctgttgctggtcacggtgggcttgacttgacttgtctctatgacaccaataatattatgtaatgtttgtgtgtggtcattccatttctttcgtcagcgaatcagttattatat

SEQ ID NO: 1545 - DNA, 1675 bp, Zea mays
aaaaatagtccaattagttgatactttatcaaataaccccctaaatggcattttatctgtaatccagtgtttgaaaatggcgtaataacgaagcgtgttctcataatggcattcgagcgaatccgtagtttgataatggcataaatccaattttctcctccaccgagccggccgaatcaaatcgaaccgcgggcagcgcgcacgcgcagcgactgccggcgatggcgagcctcaccctgccgccggcgccccccaacccacgccaggacgccatcgacctccacaaggccttcaaagggtttggatgtgacagtacaacagtgataaacatacttactcatcgcgattcggtgcagcgtggactcattcaacaggaatacagggctatgtatcatgaggaactctcccaccgtatttcatctgaactcagtggaaaccacaagaaagctatgtcgctgtggattcttgatcctgctggacgtgatgcaactgttttgagagaagctctaaatggtgacactatggatctgagagcagccactgagattatatgttccaggacaccatcacagttgcaaataatgaaacagacttattatgctagattcggtacttatcttgagcatgacattgctcaccacacatccggtgatcaccagaagcttttacttgcatatatggggattccacgctatgaaggtcccgaggttgatcctacaattgtgacacatgatgcaaaggatttgtacaaagctggtgagaaaaggctgggtacggacgagaagatttttatccgtgttttcactgaacgcagttgggcacacttggcatctgtttcttctgcttaccatcatatgtatgaccggaaattagagaaggttatcaagagcgaaacttctggaaactttgaatttgcacttttgactatcctcagatgcgcggaaaacccagcaaagtattttgctaagctcttacgaaaggccatgaaaggtttaggcactgatgacatgacacttataagggtggtggtgacgaggaccgagattgacatgcaatatatcaaggcagagtacttgaagaagtacaagaagccattagctgaggctatcaactccgagacatcaggaaactatcggacgttccttctttcacttgttggtcatggccattaggctatgtttcgaccatgggacatgatatttctatcgatccaccctaaatgcagcgacctacctggaaaacttatgatgttgccatttatctgtcgtgactcctggatctaactgccacatatcacatatgcggttcctagtatgcttgtttaaagtattcgtgtatatatttccatccgggtttcttgttggaagattctggatgggataccagatcagctgttgctggtcacagtgggcttgactggtgtctctatgacgccaatattattatgtcatgttcttgtggtatttccttcatttgttattctgtttttcgctgcttatcccatatccctgttttctccgtccttcacggagaccaacgtcttaggacataacccagagatataggggtacgtttcttggagtataaaagataggttttgtatcttattgtaagatatgactcatacgagggttgtatatatgaagctgtttgttggacaaaaaaaaaaaaaaaa

SEQ ID NO: 1546 - DNA, 1404 bp, Zea mays
aacctaaccattttcgctaatctccctccaccgagccggccgaatcaaatcgaaccgcgggcagcgcgcacgcgcagcgactgccggcgatggcgagcctcaccctgccgccggcgccccccaacccacgccaggacgccatcgacctccacaaggccttcaaagggtttggatgtgacagtacaacagtgataaacatacttactcatcgcgattcggtgcagcgtggactcattcaacaggaatacagggctatgtatcatgaggaactctcccaccgtatttcatctgaactcagtggaaaccacaagaaagctatgtcactgtggattcttgatcctgctggacgtgatgcaactgttttgagagaagctctaaatggtgacactatggatctgagagcagccactgagattatatgttccaggacaccatcacagttgcaaataatgaaacagacttattatgctagattcggtacttatcttgagcatgacattgctcaccacacatccggtgatcaccagaagcttttacttgcatatatggggattccacgctatgaaggtcccgaggttgatcctacaattgtgacacatgatgcaaaggatttgtacaaagctggtgagaaaaggctgggtacggacgagaagatttttatccgtgttttcactgaacgcagttgggcacacttggcatctgtttcttctgcttaccatcatatgtatgaccggaaattagagaaggttatcaagagcgaaacttctggaaactttgaatttgcacttttgactatcctcagatgcgcggaaaacccascaaagtattttgctaagctcttacgaaaggccatgaaaggtttasgcactgatgacatgacacttataagggtgsyggtgacgaggaccgagattgacatgcaatatatcaaggcagagtacttgaagaagyacaagaagccattagctgaggctatcaactccgagacatcaggaaactatcggacgttccttctttcacttgttggtcatggccattaggctatgttkcgaccatgggacatgatatttctatcgatccaccctaaatgcagagacctacctggaaaacttatgatgttgccatttatctgtcgtgactcttggatctaactgccacacatcacatatgcggttcctagtatgcttgtgtaaagtattcgtgtatatatttccatctgggtttcttgttggaagattctggatggggcaccagatcagctgttgctggtcacagtgggcttgcctggtgtctctatgacgccaatattattatgtcatgttcttgtggtaaaaaaaaaaaaaaaaaaaaaaaaaaaaaaaaaaaaaaaaaccaaaaaaaaaaaaaagaaaaaaaaaaaaaaaa

SEQ ID NO: 1547 - DNA, 1298 bp, Oryza sativa Japonica Group
gttgcagattactaccaccacctccccaaaatcccaatcgaatcgaaatcgaatcgagtcgagtcgccgccggagccggagacggaggcggcagcggcgcagcggtaatggcgagcctcaccctgccgccggcgcccaccaaccctcgccaggacgccatcgacctccacaaggccttcaaagggtttggctgtgatagtacaacagttataaatatacttactcatcgtgactcgatgcaacgcgcgctcattcaacaggaatacaggactatgtattctgaggatctctctcgccgtatatcatctgaactcagtggacaccacaagaaagcaatgctgctatggattcttgatcctgctggacgagatgcaactgttttgagagaagctctgagtggtgatactattgacctgagagcagccactgagataatatgttccaggacaccatcgcagctgcaaataatgaaacagacttatcatgcaaaatttggtacttatcttgagcacgacattggtcagcgcacatcaggcgaccatcagaagctcttgcttgcttatgtggggattccacgctatgaaggtcctgaggttgatcctactatagtgacacacgatgcaaaggacctctataaagctggtgagaaaaggctgggcactgatgagaagaccttcatccgcattttcactgaacgcagctgggcacacatggcatctgttgcctctgcttaccatcatatgtatgatcggtcactggagaaggttgtgaagagcgaaacatctggaaactttgaacttgctctgctaactatcctcagatgcgctgagaatccagccaagtattttgcaaaggtcttgcggaagtccatgaaaggtatgggcactgatgatagtacacttataagggttgtagtaacaaggactgagatcgacatgcaatatatcaaggctgagtactacaagaaatacaaaaaatcattagctgaagctatccattccgagacctcaggaaattatcgaacattcctcctttctctagttggtagccattaggctacatttcgtcgaccctgtggcacttgacgttccatgactatcctaaatgcagtggttctacctggaaactgtaaaatttcgccatcattgtgctctctattcgtgtgtgcttgcttaaaaatgtgtgtatatatataacctgggcattaaatagttggtgcttaatatggtttggtggttccatctgacaagtcactcgttactcggtgcatttattcgaataagtgatggtatttggtc

SEQ ID NO: 1548 - DNA, 1249 bp, Zea mays
cacgaattgcacctacccatttcgctaatctccctccacgagccgaccaaatcgaatcgaatcgcgcgcagcgcgcccgcgcagcgattgccggcgatggcgagcctcaccctgccgccggcgccccccaacccacggcaggacgccatcgacctccaaaaggccttcaaagggtttggctgtgacagtacaacagtgataaacatacttactcatcgcgattcagtgcagcgtggactcattcaacaggaatacagggctatgtatcatgaggaactctcccatcgcatttcatctgaactcaatggaaaccacaagaaagctatgttgctgtggattcttgatcctgctggacgtgatgcaactgttttgagagaagctctaagtgttgacactatggatctgagagcagccactgatattatatgttccaggacgccatcacagttgcaaataatgaaacagacttattatgctagatttggtacttatcttgagcatgacattggtcaccacacatctggcgatcaccagaagcttttacttgcctatgtggggattccacgctacgaaggtcctgaggttgatcctaccattgtgacacatgatgcaaaggatttgtacaaagctggtgagaaaaggctgggtacggatgagaagacctttatccgcgttttcactgaacgcagttgggcacacttggcatctgtttcgtctgcctaccattatatgtatgaccggaaattagagaaggttatcaagagcgaaacatctggaaactttgaattcgcacttttagctatcctcagatgcgcggaaaacccagcaaagtattttgcaaaggcagagtacttcaagaagtataagaagccattagctgaggctatccactccgaaacatcaggaaactatcggacattccttctttcacttgttggtcctggacattaggttatgtttcgaccatgggacatgatattccatccatccaccctaaatgcagcgacctacctggaaaacttatgatgttgccatttgtcagtggtgactcgtggattcgtctaacttccacatatgcggtatctagtatgcttgactaaagtattcgtgtttaaatttgtatctgggtttcttgttggaaaattctgtgcgggggcacaacagctgttgttggtcacgctaggcttgacttgtgtctccatgacatcaataatattatgtcatgttcgtgtgtggtcattccactatt

SEQ ID NO: 1549 - DNA, 1159 bp, Hordeum vulgare subsp. vulgare
gggacacagccacacacgcaggcgagcgatggcgagcctgagcgtgcctccggtgctcacgcctccgcgcgaggacgccatcgctctccacaaggccttcaaagggctcggttgcgacaccacgatggtgatcaacatacttgctcaccgcgacacggcgcagcgcgtgctcatccagcaggagtataaagccatataccatgaggatctctaccatcgcctagcaactgagctgagtggaaaccacaagaatgctatgctgctttgggtcctcgaccccgtggggcgtgacgccaccatattgaaccaagctctcaatggcgacatcaccgacctgagagccgccaccgaggtaatctgctccaggacgccgtcgcagctgcagatcatgaagcaaacctaccgcgcgaggttcggttgctacctcgagcatgacatcaccgaacgcacctatggtgatcatcagaagcttttgcttgcgtaccttggagtcccgcgaaacgaaggcccggaagtagacccttcggtggtgacagacgacgcgagggagctgtatcgaaccggcgagaagagggtgggcaccgatgagcgggccttcatccgcatcttcagcgaacgcagctgggcgcacctggcgtccgttgccaaagcttaccagcacatgtacgcccggtccctggagaaggcagtgaagagtgagacagcagggaacttccagttcgggctgctgaccatcctcaggtgcgccgacactccggcgaagtactttgccaaggtcctgcacaaggcgatgaaaggcctgggcaccagcaacgcggcactcatacgggtggtggtgacgaggaccgaggtcgacatgaagtacatcaaagtagagtaccacaacaagtacaaggggtcgctggccgaagctatacactcagagacgtcagggaactacagaaccttcctcctctcgctcgtcggccaggaccgctaaggcgctcccgtgcatgctcaatcgatcccaccacatgcatggtggcgccgaggctgccatccatgatcaattgattgatactggggggcacaataatctgaaataaggagcaaaagaagattgtattattcctgtggaatcaacacaattgttctatgttcacttttacaaatatggagc

SEQ ID NO: 1550 - DNA, 1144 bp, Zea mays
gcggcagagctcgagcactcgacaccagcgtctaacgggatggcgagcctgaccatgccgccggtgccggcgtggccgcggcaggacgccatcgacctccacaaagcattcagagggttcggttgcgacagcacgacggtgaccaacatcctggcgcaccgcgacgcgacgcagcgctcgctgatccagcaggagtaccgggccgtgttcaaccaggacctggcccggcgcatcgcgtccgagctgagcggccaccacaagcgggcgatgctgctgtggatcctggacccggccacccgcgacgccaccatcctgaagcaggcgctcacgggcgacatcaccaacctgcgggcggccacggagatcgtctgctcccggacgccgtcgcagctgcagatcatgcgccagacgtaccgcgccaggttcggctgctacgtcgagcacgacgtcaccgaacgcacgtccggcgaccaccagcgcctcctgctcgcgtacctggccatcccgcgcgccgagggccacgaggtcgacccgtcgacggtgacgctggacgcgcgcgacctctacaaggccggcgagcggcggctgggcaccgacgagcgcgccttcatccgaatcttcagccagcggagctgggcgcacatggcggccgttgcccgggcgtaccaccacatgtacgaccgccccctggagcgcgccgtcaagagcgagacgtcgggcaacttcggtttcggtctcctcaccgtgctccgctgcgccgacagccccgccaggtacttcgccaaggagctgcacagggccatgaaggggctgggcaccagcgactcggtgctcatccgggtggtggtcaccagggcggagatcgacatgcagtacatcaaggcggagtaccacagcatgtacaagcgctcgctcgccgacgccatccacgccgagacgtccggcaactaccgcaccttcctcctctccctcgtcggccgcgaccgcacctagtgatgacgatgatcgctgtttcgtctctcatctatgcctctagtagcaacaacgtacgaggcgacactgggcgccattgccactcgcgtgtgcttgctattcctgttatctccatggaaatcttcctccttgtaaataaaaaaaaaaaaaa

SEQ ID NO: 1551 - DNA, 951 bp, Triticum aestivum
atggcgagcctgagcgtgcctccggtgctcacgcccccgcgcgatgacgccgtcgctctccacaaggccttcaaaggtttcggctgcgacagcacgacggtgaccaacatacttgctcaccgcgactcggcgcagcgcgcgctcatcctgcacgagtacaaagccatgtaccatcaggatctctaccatcgcctagcaaccgagctgagtggaaaccacaagaatgctatgctgctttgggtcctcgaccctgctgggcgtgatgcgaccatactgaaccaagctctcaacggcgacatcaccgacctgagagccgccaccgaggttatctgctccaggacgccgtcgcagctgcagatcatgaagcaagcctaccgtgcgaggttcggttgctacctcgagcatgacatcaccgaacgcacctacggtgatcatcagaagcttttgcttgcgtacctgggagtccggcgcaacgaaggcccggaagttgatccttcggcggtgacagacgacgcgagggagctgtatcaagccggcgagaagagggtgggcaccgatgagcgggccttcatccgcatcttcagcgaacgcagctgggcgcacatggtgtccgtggccaacgcttaccagcacatgtacgcccggtccctggagaaggccgtgaagagtgagacgacagggaacttccagttcgggctgctgaccatcctcaggtgcgccgacactccggcaaagtactttgccaaggtcctgcacaaggcgatgaaaggcctgggcaccagcaacgcggcgctcacacgggtggcggtgacgaggaccgaggttgacatgaagtacatcaaggcagagtaccacaacaagtacaaggggtcgctggctgaagctatccactccgagacgtcggggaactaccgaaccttcctcctctcactcgtcggccgcgaccgctaa

SEQ ID NO: 1552 - DNA, 951 bp, Elaeis guineensis
atgtcgacttggagcattccgccggttctgtcttcccctcgccaggacgccattgatctctacaaagcctttaaaggattcggctgtgacagtgcagcagtagtaaacattcttgctcaccgcgatgcaacacaacgtgcactcattcaacaggaataccgagccatgtattctgaggagctcatcaaacgcttatcttctgagctcagtggaaacctaaagagagcaatgctcctatgggttcttgatccaccaggacgtgatgcaactatattaaggcaggcactcagtggagatgtcattgatttgcaagcagccactgaagtaatatgctctcgtacaccatcaatgatacagataattaaacaagcatactatgcaaaatttggttcttatcttgagcatgacattcatcgtcaaacctctggagatcaccaaaagttgcttcttgcatgcgtaagcatgccacgttatgaaggccctgaggttgattctataatggtagctaatgatgcaaaggtcctctttaaagctggtgagaagcgattaggaacagatgagaaggctttcatccgtatcttcagtgaaagaagcagtgcacatttagcagctgtttcttcttgctactctcatacatacggtagctcccttgaaaaggctgtgaagagtgagacatctggatattttgaagttgctcttcttgcaatcctcagagttgctgaaaatcctgccaagtattttgctaaggtgttgcgcaaggcaatgaaaggcctaggaaccaatgatacaacactcataagggttgtggtctccaggactgagattgatatgcaatatataaaagcagaataccggaagaaatacaacaaacccttgaaggatgcgatccattcagagacatcaggccattatcgaacttttcttctctctcttgtgggtcccaacaattag

SEQ ID NO: 1553 - DNA, 1360 bp, Zea mays
aattcatttcagtttcagcaggtcagttttcgtcctgatactctgtcgctgcagcggtgccggtgcagtgcagcgctagctgcagttgggttgcggccgcagagcagcaggaaggatggcgaccaaggtggtggtggacctgcggtccgacacggtcaccaagccttccgaggccatgcgcgcgtccatggccgcggccgacgtcgactacgacgtccggggcgcggacccgaccgcgcgccgcttccaggagaagatggcggagctcatgggcaaggaggccgcgctcttcgtcccgtcggggaccatgggcaacctcgtgtccgtcctcgcgcactgcgacgtccgcggcagcgaggtcatcctcggcgacgactcgcacatccacctctacgagaacggcggcatctccaccctcggcggcgtgcaccctaagaccgtcagaaacaactcagacggcaccatggacatcgacagcatcgtcgctgcaatcaggcctcccggcgggggcctgtattatccgaccaccaggctcatctgcttggagaacacacatgggaattccggagggaagtgtttatccgcagaatacactgaaaaggttggcgaaattgccaagagtcatggcctgaagcttcatatcgatggagctcgcattttcaacgcctctgtggcacttggagttcctgtggacagacttgtgagagctgcagattcagtttcggtatgcatatctaaaggtttaggcgcccccgttggatcagttattgttggctcgaaggccttcatcgacaaggccaaaattctccggaagaccctaggtggtggaatgagacaggttggagttctctgtgctgctgctcatgttgccgttcatgacaatgtgggaaagcttgcagatgaccacagaaaggctaaagctttggcagacggactgaataaaatcgaacagttcagagtggattcagcatcagtccagaccaatatggtattcttggacattgtggattcacgcatatcatctaacaagctgtgccaggttctgggaacgcacaatgtgctcgcaagtccaaggagtccaaaaagtgtcaggcttgtccttcattaccaaatttcagatgatgatgttcaatatgcactgacgtgttttaagaaagctgctgaacagctactaatgggcagtactgaactcgagcatttggctgaacagctactgatgggcactaccaagaactcgtacggacaatagggcaccctgatgcataagctcggtggtcttgtctgtaatcagctcgaaatattttagccgcaccaaacctttgctgaataactgttgcttctcaaaaaaaaaaaaaaaaaa

SEQ ID NO: 1554 - DNA, 1391 bp, Zea mays
acacatcagttcatttcagtttcagcaggtcagttttcgtcctgatactctgtcgctgcagcggtgccggtgcagcgctagctgcagttgggttgcggccgcagagcagcagcaggaaggatggcgaccaaggtggtggtggacctgcggtccgacacggtcaccaagccttccgaggccatgcgcgcgtccatggccgcggccgacgtcgacgacgacgtccggggcgcggacccgaccgcgcgccgcttccaggaggagatggcggcgctcatgggcaaggaggccgcgctcttcgtcccgtcggggaccatgggcaacctcgtgtccgtcctcgcgcactgcgacgtccgcggcagcgaggtcatcctcggcgacgactcgcacatccacctctacgagaacggcggcatctccaccctcggcggcgtgcaccctaagaccgtcagaaacaactccgacggcaccatggacatcgacagcatcgtcgctgcaatcaggcctcccggcggtggcctgtattacccgaccaccaggctcatctgcttggagaacacacatgggaattccggagggaagtgtttatccgcagaatacactgaaaaggttggcgaaattgccaagagtcatggcctgaagcttcatatcgatggagctcgcattttcaacgcctctgtggcacttggagttcctgtggacagacttgtgagagctgcagattcagtttcggtatgcatttctaaaggtttaggcgcccccgttggatcagttattgttggctcgaaggccttcatcgacaaggccaaaattctccggaagaccctaggtggtggaatgaggcaggttggagttctctgtgctgctgctcatgttgccgttcgtgacaatgtgggaaagcttgcagatgaccacagaaaggctaaagctttggcagacggactgaataaaatcgaacagttcagagtggattcagcatcagtccagaccaatatggtattcttggacatcgtggattcacgcatatcatctaacaagctgtgccaggttctgggaacgcacaatgtgctcgcaagtccaaggagtccaaaaagtgtcaggcttgtccttcattaccaaatttcagatgatgatgttcaatatgcactgacgtgttttaagaaagctgctgaacagctactaatgggcagtactgaactcgagcatttggctgaacagctactgatgggcactaccaagaactcgtacgggcaatagggcaccctgatgcataagctcggtgtggtcttatctgtaatcagctcgaaatattgtagccgcaccaaacctttgctgaataactgttgcttctcacttgtttattggatgtgttcgttccaaaaaaaaaaaaaaaa

SEQ ID NO: 1555 - DNA, 1480 bp, Zea mays
aacagcgcgaaacatctgtcagttttccttcaaaaatggaaaagcgaaggcaaaaccaaagtttgttgtgggagtgggacgtgacaccccgcacacatcagttcatttcagtttcagcaggtcagttttcgtcctgatactctgtcgctgcagcggtgccggtgcagcgctagctgcagttgggttgcggccgcagagcagcagcaggaaggatggcgaccaaggtggtggtggacctgcggtccgacacggtcaccaagccttccgaggccatgcgcgcgtccatggccgcggccgacgtcgacgacgacgtccggggcgcggacccgaccgcgcgccgcttccaggaggagatggcggcgctcatgggcaaggaggccgcgctcttcgtcccgtcggggaccatgggcaacctcgtgtccgtcctcgcgcactgcgacgtccgcggcagcgaggtcatcctcggcgacgactcgcacatccacctctacgagaacggcggcatctccaccctcggcggcgtgcaccctaagaccgtcagaaacaactccgacggcaccatggacatcgacagcatcgtcgctgcaatcaggcctcccggcggtggcctgtattacccgaccaccaggctcatctgcttggagaacacacatgggaattccggagggaagtgtttatccgcagaatacactgaaaaggttggcgaaattgccaagagtcatggcctgaagcttcatatcgatggagctcgcattttcaacgcctctgtggcacttggagttcctgtggacagacttgtgagagctgcagattcagtttcggtatgcatttctaaaggtttaggcgcccccgttggatcagttattgttggctcgaaggccttcatcgacaaggccaaaattctccggaagaccctaggtggtggaatgaggcaggttggagttctctgtgctgctgctcatgttgccgttcgtgacaatgtgggaaagcttgcagatgaccacagaaaggctaaagctttggcagacggactgaataaaatcgaacagttcagagtggattcagcatcagtccagaccaatatggtattcttggacatcgtggattcacgcatatcatctaacaagctgtgccaggttctgggaacgcacaatgtgctcgcaagtccaaggagtccaaaaaggcttgtccttcattaccaaatttcagatgatgatgttcaatatgcactgacgtgttttaagaaagctgctgaacagctactaatgggcagtactgaactcgagcatttggctgaacagctactgatgggcactaccaagaactcgtacgggcaatagggcaccctgatgcataagctcggtgtggtcttatctgtaatcagctcgaaatattgtagccgcaccaaacctttgctgaataactgttgcttctcacttgtttattggatgtgttcgttcctgtaaaaaaaaaaaaaaaa

SEQ ID NO: 1556 - DNA, 1389 bp, Oryza sativa Japonica Group
accaccccacccccacttttgctgctgcggaccgcgcctcatcgcgtcccgtctccacccgcgcctctcctctcgtcccgcgcctcggccgccgtctgattccgtgcagttggaggctaggaggagctcctcaaaatggtgaccaacgtggtggacctacggtcggacacggtgacgaagccctccgacgcgatgcgcgccgccatggccgccgcggacgtggacgacgacgtccttggcgccgacccgaccgcgcaccgcttcgagatggagatggcgaggatcacgggcaaggaggccgcgctgttcgtgccgtccggcaccatggccaacctcatctccgtcctcgtccactgcgacaccaggggcagcgaggtcatcctcggcgacaactcccacatccatatctacgagaacggcgggatctccaccatcggcggcgtccaccccaagaccgtcaggaacaaccccgatggaaccatggacatcgacaagattgtcgtcgccatcaggcatccggatggggcgctgtattatccgaccacaaggctgatctgcctggagaatacccatgcaaactgtggtggaaagtgtctgtctgctgaatatactgacgaggttggtgaagttgccaagagtcatggtctgaagcttcacatagatggagctcgcatttttaatgcttctgtggcccttggagttcctgttcatcgacttgtgaaagctgcggattcagtctcggtgtgcatatctaaagggttaggcgctcctgttggatcagttattgttggttcgacggccttcatagaaaaggctaaaattcttaggaagacactaggtggtggaatgaggcaagtgggaattctttgtgcggctgcctatgttgccgttcgcgacactgtaggaaaacttgctgatgaccatagaagggctaaagttttagcagatggtctgaagaaaatcaagcattttagagttgatacaacttcagtggagaccaatatggtattctttgatattgtggattcacgcatatcacctgacaaactgtgtcaagtccttgaacaacgcaatgtgcttgccatgccagcaggctcgaagagcatgaggcttgtcatccactaccaaatttctgatagtgatgttcagtatgcactgacatgcgtggagaaagctgctgaagaaatactgacaggcagtaagaagtttgaacatctgacaaacggtactaccaggaattcatacgggcactagtagatcactcctttcgtgcccactgatgcatcagtccagcgtccagcttgcttgtcatctcatgactgatgtactcacaacttggcttaataataactgatgttcactctgttggaatgagctgttactatgtgc

SEQ ID NO: 1557 - DNA, 2191 bp, Oryza sativa Japonica Group
ccgaccgcgcaccgcttcgagatggagatggcgaggatcacgggcaaggaggccgcgctgttcgtgccgtccggcaccatggccaacctcatctccgtcctcgtccactgcgacaccaggggcagcgaggtcatcctcggcgacaactcccacatccatatctacgagaacggcgggatctccaccatcggcggcgtccaccccaagaccgtcaggaacaaccccgatggaaccatggacatcgacaagattgtcgtcgccatcaggcatccggatggggcgctgtattatccgaccacaaggctgatctgcctggagaatacccatgcaaagtgagttgctcgagcacctgtttctgttttataaaaatcaagttaattgctggtccttgtgatggggaggagagtatcataaattcctgtacctgattggtttcttgttgtttctgtagctgtggtggaaagtgtctgtctgctgaatatactgacgaggttggtgaagttgccaagagtcatggtctgaagcttcacatagatggagctcgcatttttaatgcttctgtggtaagtacttgtagtatgaggccaatgagtatggtgtgattctatctattactactagtgatgaactgggtccttcagaactctgaaacaagtgtctttacaatctgacagcgactgctattagaatgaatctgccttaaattttattatgtgcttagtgttccattatcagaggattgccgtcttataatttaaaagaacacatcacatgttaagtactactcctacgtggtatccatgcatttttccactaaaatattcgacgcataaggatgtgcattctgtaccagcttctgaattcattgcgttctgttgtgccaggcccttggagttcctgttcatcgacttgtgaaagctgcggattcagtctcggtacattcaatttgcttgctaccatgcttattttcagctcactttgaatgggtcacagcataacagcaatttcctctctgaattttgcactgcaggtgtgcatatctaaagggttaggcgctcctgttggatcagttattgttggttcgacggccttcatagaaaaggtctgttcaattctgtttgttaacttgttaccttaaactgcagatgggatgtaacgatggaaatatgaacaatgctttcaggctaaaattcttaggaagacactaggtggtggaatgaggcaagtgggaattctttgtgcggctgcctatgttgccgttcgcgacactgtaggaaaacttgctgatgaccatagaagggctaaagttttagcaggtttcatgtgttttcctcttgaatcaaaattccccttctgaattcttgtgaatcacacttaaagtcctgacctttttttctttcatttgcttagatggtctgaagaaaatcaagcattttagagttgatacaacttcagtggagaccaatatggttagtctgcaagattatctatcgagtattcttgttttccactatattacctttaaacatctcacatggaaaaatgtgctgtgcgtttctaaggtattctttgatattgtggattcacgcatatcacctgacaaactgtgtcaagtccttgaacaacgcaatgtgcttgccatgccagcaggctcgaagaggtgaggttaaattctgtctcagtttttattacaaattacagatgcccagttcagcctgttacacagatcaataccagtttccagttgattatttcgtctaaaaaagttaatcttagagagtcactgacttaattttatccagttcttcactgtccagtaattcctagtacaggcatagtgattcttatgttggcctctcactgaagatctggattgtacttcatacatcaactatactcttaacaatccattttgcactcccttgatttgcagcatgaggcttgtcatccactaccaaatttctgatagtgatgttcagtatgcactgacatgcgtggaggtatacagagataaattcctttgctcttttgacctcttgtaatattgttcatggttcacttattgtgtgcgtaaactgcatatgactgatatggtcttctgtatgcagaaagctgctgaagaaatactgacaggcagtaagaagtttgaacatctgacaaacggtactaccaggaattcatacgggcacta

SEQ ID NO: 1558 - DNA, 1119 bp, Sorghum bicolor
atggtgaccaaggtggtggacctgcggtcggacacggtgaccaagccctccgacgccatgcgcgccgccatggcggccgccgacgtcgacgacgacgtcctgggcgccgacccgaccgcgcgccgcttcgagggcgagatggccgcgctcacgggcaaggacgccgcgctgttcgtgccctcgggcaccatggccaacctcatctccgtcctcgtgcactgcgacgtcaggggcagcgaggtcatcctcggggacaactcccacatccacgtctacgagaacggcggcatctccaccatcggcggcgtgcaccccaggaccgtgcccaacaaccccgacggcaccatggacgtcgataagattcttgccgccattaggaacccggacggggcgctgctgtacccgacgaccaggttgatctgcttggagaacacacatgccaattgtggtgggaaatgtttgtccgtagaatacacagacaaggttggccaaattgccgtgaaccacggcttgaagcttcacattgatggagctcgtattttcaatgcctctgtggcgctgggagttcctgtacatagacttgtaaaagctgccgactcagtttcgatatgcctatctaaagggttaggcgcgcccatcggatcagttattgttggttcaaaggccttcattgacaaggctaaaattcttaggaagaccctaggtggtggaatgagacaggttggagttctttgtgctgctgcttatgttgctgttcgcgacactgtgggaaagcttgcggatgatcacaggaaggcgaaagccttggcagagggcctgaagaaaattaaacagtttacagtggattcatcttcggttgagaccaatatggtgttcttcgatatcgtggatccacgcatttcaccgaacaagctatgccaagtcttggaacagcgcaatgtgcttgcaatgccagcaagttcaaaaagtgtcaggttcgtcgtccattaccaaatttcagatagcgatgttcaatatgcactgacatgtgtcgagaaagctgttgaagagctattgaagggcggtacaaagttggagcacttgacaaatggtactgtcaaaaacgcatattggcactag

SEQ ID NO: 1559 - DNA, 1535 bp, Zea mays
gttctgttggcagcaagtgcaatgagcatcaatgcatcagccatcatgctggtacttccaaaagagcgaaaggtttgccaattctgaaggagaaagcaaaccatatctgaaagacaaagcgcggacggaccctttgagcatccaattcgtgagctttggcgtctgtgtattttaatcgggagctgtaggctgtagctagctagagaggtttagagcagcacccaaatggcgagcaaggtggtggacctccggtcagacacggtcaccaagccctccgaggccatgcgggccgccatggccgccgccgacgtcgacgacgacgtcctgggcgcggacccgaccgcgcatcgcttcgaggcggagatggccgcggtcatgggcaaggaagccgcgctgttcgtgccgtcgggcaccatgggcaacctcatctccgtcctcgtgcactgcgacgtcaggggcagcgaggccatcctcggcgacaactcgcacatccacgtctacgagaacggcggcatctccaccatcggcggcgtgcaccccaggaccgtgaagaacaaccccgacggtaccatggatatcgacaagatcgttgccgccatcaggcatcctgatctccattacccgacgaccagactgatctgcttggagaacacacatgggaatactggtggaaagtgtttatctgtagaatacactgacaaggttggtgaaattgccaagagccatggcttgaagcttcatatagatggagctcgcatcttcaatgcgtctgtggcacttggagttcctgtagatagactcgtaaaagctgctgattcagtttcggtatgcctatcgaaagggttaggcgcacccgtcggatcagtgattgttggttcgaaggctttcattgacaaggccagaattctccggaagaccctaggcggtggaatgagacaggtgggagttctttgtgctgctgctcatgttgccgttcgtgacactatgggaaagcttgcggatgaccacaggaaggctaaagctttggcagtgggactgaagaaaatcgagcagattacagtggacccagcttcggtcgagaccaatatggtattctttgaggtcatggatccaagaatatcacctgacaaactgtgtcaagtcttggaacagcacaacgtgcttgcaatgccagccaattcaaaaagtattaggttcgtcgtccattaccaaatttcagacgctgatgttcggtacgcattggcatgtgtccagaaagcaatcaaagagctactggaaggcagtactgagttggggcattcgataaacggagctaccaaaagctcgtatgggcactagatcacttggattctggcaacctgatgcatgcagcgacacatggtacccagatgcttgttagctgctctgcttgtctgtgaccaacgcctagctgttgtagtctcgcctttcccgaataattgttgctgttcagtcaaaaaaaaaaaaaaaaaaaaaaaaaaaaaaaaaaaaaaaaaaaamcaaaaaaaaaaaaaaaa

SEQ ID NO: 1560 - DNA, 1527 bp, Hordeum vulgare subsp. vulgare
gggcacttcctcctctataaagcgcgagcccgcaccgcagtggcagcgacgccaccgaagtctctctccactccgctcatcttcgctggcccaacccgcgcccgccattcgcatccgcctcggctggggctccatctgatccacggattctggtaaaaagcacctgctagcagagcactacgtgttcctgctgaagcgtgagctcgagctacgcaggcaggatggtgaccaaggtggtggacctccgctcggacacggtcaccaagccatccgaggccatgcgtgccgccatggccgcggcggaggtggacgacgacgtcctgggcgcggacccgaccgcgcagcgcttcgaggcggagatggccaggatcacgggcaaggaggccgccctgttcgtgccgtcgggcaccatgggcaacctcgtctccgtcctcacgcactgcgacaccaggggcagcgaggtcatcctcggggacagctcccacatccacatgtgcgagaacggaggcatctccaccatcggcggcgtccactccatgcccgttgttaacaatcccgacggcaccatggacattgacaagatcgttgctgcgattaggcatcgggtcggggctggggctctgcattatcccaccaccaggctcatctgcctggagaacacgcatggaagatctggtggaaagtgtctgtcagctgaatacatcgacaaggttggtgaagttgctcaaagccatggcttgaagcttcatatcgacggagctcgtatttttaacgcgtccgtggcacttggggttcctgttgacaggcttgtgagagctgccgactcagtttcggtatgcctatcgaaaggtttgggtgctcctgttggatcggttattgttggttctaaggccttcatagaccaggctaggatactgaggaagacactaggtggtggaatgaggcaggtaggagttctatgtgctgctgcctatgttgcagttcgcgacaacgtaggcaagcttgccgatgaccacaggaaggctaaagtattagcagatgggctgaagaaaattaaacagtttacagttgatttaacttcagtggagaccaatatggtattcttcgatatcgcggatccacgcataacatctgacaaactgtgtcaactcctggaacggcgcaatgtgcttgcgatgccaggaacctccaagagcgtcagacttgtcattcactaccaaatttcagatagtgacgtccagtatactttgacatgtatcgagaaagctgtggaggaaatactgtcaggaagtgcaaagttcgagcacttgacaaacggcagtaccacgaactcatatgggcactaggccacttccttctgcgcccacctatgaagaagggcagtatctagcttgtttgtggccttggccctttgtagtagtaacaactttgcagaataatatgttgctctttgggccgatggaagtccccccacactgaactttgtgtttgtgcatgcccggatggatatgtttgccaggccggccc

SEQ ID NO: 1561 - DNA, 1436 bp, Hordeum vulgare subsp. vulgare
ggctagcaagtcgtctcgctgctgcagaaacgatggcggccaaggtggtggacctgcggtcggacacggtgaccaagccgtcggaggccatgcgggccgccatggccgcggcggacgtcgacgacgacgtgctgggagccgaccccacggcccggcgcttcgaggcggagatggcccggatcatgggcaaggaggcggcgctgttcgtgccgtccggcaccatggccaacctcatctccgtcctggcgcactgcgacgccaggggcagcgaggtcatcctcggcgacgactcccacatccacgtctacgagcacggcggcatctccaccctcggcggcgtccaccccaggactgtccccaacaaccccgacggcaccatggacgtcgacaggatcgtcgctgccatccggagccccgacggcgcgctctactaccccaccaccaggctcatctgcctcgagaatacccatggaaattctggtgggaagtgtctgactgtcgaatatactgacaaggttggggaagttgcaaaggctcatggcttgaagcttcatatcgacggagctcgtattttcaatgcttctgttgcgcttggagttcctgtcgatacacttgtgagagctgctgattcagtttcggtatgcctgtcgaaagggataggtgctcctgttggatcagttattgttggttccaaggccttcataaacaagactaaaattcttaggaagacgctaggtggtggaatgaggcaggtaggggttctctgtgctgctgcagaagtcggagttcgcgataccatcggcaagcttaccgacgaccataggaaggccaaagttttagctgacggactgaagaaaatcgaacagtttacagttgatttgacttcagtggagaccaatatggtattctttcacatggcggatccacgcatcactccggccaaactgtgcaaagtcctggagcagcgcaatgtgcttgcaatgccaacaagttccaagagcgtaagacttgtggttcattaccaaatttcagatagtgatgtccagtataccctgacatgcatcgagaaagccgttggtgaaatactggcatgcgacgctaaactggagcgtccgacgaacggcgccgccgcgaattcataagggcactagcactaagctagctaggccacttcctctttgtggcaacctatgcacaatgcatcgatgaagaaatgcagtaccatcctgcttgtttttggtcgtggccttggtgacagtatcgacaactgtgcggaataatcgattgcctgcttatgagtccaatgtcaatgtgaacgttgttcttcagcttggataacatgatatgcaatccagctggggatactaaggatactggaaatgttggccatcgcttgtccacaagtgtattttttaaattcatgtatatcttttggg

SEQ ID NO: 1562 - DNA, 2158 bp, Zea mays
gaaatacaaagcgcggacggaccatttgagcatccaattcgtgagctttggcgtctgtgtatttttaatcgggagctgtaggctgtagctagctagagaggtttagagcagcaccaaatggcgagcaaggtggtggacctccggtcagacacggtcaccaagccctccgaggccatgcgggccgccatggccgccgccgacgtcgacgacgacgtcctgggcgcggacccgaccgcgcatcgcttcgaggcggagatggccgcggtcatgggcaaggaagccgcgctgttcgtgccgtcgggcaccatgggcaacctcatctccgtcctcgtgcactgcgacgtcaggggcagcgaggccatcctcggcgacaactcgcacatccacgtctacgagaacggcggcatctccaccatcggcggcgtgcaccccaggaccgtgaagaacaaccccgacggcaccatggatatcgacaagatcgttgccgccatcaggcatcctgatctccattacccgacgaccagattgatctgcttggagaacacacatgggaatactggtggaaagtgtttatctgtagaatacactgacaaggttggtgaaattgccaagagccatggcttgaagcttcatatcgatggagctcgcatcttcaatgcgtctgtggcacttggagttcctgtagatagactcgtgaaagctgctgattcagtttcggtatgcctatcgaaagggttaggcgcacccgtcggatcagtgattgttggttcgaaggccttcattgacaaggccagaattctccggaagaccctaggcggtggaatgagacaggtgggagttctttgtgctgctgctcatgttgccgttcgtgacactgtgggaaagcttgcggatgaccacaggaaggctaaagctttggcagagggactgaagaaaatcgagcagattacagtggattcagcttcggtcgagaccaatatggtattctttgaggtcatggatccaagaatatcacctgacaaactgtgtcaagtcttggaacaggacaacgtgcttgcactgccagccaattcaaaaaggtgaagtttcattctgtgtttgaatgcactagcgctaatagttagttagctaaaaattactagttgaattaggtagctaacaaatatctagctaactattagctaatttgctaaaaatagctaatagttggactattagttagactatttggatgattttggctaattttagcagctaactattaactctagtgcatttaaacatggcctctcttggccgatcctttattcctaccatcactttggctgtttgtgcaacattgcctcccatttccggtaacaagctagactgcatatcatagtctggctgaaactccatgttcaattagcagaaccaaccttttactccaagcaagtctataatcatatcgagtttttgtaaggtccgcatttaacttaactgtccgtattcgaacttctgtgtcgtgcagtattaggttcgtcatccattaccagatttcagacgctgatgttgggtacgcattggcatgtgtcgaggtatgtgaaagcttggacccctttccatctttcactgttatagcgtttgatttttcctgtgatagtacgatttcatgttttcagaaagcaatcaaagagctactggaaggcagtactgagttggggcattcgataaacggagctaccaaaagctcgtatgggcactagatcactcggattctgccaacctgatgcatcgacacatggtacccagctgcttgttagctgctctgcttgtctgtgaccaacgcctagctgttgtagtctcgcctttcccgaataattgttgctgttcagtctctgtttggatctgcttgttctcgtgtctctgcttcatctgctttcgcttcatggtactgagtactgacgctgtgaagtggaacaagtactctctcccccaaaaaggccggtagacccaaacatcttttcttgcgggctggtaaagccaaaaatttttaaatgtactcgaacgaaaatatcatagcatagtcttgcatacaaaggaagaaatacgataagaagtgaatgtaaagcaaagcactacagatgcaaagagaaacgcaggtctcgtatgatggtgc

SEQ ID NO: 1563 - DNA, 898 bp, Setaria italica
aaatccgcccagccggtracgtctcgccggccsacaacaascacagctccgccgcttctgctgctctctccgctctcggcttcgtctgcacgctaccgcctcgcagccgctccccggctctcgctcaattcttcgccgccgccgccgctcgccgttcgccccagcatggccgccgcgtcgtccaccacctccgtccacgacttcaccgtcaaggatgcaagcgggaaggatgttgacctcagcacctacaaggggaaggttctcctcattgtcaacgtcgcatcccagtgtggattaactaactccaactacactgagctggcccagctctatgagaagtacaaggaccaaggctttgagatcctggcttttccatgcaaccagtttggcgggcaggagcctggcaccaatgaggagattgtccagtttgcctgcacacgcttcaaggccgagtaccccatctttgacaaggttgatgtcaacggtaacaatgccgcacccatctacaaattcctgaagtctagcaagggtggcctcttcggtgacagcatcaagtggaacttctccaagttcttggttgacaaggaggggcgtgttgtggatcgctacgccccgaccacttcccctctgagcatcgagarggatatcaagaaactgcttgggagctcttaaaccatcgggctggaacctgtagaaaaacctgtactcctgcattgctctgagcgctaaaatttacaataatgcggtgttaataaagtagtgctccatatatccaggggttgcagtacatgctctatttcccttgcatgaactctgtacttgtatatttcgtttgaatggagatgaggtgcctatggttaaaaaaaaaaaaaaaaaaaaaaaaaaaaaaaaaaaaaaa

SEQ ID NO: 1564 - DNA, 882 bp, Sorghum bicolor
tctcggcccacaacctcagctccgccgcttctgctctctaccggctctcgcctcgcttcgtctacacgctaccgccgaacagccgctctctcctcccgaacccccccgctagttcgccgccgccgttcgcccccacatggccgccgcgtcgtccgccacctccgtccacgacttcaccgtcaaggatgccagcggcaaagacgttgacctcagcacctacaaggggaaggttcttctcatcgttaacgtcgcatcccagtgtggcttaaccaactccaactacaccgagctggcccagctctatgagaagtacaaggaccaaggctttgaaattctggctttcccatgcaaccagtttggtgggcaggagcctggtaccaacgaggagattgtgcagtttgcctgcacacgcttcaaggctgagtaccccatcttcgacaaggttgatgtcaatggtaacaatgctgcgcccatctacaagtttctgaaatctagcaagggtggcctttttggcgacagcatcaagtggaacttttccaagttcttggttgacaaggagggacgtgttgtggatcgctatgctccaacaacttcacctctgagcattgagaaggatatcaagaagctgcttgggagctcttaaagaatatctagctcgaaaactgtataaaaaactgtatgagcattgctctgagcgctaaaatatcgaataatgttgtgttaataaagtagtgctccgtatttgagaggttgcagtacctgttctattttccttgcatgcactctgtacttgtatatgcccttcgaatgaattccaatgctgtatcagttggctaccccatttcgtgtcactagcctgctaacgggttggattcctttggc

SEQ ID NO: 1565 - DNA, 950 bp, Zea mays
gcttgcccgcttttgctctctccctcccggctctcggcttcttctacacgctaccgtctcacagccgtaaacgcccctcccggatcccgctagttcgccaccgccgcccgcccgcccgccgttcgcctcatcatggccgcctcgtcgaccgccacctccgtccacgacttcatcgtcaaggatgcgagcggcaaagacgttgacctcagcacctacaaggggaaggttcttctcattgttaacgtcgcatcccagtgtggcttaaccaactccaactacactgagctggcccagctctatgagaagtacaaggaccaaggctttgaaatcctggctttcccatgcaaccagtttggtgggcaggagcctggtaccaatgaggagattgtccagtttgcctgcacacgcttcaaggctgagtaccccatcttcgacaaggttgatgtcaacggtagcaatgctgcgcccatctacaagttcttgaaatctagcaaaggtggccttttcggcgacagcatcaagtggaacttttccaagttcttggttgacaaggagggacgtgttgtggatcgctatgctccaaccacttcacccctgagcattgagaaggatatcaagaagctgcttgggagctcttaatcagtatctgggtgcaaagctgtagaaaaacatgtatcaacaatgccctgagcgataaaatatatgataagttgtattaataaagtattgtcgtacttgagaggttgcagtatctgctctatttcccttgcatacactccgtacttgtatatccccttcggagctgatttggtgacccgggatcccaggaggatcggaggggattgagaaggaaattagttgatttcccccttaatccccttcaatcctcccgggatccccttgtcaccaaatcagccctcgaatgaattccaatgctgtatcagtttgct

SEQ ID NO: 1566 - DNA, 850 bp, Zea mays
ataaatcaaccgccggtgaagtctagtcgtctcgtcgctcggtccaccacctcagctccgccgcttgcccgcttttgctctctccctcccggctctcggcttcttctacacgctaccgtctcacagccgtaaacgcccctcccggatcccgctagttcgccaccgccgcccgcccgcccgcctttcgcctcatcatggccgcctcgtcgaccgccacctccgtccacgacttcatcgtcaaggatgcgagcggcaaagacgttgacctcagcacctacaaggggaaggttcttctcattgttaacgtcgcatcccagtgtggcttaaccaactccaactacactgagctggcccagctctatgagaagtacaaggaccaaggctttgaaatcctggctttcccatgcaaccagtttggtgggcaggagcctggtaccaataaggagattgtccagtttgcctgcacacgcttcaaggctgagtaccccatcttcgacaaggttgatgtcaacggtagcaatgctgcgcccatctacaagttcttgaaatctagcaaaggtggccttttcggcgacagcatcaagtggaacttttccaagttcttggttgacaaggagggacgtgttgtggatcgctatgctccaaccacttcacccctgagcattgagaaggatatcaagaagctgcttgggagctcttaatcagtatctgggtgcaaagctgtagaaaaacatgtatcaacaatgccctgagcgataaaatatatgataagttgtattaataaagtattgtcgtacttgagaggttgcagtatctgctctatttcccttgcataaaaaaaaaaaaaaaa

SEQ ID NO: 1567 - DNA, 828 bp, Zea mays
gtcagctccgccgcttttgctttctctctccaggctctcggcttcgtccacaagctacagccgcgcgctcctccttgacccggcctgaccccgctagttcgccgcctgccgtctgccgccccagcatggccgccgcgtcgtccgccacctccgtccacgacttcaccgtcaaggattcgagcggcaaggacgttgacctcagcgtctacagggggaaggttcttctcatcgttaacgtcgcatcccaatgtggcttaaccaactccaactacactcagcaggcccagctctatgagaagtacaagaaccaaggctttgaaatcctcgctttcccgtgcaaccagtttggtgggcaggagcctggtaccaacgaggagattgcccagtttgcctgcacacgcttcaaggctgactaccccatctttgacaaggttgatgtcaatggtaacaatgctgcgcccatctacaagtttctgaaatctagcaagggtggccttttcggcgacagcatcaagtggaacttttccaagttcttggttgacaaggaggggcgtgttgtggatcgctatgctccaaccacttcacctctgagcattgagaaggatatcaagaagctgcttgggagctcttaaacgatatctggctgcaaaactgtagaaaaaactgtatgaacattgctctgagagctgaagtatataacaatcttgtcttaataaagtagttttagtatttgagaggttgcagtacctgctttatttcccttgcatgcactctgtacttgtacttgcgacacgatccgatagaaatgatattccttttccttgcatt

SEQ ID NO: 1568 - DNA, 988 bp, Zea mays
aatctcggcccacaacctcagctccgccgcttttgctctctctctctcccggctctcggcttcgtccacaagctacagccgcgcgctcctccttgacccggcctgaccccgctagttcgccgcgccgccgcctgccgtctttcccagtatggccgccgcgtcgtccgccacctccgtccacgacttcaccgtcaaggattcgagcggcaaggacgttgacctcagcgtctacagggggaaggttcttctcatcgttaacgtcgcatcccaatgtggcttgaccaactccaactacactcagcaggcccagctctatgacaagtacaagaaccaaggctttgaaatcctcgctttcccgtgcaaccagtttggtgggcaggagcctggtaccaacgaggagattgcccagtttgcctgcacacgctttaaggccgagtaccccatctttgacaaggttgatgtcaatggtaacaatgctgcgcccatctacaagtttctgaagtctagcaagggtggccttttcggcgacagcatcaagtggaacttctccaagttcttggttgacaaggagggacgtgttgtggatcgctatgctccaaccacttcacctctgagcattgagaaggatatcaagaagctgcttgggagctcttaaacaatatgtggctgcaaaactgtagaaaaaaaactgtatgaacattgctctgagcgctaaagtatataataatcttgtcttagagctagtttggaaactctatttttctacgggatttttatttttccaagagaaaataaactaattttctttaagaaaatagaaatctttttggaaaaatatgttcccaaactagcccttaataaagtagtgtttagtatttgagaggttgcagtacctgctctatttccttgcatgcactctgtacttgtatacttgcgacacgatccgatagaatgatattccttttccttgcaaaaaaaaaaaaaaaaa

SEQ ID NO: 1569 - DNA, 807 bp, Oryza sativa Japonica Group
acgtctcgtctctgtctctcggcccaccgcttccatcgttcgtcctcgtctccacgctaccgtttcgcaaccacccgcttcctcctccggagaccgctcggccgccgctcgctccagcatggccgccgcgccgtccgccacctccgtccacgacttcaccgtcaaggatgcaagcggaaaagacgtgaacctgagcacctacaaggggaaggttctcctcatcgttaacgtcgcatcccaatgtggcttaactaactccaactacactgagctgagccagctgtatgagaagtacaaggtccaaggctttgagatattggctttcccgtgcaatcagtttggagggcaggaacccggctccaatgaggagattgtccagtttgcttgcactcgcttcaaggctgagtatcccatttttgacaaggttgatgtcaacggtaacaatgctgcacccctgtacaagtatctgaagtctaacaaaggtgggcttttcggtgatagcatcaagtggaacttctccaaattcttggttgacaaggagggtcgcgtggtggatcgctatgcgcccaccacctcccctcttagtattgagaaggatatcaagaagctgcttgggagctcttaaacctaaaggtcgggatctgtagagcaacctgcacttatgcactgtattcagcactgagagttgtattaataaattggtgacatgtacttcacaggttgcatttgcactatactccttgcatcctgaatctttattgtactctgtacctgtatagttttcatgtcaataaatttccttgctgt

SEQ ID NO: 1570 - DNA, 970 bp, Zea mays
gcccgtcccactattctctcgcctgcgcttccgcctcccgagttgcgccgccgtctccatctccacccctccatcctccgcggcgcccctgcactacggccatcgcactcccctcgctagcccttttcctctgtccccaccttgcccgcgcatcctccgtgcggccgtcgcggtttcttcgctggatctgcgcccgatcaccggcgggttcgcgctattcagcatggctgctgcctcctccgccacctccgtccacgacttcaccgtcaaggatgctagcgggaaagatgtggaccttagcacctataaggggaaggttctgctcatagtcaatgttgcatctcagtgtggcttaaccaattccaactacacagagctgagccagttgtatgagaagtacaaggaccagggttttgagatccttgcattcccatgcaaccagttcggtgggcaggagcctggcactaatgaggagattgtccagtttgcttgtactcgcttcaaggctgagtatccaattttcgacaaggttgatgtcaatggtgacaatactgcacccatttacaagttcctgaagtccagcaaaggtagtctctttggcgataacataaaatggaacttctccaaattcttggttgacaaagaggggcatgttgtggagcggtatgcaccaacaacttccccactgagcatcgagaaggacatcaagaaactactagggagttattaaaccttgtaattggattcagtagccctaccaaactgctgctttgcatcgagcacctgatgcctcagtagcgttttaataaagttgtttttataaccgagatgttttgtatttcttctgtattccctgctttgtggtaaatgtcatgtaataaaaatgatgcaatccacgatttatcttgaaaggttatgtatccaggtcggttgttatgagataaaaaaaaaaaaaaaaaaaaaaaaaaaa

SEQ ID NO: 1571 - DNA, 901 bp, Triticum monococcum
ctaccgcctcctccccccaaactcccaactacccgctctgctcctgagttccgagcccgcccgatctccgccgcagccatcccgccgacgccgctccgtcaggtcacacggggaacctcgccatggccgccgcgtcctccgccacctccgtccacgacttcaccgtcaaggattcaagcggcaaggacgtcgacctcagcgtctacaaggggaaggttcttctcattgttaacgtcgcatcccagtgtggcttaaccaactccaactacaccgagctgagccagctgtaccccaagtacaaggaccaaggctttgagatcttggctttcccatgcaatcagtttggtgggcaggagcctggcaccaatgatgagatagttcagtttgcctgcactcgcttcaaggctgagtaccccatttttgacaaggttgatgtcaacggcaacaatgtttctcccctatacaagttcctgaagtctagcaaaggtggccttttcggcgacagcatcaagtggaacttctccaagttcttggttgacaaggagggtcacgttgtggaccgctatgccccgaccacttcccccctgagcattgagaaggatatcaagaagctgcttgggagctcttagacgcgccgctggccggagcgtctcgagaaattggcactctgtattctagaaacaataataatgttgtgttgaaataaaatctgtacccagcatttcagaggctgcatctgctatgttttcagcatcctactctgtagttgttgtatatgtggtgttaatgaatgaattcaaatattgtagctgttcggtatgcctttcattggatcgtgttgttgtctggtcaaaaaaaaaaaaaaaaaaaaaaaaaaaaaaaaaaaaaaaaaaaaaaaaaa

SEQ ID NO: 1572 - DNA, 882 bp, Sorghum bicolor; identical to SEQ ID NO: 1564

SEQ ID NO: 1573 - DNA, 898 bp, Setaria italica; identical to SEQ ID NO: 1563

SEQ ID NO: 1574 - DNA, 950 bp, Zea mays; identical to SEQ ID NO: 1565

SEQ ID NO: 1575 - DNA, 850 bp, Zea mays; identical to SEQ ID NO: 1566

SEQ ID NO: 1576 - DNA, 828 bp, Zea mays; identical to SEQ ID NO: 1567

SEQ ID NO: 1577 - DNA, 988 bp, Zea mays; identical to SEQ ID NO: 1568

SEQ ID NO: 1578 - DNA, 807 bp, Oryza sativa Japonica Group; identical to SEQ ID NO: 1569

SEQ ID NO: 1579 - DNA, 970 bp, Zea mays; identical to SEQ ID NO: 1570

SEQ ID NO: 1580 - DNA, 901 bp, Triticum monococcum; identical to SEQ ID NO: 1571

SEQ ID NO: 1581 - DNA, 1757 bp, Zea mays
cgccgctcagcgcggaggagcggcagcggttcgctcccggccgacggagcgccgtccgagccggcatccagctcccctgcaacctccctccccccgcgggagaataatggcctggttatctctaatgacaacacattgaagcagaccgtggaggtagaaaaacaggggaggcaaggtaaggaggtcttagtggttcatgaattggatgagtcgaatgaggattctgggtcattggatgagccgccgggttggcttcctgacggttggactatggaggtttgtcaagaagacaatggctccatctacaagtactacacttccccaatgtccggatacatgttcacatcaaagatggagacattgcattatcttttctcaggggtggaagaacgcatgttggagttgcaggcaagcgccgaggacaacgagcttcatgagtcacatacatggcttccacgtgggtgggtgattgaagtcagagccggtgggaagaaaatggacaaaatgtacaagttttatgttcacctacctactgggcagcgattcttatcaaaagcagaagtattgcactttgttaataagggcatggtttctacatgtgatatggatgtgctgtgcgacactagcactgatgataatatacttgctcatgtggaattcaatcctgatggtttaccagatggatgggtgaaagaaacgatatctagaaagttcaatgatggaatcagaaaagaccagtactataccgatcctgttagtcaccgtgtatttcgcacgcttaagtctgtattgagctaccttggaaccggagaaatatctaggcattcctatttaccaaggagaaatgtcattgacatgtattcatttgataagtgtgcagatctgcccaaaagcatggtgaaaagattgaaagcaaaaggacaagcaaagaaaaaattcatgagagcacaggttttagacaaggacttatctaatgggcagacttcaaatcactgtgaaggtgctattgggttaactcaatctgacccggaaggagataagtttggatctatggaagcggcatgcgaaaaggggaccagttcagagactatgaaacagcgaatagggaggccaaagaaaatcttgaagcaaacaaatgatagcatttcggatcgtgacaagggttcacatcaggagcacatcgaggccaaagaggaagttgatatctgtggtgggaaagacttgacgcatttgaaaactctggagcgtaccgaggctcagaatagcacaatgataaccaaggaagtaaacaacaacgacacagcagagaaaaacctatccaagatagagggagacaactcggatctggtaaccggcacgggtttgcacaagcaagagaatagcagattaactgaagttagtgagaaggcaacattctccacaggttacaaattttacaagaggagaagttgcaataagacatgaggttcaagaaaagcataaaattagatcaagttatctggtgagttttatgggtcgccgcccaaaagttgtatcatacttcttcagggaacaaatggaaccaaagttgatctggtgtgtccaggttttcatttttttcgttttgtttattcccttctgcatgcttctgcttctagttgatgtggagggtgtctagtggaagtaatctgtttgattcttgtatcataggaattaatactggttgtagagagcaggatttaacacttgacagcaggagcatcaaaggaatcaaattt

SEQ ID NO: 1582 - DNA, 897 bp, Zea mays
ctttgttaataagggcatggtttctacatgtgatatggatgtgctgtgcgacactagcactgatgataatatacttgctcatgtggaattcaatcctgatggtttaccagatggatgggtgaaagaaacgatatctagaaagttcaatgatggaatcagaaaagaccagtactataccgatcctgttagtcaccgtgtatttcgcacgcttaagtctgtattgagctaccttggaaccggagaaatatctaggcattcctatttaccaaggagaaatgtcattgacatgtattcatttgataagtgtgcagatctgcccaaaagcatggtgaaaagattgaaagcaaaaggacaagcaaagaaaaaattcatgagagcacaggttttagacaaggacttatctaatgggcagacttcaaatcactgtgaaggtgctattgggttaactcaatctgacccggaaggagataagtttggatctatggaagcggcatgcgaaaaggggaccagttcagagactatgaaacagcgaatagggaggccaaagaaaatcttgaagcaaacaaatgatagcatttcggatcgtgacaagggttcacatcaggagcacatcgaggccaaagaggaagttgatatctgtggtgggaaagacttgacgcatttgaaaactctggagcgtaccgaggctcagaatagcacaatgataaccaaggaagtaaacaacaacgacacagcagagaaaaacctatccaagatagagggagacaactcggatctggtaaccggcacgggtttgcacaagcaagagaatagcagattaactgaagttagtgagaaggcaacattctccacaggttacaaattttacaagaggagaagttgcaataagacatgagg

SEQ ID NO: 1583 - DNA, 2402 bp, Sorghum bicolor
gcttccttcgccacctctcgcgtctcccctctcccgaaaccaaacccctcgcactccaactcctcaatctgagcagtgtagaactctctcgccctactccgaccgtcaaaaaaatccaatctttccgctcccctccgacgttctcggaggccgcacggctgcaagattgatcaatcctgcgcggatcgagccgcagacaccaccagttccaatccaatccccagctgggtgcttgcggaccgcagagcagagcccggacggagcatggggtcccgatccgccgccagcgcggcgctgcggatatggctgctggtgtccgtggcgctgctgctgggctgctgccagggaaggttcgtggtggagaagaacagcctcaaggtgacggcgcccgacgacctcaagggcacctacgagtgcgccattggcaacttcggggtgccccagtacggcggcaccatggtcggcttcgtcgcctaccccaaggccaacaggaaggcctgcaagagcttcgacgacttcgacatctcctacaaggccaagccgggggcgttccccaccttcttgctcgtcgacaggggagattgctactttgcaaagaaggcatggaatgcacagaaagcaggagcagcggcgatccttgttgctgatgacaaagacgagcctctaattacgatggacaaccctgaggagagtggcaacacggattacttagagaacatcactattccttcggcgttaataaccaagagctttggggacaggctcaagaaagcaattgacaaaggtgacatggttaatgtgaatttggattggagggaggccctgccccatcctgatgagcgtgttgagtatgagttttggaccaacagcaatgatgaatgtggcccaaagtgcgatagccagattgattttgtcaagagcttcaaaggagcagcacaggtgcttgagaagaagggctacacagagttcactcctcactacatcacctggtattgcccagaggccttcattctgagcaagcagtgcaagtcccagtgcatcaaccatgggagatactgtgcacctgacccggaacaggattttagcaaaggatatgatggaaaagatgtggtggtccagaacttgcgccaagtttgtgtctttaaggttgctaaggagcacaagaagccttggttatggtgggactatgttactgattttgcgattcggtgcccaatgaaggaaaagaagtacacaaaggagtgtgctgaaggggttattaagtcgcttggccttgatcataaagcaatagataagtgtattggtgatccagatgctgatgaagaaaaccctgttctgaaagctgaacaagatgcacagattggcaagggctctcgtggtgatgttaccatcttaccaactctggtaatcaacaatagacaatacagagggaagcttgacaaaggagcagttcttaaagcactttgtgctggttttaaggaaaccactgagccagccgtttgcttgagtgaagatatacaaacaaatgagtgcctagagaacaatggtggctgttggcaagataaggctgctaacatcactgcatgcaaggatactttccgtggaagagtttgtgagtgtccagttgtgaaaggagtaaaatttgttggtgatggctatactcattgtgaagcttccggatctgggcgatgtgaaattaataatggaggatgctggaaagataccaagaatggtcggacatactcagcctgtactgatgatggctgcaaatgcccagatggattcaagggtgatggtaagcacaaatgtgaagatattgatgaatgtaaggaaaagactgcatgtcagtgcaaagaatgcaaatgcaaaaacacatggggaagctatgagtgtggctgcagtggaggcttgctttacatgagggagcatgatacatgcataagcaaaaatggaggatcagaagcaggctggggcttcttgtgggtcgtcttcttcggccttgttgcagcaggaattgcaggatatgcagtgtacaagtacaggatccggagatacatggactcagagatccgtgccatcatggctcagtacatgcccctggacaaccaaggagatgtccagagccattctcaccatattgagatgtgaggtggatgcagacttgatgagaggagaccgacacttgatctagcttatatacacttgaattagatgtgcataaccgtaactttcttctgtagcattcagtgtccttgaacaatttgtatctgtgtggtttctgtgttaggttgtaccatgacatggtcttgtttagtaataattgtcatcttttctttcagtggcaataaaggagatggcaaacgggcatgactaaaacaagaaaattgttacgtttgtggtca

SEQ ID NO: 1584 - DNA, 2552 bp, Oryza sativa Japonica Group
atggagccatggacacgttgctcatgctgcttaactgaatcaggttcccttccctctgcttgcttcacgaactcgcggaaatcccgtcccctcccaaaatctcaccaacgagtccaccccaaatccatccacgaatctcttcctcactccaactgcctccctccgccgtcaaaatccaatctttcctctcacctccgccgctttcggcacgccccttcaaccccaagatcgatactctctccaccaatccgatccaatccgcagctgggttccacgaattgcaaaggtctaggcgcggattggagcatggggctccgatcccccaactcgatgctgtggctagtactactggtgtgggcggcgctgctgtgcggtagctgccatgggaggttcgtggtggagaagaacagcctcaaggtgacgtcgcccagcgacatgaagggcacctacgagtgcgccattggcaacttcggcgtgccccagtacggcggcaccatggtcggcgtcgtcgcctaccccaaggccaacaagaaggcctgcaagagcttcgacgattttgacatctcctacaaggccaaaccgggctcactccccaccttcctcctcgtcgataggggagattgctttttcacaaagaaggcatggaatgcacaaaacgcaggagcagcagccatccttgttgctgatgacaagactgaacccctgattacaatggacacgcctgaagagagtggaaatacagactatttagagaatatcaccattccttctgcgctgataaccaagagctttggggacaagctcaagaaagcaattgataatggtgacatggttaatgtgaatttggattggagggagtccctgcctcaccctgatgagcgtgttgagtacgaattttggactaacagtaatgatgagtgtggccctaaatgtgatagccagattgattttgtcaagagcttcaaaggagcagcacaggtacttgagaagaagggatacacacagttcactcctcattacattacctggtattgcccagattccttcattctaagcaagcagtgcaagtcccagtgtatcaaccatgggagatattgtgcacctgacccggaacaggatttcagcaaagggtatgatgggaaagatgtggtagtccagaatttacgtcaagtctgtgtttataaagttgctaaggagcatggaaaaccttggctgtggtgggactacgtgacagattttgcaatccggtgcccaatgaaggaaaagaagtacaccaaggaatgcgctgatggagttatcaagtcacttggtcttgatcacaaagccatagataagtgcattgctgatccagatgctgataaagaaaatcctgtgctgaaagctgaacaggatgcacagattggcaagggctctcgtggtgatgttaccatcttaccgactcttgtaatcaacaatagacaatacagagggaaacttgataaaggagcggttcttaaggcaatttgtgctggttttcgagaaaccactgaaccagctgtttgcttgagtgaagatatacaaacaaatgagtgcttggagaacaatggtggctgttggcaagacaaggctgctaacatctctgcatgcaaggacacttttcgtggaagagtttgtgaatgtccagttgtgaaaggtgttaaatttgttggtgatggctacactcactgtgaagcttcgggatctggccattgtgaaattaacaatggagggtgctggaaggattccaggcatggccggacatattctgcctgcacgaatgatggttgtaaatgtccggatgggttcaaaggtgatggagtccacaaatgcgaagatattgatgaatgcaaggaaaggactgcatgccagtgcaaggaatgtaaatgcaagaacacatggggaagctatgagtgcggttgcagtggcggcttgctttatatgaaggagcatgatacatgcataagcaaaaatgcagcaacagaggtaggatggaacttcttgtgggtgatcttctttggcctagtggtagccggcattgcaggatacgcagtatacaagtacaggatccggaggtacatggattcagagatccgcgccatcatggcccagtacatgcccctggacaaccaaggagatgttcccaatcattctcaccatatcgagctatgaaaagagtgaggatagcatgcaacttccccccatgttgcccaaatgggatgagaagaggtgaacaactcctggagatcatgacacagcctgacgatatgtgtagtagtatcactctgacgatcttatgtttagcaaatttagcccatgtaaatttctggattatcctgtggccgcataatttcaatcgtacctggctgctttgctcccatatagcgctggggaaatatggagattgcaaaattaggcaagtttgtgatctcgaggaagaacactagtatggcatttcccaccaaaaaagactagtttggaaagcatgaattttgtatagaattttcgtgtgaatcagttttgcttggttcttgcgg

SEQ ID NO: 1585 - DNA, 2317 bp, Hordeum vulgare subsp. vulgare
ggtaccagcaaccatcttctcccccaaaatctccccaactcctccgcccatccaaataccataaacgcactccaactccttcctccgcggcctaaagtcccagtctttccgctaaatcccgcttatccccccgcctttcctcgcccgtacagcccccaagatcgatccttcctcgaggcccagtcgccggtttggagcatgaggctccgatccgcgccgccggcggcgccgcggctgctgctgctgctggccgtgctactgtgcggcttctgctgctgctgcgaggggaggttcgtcgtggagaagaacagcctcaaggtcacggcgccggactcccttaagggcagctacgagtgcgccattggcaacttcggcgtgccgcagtacgggggcaccatggtcggcgtcgtcgcctatcctaaggccaacaggaaggcctgcaagagctttgacgacttcgacatctcctacaaggccaagcccgggtccctgcccaccttcttgctagtcgaccggggagattgcttcttcactaagaaggcatggaacgctcagaacgccggagtggcggctatccttgttgctgatgacaaggatgagcctctaattacaatggatacacctgaagagagcggaagggctgattatttagagaacatcaccatagcatcagcgctgataacaaaaagcttcggggacagactcaggaaagcagttgatagcggtcacatggttaatgtgaacttagattggagggagtccctgcctcaccctgatgagcgtgttgaatacgagttctggacgaacagtaacgatgaatgtggtcccaaatgcgacagccagattgatttcgttaagagctttaaaggaccagcacagatacttgagaaaaagggatacacacagttcactcctcattacattacctggtattgccccgaggccttcacactaagcaagcagtgcaagtcccagtgtatcaaccatgggaggtactgtgcacctgacccggaacaggatttcagcaaagggtatgacgggaaagatgtggtggttcaaaatttgcggcaagtctgtgtttataaagttgcgaaggagaataagaagccttggttatggtgggactacgtgaccgattttgcaatccgctgcccaatgaaggaaaagaagtatactaaggaatgtgctgatggagttatcaagtcacttggacttgatcacaaagcaatagataagtgtatcggtgatccaaatgccgatgaagaaaatcctgtgctgaaagctgaacaggatgctcagattggcaaaggtgctcgtggtgatgtcactatcttaccaacactggtcatcaataataggcaatacagagggaaacttgacaaaggggcagttcttaaagcactttgtgcaggtttccaagaaactactgagcctgccgtttgcttgagtgaagatatacaaactaacgagtgcttggagaacaatggtggctgttggcacgataaggctactaacatatctgcatgcaaggatactttccgtggtagagtttgcgaatgcccggttgtcaaaggtgtgaaatttgttggtgatggctacactcactgtgaagcttcaggatctggtcgctgtgagattaacaatgggggatgttggaaagagaccaggaatggccggacacactctgcctgcactgatggtggctgtaaatgtccagatgggttcaaaggtgatggtgtccacaaatgtatagatgttgatgagtgcaaggaaaggactgcatgccagtgcaaggactgcaaatgcaagaacacgtggggaagctacgagtgcgggtgtggtggtggcttgctgtacatgaaggagcatgatacgtgcataagcaaagatgcaggagcacgtgtaggctggaatttcctatgggttgtattgtttggcctagcggcagcaggaatcgcagtatacgccgtgtacaagtacaggatccggagctacatggattcagagatccgcgctatcatggcgcagtacatgcccctggacaaccaaggagagatccccagccattctcaccatattgagatgtgaagagcagcagcacaggcagtttgtttcagctcatggtaaggatgattagaggaggagaagaagacttgtcttgcatatgttgtgtgtagcgcacccagtcccagtcggaccatcctgtaaattcgttggtagatcaaacttggaagagaaacacacttgtcctgagtggtgtgatcatctcttcctttttcttctgttttttaatcagaggagagattgtgcaaaaccc

SEQ ID NO: 1586 - DNA, 2319 bp, Hordeum vulgare subsp. vulgare
tggagacttcgccgtccacctccgtcgccttccccaacttcccgactcctctccatccaagcagcagcaccgccatagacatactgcgcacgcccagaccaatctgctgcttccgggcttgccgggttcagcggatcgtgagcttagacagaccgctcgatcagagcgctcctgaggcaccgatcctgcccccgcgcgatggcgtccccgccgccgccgctgctgctaacgctggtgtgggcggcggcgctcctgtggtgcggcggatgcgacgcgcggttcgttgtggagaagaacagtctcagggtgacggcgccggtggcactgaagggtgcctacgagtgtgccatcggcaacttcggcgtgccgcagtacggcggcaccatggtcggcgtcgtggcctaccccaaggccaaccggaaggcctgcaaggggttcgatgacttcgatgtttccttcaaggccaggcccggggcgctgcccaccttcctgctcgtcgacaggggagattgctacttcacaaagaaggcatggaacgcgcaaaatgcaggagcagcggcgatccttgttgccgatgacagggatgaacctttaatcacgatggacacgcctgaagagagtggaagggtggaatatttagagaacatcaccatcccctcggcgctaatatccaaaagcttcggggataggctcaagaaagctatcgataatggagacatggttaatgtgaacttggattggagggaatctctgccccatcctgatgagcgtgttgagtatgaattctggactaacagtaacgatgaatgtggtccaaaatgcgatagccagattgatttcgtcaagagcttcaaaggggcagcccagatacttgagaagcagggatacacacagttcactccgcattacattacatggtattgcccggaggcctacacttcaagtaagcagtgcaaatcccagtgtatcaaccatgggaggtattgtgcacctgatccggaacaggatttcagcaaagggtacgatgggaaagatgtagttatacaaaatttacgccaagtctgtgtttataaagttgctaaggagagcaagaaaccttggctgtggtgggattatgtgactgattttgcagttcggtgcccaatgaaagaaaagaagtacaccaaggaatgtgctgatggagttatcaaatcacttggccttgatcacaaagcaatagataaatgtattggtgatccagatgctgatgaagaaaatcctattttgaaagctgaacaggatgcacagattggcaagggctctcgtggtgatgtcaccatcttaccaactcttgtaattaacaatagacaatacagagggaaacttgacaaaggagcaattcttaaagcactttgtgctggatttcgagaaactaccgagccaactgtttgcttgagtgaagatatacaaacaaatgagtgcttggagaacaatggtggatgttggcaagacaaggctgctaacatcactgcttgcaaggacacgttccttggaaaagtgtgtgaatgtccaattgtgaaaggtgtaaaattcattggtgatggttacacgcattgtgaagcttccggagctgggcggtgtgagattaataatggaggctgttggaaagaaaccatgaatggccggacatactctgcttgtactgctgatggctgtaagtgcccggatgggttcaaaggcgatggaatccacaaatgtgaagatattgatgaatgcaaggagaggactgcatgccagtgcaaggaatgtaactgcaagaacacatggggaagttatgagtgcggctgcagtggaggcttgctgtacatgaaggagcatgacacatgcataagcgagagtgctgcagcacaggtaggctggaacttcctctgggtcatcttcttcggcctggcagcagcaggaatcgcaggatacgcagtgtacaagtatcggatccggaggtacatggattcagagatccgcgccatcatggcgcagtacatgcccctggagaaccagggagacattcacagtcatcctcaccagattgagatgtgaagagcaacgccgcattctccagtttatggaacgaacatttttcgttcggcatgtgtgattgtagcgatcttattgtacagcatactaagaccgttctgtaaatttctagattattaatcacccaaaagtgcccgtaggcaaaattacggagacacagcaagccgtgcagagatgtttgtgccaggacatagcggactcattgtcaccaggatgtttaaaccgtacagtccaaagttcaaaacc

SEQ ID NO: 1587 - DNA, 2220 bp, Vitis vinifera
atgagggaaaagttagggcttttagtgtgcgtatggtttgtgttatgggggtcgtgcgtggggaggtttgtggtggagaagaacagcttgagagtgacttctccggagtcattgaaggacgtgtatgaatgtgcaattgggaactttggagttcctcagtatggaggaaccatggttgggactgtggtttatcccaaagccaatcaaaaggcttgcaagagcttcgaggatgtcgagatttccttcaaatcgaagcctggagggttacccacctttcttcttgccgatcgtggagattgtttcttcaccttgaaggcatggaatgctcagaatgcaggagcagctgctattttagtcgcagatgacaagattgaacctttaatcaccatggacacacctgaagaggagaatgcacatgctgattatcttcagaacataacaattccctcagcacttattagcaaatcttttggggacagtatcaagaatgctctatctaagggtgacatggttaacataaatcttgattggagggagtctcttccacatccggacgagcgggttgagtatgaattctggacaaatagcaatgatgagtgcgggccgaagtgtgagagccagattgagtttgttaagaactttaaaggagctgctcagatatttgagcggaaagggtatactcagttcaccccacattatataacttggtattgcccagacgcttttattttgagcaagcagtgcaagtctcagtgcatcaaccatgggagatactgtgccccggatcctgagcaggacttcagtagagggtatgatgggaaggatgttgtggttcaaaatttgcgccaagcttgcttttttaaagtggccaatgaaagtggaaagccttggctttggtgggactacgttactgattttgcaattcgttgtccaatgaaagataagaagtattctaaagagtgtgcagatcaagttatcctgtctcttggtgttgatgtcaagaagatagaccaatgtattggagaccctgaggcagatgtggataatccagttcttaaagctgaacaggatgcacagattggcaaaggctcccgtggggatgtgactatattgcccacacttgtaataaacaatagacagtacagaggtaagctggacaaaggagcagttctcaaggccatttgtgccggtttccaagagaccactgaaccaaccatttgtcttagtgacgaggtagagacaaatgagtgtttggaaaataatggtggatgctggcaggataaggctgctaatattactgcatgcaaggatacatttcggggcagagtgtgtgaatgtcctattgtgcaaggcgtcaagtttactggtgatggttatactaattgtgaagcttcaggagctttacgctgtgaaatcaacaatggaggctgttggaaggacaccaaagatggcagcacatactctgcttgtgttgatgacaattcaaaaggttgccaatgcccacagggattcaagggagatggagtcaaaacttgtgaagatgtgaacgaatgcaaggacaaggttgcctgcaattgtccagagtgcaaatgcaagaatacctggggaagttatgagtgcagctgcagtggcaatttattgtacatgcgagaacatgacgcctgtataaatgcaggtaaacatgttaaaacagaggttagctggagctttatttgggtcatcattcttggattggcagcagctggagttggaggatatgccctgtacaagtacagaatccggagatacatggattctgagattagggcaatcatggcacagtacatgcctttggataatcaaggagagattccaaatcatgttccccatggggacatttagacaattggagtggcggatggaggtagatgaaaaagaggagaagaggagagacatgcccatgtcctaagatcctctccccacatatttttcatcatctgtggagatgttaaaacagaagctggtggctgttgtcatgtaggaattacacttgcattttgtgtgggaagtctgacttcttgcatccacatactacttttttcactgttttttcatgtaagacatttgtttatcctactccttaatgtatatttgaatcttaattagctagcatacttccataaagctacaaaaattttcccacttacgatgtgtttccgtggatctcaatacggaattttt

SEQ ID NO: 1588 - DNA, 1878 bp, Populus trichocarpa
atgagggaaaagttaggatttttagttggtgtatggcttttgctttgtgggttttgttttggtaggtttgtagtcgagaaaaacaacttgaaactaacatcacctgattcattgaaaggtgtttatgaatgtgcgattggtaattttggagttcctcaatatggagggaccttagtcggtactgtgatctatccaaaagctaatcaaaaggcatgcaaagggtttgatggggttgatatctctttcaaatctagacctggagggttacctacttttgtccttgttgatcgtggagattgttacttcaccctgaaggcatggaatgcacagaatggtggagcagcagctattcttgtagcagatgacaaggatgaaccattgattaccatggacacccctgaagaagagaatgcagatgctgattatctgcagaatatcactatcccctcagcacttattagcaagtccttgggggatagtatcaagaaagctatatctaatggagagatggttaacatgaatcttgattggacagaggctcttccacatcctgatgagcgggttgagtatgagttttggacaaatagcaatgatgaatgtgggccaaagtgtgacagtcagattgagtttatcaagaacttcaaaggtgcagcacagatacttgagcagaagggttatactcagttcacccctcactatataacatggtattgcccagaggcatttgttctgagcaaacaatgcaaatcccagtgcatcaaccatgggagatactgtgctccagatcctgagcaggatttcagcaaagggtatgatggaaaagatgttgtagttcaaaatctacgccaagcttgcttttataaagttgccaatgaaagtaaaaagccatggctttggtgggactatgtgactgatttttcaatccgttgcccaatgaaagagaagaaatacaccaaagagtgtgcagatcaagttattcaatctattggtgttgatctcaagaagatagatatatgtataggagaccatgaggcagatgtggaaaacgaagttcttaaagctgaacaacatgtgcagattggaaaaggttctcgaggagatgtgactatacttccaactctcgtgataaacaacaggcagtatagaggtaagttggacaaaggagcagttctcaaggcgatttgtgcaggttttgaagagactacagagccagccatttgtttaagtgaagatgtagaaaccaacgagtgtctagaaaataatggtgggtgctggcaggacagggctgctaaccttactgcatgcaaggatacttttcggggtcgggtatgtgaatgtccaatggtacaaggtgtgaagtttgttggtgatggttatactcattgtaatgcttcaggttctttacgctgtgaaattaacaacggaggatgctggaagaaaactcaagatggcactacgttttctgcttgtgttgaagatcgttcacaaggttgcaagtgtcctccaggattcaagggtgatggagtaaattcctgtgaagacgtggatgaatgcaaagacaaggtagcttgccagtgtccagaatgcaaatgcaagaatacctggggcagttatgagtgcagctgcagtggtggtttattatacatgcgagaacatgacacttgcataagtaatgctgctagggcagagtacagctggagctttgtttggattattattcttggcttggctactgctggagttgctggatatgcaatttacaagtacagaattcggagatacatggattcagagattcgggctatcatggcgcagtatatgccattggatagtcaagcagacatccctgttcatcatgctccccgtggggacatctga

SEQ ID NO: 1589 - DNA, 1889 bp, Zea mays
atggattacttggctgctgctgtacccgtgaccttggctctgggagtgggagctatcttgttggtcttacgatggacgtactgccgccgccgaacaagcgccgaagaagcaagactgcccccggggtcaaggggcctcctgttcctgggggagacgctccactacctggcagcgtcctccaccccgggggtattgccaccattcttccagcgacggttggagaggtatggccccatcttccggacgaacctggtcggggaggatctcgtcgtgtcgctggacgcggagctgaacgcgcacgtgctgaagcaggaggagcgcggcttccagatctggtacccgccctccttcatgcgcgtcttcggcgccgacaacatcaccgccaagctcggcgtgctccaccgccacatgaggaccctcgtgctccgcctcttcggccaccagaccgtccgctccgtgctgctgcacgacgtgcagcggagcgcgcgcgacgagctgcgctcatggctcggccgcccggacgtcgaggtcaggacggccacctccaggatgatatttggcgtcactgccaacaagctgatcagccatgacgacgcagcatctggaggcacgttgtggagatgcttccacgactggacttcggggctgctctcgtttccggtttccattcccggcacaaccttctacagatgcatgcagggacgtaagaaggttatgacgatgctgaaacagcagctcgtcgagcgtcgacggaacgcagcggagcgcgagacgacagaggatttcttcgatctcgtgatcgatgaactgaacaagccagaccctatgatggacgagagcaccgcgttggacttgctgttcaccatgttgtttgcgagccatgagacgacgtccatggtattaaccgtcatactcaagtatctgactgacaacccaaaagctttgcaagagctgacagaggagcacgaaagaatcctggaaagtagggccgatccaggctctgacctcacgtgggaggagtacaggtctatgaaattcacatctcatgttatacatgagtcgctaaggctcgcaaacatcgcactggccatgttcaggaaagcaaatcaggatgtgcacataaatgggtacacaattccaaaaggatcaaagatcatgatgtgtgcactagcatcgcacttgaatacggaggtctacgaggacccctcagtgttcaatccatggagatggaaggatattcctgaaccagtcggcacctctaaggactttatggccttcgggggtggtttgcgcctatgcgctggtgccgagttttccaagatgcagatggctatgttcctccattacttggtcacaaattacagctggaaacccgtcagcggtgggacaatgttattctatccaggactgcaatttccagaaggcttccacatccagcttcttccaaaaatcccaaacgtggttccataaaccctatgaagaaatatgaatacgaataatttaagcaaatattctaaatgtaccctggggaattgaagttcgataacgatgtggtacgggctgatttggtaaccatggatcacaggaggatgggagaggattgatggagaaattagttcatttctccctcaacctctttcaatcctcttatgatccacttatcaccaaatcaaccctaatgatagcaggtcgaattgtcggaacaaataatagtttcaccaaacagaaggggagtatgcatgtgtgtaactttttatagttataaataatagtagagtaaattcagctcgttgtgtaacaactatgcaggtgagtaaaaattggttcagcatattgtatatattatgcccagttcaatggaaaaaaaaactttgttgtctgttgtgtat

SEQ ID NO: 1590 - DNA, 1656 bp, Sorghum bicolor
atgtcgatgcattacttggtttctgtatctgtgacctgcttggctctgggagtgggagctatcttggtcttgagaaggaggaacggcggccgaacgtgcgaaggagcgaggctgccaccggggtcgaggggcctgccgttcattggagagacgctccactacttggcagcgtcctcaactcttgggctattgccacccttcttcgagaaacggttggagaggtacggccccatcttccggacgagcctagtcggggaggacctcgtcgtgtcgctggacgcggagctgaacgctcatatcctgaagcaggaggagcgtggcttccagatttggtacccaccctccttcatgcgcgtcttcggcgccgacaacatcacctctaagatcggcgtgctccaccgccacatgaggacccttgtgctccgcctcttcggccaccagaccatccgctccgtgctgctgcacgacgtgcagcggagcgcgcgcgacgagctccgctcatggctcgaccgcccggacgtcgaggtcaggacggccatctccaggatgatatttggcgtcactgcaaagaagctgatcagccatgatgatgcagcatcagggggaaggttgtgggaatgcttccacgactggacttcggggctactctcattcccagttcccattcctggcacaactttctacagatgcatgcagggacgcaagaacgttatgaaggtgctgaagcagcaactcggtgagcgtaggaacgcagcggagcgcgagaccgtggatttcttcgatcttgtgatcgatgaattgaacaagccaaaccctatgatggacaagagcaccgcgttggacttgctgttcgcgatgctctttgcaagccatgagacgacgtcgatggtattaaccgtcatactcaagtatttgacggacaaccccaaagctttgcaagaactaacagaggagcatgaaagaatcctggaaagaagggttgatcgggactccgatatcacgtgggaggagtacaagtctatgaaattcacatctcatgttatacatgaatctctaaggctggcaaacattgctctagtcatgttcaggaaagcagatcaggatgtgcacacaaatgggtacacaattccaaaaggatcaaagatcatgatctgtccactagcatcgcacttgaatatgaaggtttacgaggacccctcagtgttcaatccatggagatggaagaatattcctgaaccagtcggtgcctctaaggactttatggcctttgggggtggtttgcggctatgtgctggtgctgatttttccaagatgcaaatggctatgttcctccattacttggtcagaaattacaggtggaaaaccgtcagtggtgggacaatggtattctatccagggctgcaatttccagatggcttccacatccaacttcttccaaaaatctgaaatgtggttctagaaaccctatcaagaaattatgcgcatggtattaacaattatgttatgagtagtagttatgactaaataaatacaaataagaacaattatatttatatttatagggtgaaggagaaaaggcttaaagttcaataatgatgtgatagattattcgaccaaactatgtttcaagagcactgggcaatattgtactacaat

SEQ ID NO: 1591 - DNA, 1501 bp, Sorghum bicolor
gctgagtccccttatacatagacactacttgagctacatttttagtagagtaatgtcgatgcattacttggttgctgtatctatgacctgcttggctctgggagtgggagctatcttggtcttgagatggaggaacggcggccgaacgtgcgaaggagggaggctgccgccggggtcgaggggcctgccgttcatcggagagacgctccagtacttcctggcagcatcctcaactcttgggctattgccacccttcttcaagaaacggttggagaggtatggccccatcttccggacgagcctagtcggggaggacctcatcgtgtctctggacgcggagctgaacgctcatatcctgaagcaggaggagcgtggcttccagatttggtacccaccctccttcatgcgcgtcttcggcgccgacaacatcacctctaaaatcggcgtgctccacctccacatgagaactcttgtgctccgcctcttcggccaccagaccatccaatccgtgctgctgcacgacgtgcagcggagcgcgcgcgacgagctccgctcatggctcgaccgcccggacgtcgaggtcaggacggccatctccaggatgatatttggcgtcactgcaaagaagctgatcagccatgatgacgccgcatcaggaggaaggttgtgggaatgcttccacgactggacttcggggctactctcatttccagttcccattcctggcacaactttctacaaatgcatgcagggacgcaagaacgttatgaagatgctgaagcagcagctcggtgagcgtaggaacgcagcggagcgcgagaccgtggatttcttcgatcttgtgatcgatgaattgaacaagccaaaccctatgatggacgagagcaccgcgttggacttgctgttcatgatgctctttggaagccatgagacgacgtcgatggtattaaccgtcatactcaagtatttgacggacaaccgcaaagctttgcaagaactaacagaggagcatgaaagaatcctggaaagaagggttgatccagactccgatatcacgtgggaggagtacaagtctatgaaattcacatctcatgttatacatgaatctctaaggctggcaaacattgctctggtcatgttcaggaaagcagatcaggatgtgcacacaaatgggtacacaattccaaaaggatcaaagatcatgatctgtccactagcatcacacttgaatatgaaggtttacgagaatccctcagtgttcaatccatggagatggaagaatattcctgaaccagtcggtgcctctaaggactttatggcctttgggggtggtttgcggctatgtgctggtgctgatttttccaagatgcaaatggctatgttcctccattacttggtcagaaattacaggtggaaaaccgtcagtggtgggataatggtattctatccagggctgcaatttccagatggcttccacatccagcttcttccaaaaatctga

SEQ ID NO: 1592 - DNA, 2596 bp, Sorghum bicolor
tcgatgcattacttggctgctctgtcggtgactctgctgggagctatcttgctccgttgggccttcaaatggatgaactacggccggacgggcggtgaagaagggatgctgctgccgccggggtctaggggcctgccgttcctcggcgagacgctcgagttcttcgcggcgtccccgacccttgagctagtgccattcttcaagcgacggctggagaggtatatgtgcatatactgtactactaccatttttaccaaccaggtgccatgcatagataggtcctttgatgattttatagaagtgtgagagccaccagcatgatctaacaaagtgccggccgccgacgacgtacgtcgacgccggctcgtcgccggtgcatgcaggttcgggcccatcttccggacgaacatagtcggcgaggacatgatcgtgtcgctggacccggagctgaacgcgcgcgtgctgcagcaggaggagcgcggcttccagatctggtacccttcctctttcatgcgcatcttgggcgctgacaacatggtctccatgctcggaccgctccaccgccacattaggaacctcgtgctccgcctcttcgggcccgaggccctccgcctggtgctgctccgcgacgtgcagcggagcgcgcgcgacgagctccggtcatggctcgaccggccggaagtcgaggtcaggacggccacctccagggtaattaaaagctgcatgctctgcgactgcatgcgtgtgtcgtttatggtttatgcctttgcattattgatgatcgatcgatcgatctcacgacctgtgcgtacgtgcagatgatatttggcgtcacggcaaagaagctgatcagccacgacgacgtggcatcaggaggaagcctgtggaaatgcttcgacgcctggactaagggcctgatgtcattcccgatctgcgttcctggaacagccttctatagatgcatgcaggtgcatgtgcaggataccggcctgttctaaattataagataggttttctaaatttaaagtatatatatatatatatatatatatgaattacacggtataatacagatattcaaatacgcatagttttctttataaatatatgtacgtaaactttacccctacaagctagcatttttgaaggactgagccagcatgatatgtgtaaatacataataaaaattatgcatatagaaatgtcaaaatattttttgtttgaaaccgaagcagtataagcaacgtaacttgacactgtttgattgagtttaattaatctccaacaataatatataatatacccacagggacgcaagaacgttatgaaggtactcaagcaacagctcgatgagcgcaggaacggagccgagcgcaagaccgtggatttcttcgatcttgtgattgatgagctcgacaagccaaactctataatgagcgagagcatcgcgttgaacttattgttcttgctcctctttgcaagccatgaaacgacgtcaatggggctgaccgtgatactcaagtttctaacggacaatccaaaatccttgcaagaattgaccgtaagtaattaaaagctttatcgccaaactcttttgtgtcagtcaaagttgttccttgattttgtatttgatatgagatgttttcaggaggagcatgaaaaaatcatggaaagaagggtggatccagactctgatatcacctgggaggagtacaagtctatgaaattcacatctcacgtatgtgctatatataaaattgtaaaaaaaaactcctcaaacatatctctggtccatgatatatagaatccaatccaacaattgtcgagcacctaatatactttctacatcacatataggtcatacatgaatctcttaggctcgcaaacatcgctccggtggtgttcagacaagcaaaccaggacgtacacataaagggtatgcatatgcatttggtttgcaccatgtgcagtaaaaaaatctacgagggtatggtattcctaggaatagatgagtgtatatatcctcactttgaacttatgcactcaggatacactatcccagaaggatcaaagatcatgatttgtccatctgcagctcacctgaattcaaaggtttacgaggaccccttggcattcaatccatggagatggaaggtatgtgaaacccatatttagaaacaattcttaattgacctaaatagttttaaaatatcattcctaaattgtgttctcagagcaaagtgttgttttgatgacatatatgtttacatggtgcaggatactcctgaaccagttggtggctctaaggattttatggcctttgggggtggtttgcggttatgtgttggtgctgagtttgccaagctgcaaatggctatgttcctccactacttggtcaccaattacaggtaaaagaatatgagtatacctggaccatataaatgatgatgtacaagagcctcaaatgtataacgatgctaataataccatgtgttttcttgaatatagatggaaagccctcagcaaagggacgatgatgctttatcccggcctgcgatttccggacggctttcacatccagcttcataagaaaaca

SEQ ID NO: 1593 - DNA, 1962 bp, Sorghum bicolor
atggggatcgtggaggcatgggtgcgggagaagcccatccgcaccttcctagcccgactcgcccagcgccgggcggaggcggccgccgccttcctcgcctccccctccgccaccgcggtcatcgacggcgagggcggcggcgacgggagcatcccgcagctctcctccgtcgccaactccgtcgtctcccgctgctcaaggattcttgctctttcaattgagaacttacagcaaagctttgagactgattttccacacaattgtaatgaggctaatacatatgcaagagaccttttagagtattgctgccacaaagctcttcatgaagttactacacgtccagactatttggctgataagaatcttcgccgcttgatgtttgatatgatgcttgcatgggaaaccccaggcgctcaggatgcgtcagtagaaaatgaaaaaggttctattgtgcgtgattcccttgagattgaagatgaggatgaggggtcaattttttatgcaaattccacaagattggctgttcaagttgatgacaagaagacagtcgggttaagtgcttttgcacgaatagcaccttcatgcccaataatagctgacctggttactgtccacaatctgtttgatgcacttacaagttcatctggaggccgattgcactttcttgtttatgacaagtatctcaagagtttagacagggaattgaggtctgtgaaaggtatcatgcaatcatcacttgcctcaagttttcatcttgatgctggagaatgcatattagctattgatggagacaagcctattcatccggtactgcaacatattggaatatcggcgtggccaggaagattggtcctcacaacacatgctctttattttcagagtatcagagtgggatatggtgataagattgttaaatacgatctatcaacagattcaaatcaagtgattaagcgtgatttgactggaccgctgggtgtccgcctctttgataaagctgtgatgtacaaatcaagcactttgacagaaccaatttattttgatttccctgaattaggaggtccttcacgaagagactattggttagcaatcacctgtgaagtattgcaggtgaacagatttatcaggaagttcaatcttggagatgttcagagagcagaagcactctcaaaagctatcttgggcattttgagatactctgctgtcaaagaagcttttcatattgctccttcccactttaagacaacacttacttttagcttagcagaaaagcttccaaaaggagacatggtcttagaagccctgtataataactatttccaactcctggactcttcattgagacatttggcaattgattctgcagtcgataaaatgtcagagaaccattctgtaccattttctttgtatgctctctctagaatgggttttcttctgctgaagacaaaagatgaaactgaaaaggaaatgagcttttgtgctgtttgctttggtgtaacaaaatatctgcaggctgccctgaaagagtcaatttgttactctgagagaatagagtcagcacgtgctacagtcgatcaagtaaaggtggaaggcattgatgtaaatcttgccctcatgcaggagttactcttccctttcattcaagtaggcaagattgtttactctctcagccaatgggaagatccttttaaatcacttctattcttagcttttatgctgtatgttattcaaaggggtctggtcagttacattgtgccctttgttttcttaacttttgctattatcatgatttggcataagtatgttggagacggaaaattgttggaagtgcttgaagtgaaacctcctccaagtaaaaatgctgttgagcagattttgacattgcaggagggtatatccaagttagaagagtttctacaggctgtgatgaatgtttctttagaagttctcagattttggttctga

SEQ ID NO: 1594 - DNA, 2369 bp, Zea mays
gtttcgtcgacaagccagcagcccagcacgcaaagggcactgtgccgttacggcgcggcggagccggaaactcccgagtcgcgtgacagtaaacgaaggcacgaacgcgactcttccatccaactgtcgaagcaaccgaatcggggacaaccgagggcgagggcggccggcatggggatcgtggaggcgtggatgcgggagaagcccatccgcacattcctagcccgcctcgcccagcgccgggcggcggctgccgccgccttcctcgcttccccctctgccaccacggtcatcgatggcgagggcggcagcgacgggagcatcccgcagctttcctccgttgccaactccgtcgtgtcccgctgctcaaggattcttgctctttcaattgagaacttacagcgaagctttgagactgattttccacacagttgtaatgaggctaatacatatgcaagagaccttttagagtattgctgccataaagctcttcatgaagttacaacacgtccagattatttggccgataagaatcttcgccgcttgatgtttgatatgatgcttgcatgggaaactccaggtgctcaggatgtgtcagtagataatggttctattgtgcgtgattcccttgagattgaagatgaggatgaggggtcaattttttatgcaaattccacaagattggctgctcaagttgatgacaagaagacagtcgggttaagtgcttttgcacgaatagcaccttcatgcccaataatagctgacctggttactgtacgcaatctgtttgacgcacttacaagttcatctggaggccgattgcattttcttgtttatgacaagtatctcaagagtttagacagggaattgaggtctgtgaaaggtatcatgcaatcatcacttgcctcaagttttcatcttgatgctggagaatgcatattagctattgatggagacaagcccattcaaccggtactgcaacatattggaatatcagcatggccaggaagattggtcctcacaacacatgctctttattttcagagtattagagtgggatatggtgataagattgttaaatacgacctatcaacagattcaaatcaagtgattaagcgtgatttgactggaccactgggtgtccgcctctttgataaagctgtgatgtacaaatcaagcactttgacagaaccaatttatttcgatttctttgaattaggaggcccttcacgaagagactattggttagcaatcacccgtgaagtattgcaggtgaacagatttattaggaagttcaatcttggagatgttcagaaagcagaagcactctcaaaagctatcctaggcattttgagatactctgctgtcaaagaagcttttcatattgctccttctcactttaagacaacacttacttttagcttagcagaaaagcttccgaaaggagatatggtcttagaagcactgtataacaattatttccaactcttggactcttcattgagacatttggcaattgattctgcagtcgatagaatgtcggagaaccattctataccattttctttgtatgctctctctagaatgggttttcttctgctgaagacaaacgataaatctgaaaaggaaatgagcttttgtgctgtttgctttggtgtaacaaaatctttggaggctgccctagaagagtcaatttgttactctgagagaatagagtcagcacgtgctacagttgatcaagtaaaggtagaaggcgttgatgcaaatcttgccctcatgcaggagttactcttccctttaattcaagcaggcaagattgtttactctctcagccaatgggaagatcctttgaaatcacttctattcttagcttttatgttgtatgctattcaaaggggtctcatcagttacatcgcaccctttgttttcttaacttttgctattatcatgctttggcataagtatattggagacggaaaattgttggaagtgcttgaagtgaaacctcctccaagtaaaaatgccgttgagcagattttgacattgcaggaggctatatccaagttagaaaattttctacagtctgcaaatattactcttctgaagttcagatctgtcttgtttgcctgtgttcctaaggccactgaagtagttgcagctgtacttattgtcgcagctgcatttcttgtcttcctaccttccaggcctctgatacagatgttagtcctggaaatgtacacaagggagatgcccctaaggaaacagaacactgaaaaattccgcaggcgaattagagagtggtgggctcgcattccagctgcacctgtgcagatgatcagacctaatgaaagcaagaaaaagagatgatc

SEQ ID NO: 1595 - DNA, 2464 bp, Hordeum vulgare subsp. vulgare
gaaagcccccaaagggtcaaggaggagtcgaggcctcgaggggggagcgaggtcggcatggggatcgtggagacgtgggtgcgcgagaagcccatccgcaccttcctctcccgcctctcccgccagtcggccgccgccttcgtcgcgtccaccacctcccgctcccccgcggcggccgatggcgagggcggcggcgccgacggaggcatcccgcagctctcgtccgtcgccaactcggtcgtctcacgctgctcacggattcttgctgttgcaactgagaacttgcagcaaagttatgaggctgatttcccagataattgtaaggaacccaatacatatgccagagaactattagagtactgctgccacaaagctctccatgaagtaactacacgtccagactatttggctgatatgaatcttcgacgtttaatgtttgatatgatgcttgcttgggaaaacccaggttctgaggaaggattgctaaaaaataattctaccttgtgtaatcccgtggatattgaagatgaagacgagggatcaattttctatacgaattccacaagtttagctgttcaagttaacgacatgaagacagttggattaagtgcttttacacgaatagcaccttcatgcccaataatagctgacttggttactgtccacaatctgtttgatgcacttacgtgttcatctggtggccggttacattatttcgtatacgacaagtatctcaaaagtttagaccgggtattcaggtctatcaaaggagttatgcagtcatcacttgcttcaagttttaatcttgatgctggggaatgtatcttagctattgatggtgacaagcctattcatcctgtattgcagcatgttgggatatcagcttggccaggaacattgatccttacaacacatgctctttattttcagagtatcagagttggttatggtgataagattgttaaatatgatttagcaacagattcaaatcaagtgatcaagcgagattttactggaccattgggtgttcgtctgtttgataaagctatgatgtacaaatcaagcactttaacagaaccaatttatttcgactttcctgagttagggagcccctcacgaaggaactactggttagcaatcactcgtgaagtaatgcaggtgaataaatttatcagaaaattcaaccttgaagatattcagagagcagaggcactctcgaaggctatcctgggcatcttgagatactctgctgtgaaagaagcttttcatattgctccctctcacttcaagacaacactcacttttagcttagctgaaaagctcccaaaaggggatatggtattagaggccctatacaacaactacttccaactgttggacacttcgttgagccatttggcaactgagccagcagttgacaaagcagcgcagactcattctgtaccattttcattatacgctctctctagaatgggatttaacttgctgaagagaaaaaatgaaactgaaaaggagataagcttttgtgctgtttgtgttggtgtaacaaaatctctggaggctgctttgcaagagtcatttctttattctgaaagaatagaggcagcacgcgctacggttgatcaagtgaaggtggaaggtcttgatgcaaatgtagccctcatgcaggagatacttttttcgttcattcatgcaggcaaacttatttactcgttaaccaagtgggaagatcctctgaaatcatttttgttcttagcttttatcttctatgttatccaaagcgggcttgtcagttacactgtgccctctgttttcgtagtctttgccgtcgttatgctttggcataagtacagtgaagaaggaaaaatgttggaagtgcttgaagtaagaccccctccaactaaaaatcctgtcgagcaaatcttgatcttgcaggacgctatatcaaaattggaagataccctacaggctgtaaatattgttcttctcaaattcagagctctgttgtttgcagctgttccaaaggcaactgaaatagtcgcagtggcacttcttgttgcagctgcggttgttgtctttgtgcctcctaagcatctactcctgatggcagtcctggaggtttacacgagggagatgccactaaggaagctacacacagagaagttccgaagacgaattaaagagtggtgggcccgtattccagctgctcctgtacagatgatcagacctaacgaagacaagaaaaagatatgactatgagctctgtgtccattgcaactgagagctcacaattttccccaacctcctatagccagctaacatgtacagatatcacccctgattaccctgtgattcgtttctacatttctagtgctgaatgctaatgatgttcccctgattaacaatgtaataattgtacatttgtcattgttatcgatgcataaaaagctagacatgtgtgtat

SEQ ID NO: 1596 - DNA, 2704 bp, Oryza sativa Japonica Group
gcacggactgaacgaggcggcggaaataaaacaactcgaggctggaggctggctggcttccttgccgctgcccggctgaaaaagcccccgaagcagaggcttccggttgaagcaaagcaagagcgcgagggcgccgtcgggcatggggatcgtggagacgtggatgcgggagaagcccatccgcaccttcctcgcccagctctccacccgccgggcggcggcgggggccgcggccctgctcgcttcctcctccgccgccgcggcgtccgccgacggcgagcccggcgaccggagcatcccgcagctctcctccatcgccaactccgtcgtctcccgctgctccagggttcttgctcttgcaaccgaaaccttgcagcaaaactttgaagttgactatcccgatagttgtaaggagtctaatacatatgcaaaggaatttttagagtactgctgccacaaagctctccatgaagtaactacacgtccagatcatttggctgataagaatcttcgccgtttaatgtttgatatgatgcttgcgtgggaacacccaggtgctgttgttgaggatgaattatcagaaaatcattctgctttgcgtacaactgtggatattgaagatgatgacgagggatcaattttttatgcaaattccacaagattggcggttcaagtcaatgacaagaagacagttggcttaggtgcttttgcacgaatagcaccttcatgccctataatagctgacttggttactgtccacaatctgttcgatgcactcacatgttcatctggtggccgcttgcactttttcgtgtttgacaagtatatcaaaagtttagacaaggtattcagatctgtcaaaggtatattgcagtcaccgcttgcttcaagttttcatcttgatgctggggaatgtatcttagctatggatggagacaggcctattcatcctgtttttcaacacattggaatatcagcatggccaggaagattgattcttacaactcatgctctttactttcagagtatcaaagtgggttatggtgacaagattgttaaatatgatttagcaacagattctgatcaggttatcaagcgtgattttactgggccattgggtgttcgcctgtttgataaggctgtgatgtacaaatcaagcactttaacagagccaatttattttgacttccctgaattaggaggtccctcacgaagagactattggttagcaatcgctcgtgaagtattgcaggtgaataaattcatcaggaagttcaatcttgaaaacgttcagagagcggaagcactctcaaaagctatcctgggcatcttgagatactctgctgtgaaagaagcttttcatatttctccttctcactttaagacaacactcacttttagcttagcagaaaaacttccaaaaggagacatggtcttaaaagccttgtatgctaactactttcaactgttggacacttcgttgagtcatttggtgactgagtcacccgttgacaataggctgcagaaccattcattaccattttcattatatgctctctctagaatgggatttatattactgaagagaaaagatgaagctcaaagtgagataagcttttgtgctgtttgctttggtgtaacaaaatctctagaggctgctttggaagagtcaatttgttactctgagagaatagatgcagcacgtgcaactatagatcaagtaaaggtggaaggtgtggatgcaaatcttgccctcatgcaggagttacttttcccattcactcaagtagtcaaactcacttactcattgaccaagtgggaagatcctctgaaatcatttctgttcttagcttttaccctgtatgttattcaaaggggatttattgcttacatgttgccctcattttttttggcatttgctgttgttatgctctggcataagtacaatggaagggagcaattattgggagtgcttgaagtaagaactcctccaagtaaaaatcctgttgagcaaatcttgaccttgcaggatgctatatccaagttggaagaaactctacagtctgtaaatattgttcttctaaagttcagagctgtcttgtttgcagctgttccaaagacaactgaaatggtcgcagtggcatttcttgctgcatctgcatttcttatctttgtaccttggagacatctgctcctgattgcagtcctggaggtgtacacaagagagatgccgctaaggaaacagaacactgaaaagttccgccggcggattagagagtggtgggcccgcattccagccgctcctgtgcagatgatcaaacccaacgaaagcaagaaaaagagatgacaatgtgctccgtgctgttgcaaagagctcacaattttccctgtttcccattcctatttttcacctgaccagctaacctgtacatatctcaaaccctcttgcctcattgttacagagatattcttactgatcaaagctagccaaactagtaatcaattcaatgcatagtgccattgctatgagtgtacactgtacaaatatatgatcgaaaacaaattaatgctgtattttctttcgttgattgtgtaactttttgctgtgcatgcaagttcctgagttctgtgaacaaatctgggtgataaacatggacataatcagtttaaaaaggaaaaaaaatgaagttaatcttattgtatt

SEQ ID NO: 1597 - DNA, 2716 bp, Zea mays
ccgtcccgtcccgtcccccactcctcccgttccgtgctgctctcagcaagaagaaccaagggagaaggaaacccaccacaccacccctgataaaagaaggggtcgcacgctcccgctcccgccgcgacgccatggacgcctgggaggccaccaaggcggtgttcgaccgggtgcgggcgctggacccggacaacgcgtccaagatcatgggcctgctgctcatccaggacaacagcgacaaggagctcatccgcctcgccttcggccccgaccacatcctccacgccttcgccgccgcagcgcgcgccgacctcgccgccaagcccgcgtccccgccctcgcccgtgcccggcccgctccaccagcccgcctcgccctgggcgccgccctccgaccaccagcaggcccccttcgccgccgaccacgcgctcgggtacgactacgacggcgccgacgccgacacattcttctccgacgactacgactgctggtccccggccggcgccaccgcccaccgccgcagcttctcgcttagcgacgccgagctcgccgccgccgccgccggccccggcgcgtggcggccctgcatgtacttcgcgcgcgggttctgcaagaacggctctgcctgccgcttcctccacggcctgcccgagcccgcccccgacgccgcggagcgcgagatggccgtcatgcgcgccaaggccctcgccgccgccgccgcgcgcccgcagcagcagcagcagctcatggcgtccgcgttcccgttctcgccgtcgccgtcgccgcccaagggcgccaacctcaacctcctgctccaccaccactaccagcagcaaagcgagccccaaagggcgggggccgccatgctgctccagggcggcggcggcgacgacatgcacagtagcaggttccctctgcggtcgcccggcaggatggaccgcggcgagctcgtctccagccccgccgcgcggcagatctacctgaccttcccggccgactccaccttcggcgaggacgacgtctccaactacttcagcatgtacgggccggtgcaggacgtgcgcatcccgtaccagcagaagcgcatgttcggcttcgtcagcttcgtctacgccgagacggtgaggatcatcctgtgcaagggcaacccgcacttcgtgtgcgacgcgcgcgtgctcgtgaagccctacaaggagaagggcaaggtccccgacaggttcaggaagctgcagcacccgcacctcggcgacttcgccggctgcacgtcgcccaccggattgctggattccagggaccccttcgatctgcagcagccacagatcggaccaaggatgatgtacgggaacatcgccaaccacgaggcgttcctgaggaggaagctcgaagagcagcagcaggccatcgagctggagggccgccgcttcatggggctgcatctcctcgacctcaagatcaggggccaccacctcggctcctcccccgccacgaccgtcgtggggcaaggcgagggcggcaagggcagtggcaatggcaatgccgtccagctggaggatgtcatcgtccaagatactcctacgaagatgaacagtaacagccttgcaatgagtgcgcctgcagctgctgtatctgctgcagccgatgcaggaggcgagcacgaggagcagcaggaagcagggcacggggaggaaggcgacggcagtcccaagcaggcagtcaaccttggggaagacgagaagacggaatctggccccgtcacagctccacccattgttgctcgtggattccaagaaagtggtggcgtggccgtggagcacatcttgcctgacagccccttcgcatccaccaccaacaaggaggcctcagctccaacggctcagaacgggggcatcagcaatggcagccctcaccatgtggcttcttcgcccctcttcccacctgcacccgccattgagctgcccccgtacaactcctgcttctttcaggcgcccaggttttctcctgggcatgaagccattgggctgtgaatacagagcaaaaaggggtctccttttcctctaatctgggagggctatcgatgaccccatcaagtggaggaaaggagtagaaagctttgattaacaaatactaggtgtatcttcagagagggacaacaacagcagcaacaaaaaagagagagagagagagaaacaagtctaggttgttttagctctaggcctaagtatatgatagtagtcctataatataaataataatagtcttttagtagctcctgccggtatcaagattcaagtgattaaaaccgtagatggcgtagtactagtaaaaactagacagctagtcttggcagccagttgtagtgaagtgacatggctgcatacagacatccaaaggaaacggacttggtaggtgccgtggacaaaatccttggccggacagacttggtgctgctgcagctgcagtgctgctgcacaaggaaaagtgatgagaccgagacgagaggggtgtactctgctgggaccagagcactcacgggtgcagagagactccacttcacctcatgagcaattctgcagggaccccccctctgaatcgtaggagcatgcaccaagcactccttgtcctggtctttcaccttttgctcatcttttcacccttgtagaaaacagcaggaggtagcagacagacagaggaatgggaaaaaaagtatttattagtc

SEQ ID NO: 1598 - DNA, 2131 bp, Zea mays
ggacgcctgggaggccaccaaggcggtgttcgaccgggtgcgggcgctggacccggacaacgcgtccaagatcatgggcctgctgctcatccaggacaacagcgacaaggagctcgtccgcctcgccttcggccccgaccacatcctccacgccttcgccgccgcagcgcgcgccgacctcgccgccaagcccgcgtccccgccctcgcccgtgcccggcccgctccaccagcccgcctcgccctgggcgccgccctccgaccaccagcaggcccccttcgccgccgaccacgcgctcgggtacgactacgacggcgccgacgccgacacattcttctccgacgactacgactgctggtccccggccggcgccaccgcccaccgccgcagcttctcgcttagcgacgccgagctcgccgccgccgccgccggccccggcgcgtggcggccctgcatgtacttcgcgcgcgggttctgcaagaacggctctgcctgccgcttcctccacggcctgcccgagcccgcccccgacgccgcggagcgcgagatggccgtcatgcgcgccaaggccctcgccgccgccgccgcgcgcccgcagcagcagcagcagctcatggcgtccgcgttcccgttctcgccgtcgccgtcgccgcccaagggcgccaacctcaacctcctgctccaccaccactaccagcagcaaagcgagccccaaagggcgggggccgccatgctgctccagggcggcggcggcgacgacatgcacagtagcaggttccctctgcggtcgcccggcaggatggaccgcggcgagctcgtctccagccccgccgcgcggcagatctacctgaccttcccggccgactccaccttcggcgaggacgacgtctccaactacttcagcatgtacgggccggtgcaggacgtgcgcatcccgtaccagcagaagcgcatgttcggcttcgtcagcttcgtctacgccgagacggtgaggatcatcctgtgcaagggcaacccgcacttcgtgtgcgacgcgcgcgtgctcgtgaagccctacaaggagaagggcaaggtccccgacaggttcaggaagctgcagcacccgcacctcggcgacttcgccggctgcacgtcgcccaccggattgctggattccagggaccccttcgatctgcagcagccacagatcggaccaaggatgatgtacgggaacatcgccaaccacgaggcgttcctgaggaggaagctcgaagagcagcagcaggccatcgagctggagggccgccgcttcatggggctgcatctcctcgacctcaagatcaggggccaccacctcggctcctcccccgccacgaccgtcgtggggcaaggcgagggcggcaagggcagtggcaatggcaatgccgtccagctggaggatgtcatcgtccaagatactcctacgaagatgaacagtaacagccttgcaatgagtgcgcctgcagctgctgtatctgctgcagccgatgcaggaggcgagcacgaggagcagcaggaagcagggcacggggaggaaggcgacggcagtcccaagcaggcagtcaaccttggggaagacgagaagacggaatctggccccgtcacagctccacccattgttgctcgtggattccaagaaagtggtggcgtggccgtggagcacatcttgcctgacagccccttcgcatccaccaccaacaaggaggcctcagctccaacggctcagaacgggggcatcagcaatggcagccctcaccatgtggcttcttcgcccctcttcccacctgcacccgccattgagctgcccccgtacaactcctgcttctttcaggcgcccaggttttctcctgggcatgaagccattgggctgtgaatacagagcaaaaaggggtctccttttcctctaatctgggagggctatcgatgaccccatcaagtggaggaaaggagtagaaagctttgattaacaaatactaggtgtatcttcagagagggacaacaacagcagcaacaaaaaagagagagagagagagaaacaagtctaggttgttttagctctaggcctaagtatatgatagtagtcctataatataaataataatagtcttttagt

SEQ ID NO: 1599 - DNA, 2803 bp, Zea mays
caacaagggagaaggggaaaccaccaccaccaccacacttgataagaagggggccgcacgcgcctgcccgctcccgccgctacgccatggacgcctgggaggccaccaaggcggtgttcgaccgggtgcgggcgctggacccggacaacgcgtccaagatcatgggcctgctgctcatccaggacaacagcgacaaggagctcatccgcctcgccttcggccccgaccacctcctccacgccttcgtctccgccgcgcgcgccgacctcgccgccaagcccgcgtccccgccgtcgcccgtgctgggcccgctccaccagacctggggagcgccgccgcacccgagccctaccgctggctccgaccaccaacaccaggcccccttcgccgccgacctcgcgctcggctacgacttcgacggcgccggcgccggcgctgacgcgttcttccccgacgactacgactgctggtcaccggccggcgccgcccaccgccgcagcttctcgctcagcgacgccgaggccaccgccgccgccgccggaggcgctgcgtggaggccatgcatgtacttcgcgcgcgggttctgcaagaacggctcctcctgccgcttcctccacggctttccggaggacgatgacgccgccgcggagcgcgagatggtcgtcatgcgcgccaaagcccttgccgccgccgccgcgcgcccccagcagcagcagcagctcatggcgtccgcgtttcccttctcgccgtcgccgcccaagggcgtcaacctcaacttcctgctccaccagcaccagcagcagaacgagccgcaaagggcggcggcggcggcggccatgctgctccagggcggcgacgacatgcacagcaggttcccggtgcggtcgccccggatggaccgcggcgagctcatgtccagccccgccgcgcggcagatctacctcaccttcccggccgactccaccttcagcgaggaggacgtctccatctacttcagcatgtacgggccggtgcaggacgtgcgcatcccgtaccagcagaagcgcatgttcggcttcgtcaccttcgtctacgccgagacggtgaagatcatcctcagcaagggcaacccgcacttcgtttgcgacgctcgcgtgctcgtcaagccctacaaggagaagggcaaggtccccgacaggttcaggaagctgcagcacccgcaccacggcgacttcgccggctgcacgtcgcccaccggactgctggattccagggaccccttcgacctgcagcaaccgcagattggacctaggatgatgtacgggaacgttgctggccacgaagcattcctgaggaggaaactggaagagcagcagcaggcggccgagctgcagcaggccatcgagctggaggggcgccgcttcatggtgctgcacctcctcgacctcaagagcaggggccaccaccacctcggctcctcccccgcggccatggccaccaccactctggggcaaggcgacgacggctgcaaaggccgcagcgccaacgggaatgacaatgccgtcgccttccatttggaggatgccaacatccaagatactcctaccaagatgaacagtaacagccttgcaatgagtggtgggcctgcagccggtgcaggaggcgagcacgaggagcagcagcaggatggggacggggatggcagtcccaagcaggcagtcaaccctgggaaagaggagaagacggaatctggtcctgtcacagccacgcccattgttgcctgtggattccaagaaagtggcgtggtggagcacatcttgcctgacagcccctttgcgtcccccagcaaggcctccactcaaaatgggagcatcatcagcaatgcggcttcatccctcttccccccgcctgcatccaccatggagctgcccccgtacagctcttgcttcttccaggcgcccaggttttctcctgggcatgaagccattgggctgtgaatacagagcaaggggagggagggggtctactttcctctaatctgtgaggactatcggtgaccccgtcaagtggaggcaagagttaggaagctttgattaacaaatactaggtgtatgttcagagagagggacagcaacaacatcaaccaaaaagagagagagagagacaaagacaagtctaggttgttttagctctaggccctaagtatatgatgatagcagtcgtataaataacagtgttttagtaagtatctcctgccgggtatgaagactcaagaacaaaggtcagatctcgcgtatgctcgtttgtagcagtgtggatctgatacaggtaattgaaacctttagatggtggtagggctagtagtgagcagtagacgacaactagtcctggcagccagttgtagtgaggtgacatggctgcatacagacatccaaccaaaggaaacagagggtgtggtgtggaaagaaggggagagtggacaaaagccagacatggctggcgctgctgctgcataggcacaggcacaggcacagggaaaggtgatgagacgagaggggtggggtggtactctgctgggaccggcgcactcacgggtgcggagaatcagcttcgcctcacgagcgatgcagcagcggagacacagacacctctcgtctgcgtactgtttcgcccatgctcttgtcttgtacgcatgcagcagcgctccttgtcctttggctccatcgatgtattacctgctcttcttttcaactaggagtttagcggacaaagaaatgaaaaagtaattagcagtcatttatcttggtcaaaaaaaaaaaaaaaa

SEQ ID NO: 1600 - DNA, 1914 bp, Sorghum bicolor
atggacgcctgggaggccaccaaggcggtgttcgaccgggtgcgcgcgctggacccggacaacgcgtccaagatcatgggcctgctgctcatccaggacaacagcgacaaggagctcatccgcctcgccttcggccccgaccacctcctccacgccttcgtcgccgccgcgcgcgccgacctcgccgcctcatccaagccggcctccccgccctcgcccgtgctcggcccgctccaccagcccgcctcgccctggggcccaccgccatccgaccaccaccaccagcaccagtcccccttctccgccgccgaccacgcgctcgggtacgactacgacggcgccgctgccgctgccgcccccgcctccgcagacgccttcttccccgacgactacgactgctggtccccggcaggcggcgcaaccgcccaccgccgcagcttctcgctcagtgacgccgaggtcgccggcgccgccggcgccggcgcctggaggccctgcatgtacttcgcgcgtgggttctgcaagaacggctcctcctgccgcttcctccacggcttgcccgaggacgacgacgccgccaccgcggagcgcgagatggtcgtcatgcgcgccaaagccctcgccgccgcgcgctcccagcagcagcagcagcagctcatggcgtccgcgtttcccttctcgccgtcgccgtcgccgcccaagggcgtcaacctcaacttcctcctccaccaccacaaccagcagcagcagcagaacgagccccaaagggcggcggctgcggcggcggcggccatgctgcttcagggcggcggcggcgacgacatgcacggcaggttcccggtgcggtcgccccggatggaccgcggcgagctcatgtccagccccgccgctcggcagatctacctcaccttcccggccgactccaccttcagcgaggaggacgtctccaactacttcagcatgtacgggccggtgcaggacgtgcgcatcccgtaccagcagaagcgcatgttcggcttcgtcaccttcgtctacgccgagacggtgaagatcatcctcagcaagggcaacccgcacttcgtgtgcgacgcgcgcgtcctcgtcaagccttacaaggagaagggcaaggtccccgacaggttcaggaagctgcagcacccgcaccatggcgacttcgccggctgcacgtcgcccaccggattgctggattccagagaccccttcgacctgcagcagccgcagattggaccaaggatgatgtacgggaacattgccaaccacgaggcgtttctgaggaggaagctggaggagcagcaccaggcggcggagctgcagcaggccatcgagctggaggggcgccgcttcatggggctgcacctcctcgacctcaagagcaggggccaccacctcggctcctccacggccgccatggggcaaggcgagggcggcaaaggcaatggcaatgccgtccagcaagaggatgccaacatccaagatactcctaccaagacgatgaacagtaacagccttgcaatgagtgcgcctgcagccgatgcaggaggcgagcacgaggagcagcagggagaagaggatggggatggggatgggggtggcagtcccaagcaggcagtcaaccctggggaagaggagaagacggaatctggtcctgtcactgctgctactacacccattgttgcttgtggattccaagaaagtggcctggtggagcacattttgcctgacagcccctttgcatcccccaccaaggccacctccactgatacagctccagcagctcaaaatggaaacatcagcaatggcagccctcaccatgtggcttcatccctcttcccacctgcatccaccattgagctgcccccatacaactcctgcttctttcaggcgcccaggtag

SEQ ID NO: 1601 - DNA, 1946 bp, Zea mays
ctccaaaatagcgagccgaagggggccacgaccacgagtcctccacctccctctccgccgcgtcgcacgcgcttgacgcgcgccgagagccgaatcggagccacgaggcagccgccccgggcggatcgatcctagggccagggcatgggcggaggggacgccgacgccggcggcgagcccgcggacgcgcaggccacgctccacatccggtgcaccaacggctccaagttcaccgtgcggaccgacctgggcgccaccgtcggggcgtttaaggcgatcgtcgcccacagctgcgacgtgccggcgccgcagcagcggctgatctacaagggccggatcttgaaggacgagcaaaccctagccagctacggtgtggagacagaccatacaatccacatggtacgtggtgctgtgctatcaccaacatctactgcacctgcagccaaccaagaacctaccactgctgctcctgccagttccccggcaacaggattgggtggcttgttgcaaagtctgggtactacaggcgctgctgctaacagtgaggggttgtttggatctgccccccctggattagaccaaatgcagcaacagctagctgaaaatccgaacttgatgagggaaatgatgaatatgccactcatgcagaatttgatgaacaatcctgaactcatacgcagtataataatgaacaatcctcaaatgcgcgagctcattgaccgcaatccggatcttgctcatgtcctcaatgatccaagcattatgcgccagacttttgaagcagttcggaatcctgaactcatgagggagatgatgcggaacacagacagagccatgagcaacatcgagtcttctccagaaggattcaacatgctccgtcgcatgtatgaaactgtccaagagccttttctgaatgcaacaacaatgggtagcgagggtgatcgaaattcgaatccattctctgctcttctaggaaatcaggggtctaaccaagcaagagactcagctgcaaatggaacaactagagcttcagaccccacatcagggtctccagctccaaatactaatccacttccgaatccttggggctcaaatgctggctctgcccaaggagcagcaaggtcctctcctgctagcaatgttaggagtactacagcaagtggcctaggagggttgggttcagcagatttgggaagtacgcatggtgccagtggtggtggctctgatgctaccttgttgactcaagttttgcaaaacccaactatgatgcagatgatgcagaacattatgtctaatcctcagtccatgaatcagctgcttaatatgaatccaaatgtacgtaacatgatggaatccaatactcaaatgagagaaatgattgagaatccagaatttcttcgccagttaacatctcctgaaacattgcagcaattaatttcgttccagcagtctttgatgtcacaacttggccaacaacaagctggacaggagcggacacaatcaggctctggtgcaggcaatgtcaacctcaacaccttgatgaacatgttcagcgggcttggtgctggtggtggcctaggtgttccaaatgctcctaatgcaccgccagaagaactgtacgccacacaattagctcagctccaagaaatgggtttctttgacacacaagagaacatccgagccttggccgctaccgctggaaatgttcatgctgcagtggagcgacttcttggaaatatgggctaatagaatatgatgatcataactgtactcagatattgtgatttttagttggcattgtgagatcatgtctggctcattggttttacacccgagggtgagaggcggcgtctagattttgtgttcaaggatgaataaagagtgtaccgggggaacctttcatatacatatggtctggtgtcatggttaaggccccgtttcaatct

SEQ ID NO: 1602 - DNA, 1864 bp, Sorghum bicolor
atgggcggaggggacggggacgccgacgccggcggcgagcccgcggccgcgcaggccacgctgcacatccggtgcaccaacggctccaagttcgccgtgcgggccgacctgggcaccaccgtcggggcgttcaaggcgatcgtcgccgagagctgcgacgtgccggcgccgcagcagcggctgatctacaagggtcggatcttgaaggacgaccaaaccctagccagctacggtgtggagacagaccatacaatccacatggtacgtggtgctgcgccaccaccagcatctactgcacctgcagccaaccaagaacctaccactgctgctcctgccagttccccggcagcaggattgggtggcttgttacaaagtctgggtgctacaggggctgctgctaacagtggggggtcaggtttgtttggatctggcctccctgagttagaccagatgcaacaacagctagcggaaaatccgaacttgatgagggaaataatgaatatgccacttatgcagaatttgatgaacagtcctgaactcatacgcagtataataatgaacaatcctcaaatgcgtgagcttattgatcgcaatccagatcttgctcatgtcctcaatgatccaagcatcatgcgccagacttttgaagcagttcggaatcctgaactcatgagggagatgatgcggaacacagacagagccatgagcaacattgaatcttctccagaaggattcaacatgctccgtcgcatgtatgaaactgtccaagagccttttctgaatgcaacaacaatgggtagcgagggtgatcgaaactcgaatccatttgctgctcttctaggaaaccaggggtctaaccaagcaagagactcagctgcaaatggaacaactacagcttcagaccccacttcaggctctccagctccaaatactaatccacttccaaatccttggggcccaaatgctggctctacccaaggagcagcaaggtcccctcctgctagcaacactaggagtaccacagcaagtggcctaggagggttgggttcagcagatttgggaagtatgcttggtgccagtggtggtggctctgatgctaccttcttgactcaagttttgcaaaacccaactatgatgcagatgatgcaaaacattatgtctaatcctcagtccatgaatcagctgcttaatatgaatccaaatgtacgtaacatgatggaatccaatactcaaatgagagaaatgattcagaatccagaatttcttcgccagttgacgtctcctgaaacattgcagcaattaatttcattccagcagtctttgatgtcacaacttggccaacaacaagctggacaggagcggacacaatcaggctctggtgcaggcaatgtcaacctcaacaccttgatgaacatgttcagcgggcttggtgctggtggtggcctaggtgttccaaatgctcctaatgtgccgccagaagaactgtatgcaacacaattagctcagctccaagaaatgggtttctttgacacacaggagaacatccgagccttggccgctaccgctggaaatgttcatgctgcagtggagcgacttcttggaaatatgggccaatagaatatgatgatgatcataactgttttgtagttggcgttgtgagattatgtttggttcattggttttacacctgagattcagaggcggcatctagattctgtgtttaaggatgaataaagagtgtaccggtagaacctttcatatacatgtggtctggtgtcatggttaaaattgttgttgttggtacattgggttgctgtacatacacattgatctcttgcaatgtacatggacaatgtctttctgt

SEQ ID NO: 1603 - DNA, 2051 bp, Oryza sativa Japonica Group
acaagcccgtgcagacgagacgcgacacgcgacacgggaagaggaggggggaggggaacacacgccacactcctctcgcccgcatcgcactcgcaccgcacgcgtcgaaggatcgggaaggcgcagccccgcgtcggatcgagagctagggttatgagcggcggggacggggaagaggcagccgccgcggcggcggccgcgacgctgcacatccggtgcaccaacggctccaagctcgcggtgcgggccgacctggggctcagcgtcggggcgttcaaggcgatcgtcgccgagagctgcgacgtgccggcgccgcagcagcggctgatctacaagggccggatcttgaaggacgagcaaaccctagccagctacggtgttgagacggatcacaccattcacatggtccgtggtgctgcaccaccaccagcgtcaaccgcacctcctgcagccaacaatgtaactcctgccattaatgctaccactgcttccaattcaccagcagttggttttggaggtttgttgcatggtcttgggggttcaggttctgctaacagtggagggttgggctcatttggttctggccttccagaactatcccagatgcaacaacagctatccgagaaccctacgttgatgagagaaataatgaatatgccactcatgcagaatatattgaatagccctgatctaattcgcaatataattatgaacaacccccaaatgcgtgaaattgttgatcgtaatccagatcttgctcatgtcctcaatgatccaagcattctccgccagactgttgaagcagctaggaatcctgaacttatgcgagagatgatgcggaacacagacagagccatgagcaacattgaatcttctccagaagggttcaatatgctccgccgcatgtatgaaactgttcaagagccatttctgaatgcaacaacgatggctggggagggtgatagaagttcaaacccattttctgctctcctaggaaatcatggatcaaaccaagccagagatccagctgcaaattcaccaacgaccacctcagaatccacaacaggttctcctgctccaaacactaatccacttccaaatccctggagcacaactgctggagctgcacagggagcaacaaggccctctccagttaccaatgcaaggagtgccacagctggtggcctaggagggttaagttctacagatttgggaggtatgctgggtggtggctcggatacttccttcttgagtcaggtgttgcaaaatcctacaatgatgcaaatgatgcagaacattatgtcaaatcctcagtccatgaatcagctgcttaatatcaacccaaatgtacgtaatatgatggaatctaacactcagttgagggagatgttccagaacccagaatttgttcgccagttgacatctcctgaaactttgcagcaattaatctcattccagcagtccttgatgtcacaacttggtcaacaacaagctggcccagagcgaacccaatcaggtgctggtgcaggcaatactaacctcaacaatctgatgagcatgttcagtgggctcggtgctggtggtggcctaggtgttcctagtgcacccaatgttccaccagaagagctatatgcaacacaactagctcagctccaagaaatgggtttctttgacacacaggagaacattcgagctttgattgctacagcgggaaatgttcatgctgcggtggagcgacttcttgggaatattggctgatagactgttgtgatcgaagatgtcctcgacttgttacctgtagctcagattgtaagattgtctggttcattggttttataccgtcagattcaaaggcatcatctaggtacatggtttagatgaataaatgagtcaagtgggttaacctttccatacatggttgtcatgtcgtgatcgagatattggtgtattgatggtactttgggttggtgtatatacatattgagctattggtggttactgcagtgtacatgaccgttgtttatgtttacttgcctgctcttacaacctat

SEQ ID NO: 1604 - DNA, 1700 bp, Zea mays
cgcagcagcggctgatctacaagggccggatcttgaaggacgagcaaaccctagccagctacggtgtggagacagaccatacaatccacatggtacgtggtgctgcgccaccaccagcatccactgcacctgcagccaaccaagaacctaccactgctgctcctgccagttccccagcagcaggattgggtggcttgttgcaaaatctgggtgctacaggggctgctgctaacagtgggggtttgggtttgtttggatctggcctccctgaattagaccacatgcaacaacagctagctgaaaatcctaacttgatgagggaaataatgaatatgccactcatgcagaatttaatgaacagtcctgaactgatacgcagtataataatgaacaaccctcaaatgcgcgagctcattgatcgcaatccggatcttgctcatgtcctcaatgatccaagcatcatgcgccagacttttgaagcagttcggaatcctgaactcatgagggagatgatgcggaacacagacagagccatgagcaacattgaatcttctccagagggattcaacatgctccgtcgcatgtatgaaactgttcaagagccttttctgaatgcgacaacaatgggtagcgagggtgatcgaaattcgaatccatttgctgcacttctaggaaatcaggggtctaaccaagcaagagactcagctgcaaatggaacaactacagcttcagacaccacatcaggggctccagctccaaatactaatccacttccgaatccttggggtccaaatgctggatctgcccaaggagcagcaagatcccctcctgctaccaacactaggagtactacagcaggtggcccaggagggttgggttcagcagattttggaagtactcttggtgccagtggtggtggctctgatgctaccttcttgactcaagttttgcaaaacccaactatgatgcagatgatgcagaacattatgtctaatcctcagtccatgaatcagctgcttaatatgaatccaaatgtacgtaacatgatggaatccaatactcaaatgagagaaatgattcagaatccagaatttattcgccagttgacgtctcctgaaacattgcagcaattaatttcattccagcagtctttgatgtcacaacttggccaacaacaaactggacaggagcggacacaatcagcctctggtgcaggcaatgtgaacctcaacaccttgatgaacatgttcagtgggcttggtgctggtggtggcctaggtgttccaaatgctcctaatgtgccaccagaagaactgtatgcaacacaattagctcagctccaagaaatgggtttttttgacacacaggagaacatccgagccttggccgccactgctggaaatgttcatgctgcagtggagcgacttcttggaaacatgggccaatagaatatgatgacgaacataactgtgttctgatccatgcgatctgtagttggcattgtgagattatgtctggttcattggttttagacctgagattgagaggcggcatctagattctgtgtttaaggatgaataaagagtgtaccggtggaaccttacatataaatgtgggctggtgtcatggttaaaattgttgttgttggtacattgggttgctgtacatatggatcttttgcaatcttatttgcattgtac

SEQ ID NO: 1605 - DNA, 2108 bp, Oryza sativa Japonica Group
aaagaaaagaaaaagaaaaaaaaaactcgagctcacgcgcacacgcacgcgacgcgacgcgaccccgaatcggaggcgaggccgccgactccgagcggatcgggccgaggtcgacggcatgggcggcggaggaggcgaggccgggggcggcgacggaggggagtcctctcctgctgcggctgcggcggcggcggtggcgggggccgcggcgctgcacatccggtgcgcgaacgggtccaagttcaccgtgcgggccgacctcgacgccacggtgggggcgttcaaggaggtggtggcggggagctgcgacgtgccggcggcgcagcagcgcctgatctacaagggccggatcctcaaggacgagcaaaccctagaaagctatggtgttgaaacagatcataccattcatatggtgcgtggcgctggtcccccagccggatcagctgcacctgctgcagccagcccccaagcttcagctgctcctagcagcggcccaacagatggtcttggaagtttgtttcctggccttggtggtacaggaactgctggtaccaggccatctggtctttttgggtctggatttccagaattggatcaaatgcagcagcagttaagccaaaaccccaacttaatgagggaaataatgaatatgccaatgatgcagaatctcatgaataaccctgatttaattcgtaacatgatcatgaacaatcctcaaatgcgtgatatcatcgaccggaatccagatcttgctcatgttctcaatgatccaagtgttctccgccagacccttgaagcagccagaaaccctgaaatcatgagggagatgatgcggaacacagacagagcaatgagcaacattgagtcttctcctgaagggtttaatatgctccgacgcatgtatgaaactgtccaggagcctttcctaaatgcgacaacaatgggtggagaaggcaacacagctccaaacccattctcagctcttcttggaaatcagggttctaaccaaccaagggatcctgctacaaatgctccaaatactggctcagagtctacaacaggaacccctgctccaaacactaatccacttccaaatccttggagctccaatgctggaggtgcgcaaggagcaacacgggcaggttctactggcaatgcaagaaccggtgccactgggggccttggagggttggggtcagctgatctgagcagtttatttggtggtcttgccggtaatacaggaactggtgctactggtggtctaggagggttgggttcagcagatttgggaagtttgcttggtggttctcctgattcttcttccttgagccagattttgcaaaaccctgttatgatgcagatgatgcagaatatcatgtctgatccacagtccatgaaccagttgcttaacttcaacccaaatacacgcaacctcatggaatcaaacactcagttgagggaaatgttccaaaatccagaatttattcgccagcttacatccccagaaactatgcagcaattactctcgttccagcagacattattatcacagcttggtcaaaatcaacctaggcaggatggtagccaaggaggcaatgcgacaggcatgcggggaaatgttagcctcgacaccttgatgggcatgcttagtgggcttggtgctggaggtggcataggtgtacccaatacatccaatgttccaccggaagaactgtatgcaacacagctcactcagctccgagagatgggtttcatcgacactgcagagaacatccaggcgctagtcgcaactgctgggaatgtgaatgctgcggtggagcgtcttcttggcaatcttggccagtagctaaagcgtaccagacgctgcccataacgtcaccaactccgctcttttgcaagaggttttttagcccctccaagttcaaacgcagcgtctgtctacagtctcaggagaaaataaaacaaagaaatcccacccccaccattaacttttccatacatggtcgtcatgcctttgtttttaccgtgttgtatttgactatttgggttgatgtacatacatatgaaattatcggatcttaccgcatagaatatgggtctacctttgc

SEQ ID NO: 1606 - DNA, 1982 bp, Hordeum vulgare subsp. vulgare
gggacggacggacgaactcgcgcacacacagcgagcacgacacaaaccacaaacccctcccccactccacgcgccggatcggggcggaggccggccggatcgaccctcgggccaggcaggggcatgggcggcggcgagggcgaggcgggcggcgagcccgcggccgcgccggcgacgctgcacatccgcggcaccagcgggaacaagttcgcggtgcgggccgacctgggcgccaccgtcggggagttcaaggcgctcgtcgccgagagctgcgacgtgccggcgccgcagcagcggctgatctacaagggccggatcttgaaggacgaccaaaccctagccagctacggtgtggagactgatcacaccatccatatggtgcgcggtgctgcaccaccagcaacatcggctaccccggctgcagccaaccttgggacttcaactatgactcctgtgaataccccgccagctggtcttggaggcttgtttcaaggtcttggtggtacaggaactgctggcagtggagcttttggtttatctggctctggccttccaggattagagcagatgcaacagcagttaactgagaatcccaacttaatgagagaagtattgaatacgccagccatgcaaaacataatgaatagccctgatctaatacgcgatttaattatgaacaatcctcaaatgcgtgagctcgttgaccgtaatccggatctggcacatgtcctgaatgacccaagcattctccgccaaactgttgaagcagctaggaatcctgaacttatgagagagatgatgcggaacacagacagagccatgagcaacattgaatcttctccagaagggtttaatatgctgcgccgcatgtatgaaactgttcaagagccatttatgaatgcaacaacaatgggtggggagggcggcacaaatccgaacccatttgcagctcttctaggaaaccaggggtctaaccaagccagagatccaaccggagatgcaccaactactgctcctgctccaaatactaatccactcccaaatccctggggtgcaaatgctggggctgcacaaggagcagcaaggccttctggtgctgctgctgcaaggagtgccacaagcggtggcctaggagggttgggttctgcagatttgggaagtatgctgggtggtggctctgatgcttccttactgaaccaggttttacaaaaccctaccatgatgcaaatgatgcaaaacattatatctaatcctcagaccatgaatcagttactcaacatggacccgaatgtacgtaacatgatggaatcaaatacccaaatgagagaaatgtttcagaatccagaatttctacgccagttgatatctcctgaatcattgcagcaattagattcattccagcaggcattgacatcacaacgtggtcaacaagctgctggccaggagaggacccaagcgggcgctactccaggcaacgttaacctcaacagcttgatgagcatgttcagtgggcttggtgctggcggtggcctgggtggtgtcccaaatatcccaactgtgccaccggaagagcgctacgcgacgcagctagctcagctccaagaaatgggtttcttcgacccacaggagaacatccgggcgctgctggctaccaatgggaatgtccatgctgcggtggagcgccttcttgggaactttgggcaatagttgattatatatcccgggtcggtcacctgtagtagttggcattgtgaggtttcactggttgtatacccggccagattgaagggcggcatatctctagattctatgtgttttaagatggatgaataaaccagtctctctactggctatcctttgcatgcatgcgtgcatacatgagtcccgtgtcgtggtggttaaactgtggtatattggtagtacttaccttgggtcgtgggtgtacatacatattgaattgtggtggtctttaaaagtacatc

SEQ ID NO: 1607 - DNA, 1971 bp, Hordeum vulgare subsp. vulgare
ggatttctcacacaacacgacccaaacccctcccccctctcccactccacaggccagatcggggcagaaaccggccggatcgaccctcgggctaggggcatgagcagcggcgagggtgaggcgggcagtgagcccacgggagcggccccggatgtggccccgctggcagtgctggacatcagggacactagcgggaacgagttctgggtgtgggccgacctgggagacaccgtcggggagttcaaggtgatcgtcgctgggagctgcgacgtgccggcgccgcagcagcggctgatctacaagggccggatcttgaaggatgaccaaaccctagccagctacggtgtggagactgatcacaccatccatatggtgcgcggtgctgcaccaccagcaacatcggctaccccggctgcagccaaccttgggacttcaactatgactcctgtgaataccccgccagctggtcttggaggcttgtttcaaggtcttggtggtacaggaactgctggcagtggagcttttggtttatctggctctggccttccaggattagagcagatgcaacagcagttaactgagaatcccaacttaatgagagaagtattgaatacgccagccatgcaaaacataatgaatagccctgatctaatacgcgatttaattatgaacaatcctcaaatgcgtgagctcgttgaccgtaatccggatctggcacatgtcctgaatgacccaagcattctccgccaaactgttgaagcagctaggaatcctgaacttatgagagagatgatgcggaacacagacagagccatgagcaacattgaatcttctccagaagggtttaatatgctgcgccgcatgtatgaaactgttcaagagccatttatgaatgcaacaacaatgggtggggagggcggcacaaatccgaacccatttgcagctcttctaggaaaccaggggtctaaccaagccagagatccaaccggagatgcaccaactactgctcctgctccaaatactaatccactcccaaatccctggggtgcaaatgctggggctgcacaaggagcagcaaggccttctggtgctgctgctgcaaggagtgccacaagcggtggcctaggagggttgggttctgcagatttgggaagtatgctgggtggtggctctgatgcttccttactgaaccaggttttacaaaaccctaccatgatgcaaatgatgcaaaacattatatctaatcctcagaccatgaatcagttactcaacatggacccgaatgtacgtaacatgatggaatcaaatacccaaatgagagaaatgtttcagaatccagaatttctacgccagttgatatctcctgaatcattgcagcaattagattcattccagcaggcattgacatcacaacgtggtcaacaagctgctggccaggagaggacccaagcgggcgctactccaggcaacgttaacctcaacagcttgatgagcatgttcagtgggcttggtgctggcggtggcctgggtggtgtcccaaatatcccaactgtgccaccggaagagcgctacgcgacgcagctagctcagctccaagaaatgggtttcttcgacccacaggagaacatccgggcgctgctggctaccaatgggaatgtccatgctgcggtggagcgccttcttgggaactttgggcaatagttgattatatatcccgggtcggtcacctgtagtagttggcattgtgaggtttcactggttgtatacccggccagattgaagggcggcatatctctagattctatgtgttttaagatggatgaataaaccagtctctctactggctatcctttgcatgcatgcgtgcatacatgagtcccgtgtcgtggtggttaaactgtggtatattggtagtacttaccttgggtcgtgggtgtacatacatattgaattgtggtggtctttaaaagc

SEQ ID NO: 1608 - DNA, 1668 bp, Oryza sativa Japonica Group
cgccaccttccccttccccccctccgccgcctcctccgccgcgaaacgaaaggcgagctctctctctctctctctccgcggcgcggtcaaaaccctagcgcgcgaggaggccccccccatggcgcagcagctctccgcccccttccgcgccgccgcggccgccggatcccgcgcctccgccgccgccgccgatcccgccaaggtgttacgcttgagaagcgctggctcagctcagttcacctccatcgcagcttcctcttcatttgctaggaacattgagccgctgagagcgatagctactcaggcaccccctgccgtcccacaatattcgagtggcgagaagacaaaggttggcatcaatgggtttgggcgaattgggaggttggtcctgcgtattgcaaccagtagagatgatattgaagttgttgctgtcaatgatcctttcattgatgctaaatacatggcctacatgttcaagtatgactccactcatggtccatttaaaggctccattaaggttgtggatgattcaaccctggagatcaatggaaagaaagtcacaatcactagcaaaagagatccagcagatattccttggggtaactttggagctgagtatgttgttgaatcttcaggtgtttttacaacaactgaaaaggcatcggcacatttgaagggcggtgctaagaaagttgtgatatctgctccatcagcagatgctccaatgtttgtcgttggagtaaatgagaagagctatgatcctaaaatgaatgttgtttctaacgcaagttgtactaccaactgtcttgctcctcttgccaaggttgtccatgaggaatttggcattgttgagggtctcatgacaactgttcatgccacaacagccacccagaagactgtcgatggcccttcaatgaaagattggagaggagggcgtggtgctgctcaaaacataattcctagctccactggtgcagccaaggctgttgggaaagtcctccctgagctaaatggaaagctcactggtatggccttccgagttccaacaccaaatgtgtctgttgtcgacttgacctgccggattgaaaaaagtgcatcctatgacgatgtgaaagcagccatcaaggcagcatcagagggtgcactgaaaggtattctaggttacacagatgaggatgtggtttccaatgacttcgttggtgatgcaaggtcaagcatctttgatgccaaggctggtattggactgagctcttccttcatgaagcttgtgtcatggtatgacaacgagtggggctacagcaaccgtgtgttggatctgattgcccacatggctcttgtcaacgccaagcactgatttgttgaaaatcctcctccgatagtatctagctaggaaaggctgcaattttgacggtctctttctgttgtcttggaataagatgtaaacttggaaacaaagcaaaaaaagaatggacattgatgtccatgacattgtttgtagcaggcggtgaaatttactctgtatcgacctgggcaagcggaactgttgagtgaaccatatgtcggcaacctgattgattcattgagtccaatgctatgccattctatatttactttaaacatgcttgtttcatgccagaaatgttcaacagacaattggcaatttacctc

SEQ ID NO: 1609 - DNA, 1647 bp, Zea mays
awgacacgcttccgcggcgccaccaccttccgccctccgctgcccgctcgcctccgcgcccgaaaggcaaagcctcctcgctcctgccccgccccctcctcgcggcgtcggtcaaaccctagcacaccgtacgcgcaggcctgcccgctcccattccccacctccacccatggcggcgctctccgcgcccctccgcgccgtcgccgccggatcccgcgtcgccgcgtccgaccccgtcaaggtctcgtgcgtgaggagcactggctcagctcacttcggctgcgccttcccctacatcagggcctcctcttcggctgcgaggaacctcgagccgctgagggcgatagccacgcaggcgccccctgccatgccacaatattcgagtggggagaagacaaagattggcatcaacgggtttgggcggattggcaggttggtcctgcgaattgcaaccagcagagatgatattgaagttgtggctgtgaatgaccctttcattgatgctaagtacatggcctatatgttcaagtatgattccactcatggcccgtttaaaggttctattcgtgtcgtggatgattcaaccctcgagatcaatgggaagaaggtcacaattacaagcaaaagagatcctgcagagattccatggggtaactttggggctgaatatgttgttgaatcttctggtgtcttcacgacgactgataaagcatcagcacacttaaagggtggtgcaaagaaagtggtgatatctgcaccatcagctgatgctcccatgtttgtagttggagttaatgagaatagctatgatccaaagatgaatgttgtttctaatgcaagttgcactaccaactgccttgctccacttgccaaggttgtccatgaggaatttggcatcgtggagggccttatgacaactgttcatgcaacaacagctacccagaagaccgtcgatggtccttcgatgaaggattggagaggaggacgtggtgctgcccaaaacataattcccagctccactggtgcagcaaaggctgttggaaaagtcctgcctgagctgaatggaaaactcactggtatggccttccgagttccaacaccaaatgtctctgttgtggatttgacatgccggattgagaaaagcgcctcctatgatgatgtgaaagcagccatcaagacggcatcagagggtgcactcaaaggtattcttggctacacagacgaggatgttgtttccaatgattttgttggtgattcaaggtcaagcatctttgatgccaaggctggtattggactgagctcttccttcatgaagctcgtgtcttggtatgacaacgagtggggctacagcaaccgggttctggatctgatcgctcacatggctcttgtgagcgccaagcactgatgttcgtactcgttcctccagtaccagtagtagcctagataagaggctgcagttttgacggccattttcttttagctgttgtttggaataaaagaccaaatgttggaacacttggaactcgcgcaaaactggaatccgattcatgacctgtgttttagttgtagagggggcaaatttgcatcgtactatatgcgggattgttgatcggatgtcgtatggttcattgaaaaaaaaaaaaaaaa

SEQ ID NO: 1610 - DNA, 1510 bp, Zea mays
cgctgcccgctcgcctccgcgcccgaaaggcaaagcctcctcgctcctgccccgccccctcctcgcggcgtcggtcaaaccctagcacaccgtacgcgcaggcccgcccgctcccattccccacctccacccatggcggcgctctccgcgcccctccgcgccgtcgccgccggatcccgcgtcgccgcgtccgaccccgtcaaggtctcgtgcgtgaggagcactggctcagctcacttcggctgcgccttcccctacatcagggcctcctcttcggctgcgaggaacctcgagccgctgagggcgatagccacgcaggcgccccctgccatgccacaatattcgagtggggagaagacaaagattggcatcaacgggtttgggcggattggcaggttggtcctgcgaattgcaaccagcagagatgatattgaagttgtggctgtgaatgaccctttcattgatgctaagtacatggcctatatgttcaagtatgattccactcatggcccgtttaaaggttctattcgtgtcgtggatgattcaaccctcgagatcaatgggaagaaggtcacaattacaagcaaaagagatcctgcagagattccatggggtaactttggggctgaatatgttgttgaatcttctggtgccttcacgacgactgataaagcatcagcacacttaaagggtggtgcaaagaaagtggtgatatctgcaccatcagctgatgctcccatgtttgtagttggagttaatgagaatagctatgatccaaagatgaatgttgtttctaatgcaagttgcactaccaactgccttgctccacttgccaaggttgtccatgaggaatttggcatcgtggagggccttatgacaactgttcatgcaacaacagctacccagaagaccgtcgatggtccttcgatgaaggattggagaggaggacgtggtgctgcccaaaacataattcccagctccactggtgcagcaaaggctgttggaaaagtcctgcctgagctgaatggaaaactcactggtatggccttccgagttccaacaccaaatgtctctgttgtggatttgacatgccggattgagaaaagcgcctcctatgatgatgtgaaagcagccatcaagacggcatcagagggtgcactcaaaggtattcttggctacacagacgaggatgttgtttccaatgattttgttggtgattcaaggtcaagcatctttgatgccaaggctggtattggactgagctcttccttcatgaagctcgtgtcttggtatgacaacgagtggggctacagcaaccgggttctggatctgatcgctcacatggctcttgtgagcgccaagcactgatgttcgtactcgttcctccagtaccagtagtagcctagataagaggctgcagttttgacggccattttcttttagctgttgtttggaataaaagaccaaatgttggaacacttggaactcgcgcaaaactggaatccgattc

SEQ ID NO: 1611 - DNA, 1785 bp, Sorghum bicolor
gaacgatcacgcgctgaacgcttccgcctcgccgccaccttcccacccctctcctccctccgcccgcctcctccgcgcccccgaaaggcagaaccctcgctccctatcccggtcccctcctcgcggcgtcggtcaaaccctagcacacggtacgcgcagacccgtccgcccgctcccattccccatccccacacatggcggcgctctccgtgcccctacgcgccgcggccgtcgccgccggatcccgcgccgccggggccgaccccgtcaaggtcttgtgcgtgaggagcactggctcggctcactttggctgcgccttcccttccatcacggcctcctcttcggttgcgaggaacatcgagccgctgagggcgatagctacacaggcgccccctgccgtgccacaatattcgagcggggagaagacaaagattggcatcaatgggtttggacggattggcaggttggtcctgcgaattgcaaccagcagagacgatattgaagttgtggctgtgaatgaccctttcgttgatgctaagtacatggcctatatgttcaagtatgactccactcatggcccgttcaaaggttctatccgtgtcgtggatgattcaaccctggagatcaatgggaagaaggtcacaattacaagcaaaagagatcctacagagattccatggggtaactttggggctgaatatgttgttgaatcttctggtgtctttacaacgattgataaagcatcagcacacttaaagggtggcgctaagaaagtggtgatatctgcaccatcagcagatgctcccatgtttgtagttggagttaatgagaaaagctatgatccaaagatgaatgttgtttctaatgctagttgcaccaccaactgccttgctccacttgccaaggttgtccatgaggaatttggcattgtggagggccttatgacaactgttcatgccactacagccactcagaagactgttgatggtccttcgatgaaggactggagaggaggacgtggtgctggccaaaacataattcctagctccactggtgcagcaaaggctgttggaaaagtcctacctgagctgaatggaaagctcactggcatggccttccgagttccaacaccaaatgtctctgttgtggacttgacatgccggattgagaaaagcgcctcctatgatgatgtgaaagcagccatcaaggcggcatcagagggtgcactcaaaggtattcttggctacacagacgaggacgttgtttccaatgattttgttggtgattctaggtcaagcatctttgatgccaaggctggtattggactgagctcttccttcatgaagctcgtgtcttggtatgacaacgagtggggctacagcaaccgggttctggatctgatcgcccacatggctcttgtcagcgccaagcactgatgttcgtgctcgttcctccagtagtagcctgggaaaaaaaggctgcaattttgacggccattttcttttagctgttgtttggaataagataaaaatgctggaacgctttgaactcgcgcaaaaatggactcagatccatgagctgtattttagttgtagaaggggcaaatttgcaccatagtaccctgcggaattgttgattgatgagtcctatggttcgtcgacttgatgttttgttatgatgtgtgggcccttgaatgagttgatatttttttaggccatccatgctttaatggaaatatatataggatggcaatggcaatccgtcgacttgcacggtattttggtt

SEQ ID NO: 1612 - DNA, 1801 bp, Zea mays
cttttaatttcatttcctctcttttgacgacggaaacgaggcacgatcacacgctgaacgcttccgccccgccgccaccttccccgctctcctccctccgctcgcctccgcttccgttccgcgccctgcccccggaaggcaagcaaagccctcgctacttgcggagcgtcgttggtcaaaccctagcacacgtacgagcaggccagccccgcccgctcccattcccaggccctcatccatggcggcgctctccgtgcccctccacgccgccgccggatcccgcgccgccgcggccgaccccgtcaaggttccgtgcgtgaggagcactggttcagcccatttcggccgcgccttcccctccgtcgcggtctcctctttggctgcgaggcacatcgagccgatgagagcgatagctacacaggcgccccctgccgtgccacaatatttgagtggcgagaagacaaagatcggcatcaacggctttgggcggattggcaggttggtcctgcgaattgcaactagcagagacgatattgaagttgtggctgtgaatgaccctttcgttgatgctaagtacatggcctatatgttcaagtatgactctactcatggcccgtttaaaggttctatttgtgttgtggatgattcaaccctggagatcaatgggaagaaggtcacaattacaagcaaaagagatcctgcagagattccatggggtaactttggggctgaatatgttgttgaatcttctggtgtctttacaacgactgataaagcatcagcacacttaaagggtggtgctaagaaagtggtgatatctgcaccatcagcagatgctcccatgtttgtagttggagttaatgagaatagctatgattcgaagatgaatgttgtttctaatgcaagttgcaccaccaactgccttgctccacttgccaaggttgtacatgaggaatttggcatcgtggagggccttatgacaactgttcatgccacaacagccacccagaagaccgttgatggtccttcaatgaaggattggagaggaggacgtggtgctggccaaaacataattcctagctccactggtgcagcaaaggctgttggaaaagttctgcctgagctgaatggaaagctcactggcatggccttccgagttccaacaccaaatgtctctgttgtggacttgacatgccggattgagaaaaacgcctcctatgatgatgtgaaagcagccatcaaggcggcatcagagggtgcactcaaaggtattcttggctacacagacgaggacgttgtttccaatgattttgttggtgattctaggtcaagcatctttgatgccaaggctggtatcggactgagctcttctttcatgaagcttgtgtcttggtatgacaacgagtggggctacagcaaccgggttctggatctgatcgcccacatggctctcgtcagtgccgccgccaagctctgatgtccgtactcgtttctccagtagtagcttagaaaaaaagactgcaattttgacggccattttctgttagctgttgtttggaataagatcaaatgctggaacacttcgaactcgcgcgagactggactcagatccatggcctgtattttagttgtagaagtgggcaaatttgcaccgtagtaccctggcatggttatatgcggaattgttgattgatgagtcgttgtacggtttgtcgacttgatgatatgttgatgtgggagcccctgaatgaggcggtattaatggaaatataggatggcaatggcaaaaaaaaaaaaaaaa

SEQ ID NO: 1613 - DNA, 1563 bp, Oryza sativa Japonica Group
accgggagacgcatcacggaaccacgccgccgacgacgacccccgccgccgcacaactccgctcgccgtctcctccgcccccgcctccattccgccgccttccttagaggaagccaagtttccagcgccgccgcacctgcatggcgtcgctcgccgtccccctccgcgcttccgccaccccggccatcgccggcaccggcagcggcggcggatcacgcgccgccgaccccgtcaaggtgtcgtgcgttaggagcaaggttacctgcggttttccttccgttggggcttcgtcttcacttgctagcagcgttgagccggtgagagcaactgctacacaagcaccccttgccacccatcaatcttctagcacggagaagacaaaggttggcatcaatggatttggacggattgggaggttggttctacgaattgcaactaatagagatgacattgaagttgtggctgttaatgatccttttatcgatgctaagtacatggcttatatgttcaagtatgattcgacacatggtccatttaaaggcaccataaaggttgtggatgagtcaaccttggagattaatgggaagaaaatttcagttacaagcaaaagagatccctcagatattccttggggaaactttggagctgaatatgttgttgaatcatctggtgtttttacaacaactgagaaagcatcagcacacttaaagggtggtgcaaggaaagtagtgatatctgctccatccgcagatgctcctatgtttgtagtcggagtaaatgagaagaattacaaccccagcatgaatgttgtctctaatgcaagttgtactaccaactgtcttgcgccccttgccaagattgtccacgaggaatttggcatagctgagggcctcatgacaactgtccatgctacaacagccacccaaaagactgtcgacggtccttcaatgaaagattggaggggaggacggggtgctagtcagaacatcatccctagttctactggcgcagcaaaggctgttggaaaggtccttccagcattaaacgggaaactcactggtatggccttccgagttcctacacctaacgtctctgtagttgacttgacatgccgtcttgagaaaagtgcttcttatgaggatgtgaaagcagctatcaaggaagcctcagaaggttctttgaaaggtattttaggctacacagatgaggacgtcgtttcgaatgatttcattggtgacaccaggtctagcatatttgatgccaaggctggaattggcttaagttcttctttcatgaagctcgtctcttggtacgacaacgagtggggctacagcaaccgggtcttggatttgatcgggcacatggctctcgtcaacgctaagccctgatgccattgataacagcagatgccctagtaatgtaggaagagaaggctgcaaacttgatggccccttctgtatctcggaattatattaagcacaccgaacaaaaccattgccgacatgaagatacatgctgtgttgtgataatccgagcttatttttggcctgtttgaattttgtt

SEQ ID NO: 1614 - DNA, 1657 bp, Hordeum vulgare subsp. vulgare
ggagggagatcgcccgctcgctgcacaacgcccacgccgccgtctcccctctccctctccgcctccctccgtccaaccgcacctcgcacccccgccgccggcggcacctcatggcgtcgctctccctctccctccgcgcctccgcatccgcctcctcggccggatcccgcgcagccgccgcaatcaaggcatcgtgcgtgaggagcaaggttacctgcagcttcccttccgtcggagccacctcctcacctgctagaagcattgaacccgtaagagcaaccgccacacaggcgccccctgccaccccttcatcttctagcggggagaagacaaaggtcggcatcaatggttttgggcggattgggaggttagttctgcgtattgcaatcgatagagatgatattgaagttgtggccgtcaatgatccgtttatcgatgctaaatacatggcctatatgtttaagtacgattccacacacggtccttttaaaggaaccataacagttctggatgagtcgaccttggagattaatgggaagaaagtctcagttacaagcaaaagggacccctcagatattccttggggcaactttggagctgaatacgttgttgaatcatctggtgtttttacaacagttgagaaagcttcagcacatttgaaggggggtgcaaagaaagtggtcatatctgctccatcagccgatgctcccatgtttgtggttggtgtaaatgagaagaattacgaccctagcatggatgtcgtctctaatgcaagttgcaccaccaactgtcttgctcctgttgccaaggttgtccacgaggagtttggcattcttgaaggcctaatgacaactgtccatgccacaacagccacacaaaagactgttgatggtccttcgatgaaggactggaggggaggacgcggggctggtcaaaacatcatccctagctctacgggtgcagcaaaggctgttggaaaggtccttccagctttaaatggaaagctcactggcatggccttccgggttcctacacctaacgtatccgttgttgatctgacctgccggcttgagaaaaacgcatcgtatgaagatgtgaaagcagctatcaaggaagcatcagaaggtccgcttaagggtattttaggctacacagacgaggatgttgtttcaaacgattttgttggtgacacaaggtcaagcatctttgatgccaatgctggtatgggtctaagttcatctttcatgaagctcgtctcctggtatgacaacgagtggggctacagcaaccgtgtcctggatctgatcgggcacatggctcttgtcaacgcttgatgatgatgcctcgattactatttagtgcagaaggtctcctcgcgtagtgtaggaaaattaaggctgcaattttgatggccattctcgtatcctggaataatatttctgtgcgatgaaaacaatcaaatcaatcggcgtcgacttgaagctgtagaacgctcatgctggtctgtaaaaccccataactgaatcgctgtgggtgggcaagaaacccaatctccgactcgtcgagtcatagcgttgttactttgaccttgtggtggtatccgtgttttgtttccaccttcagggaggataggaaatgatgatgatgatgatgactc

SEQ ID NO: 1615 - DNA, 1790 bp, Guzmania wittmackii x Guzmania lingulata
gggggagagagagggagcttctcttcagattccgattccttcgagttgttgttgttgttgttgttgttgtccccttcgctcgcttctagggtttgctttttctctctctttgggggcggatccttcgagaaaacgtcgagagagagaggggaaggagagggagagggaagggtggtgcggtgtctctaatggcggcgtcctctgctgttctccgatccgcgacaccccacgtcctcggcggatctcgcggcggcgctggggcttcggagccgatcaagatatcttatgtgaggagtctgagctcagccccgaatcattcgagggtttttggtgctgccatatccacctcatcacgaaaatctggtgcaagaagcattcagccgatcaaagccacggctactgcagcccccccttccgttccaaaattgtcaagtgggggaaagacgaaggtgggcataaacggttttgggcgtattgggaggctggtcttgcgcatagctaccgccagagatgatattgaagttgttgctgtgaacgatccatttgttgatgcaaagtacatggcgtacatgttaaaatatgattccactcatggattattcaagggaaccatccgggtagtggatgagtctactctagaaatcaatggaaagagaatttcagtcacaagcaaaagagatcctgcggaaatcccttggggcaatcttggtgcagaatatgtagttgaatcttctggtgtttttacaacaacggacaaggcatcagcacacttgaagggtggtgccaagaaagtggtcatatcggccccctctgctgatgctcccatgtttgtggttggagtgaatgagaaggcctaccaaccaagtatgaatgttgtttccaacgcgagttgcactaccaactgtcctgctcctctagctaaggtggtgcatgaggagtttggtattatcgaaggcctgatgacaactgttcatgcaacaacagcaacacagaagactgttgatggtccttcgatgaaagattggcgaggaggccgaggggctagtcagaatatcattcctagttctactggtgcagcaaaggctgtgggaaaggtccttccggaactaaacgggaagcttactggcatggcgttccgtgttcccacgcctaacgtatctgttgtggacttgacttgccgcatcgaaaaaaatgcttcatatgatgatgtcaaagcggctatcaaggctgcttcggaaaatgcactgaaaggcattcttgggtacactgatgaagatgtcgtctctaatgattttgtcggcgattcaaggtcgagcatatttgatgcgaaggccggtatcggactcagcaaatctttcatgaagctcgtctcttggtacgacaacgagtggggttacagcaaccgcgtgctcgatttgatcgggcacatggcgttggtatgcgcccgccactgaaggagcaacagcagaagctcgctcgcactgcttcgctccgctccgagccttcgaaattagtcgtcggcgattttggggggagagttttgttgtcagatattttttttcttacaaaccaaattgtggttaaatcacaatactacaaatttttaagcgaaactttagataaacttaagaggaactgggcttggagaacaataatatcccagtattagcaaaccaataagttactcaaaactttgaatctcagtggattctaatttgaacttccaatttggttgttgtattaaaatgtttggtgtatttgatgttgtttaaaaaaaaaaaaaaaaaaaa

SEQ ID NO: 1616 - DNA, 1663 bp, Capsicum annuum
ggcacgagctatccttctcattttactaatattttttttcttccttcaccaaaacacatactaacctttttgtgtttagggttctttgaatagtatattttacataaaacatagagattcaccaaactctcttgcatttttgtgactcttcaatggccttctcttctcttctcaaacctaccgcctcccttgttcgtccatcccatcgctcccaggcatcatgtgtaggccttcaacacagttctaactctgtcaaattacaatcagctatcttcggagatgttgtctcaatcgcgcaatcttcgtccttacaaaactctggtgcctgcagcattcaaccaatcagagcaactgctactgagttgcctccaacagttccaaagtcacagacgggtgggaaaacaagggttggtataaatggttttggacgtattgggagattagtattaagaattgcaacattcagggatgatattgaggtagttgcagttaatgacccatttattgatgcaaagtacatggcttacatgctcaagtacgactccacccatggagttttcagaggatccatcagtgtcctggatgacactactttggaaatcaacgggaagcagattaaagtcagtagcaaaagggaccctgcagatattccatggggtgatttaggtgcagattatgttgttgaatcttctggtatcttcacaactgttgacagggcttcaggacataagaagggtggtgcaaagaaggtcgtaatctcagccccatcagctgatgcaccaatgtttgtggtgggagtgaacgagaaaacttacaaagccaacatggatgttgtttccaatgctagctgtacaaccaattgccttgctccacttgccaaggtggttcatgaagagtttggcattgttgaggggctaatgactactgtgcacgcaacaacagctacccaaaagactgttgatgggccatcaatgaaggattggcgaggaggccgtggtgcaggacagaacatcatcccaagttcaactggtgctgctaaggcagttggaaaagttctgccagaattgaatgggaagctcactggaatggcattccgtgtcccaacacctaatgtctctgttgtggacttgacttgccggctaaataaaagtgcttcttatgatgatgtgaaagcagcgataaagtatgcatcagagggtccacttaaaggcattttgggttacaccaacgaggatgttgtgtcaaatgattttgttggggattccaggtcgagcatatttgatgctaaagctggtataggcctgagcaaatcattcatgaagctcgtctcctggtacgacaacgagtggggttacagcacccgagttttggacctcatagagcacatggcgttggtagcagccaccagttgaaatagaagataggagctaatgcagaagttggcgcaagcaacaatttgtatttgaaaaagttaaagaggagttttgatggctccgtttttgttatggattgagtttcattactgtcgtattcgagtttaaaataatgaacagttggacatgtatggtgattatatacgcgttttcataaggatgtgattctatacacttgctgctatggagaggtggctatttttgaccataaaaaaaaaaaaaaaaaaaaa

SEQ ID NO: 1617 - DNA, 1802 bp, Vitis vinifera
taaaggtcatacacctaacagaggaagaagccttcctttttctctagggttttctttctttctttctttctttcttggcctttacttcaatccaagagaccagaggagaagaggaagagttccattcggttttgtaatggcgctctattctctcttcagatccgcgccttccgccgccgccgccgccgccgctactgtggtggattcttctcgtccttctgatcgatgcaaggtgtcttgcattggtttcaatagcaatgcggactcactgaaggttcagaccaccatatttggtactccttgtattggaaattcatcttccttacagaaatgcagtgccaggagtctccagcccatcaaagccacagccacagaattgcctcctacagttcaaaagtcatggagcagtgggcagacaaagattggaatcaatggttttggtcgaattggaaggttggttttacgagtagcaacctctagggatgatattgatgtggtagcagtcaatgatccatttgttgatgccaaatacatggcttacatgttcaagtatgattctactcatggagttttcaagggaaccatcaaggtattggatgagtccactttggaaatcaatggcaagcagataaaagttacaagcaaaagggacccatcagaaatcccttggggtgattatgggattgattatgttgttgaatcttctggagttttcacaacaaccgagaaggcttctgcacacataaagggtggtgccaagaaagtggtaatttcagctccatcagctgatgcaccgatgtttgtggtaggagtaaatgagacttcatacaagccaagcatgaatattgtttctaatgcaagctgtaccaccaattgccttgctcctcttgccaaggttgttcatgaggaatttggtatcgttgagggtttaatgacaactgtgcatgccactacagccacacagaagaccgtggatgggccttcaatgaaggattggcgagggggccgaggtgcttcacaaaatatcatcccaagctccactggtgctgcaaaggctgttggaaaagtccttccagaactcaacggaaagctcactggaatggccttccgcgtcccaacacctaatgtctctgttgtggacttaacttgtcgacttaagaagagtgctacatatgaagatgtcaaagcagccgtaaagtatgcctcagaggggccattgaagggtattcttggatacacggatgaggatgttgtctccaatgattttgttggtgactcaaggtcaagtatatttgatgcaaaggccgggatagggctgagtgcttccttcatgaagctcgttgcatggtatgacaacgaatggggatacagcaaccgagtgctggacctcatagagcacatggcattggtggcggccagcaaatgagaacaagaaactagtagaggtttgccaaacctgcatcttctccaatttttatgcctgcaatgaatatgcttgaaagagtaggagttcataggtggtttggccaaactatgaaataatgaatgagatttgaacattaacctgtatgagttgatggataagtggtattttttcttgattggtggtatctttttgatacaaattaaggtataaagcaataggacctagttggataagtggtatgcgatagggacctagttggattagtggtatttcttcttgattggtatcgcatccaaacccaagacattgatgcgatatttaagtgccatgtttttattttatgcttgaaaggtaaatgtgaaagtctcttcgatta

SEQ ID NO: 1618 - DNA, 2044 bp, Sorghum bicolor
gcaaaaccccacagccggagctcgcggtcgccggtcgccaccaccaatggggccacccgccatggcgttccaagccctcaccctcaccccagtccccttctcactccacagctcgagtcgccgcgtccgcgtccgcgtgcttgccgtcgcggctgaccagacccctccgccgccggcggtccccccttcggagccggcgaacagccctagccgcctccttcgggagctcgcgcagcggaagaaggccgtatcccctaagaagaagcacccgccgcgtcgcttcatcctgaagccacctctcgacgacgagcgcctcacccggcggttcctcagcagcccgcagctgtcgctcaaggcgctcccgctgctctcttcctgcctcccctccgcgccgctctccaccgccgacaggacctggatggacgagtacctcctagaggccaagcaggcgctcgggtacccgctcgcgccctcggagacgctcggcgaaggcgatgactgccccgcgcggcatttcgatgtgctgctctacctcgcgttccagcatctggacccctcctccgagcgcacgcggacgcggcacgtgcggaacggtcactccaggctctggttcctgggtcagtacgttctggagctcgcgttctgtgagttcttcttgcagaggtaccccagggagtctcctgggccgatgagggagcgggtgttcgctctgattgggaagaaggtgttgccccgatggctcaaggcagccagcctgcacaatttggtcttcccctatgatgatttggataagatgatacgtaaggaccgggagccgccgtccaaggctgtgttctgggcactatttggagctatatatttgtgctttggaatgcctgaagtctatcgtgtcctatttgaggcatttgggatggacccagacgatgagagctgtcagccaaaattgcgtcggcaactagaggatgttgattatgtttcagtggagtttgaaaagagacagctcacgtggcaggatgttgctgcctacaggccaccaccggatgctctttttgctcatcctaggcttttccgagcttgtgtgccaccaggcatgcatcgcttcagaggaaatatttgggattttgacagtagacccaaggtcatgaataccctaggatatcccttgcccatgaatgacagaattccagaaatcacagaagcaaggaatatagagcttggacttggtcttcagctgtgctttttgcacccgtcaaaacataagtttgagcatccaagattctgttatgagcgccttgaatatgtcggccagaaaattcaggatttagtaatggcagagaggctactcatgaagcacctcgatgcaccgggcaggtggctggcagaaaagcatcggaggacgttaatgaacaagtattgcggacggtacctgcgggacaagcacctgcagcactatattatttacggggagacagtgcaagacagattcgaacacaatcgacgtctaaggaatccttcaacgacctctgtccagcaagcgctacatgggcttgcatactgtgtgtatggcaaacctgacgtgcggcgcttgatgttcgaggtgtttgactttgaacaggttcagcctaaagcagtatgatgtgtttgacttcgaacagttcgaggtgctcgagttgctgaccaacaagaccgccaatggcagcggtaaaaatgctgtggcttctggaagtcatccatccgacaggagatattcagttctgaagcctgaagcatgaaccctgatctgaggccactgagtagccactgggtgcggcctctcctgaaactatcaccgttccaacctcctcgtccgtcggaaatggtagactagtgatgctgtaaatcggaagttgctgttctttgaacttacaattttgacaattagttgaattcctgtttgggcagaaacgcaaatagcagcagcatggcatattcatttcctatcagaattgtagtctgtaatcgagaagcagtgagatgaataatacaaagatattcattcgtccgc

SEQ ID NO: 1619 - DNA, 2107 bp, Zea mays
cataattctcgtctgcttatccgctcccttctctccctcaacttcagcaagttccccgcaaaaccgcagccggaggtcgccggtcgccaccaccaatggggccacccgccatggcgttccaagccctcaccctcacgccactccccttctcactccacagctcgagccgccgcgtccgcgtgcttgccgttgcggccgaccagactcctccgcccgcccccccttcggagccggcgaacagccctagccgcctccttcgcgagctcgcgcagcggaagaaggccgtatcccctaagaagaagcatccgccgcgtcgcttcatcctgaagccacctctcgatgacgagcgccttacccggcggttcctcagcagcccgcagctgtcgctcaaggcgctcccgctgctctcttcctgcctcccctccgcgccgctctccaccgccgacaggacctggatggacgagtacctcctcgaggccaagcaggcgctcgggtacccgctcgcgccctcggagacgctcggcgaaggcgatgactgccccgcgcgtcatttcgatgtgctgttctacctcgcgttccagcatctggacccctctagcgagcgcacgcggatgcggcacgtacggaacggccactccaggctctggttcctgggtcagtacgttctggagctcgcgttctgcgagttcttcttgcagaggtaccccagggagtcacctgggccgatgagggagcgggtgttcgctctaattgggaagaaagtgttgccccgatggctcaaggcggccagcctgcacaatttggtcttcccctatgatgatttggataagatgatacgaaaggaccgggagccaccgtccaaggctgtattctgggcaatatttggagctatatatttgtgctttggaatgcctgaagtctatcgtgtcctttttgaggcatttgggatggatccagatgatgagagctgtcagccaaaattgcgtcgtcaactagaggatgttgattatgtttcagtggagttcgaaaagaggcagctcacttggcaggatgttgctgcctacaggccgccaccggatgctctttttgctcatcctaggcttttccgagcttgtgtgccaccaggcatgcatcggttcagaggaaatatttgggattttgacagtagacccaaggtcatgactaccctaggatatcccttgcccatgaatgacagaattccagaaatcacagaagcaaggaatatagagcttggacttggtcttcagctgtgttttttgcacccatcaaaacataagtttgagcatccaagattttgttatgagcggcttgaatacgtcggccagaaaattcaggatctagtaatggcagagaggctactcatgaaacacctcgatgcaccaggcaggtggctggcggagaagcatcggaggacgttgatgaacaagtattgtggacggtacctgcgggacaagcacctgcagcactacattatctacggggagacagtgcaagacagattcgaacacaatcgacgtctaaggaatccttcaacgacctctgtccagcaagcgctacatgggcttgcatactgtgtgtatggcaaacctgacgtgcggcgtttgatgttcgaggtgtttgacttcgaacaggtccagcctaaagcagtctgaggatcttctccattggtaccgatgctagagttgctgaatgctgaccaacaagaccccaatggcagtggtacaaatgctgtagattcttgaagtcgtccattcgacaggagatctttcgattytgaagcctgaagccctgaaccctgagctgggacagctgattagccactgggtcctgtctctcctgaaaccgtcactgttccaaccttcttgtccgtcggaaatggtagactagtgatgatgtggatcggaggctgctgttgtttgaacttacaattttgataattcgttgtaaattcctgtttgggcagaaacgcaaatagcagcagcatggcagattcatttcctatcagaattgtagtccgtaatcgagaagcagtaagatgaataatataaagatattcattcaaaaaaaaaaaaaaaaaaaaaaaaaa

SEQ ID NO: 1620 - DNA, 1979 bp, Hordeum vulgare subsp. vulgare
ggcgagagaaacccagtggccacctcccaccatggcaccgcccgccatggcgttccaggcgctcgccttctcgcccctcccgctccacctccccgccacgcggcgccgggtccgcgtgctcgccgtggccgccgaccagacccctccgcccccgcaggcctccccctccgagccggccaacagcccgagccggctcctccgggagctcgcgcagcggaagaaggccgtctcgcccaagaagaagcacccgccgcggcggttcatcctcaagccgccgctcgacgacgagcgcctcacccagcggttcctcaacagcccgcagctgtcgctcaagtcgctcccgctcctctcctcctgcctcccctccgcgccgctctccgccgccgaccgcacctggatggacgagtacctcctcgaggccaagcaggcgctcggctacccgctcgccccctccgagacgctcggcgagggcgacgactgccccgcgcgccacttcgacgtcctcctctacctcgtcttccagcacctggacccctcctccgagcgcacgcggacgcgccacgtgcggaacggccactccaggctgtggtttcttggccagttcgtgctggagctcgccttctgcgagttcttcctgcagaggtaccccagggagtcccctgggccgatgcgggagcgggtgttcgcgctcatcgggaagaagatgctgcccaaatggatcaaggcggcgagcctgcataatttggtgtttccttatgacgatttggataagatgttacgcaaggacagggaaccgcccacgaaggctgtgttctgggcattatttggagccatatatttatgctttggaatgcctgaagtctatcgtgttctctttgaggcatttgggatggaccctgaagaagagagctgtcagccaaaactgcggcgtcaactggaagatgttgattatgtttcagtggagtttgaaaagagacaactcgcatggcaagatgttgctgcctaccggccaccagcggatgctctttttgctcatcctaggcttttccgagcatgtgtgccaccaggcatgcatcgtttcagaggaaacatttgggattttgataatagacccaaagtcatgaacatcctaggatatcccttgccggcgaatgataaaattccagaaattacagaagcaaggaatatagaacttggacttggcctccagctgtgcttcatgcatccctcaaagtataagtttgagcatccgagattttgttttgagcgtctggaatatgttggtcagaagattcaggatctagtattggcagagaggctgctcatgaagcatctcgacgcacctggcaggtggttgtcagagaagcataggaggttgttgatgaacaagtattgcgggcggtacctgcggggcaagcaccttcaccactacattatatacggggagactgtacaggacagattcgaacacaaccgccggctaagaaatccttccacgaccgccgtccagcaagcgatacacgggctctcatactgcgtctacggcaaacctgatgtgcggcgcttgatgttcgaggtatttgacttcgaacaggtccagccgaaagctgtatgaggaggatatgctccatgtcggtttgtgctgaactgatgaccggcgagaatgccagcgcttgaaggaaaaatgcagggtcgtcaaaatcctagcgcggatcagatcgcgctgttccgaagcctgagcccaaagccggaccgcggattaaagcaagcactgcccgtccagcctcttctggacccccacagctcttgtaacctgttgtcttgcgtgctagataggcagatgtactagagatgatgtaaaatcgaacgccgtagtttttcgaagttacagttttgagagctgactgtaaattccaatttgagcagaaacacaaacagctgcagcagcagccgcaggaagatatagagttatccgtgag

SEQ ID NO: 1621 - DNA, 2102 bp, Oryza sativa Japonica Group
aaagttgttctccgcttatcctcttcctcttcttcttcctcaaacccgcaaaaccccaagccccgagctcacacaccaccaccaccgccatcgccatggcgccacctgccatggccttccaagctctcgctctcggccccctccccctccccctccccgcggcgcgtcgccgccgccgcgtgcgagtcctcgccgtggccgcagaccacaccccgccgccgccgccgtcgccgtcctcccctcccgagccggcgaacagcccgagccggctcctccgtgagctcgcggagcggaagaaggccgtgtccccgaagaagaagcacccgccgcggcgcttcatcctgaagccgccgctcgacgacgagcgcctcacccagcggttcctcagcagcccgcagctgtcgctcaaggcgctcccgctgctatcctcctgcctcccgtcggcgccgctctccgccgcagaccggacatggatggacgagtacctcctcgaggccaagcaggcgctgggctacccgctcgccccctccgagacgctcggggacggcgacgacgacggctgccccgcgcggcacttcgacgtgctgctctacctcgcgttccagcacctggacacgtcctgcgagcgcacgcggacgcggcacgtccggagtggccactccaggctctggttcctgggccagtacgtcctggagctcgcgttctgcgagttcttcctgcagaggtacccccgggaatcccccgggccgatgcgggagcgggtgttcgcgctgatcgggaagagagcgattcccaagtggatcaaggcagctagccttcacaatttggtgttcccttatgacgatttggataagatgattcggaaggaccgggagccaccagcaaaggctgtattctgggcactgtttggagctatatatttgtgctttggaatgcctgaagtctaccgtgttctttttgaggcgtttggcatggaccctgaagatgagagctgccagccaaagctgcggcgccaactagaagatgttgactatgtatcagtggagtttgaaaagagacaactcacatggcaagatgttgctgcctatcggccaccaccagatgccctctttgctcaccctaggctatttcgagcatgcgtgccaccaggcatgcatcgtttcagaggaaatatttgggattttgacaatagacccaaggtcatgaacacactgggatatccattgcctatgaatgatagaattccagaaatcacagaagcaaggaacatagagcttggacttggtcttcagttgtgcttcttgcatccctcaaagcataagtttgagcatccaagattttgtttagaacgcctggagtatgttggacagaaaattcaggatctagtgatggcggagaggctgctcatgaagcatctcgatgcacccggtaggtggttggcagagaagcatcggaggttgctaatgaacaaatactgcggacgatacctccgggacaagcacctgcaccactacattatctacggggagtcggtgcaagacagatttgaacacaaccgccggctgagaaatccttccacgaccgccgtccagcaagcaatacacggccttgcttactgcgtctatggcaaaccggatgtaaggcgattgatgttcgaggtgtttgacttcgaacaggtccagccaaaagcagtatgagggtggtcacaaaacctgtgcttgtgctgagctgctgatacgctgacattaccggcgtttgaaagctgaaatgcttcagtgttgtgacctgtgaacagatccaagcgcagacagttctgagtctgatccccgaagtcgaaaagcaggttaacacacgtaactcatgcaccctcgtttctacgagatgaactggattagagatgttgtaaatcgaacgctgttgttttctgaatttacagttttgacgatttgatgtaaatttccatttgagcagaaaatgcaagcagcatcagagacaaaaaacagcataggaagaatttttcctgtgaaacatgcttgtaaaggagtttgtaatagatctgcagaacatctttgcaaccaatgatacaagcagcttcatctttt

SEQ ID NO: 1622 - DNA, 2032 bp, Hordeum vulgare subsp. vulgare
agaaacccagtggccacctcccaccatggcaccgcccgccatggcgttccaggcgctcgccttctcgcccctcccgctccacctccccgccacgcggcgccgggtccgcgtgctcgccgtggccgccgaccagacccctccgcccccgcaggcctccccctccgagccggccaacagcccgagccggctcctccgggagctcgcgcagcggaagaaggccgtctcgcccaagaagaagcacccgccgcggcggttcatcctcaagccgccgctcgacgacgagcgcctcacccagcggttcctcaacagcccgcagctgtcgctcaagtcgctcccgctcctctcctcctgcctcccctccgcgccgctctccgccgccgaccgcacctggatggacgagtacctcctcgaggccaagcaggcgctcggctacccgctcgccccctccgagacgctcggcgagggcgacgactgccccgcgcgccacttcgacgtcctcctctacctcgtcttccagcacctggacccctcctccgagcgcacgcggacgcgccacgtgcggaacggccactccaggctgtggtttcttggccagttcgtgctggagctcgccttctgcgagttcttcctgcagaggtaccccagggagtcccctgggccgatgcgggagcgggtgttcgcgctcatcgggaagaagatgctgcccaaatggatcaaggcggcgagcctgcataatttggtgtttccttatgacgatttggataagatgttacgcaaggacagggaaccgcccacgaaggctgtgttctgggcattatttggagccatatatttatgctttggaatgcctgaagtctatcgtgttctctttgaggcatttgggatggaccctgaagaagagagctgtcagccaaaactgcggcgtcaactggaagatgttgattatgtttcagtggagtttgaaaagagacaactcgcatggcaagatgttgctgcctaccggccaccagcggatgctctttttgctcatcctaggcttttccgagcatgtgtgccaccaggcatgcatcgtttcagaggaaacatttgggattttgataatagacccaaagtcatgaacatcctaggatatcccttgccggcgaatgataaaattccagaaattacagaagcaaggaatatagaacttggacttggcctccagctgtgcttcatgcatccctcaaagtataagtttgagcatccgagattttgttttgagcgtctggaatatgttggtcagaagattcaggatctagtattggcagagaggctgctcatgaagcatctcgacgcacctggcaggtggttgtcagagaagcataggaggttgttgatgaacaagtattgcgggcggtacctgcggggcaagcaccttcaccactacattatatacggggagactgtacaggacagattcgaacacaaccgccggctaagaaatccttccacgaccgccgtccagtaagcgatacacgggctctcatactgcgtctacggcaaacctgatgtgcggcgcttgatgttcgaggtatttgacttcgaacaggtccagccgaaagctgtatgaggaggatatgctccatgtcggtttgtgctgaactgatgaccggcgagaatgccagcgcttgaaggaaaaatgcagggtcgtcaaaatcctagcgcggatcagatcgcgctgttccgaagcctgagcccaaagccggaccgcggattaaagcaagcactgcccgtccagcctcttctggacccccacagctcttgtaacctgttgtcttgcgtgctagataggcagatgtactagagatgatgtaaaatcgaacgccgtagtttttcgaagttacagttttgagagctgactgtaaattccaatttgagcagaaacacaaacagctgcagcagcagccgcaggaagatatagagttatccgtgagaaacatgccttgtaatgttgtagccgaaaatgtgaatgcaacgtgtactgctcacgtgc

SEQ ID NO: 1623 - DNA, 1599 bp, Ricinus communis
atggagctctcctcttctttcactcacttcacaaaaatatctgaaatttctttcacgtcttctttctctccatttgctctccaaatccatctcaaaaaacccataaaatttcctccgaatcttcgtgttttagctgtagctatagacccaccacagcctcaagaattaccacaaaacagcccacaaagactgctcaaagaacttgcagagcgcaagaaaattacttctcctaagaaaaaagtaccacccaaaagattcatactgaaaccgccacttgatgacaagaaacttgcacaaagattcttaaatagcccacaattatcactaaagcaattccctttactcagttcttgtttaccctcttcgcgcttaaacagtgttgataaaacctggattgatgagtacttgcttgaagctaaacaagctttagggtattcattagaaccatcagataattttggggatgataatcctgcaaaacagtttgatactttgttgtatttggcttttcagcatcctagttgtgagaggaccaatgctagacacgttaagtatgggcattcaagactttgcttcttggggcaatatgtgttggaattggctttttgtgaattttttctgcagagatatccaagggaatctccggcgccaatgagggaaagagtttttgctttgattggaaagaggaatttgcctaagtggattaaagcagccagtttgcagaacttaattttcccttatgatgatattgataagttgcttaggaaagacagagaaccgccagtgaagtctgtattctgggctctgtttggtgcaatatatttgtgtttcggcatgccagaagtataccgagttctttttgaagtgtttgggatggacccagaagctgaggattgccagccaaaattaaggagacaacttgaagatgtagattatgtttctgtggaatttgaaggaaacaagcttagttggcaagatgttgctgcttataagcctcctgaggatgctctctttgcacacccaagacttttcagagcttgtgttcccccaggcatgcatcggttccgaggaaatatatgggattatgacagcagaccgaaagtcatgaaaacactaggatatcccttggcaatgtcagacagaattccagacattactgaagcaaggaatatcgaacttggacttgggttacagctttgtttcttgcatccatcaaaatacaaatttgagcatcctcggttttgctatgaaagattagaatttgttggccaaaagatccaggatcttgtgctggctgagaggttgttgatgaagcatttagatgctcctgggaagtggctacaagagaggcaccgtcgtcttctgatgaacaaattctgcgggaggtacttgagagataagcatttgcatcactttattgtgtactctgagcaggttatagatgcatacgagaacaatcgaagactccgaaaccctgcgacaactgctgttcaacaggctcttcatggactttcctacactgtgtacgggaagccagacgttagacgcctcatgtttgaggtttttgattttgagcaaattcaaccaaaagctgtataa

SEQ ID NO: 1624 - DNA, 1862 bp, Arabidopsis thaliana
ctgctgcaaaaatcgtgtcttttgcgtgttctcgagtcgaattggatgatttgattcttaatttttgtttgatagtaacagtctaaagaagcaatggagctttgttcttcatctccatcttcttctctccttcgcatttgttcatcttcagcaccagaaatctcattttcatcttcaatttctcagttcccatctaaaacccaatcgattctcacaaaatccagattccaaaatctccgaatttgcgcttccgtgacggcggagactcaaggtcttccacgagacagccctcaacgtctcctcaaagagctagcacagcgtaaaacagcgacaggaccgaagaaaaaggttcctcctaaacgattcatcttaaggccaccattagacgataagaaattagctgagagattcctcaatagtccacaattgtctctgaagtcgtttcctttacttagctcttgtcttccatcgtcaaagcttaacaacgctgataaaacatggatcgatgagtatcttcttgaagttaaacaagctttagggtattctctggaaccttcagagagtttaggagatgataatccggcgaaacactttgatacgttgctctatcttgctttccagcatccgtcttgtgatagagcacgtgcgaggcatgtgaagaatgggcactcgaggctttggtttctgggtcagtatgtgcttgagcttgctcttacggagtttttcttgcagaggtatccgagggaatctccgggacctatgagggagagagtgtttgctttgattgggaagaggtatctcccgaaatggattaaagcagcgagcttgcaaaatctcatctttccttatgatgatatggataagttgattaggaaagagcgtgagccaccggttaaatctgtgttctgggctttgtttggtgccatctatctatgttttgggatgccggaagtgtatcgtgtactttttgaggtgtttgggatggatccagatgctgatgagtgtcagcctcgaagcaggagacagctcgaggatgtagattatgtttctgttgaatttgaagggaaaaagctaggttggcaagatattgctacttacaagcctcctgaagatgctttattcgcacaccctaggctattcagagcttgtgttccaccgggaatgcatcgtttcagagggaacatatgggattttgacagcaaaccaaaagttatgcagaccctcggataccctttaacgatgaatgatagaatcaaggagataactgaagcaagaaacatcgaacttggactcggtttacagctctgcttcttgcatccttcaaagcataagtttgaacacccgcggttttgttttgagcggctggaatatgtaggacagaagatacaggacatagcaatggctgaacgtttgttaatgaagcacttggacgcaccagggaagtggttgcaagagaagcatagacgtctattaatgaacaaattctgcggccggtatcttagagaaaaacgtcttcacaactttataatatactcagaggaggttcatgatcggtatgaacataaccggagacttaggaatccggcgacaaccgctgtccaacaagccattcacggcctcgcctacaccatctacgggaaacccgatgttcggcggctcatgtttgaggttttcgacttcgaacaaatccaacctaaagctgtctgaaaatcgaagctgtctctctcatttgtctaatgtcttttagtatactactgggtttgatttatgtagttaaatgcttaattacctttggtgaaaagttgaaaactttaaactagcaaaatgagcttcatcagtataatcttaggttcatcagtttc

SEQ ID NO: 1625 - DNA, 1856 bp, Arabidopsis lyrata subsp. lyrata
ctgttgcaaaaatcgtgtctttgtgttctcgagtcgagtttgatgatttggtttcttaatttttgtttgataatagtctaaagaagcaatggagctttgttcttcatcttcatcatcttctctccttcgcatttgttcatcttcagcaccagagatctcattttcttcttcaatttctcagttcccatctaaaatccaatcgattctcacaaaacccagattccaaaatctccgaatttgcgcttccgtggcggcggagactcaaggtcttccacgagacagtcctcaacgtcttctcaaggagctcgcgcagcgtaaaacagcgacaggaccgaagaaaaaggttcctccgaaacgattcatcttaagaccaccattagatgataagaaattagctgagagattcctcaatagtccacaattgtctctcaagtcgtttcctttactcagttcttgtcttccatcgtcaaagcttaacaacgctgataaaacatggatcgatgagtatcttcttgaagttaaacaagctttagggtattctctggagccttcagagagtttaggagatgataatccggcgaaacactttgatacgttgctctatcttgcgttccagcatccgtcttgtgatagggcacgtgcgaggcatgtgaagaatgggcactcgaggctttggtttctgggtcagtatgtgcttgagcttgctcttacggagtttttcttgcagaggtatccgagggaatctccgggacctatgagggagagagtgtttgctttgattgggaagaggtatctccccaaatggattaaagcagcgagcttgcaaaatctcatctttccttatgatgatatggataagttgattagaaaagagcgtgagccaccggttaaatctgtgttctgggctttgtttggtgccatctatctatgctatgggatgccggaagtgtatcgtgtactttttgaggtgtttgggatggatccagatgctgatgagtgtcagcctcgaagcaggagacagctcgaggatgtagattatgtttctgttgaatttgaaggcaaaaagctaggttggcaagatattgctacttacaagcctcctgaagatgctttattcgcacacccaaggctattcagagcttgtgttcctccgggaatgcatcgtttcagagggaacatatgggattttgacagcaaaccaaaagttatgcagaccctcggataccccttaccgatgaatgatagaatcaaggagataactgaagcaagaaacatcgaacttggactcgggttacagctctgcttcttgcatccttcgaagcataagtttgaacacccacggttttgttttgagcggctggaatacgtaggacagaagatacaggacatagcaatggctgaacgtttgttaatgaagcacttggacgcaccagggaagtggttgcaagagaagcatcggcgtctattaatgaacaaattctgcgggcggtatctgagagaaaaacgtcttcacaactttataacatactcagaggaggttcatgatcggtatgaacataaccggagacttaggaatccggcaacaaccgctgttcaacaagccattcacggccttgcctacaccatctacgggaaacctgatgttcggcggctcatgtttgaggttttcgacttcgaacaaatccaacctaaagctgtctgaaaatcaaagtgtctctctcatttgtcttaatgtcttttagtatactactggatttgatttatgtagttaaatacttcattaccttttggtgaaatgttgaaaacttgaaactagcaaaatgagcttcataagtataatctcaggttcatcagtt

SEQ ID NO: 1626 - DNA, 2403 bp, Zea mays
cgacgctgctaaccgctcgacgtcccgccacctccacaacgcagttgggcgcgcttccagcctccgccggaccggcgagctccggaggtctcagagtgtccatggaatgatttaaagatggcggcaccactgccttcgtcttgcacatctcttgcacactctcctagggtttagggtctagactcaaaccccttctcgaagactaccatatggcgtccgcatctcgagtgaggcttggcactctagttccccttaccaaggacaatgctggctcatcaaatggatctgtatcaagcattcctatattccaggggcccaatgtagtcgggagggatcatttggttgtcgtcgacaagaggatcagccgcaagcatctgagcctccacgcctctactgatggctccattgaagtagtagtggaaggtccaaaccctataattgtgcgatcgaagggacagaggaggaaggtttgtgctaaagagacagccaagattgctcatggtgatgtcctagaactgattcctggtgattatttcgtgaagtacgtggacatgggtgatgaacatgtaccaatgcatttgagcgacttaatgaagggtaagaggtatagtgaggaacatggcgcagcagtcaagaggattcgacagattatggaagatgaggctttggcaaaaacactacaggaaagctttgcagcagatgatgcagctgtttctggcatgccttctggccaaaaaataagttcacatgacagtgccggttcttccgaaagaaataatgacagaacacactctgttggtcctttgaaagatatgctccctttgacttttcggctcatgcatgtccaaggtcttccatcatggactaacacttcatcagttaccattcaagatgtcatacagggtgaagtactgcttgctgtactttcaaattacatggtggacattgattggttgcttactgcgtgcccaagtttgaggaaggttccacatgtcctggttctacatgggcaagatggtgcttcattagagcttatgaagaagctgaagcctgcaaattggatccttcacaggcctccactcccaatttcatttggaacacaccattctaaggctatgttgcttgtgtatcctcaaggaattcgaattgttgtgcacacagcaaatttgatacatgttgactggaattacaaaagtcagggactatggatgcaagattttccctggaaagacacagtcgatatgaataaaaaaacagcctttgagaatgatctagttgattatctaagtgcacttaagtggcctgagttcagggtgaatctcccaggggttggtgatgtcaacatcaatgcggcattctttaggaagtttgactatagtaattcaatggtcaggttgattggatcggttcctggttatcatgtgggctccaatattaggaagtggggccatatgaaacttaggaatgttctggatgaaatcatgttcaataaacaattttgcaaatcccctctgatttaccagttttcttccctggggtcacttgatgagaaatggatgagtgaatttgcatgctcgctgtcagctggtaaatcagatgatggatcacagctaggaatcgggaaaccactgattgtctggcctacggtggaggatgttcggtgctcgatagagggttatgcagctggtagttgcattccaagtcctcaaaagaatgttgagagagacttcttgaagaaatattggtccaggtggaaagcggatcatgtaggtcgttgtcgggctatgcctcacataaaaacctttactcgttacagtggccaaaacattgcatggtttctgcttacctcagcaaatttaagcaaagctgcttggggcgcgctacagaagaacaacacacagctaatgatacgttcatatgagctaggtgtattgttcttgccccaaacactccaatcagtaccacaattttcatgcacggaaaagagccgctcaatcagggatggcgtcgcccttggcaagacgatcaagaccaagctggtcactctttgctggaaaggtgacgaagaggatccatctattgtgagattgcctgtgccataccagcttcctccacaaccttatggcacacaagatgtcccttggtcgtgggatcggaggtacacaaagaaggatgtgtatggttccgtctggccacgatatggctagcctgtgatttggttttatttatatcccagaaaaagatgattcctaaccctgttactgttcgggtcggtttgaaccatcgggcagcccctctcgttctgtgaccctgctttcatggccactcgaccatcagtggcgagaattgtgggatacgatattttcatctggttgaagctatgatattgattgatgcgtgaac

SEQ ID NO: 1627 - DNA, 2386 bp, Sorghum bicolor
atggcctccgcatctcgagtgaggcttggcactctagtccctcttaccaaggacaatgctggctcatcgaacggatctgtatcaaacattcccatattccaggggtccaatgtagttgggagggatcatttggttgtcgtcgacaagaggatcagccgcaagcatctgagcctccacgcctccactgatggctccattgaagtagtagtggaaggtccaaaccctataatggtgcgatcgaatgggcagaggaggaaggtttgtgctacagggaaagccaagattgcacacggtgatgtcctggaactgattcctggtgactatttcgtgaagtatgtggacatgggtgatgaacataaaatttctgtaccaatgcatttgagcgacttaaagaagggtaagaggcatagtgaggaagatagtgcagcagtcaagaggaatagacagattatggaagatgaggctttggcaagaacactacagattggctttccttgtgtaaaatcacagtgcaccatcaaattatgttgtgtcctatctaaacaggaaagcttcgcggaagacaacacagctgtttctggcatgacttctggccaaaaaataagctcacatgacagtgctggttcttctggaagaaataatgagagaaaacactctattggtcctttgaaagatatgctcccattgacttttcggctcatgcgtgtccaaggtcttccatcatggactaacacttcctcagttagcattcaagatgtcattcagggtgaagtgcttcttgctgtactctcaaattacatggtggacattgactggttgcttactgcatgtccaagtttgaagaaggttccacatgtcctggttctacatggacaagatggtgcttcattagagcttatgaagaaactgaagcctgcaaattggatcctccacaaacctccactcccaatttcatttggaacacatcattctaaggccatgttgcttgtatatcctcaaggaattcgaattgttgtgcacacagcaaatttgatacatgttgactggaattacaaaagtcagggactatggatgcaagattttccctggaaagacacaaatgatatgaataataaagttccctttgagaatgatctagttgattatctcagtgcacttaagtggcctgagttcagcgtaaatctccccgaggttggtgatgtcaacatcaatgcagcattctttaggaaatttgactatagaaattcaatggtcaggttgattggatcggttcctggttatcatgtgggccccaatattagaaagtggggccatatgaagcttaggaatgttcttgatgaaatcacgttcaataaacaattttgcaagtcccctttgatttatcagttttcttccctggggtcacttgatgagaaatggatgagtgaatttgcatgctcgctgtcagctggtaaatcagatgatggatcacagctaggaatcgggaaaccactgattgtctggcctacagtggaggatgttcggtgctcaatagagggttatgcagctggtagttgcattccaagccctcaaaagaatgttgagaaagacttcttgaagaaatattggtccaggtggaaagcggatcatgtaggtcgctgtcgggctatgcctcacataaaaacttttactcgttacagtggccaaaacatcgcatggtttctgcttacctcatcaaatttaagcaaagctgcttggggcgctctgcagaagaacaacacacagctaatgatacgctcatatgagctaggtgtattattcttgccccaaacgctccaatcaataccccaattttcatgcacggaaaagagccgctcaagccgggatggcgtcgccattggcaggacgatcaagaccaagctggtcactctttgctggaaaggggacgaagaggatccatctattgtgaaattgcctgtgccataccagcttcctccacaaccttatggcacacaagatgtcccttggtcatgggatcggaggtacacaaagaaggatgtgtatggttccgtctggccacgacacggctagcttgtagatacgcatacgctcctgtttgtctttattatcccgaaacgaaaaaagacgattcctaaccctgttactgttcggatcggactgaaccatcggcaaggtagggcatgattcctctcgtcccgtgaccctgcgttcatggccactcgaccatcagtggcgacaatggtgggcactgtaggattcgatattttttgctgttgatgcattgattgttgcgtgaacaaaatggcattggttgcttgctactgcggtgtttatacatgcacctagctgtcctggtcgaatttattccgcacaaagtatcgttata

SEQ ID NO: 1628 - DNA, 2326 bp, Hordeum vulgare subsp. vulgare
gttgttaagctagggtttagtcttgtagttgtagacacagggtttaggatccgggagcagcccagctcccctacgagacctctctcatgtcgtcttcctcccgagtaagggttgggactctggttccctttgttgaaggcaaatctgggtcaccgaatgcgtcgtcgctgccaatgccaagcattcccatctttgagggctccaatgtcgttgggaggagtaatttggtggctgttgacaagagggtcagtcgcaagcatttgagcctgcgcgccgtgcctgatggctccgtcgaagtagtcgtggaggggacaaatcccattgttgtccgatcagagggtcagagaagaaaagtttgtgctcagcagagagccaagattatgcccgatgatgtcttggagctgattcccggtgaatattttatgaagtatgtgaatatgagtgatgagcgtaaaatttccgcatcagtcgactcacatgacttaaagaaagggaagaggcatagcgaggaagatagtgtagctgcaaagagaaatcgacaagttatggaagatgaggctttggcaagaacactgcaggaaagctttgcagaagagagtgcatctgttaccgaagtgttaagttcacttgatagtgctggttcttccgagagaaacaaagagagaacgcattctgtcggtcctttgaaagatgtacttccgttgtcttttcgactcatgcgtgtccaaggtcttccatcatggactaacacttcaacagtcaccattcaggatgtcatacagggtgaagtgcttcttgctgtactctcaaattatatggtggacatggattggttgcttactgcatgtccaagtctaaggaaagttccgcatgtcctagttctacatggagaagatggtgcttcattggagcgcttgaagaaaacgaagcctacaaattggatccttcacaagcccccgctcccaatatcattcggaacacatcattcgaaggccatgctgcttgtatatcctcaagggattcgtgttgttgttcacactgcaaatttgatacatgttgactggaataacaaaagtcagggactatgggcacaagattttccctggaaggaagcaaatgatatgagtacaaatattggttttgagaatgacctggttgattatctcagggcacttaagtggcctgagttcagggtaaatctcccagttgtgggtgatgtcaacatcaatgcagcattctttcggaaatttgattatagtagctcaacggtcaggttgatcggatctgttcctggttatcatgtcggccccaatatgaaaaagtggggccatatgaagcttaggagtgttcttgaagagtgcgtatttgaaaagcagttttgcaagtcaccacttatttatcagttttcgtccttggggtcacttgatgaaaaatggatgagtgagtttgcatgttcgttatcagctggtaaagcagatgatggatcacagttgggtatcgggaaaccactgattgtctggccaacagtggaggatgttaggtgctcaatagagggttatgcagctggcagttgcattccaagtcctcaaaagaatgttgagaaagatttcttgagaaaatattggtccaggtggaaagcagaccacgtaggccgttgccgtgctatgccgcacataaaaacttttactcgctacaatggtcaaaatattgcatggtttctgcttacctcttcaaatttaagcaaagctgcttggggagcactgcagaagaacaatacacagctgatgatacgatcatatgagttaggtgtattgttcttgcccaaaactctccagtctgttccacaattttcatgcacagacaagagccgctcaaacctggataaacttgcccttggtaagaacatcaagaccaagttggtgacactttgttggaaaggcgacgaagagaaggatccatctgcagaagttgtgagattgccagtgccatatcaactccctccacaactttacggcccggaagatgtgccatggtcgtgggatcggaggtacacgaagaaggatgtgtatggttcagtctggtcacgccatggctaagctaagctgcgagcgcgttcaggtccacacgaacctggagtccgttgattgatcgctggtggaatcatcggttgataggacctgattgctcatgctccctgtttctaggcctctcgctctcggctaactgtgcaagaaaccagaagcaatggaacgaacatttggttgacaggattatttggaacgttggatattttcagcttattggaacgtgcactgaagttatttgc

SEQ ID NO: 1629 - DNA, 2377 bp, Oryza sativa Japonica Group
ctctttcccttccccatcctcctccccattgcgctgggtaggattccaatgtgggggactagggtttagggtttggagtcaatcccagaccgcgcccatgacgtcctcgtctcgagtaagggttggcaatctagtccccctcaatgaaggaaatgcgagctcgtcaaatggatcggtgtcaagcattcctatctatctgggtgccaatgttgtagggaggaatcatttggtggtcgtcgacaagagagtcagccgcaagcatctgagcctacatgcctcggcggatggttccattgaagcggtagtggaaggaccaaatcctatcattgttcgatctgagggccagaggaggaaggtctgtgctcaagagagagtaaagattgcacatgatgatgtcctggaactcatccctggtgaatattttgtgaagtatttgaatgtgggcgataaccataaaagttccacatcaatgggttcaagtgattttaaaaaggggaagaggctctgtgaggatgatactgtagttatcaaaagaaatcgtcagattatggaagatgaggctttggcaagaagtttacagaaaagctttgcagaagaaagttcaactatttccggtttgggttgtgatcaaatgttaagttcacttgatagtgctggtttttctgagagaaataacgagagaatacactctgttgattatctgaaagatgtactttcattgacttttcggctcatgcgtgtccaaggtcttccttcatggactaatacttcctcagttaccattcaagatgtcatacagggtgaagtgcttcttgctgtactctcaaattatatggtggacatggaatggctgcttacagcatgtccaagcttaaggaaagttcgacatgtcctagttatacatggagaagatggtgcatcagtggagcttctgaagaaagtgaagccagccaattggatccttcacaagcctccacttccaatttcatttggaacacatcattcaaaggccatgctgcttgtatatcctcaagggattcgtgttgttgtgcacacagcaaatttgatacatgtcgactggaataacaaaactcaggggctatggatgcaagattttccctggaaagatgcaaaagatgtgaatagaagtgtttcctttgaaaacgatttggttgattatctgagtgcaattaagtggcctgagttcagggtaaatttaccagtggttggtgatgtcaacatcaatgcagcattctttaggaagtttgattataagagctcatcggtcaggttgattggatccgttcctggttatcatgttggccccaatattaaaaagtggggtcatatgaagcttaggagtgttcttgaagggtgcacatttgaacaacagttttgcaaggctcccatgatttatcagttctcttccttggggtcacttgatgagaaatggatgagtgagtttgcattctcactatcagctggtaaatcagataatggttcacctttgggtattggtaaaccactgattgtctggcctacagtggaggatgttaggacatcaatagagggttatgcagctggtagttgcattccaagccctcaaaagaatgttgaaaaagatttcttgaggaagtattgggccaggtggaaagcggaccatgtgggtcgttgtcgtgcgatgcctcacataaaaacttttactcgatacaatggtcaagacattgcatggtttctactaacctcggcaaatttaagcaaagctgcttggggtgcgttgcagaagaataatacacaactgatgatacgctcatatgagttaggtgtactgttcttgcccaaaactcaccaatctgtaccacaattttcatgtacggggaagaacaattcaaacctgaataacctggcccctgggaaagagatcaaaaccaaactggtcacactctgctggaaaagcgacgaagaaaaagaacaatccacggaaattatcagattgccagtgccatatcaacttcctccaaagccttacggcacagaagatgtcccatggtcttgggacaagaggtacacaaagaaggacgtgtatggttcagtctggccgcgccatggttagctaagcggtatgcggacaatatatgatcaatgaaaggctaaccctgctccgatgtcgacaacaagaaggccggtagctgatcgcctgtcagtgcccactactcaaccattagcaggaagtagtactatttcctgggagagattagatatttctattactaatttgtacgagcacaggatattttctttcttgttggtacgaatcgtgtgccttgtctgcttccgatcgtgatgtttatgcctccatcctcttttacagagtagt

SEQ ID NO: 1630 - DNA, 1501 bp, Zea mays
aaaaatcgtccgactgtagcctagtcgacggatttgatcccgcaggccgcagcgcagcggccgtgtccgctgccgccaccagccaccggccacagccaggcagccagctcgcgtcgaagaagacgacgtggcccgccaagctcccctgccaaaagaaacaggagggcccgcgtcgtcgcctagtcggcgcgtggtgggagtggtatggagaggggcgccgccacggccgccgcggcgctcggctgcgccctccgctccccttccccctccgcgtccccggctccccggtggccgccgctccaccgctgcccacggcgcggcccgcccgggcctccccgctccctcctgccgcccgcgcggcgtttcaggcccctagacatgaagaagggacatagtaggaactcaccgaagaccttcagctcatctggacactcgggggttagactaaacaacgaaggtctcgtcaacgacaggctcctaatagattgtggagaggatcaagattgtgtgctcggtggcatagttgccctgggaaagtttgatgctctccacattggtcatcgggaattggcaatgcatgcttctaaagcagggactccttttcttctttcttttgtgggaatggccgaagtacttggctggacatataggccacctatagttgctcattgtgatcgcaagcgggtcctttcatcttgggctccatactgtaggaatgtggtaccacttgaatatcaagttgaattttcaaaggtcaggtccctgtctccacgacaatttgttgaaaggttatcaaaggatcttagaataaaaggtgtcgtggcaggtgaaaattacaggtttggttacaaagcatctggtgacgcaactgagttagtgaaactatgtgaggaatttggtttaagtgcattcattgtacgctctgtcatggacacagcaaaaagatctcttaatggattttcaggcgctataaattcgagtgataaaggacaggtttcttccagccgtgtccgccatgcattggctatgggtgacatggaatacgtctctgaattactagggaggaaacaccgtcttttgctaatggttaaccaacactgccttcatgaaaagaaaagcattgtactccctaattcttgcatgctgaacatgccaccagctgaaggtctctatgaaaactgcgaccttgttaatggagggtatcttggaccatgtagagtgatcatcaactctgatactatcatcattgagatgaaagatgataacagtttatccctaaatcctattcaagaagttcagttagggattgagtttggatgaagttatatactttttgcatctgccatcttgtggagattattgctgaaagaagacattggggggaatactgcaaggggaagtcgaagactttgttcaagcgtgcagtacgcctcatcgtgattgagttcaggagcattttgtagtctcacaagaatgctttattacaaaaaaaaaaaaaaaa

SEQ ID NO: 1631 - DNA, 1393 bp, Oryza sativa Japonica Group
agtcaaagcaagcttctaggcacgaacaaagggcaaaacagatgctcgttggcaactttcagctcatttggacagtcagggatcagtctgaacaatgaagatttagtgaaagataagctcctaatagattgtggggaagatcaagattgtgtgattggtatgcactatgtttttttttcttcagattatttaagtttcatacttgtgtgcttattttgcatgtaaaacctataccatgcacctccagtaagtgataattgcatgccaaatctattatgggcagctcatgtccttttctaaggctgcacatatactttcttagaaaactctgcacaaatcttgcatgaggctaggattaaaccagattttcattgggtattcaatgcatgtttcagatgggatagttgccttgggaaagtttgatgcccttcacattggccatcgagaattggcaatgtatgcttctaaggcaggaactccctttcttctttcttttgtgggaattgctgaggttcttggctgggagtataggtgagtgtaaaagaggctattcataatttcccttggtaatcattagccccaaataactgagtgccttgcttgtggcaattcatgactgctttcctttcatgcaggcctcctatagttgctcagtgtgatcggaagcgagtgctcacctcttgggctccatactgtaagaatgtagtgcctattgaatatcaagttgagttttcaaaggtcaggtacctaactccgcggcaattcgttgagaggttatcaagggatcttaaaatacaaggtgttgtagcaggtagaaacatgttgtcttctcttgtaggtgcactatcttactgtattgtcataaccttttacaatatagctttgtttgttattatgacaggtgaaaactacagatttggctacagggcatctggcgatgcagctgagctagtgaaactatgtgaagaatttggtttaagtgcatttattgtacggtcagtcatggacacagctagatcttataatggagttacaacctccgtaaattcaagcgacaaggggcaggtttcttctagtcgtgttcgccatgctttggctatgggtgatatggaatatgtttctgaattactagggaggaaacaccgccttgtgctgacagttaaggaaaaccaccttcaggaaaggaaaaggatcatgctgccaaaatcttgcatgttgaacatgccaccagctgatggtttgtatgagaattgtgaccttcttaatggaggccatcttggactatgcagggtgatcataaactcagagaccattgtaattgagatgaaagatgagaacagtttattaccaaatactattcaagaaaatcagcaattaggtattgaatttggat

SEQ ID NO: 1632 - DNA, 1820 bp, Oryza sativa Japonica Group
gtgccgcgtgcgtgactgccagcagcagcagcaagcggaggagaggagagacgcgccgccgccgccgccgcctgcgaagcaaagcggcgagcgagaagccaacggcgcatcaaagtgaggatatggagaggggcgccgccgccgcaggagcgctctcatgcaccttccgctccccttccccttccccgacgtccccggccgcgccccattggcggcctctcctcggcttccgctcccgctcccgctcgcgtggccggggctggggccagcgcgcggtggtcgccggggcaccgcggttattcctgccgccaccatgccggcgcttcagatactgcagtcaaagcaagcttctaggcacgaacaaagggcaaaacagatgctcgttggcaactttcagctcatttggacagtcagggatcagtctgaacaatgaagatttagtgaaagataagctcctaatagattgtggggaagatcaagattgtgtgattgatgggatagttgccttgggaaagtttgatgcccttcacattggccatcgagaattggcaatgtatgcttctaaggcaggaactccctttcttctttcttttgtgggaattgctgaggttcttggctgggagtataggcctcctatagttgctcagtgtgatcggaagcgagtgctcacctcttgggctccatactgtaagaatgtagtgcctattgaatatcaagttgagttttcaaaggtcaggtacctaactccgcggcaattcgttgagaggttatcaagggatcttaaaatacaaggtgttgtagcaggtgaaaactacagatttggctacagggcatctggcgatgcagctgagctagtgaaactatgtgaagaatttggtttaagtgcatttattgtacggtcagtcatggacacagctagatcttataatggagttacaacctccgtaaattcaagcgacaaggggcaggtttcttctagtcgtgttcgccatgctttggctatgggtgatatggaatatgtttctgaattactagggaggaaacaccgccttgtgctgacagttaaggaaaaccaccttcaggaaaggaaaaggatcatgctgccaaaatcttgcatgttgaacatgccaccagctgatggtttgtatgagaattgtgaccttcttaatggaggccatcttggactatgcagggtgatcataaactcagagaccattgtaattgagatgaaagatgagaacagtttattaccaaatactattcaagaaaatcagcaattaggtattgaatttggatgatatggtacagctcaattcatgattggtgacatggcaggtcatattttgtactatatcttcattatatctggcaccttgcggattagtttgtgttgatgctaaatagtgctgattttatctggaggggatatagagcaagaaagaaaaaaactgagaactttgtattcaagggtgtatacctcatcgtgatcaagccaaagagcatcttatagatgaacagagattttgtgcaaatttgcatttcatgcaacgagaagacatggtagtcagagaggacattgtcctttttctccctgggaattggcaacgatagaactgactagcttctagctagctgtatcagcaaagctgaagcacaaggaaacatacaagggaactcatttcccaaatcccacctagtacgtttttccagcttatgaaattgtgatttgtacaaataggtttcatttacacagcaacttcccattgttagatagcagcttgttccatcaacagttaatgaaatatgttgcttgatcttcg

SEQ ID NO: 1633 - DNA, 1748 bp, Hordeum vulgare subsp. vulgare
gaagcaacgaagcagcctcagcgcagcaccggcggcaacagaggacaggagtgggtcgcgtcgcatcgcatcgcacccgcgcgtgggatggagcggggcggcaccgccgcgctcgcctgcacctttcgctcctcctcctcctcctctccggtctcccactgctcacctctcctccgctctcgtggacgcccgcccgcgcccgccggggctcctcacctcctactgccaaccggccggcgcttcagtcaaaataggtttttagaaacaagcaaggggcttaagcggtactcgttgacgacattcagcccatttgggcgtccaactagtctgaacgatgctgatttagtaaaagataagatgctaattgattgtggagaagagcaagactgtgtgcttgatgggatagtcgccttgggaaaatttgatgcccttcacattggccaccgggaactagccatgcatgcttctaaatcaggaaatccttttcttctttcttttgtgggaatggctgaagtactaggctgggagtataggcctcccatagttgctcattgtgatcggaagcgagtcctttcgtcttgggcaccatattgtagaaatgtggtgcctcttgaatatcaagttgagttttcaaaggtcaggtacctaactccacgccaatttgttgagaagttatcaacggatcttagaataaaaggtgttgtagcaggtgaaaactacagattcggctacaaagcctctggtgatgcagctgagttagtgaagctgtgtgaggaatttggtttaagtgcatttattgtacggtctgtcatggacaccgcaaagggatcttacaatggagcaacacccgccgtaaattcaagcgacaaaggacaggtgtcttctagtcgtgttcgccaagctttgtcagttggtgacattgaatacgtctccaaattacttgggaggaaacaccgccttgtgctaacagtgagcgaatgctctattaaggaacggaaaaacattataattcccaaatcttgcatggttaacatgccaccagctgacgggttctacgagaactgtgaactcttcaatggagggtatctgggactatgcagggtggtcattagcacagaaaccattgatattgagatgaaagacgagagcagtttgtcaccagacccttttcaagaagttcaacaattagggatagagttcgggtgatattgcagctccttttgtgatcagcggctggtcgtagtttgtatacctggtaaccttttggacaattttgagtcgaaaccttaggcgggagattttttgtttccctagatggaagatatatcacagaaatgatcggaggtgtgtattcagcctggttttcagcctggtcaaggttcatcaatccgaagtccagttcatggtttgatggaaggattgtcccggagaatgttagacattagtgcacacagcaagagaagcggggacacgaaggcggcggcattctttcctgtggaccggcaaataaagagctgtgactgtcttctagcagctgtatgtattgagaccaaagaagagactcaatcttccagcatgtcttagtcctggtacattgtagtctgtacattttcaaaggtgtttccagagctagccccttctttgttgctatagttcacaagcatactttgttgcatcttacaacgaggatgatatcttgtttgttagtactacattgcttcacgattaagcaggatttttgttgccac

SEQ ID NO: 1634 - DNA, 1727 bp, Hordeum vulgare subsp. vulgare
ggcagcaccggcggcaacagaggacaggagtgggtcgcgtcgcatcgcatcgcacccgcgcgtgggatggagcggggcggcaccgccgcgctcgcctgcacctttcgctcctcctcctcctcctctccggtctcccactgctcacctctcctccgctctcgtggacgcccgcccgcgcccgccggggctcctcacctcctactgccaaccggccggcgcttcagtcaaaataggtttttagaaacaagcaaggggcttaagcggtactcgttgacgacattcagcccatttgggcgtccaactagtctgaacgatgctgatttagtaaaagataagatgctaattgattgtggagaagagcaaggctgtgtgcttgatgggatagtcgccttgggaaaatttgatgcccttcacattggccaccgggaactagccatgcatgcttctaaatcaggaaatccttttcttctttcttttgtgggaatggctgaagtactaggctgggagtataggcctcccatagttgctcattgtgatcggaagcgagtcctttcgtcttgggcaccatattgtagaaatgtggtgcctcttgaatatcaagttgagttttcaaaggtcaggtacctaactccacgccaatttgttgagaagttatcaacggatcttagaataaaaggtgttgtagcaggtgaaaactacagattcggctacaaagcctctggtgatgcagctgagttagtgaagctgtgtgaggaatttggtttaagtgcatttattgtacggtctgtcatggacaccgcaaagggatcttacaatggagcaacacccgccgtaaattcaagcgacaaaggacaggtgtcttctagtcgtgttcgccaagctttgtcagttggtgacattgaatacgtctccaaattacttgggaggaaacaccgccttgtgctaacagtgagcgaatgctctattaaggaacggaaaaacattataattcccaaatcttgcatggttaacatgccaccagctgacgggttctacgagaactgtgaactcttcaatggagggtatctgggactatgcagggtggtcattagcacagaaaccattgatattgagatgaaagacgagagcagtttgtcaccagacccttttcaagaagttcaacaattagggatagagttcgggtgatattgcagctccttttgtgatcagcggctggtcgtagtttgtatacctggtaaccttttggacaattttgagtcgaaaccttaggcgggagattttttgtttccctagatggaagatatatcacagaaatgatcggaggtgtgtattcagcctggttttcagcctggtcaaggttcatcaatccgaagtccagttcatggtttgatggaaggattgtcccggagaatgttagacattagtgcacacagcaagagaagcggggacacgaaggcggcggcattctttcctgtggaccggcaaataaagagctgtgactgtcttctagcagctgtatgtattgagaccaaagaagagactcaatcttccagcatgtcttagtcctggtacattgtagtctgtacattttcaaaggtgtttccagagctagccccttctttgttgctatagttcacaagcatactttgttgcatcttacaacgaggatgatatcttgtttgttagtactacattgcttcacgattaagcaggatttttgttgccac

SEQ ID NO: 1635 - DNA, 687 bp, Sorghum bicolor
atgcacaagacggcgcaggcctggttcaccggcgggaccgccgcctccaccggcaccgccgccgagtcgcagccgtccctcctcgccgactggaactcgtacgccgccacccgctccgacgcctcctcgtcctcgccgctccccttcgacatcgaggccgcggtccgctccgccaacgacaccgtctccggcaccttcagctcggtcaccaagggcgtgcgggagctcccggggagcttccagagcgccaccagcagcttcccctccgggaaggcgctcatgtacttcggcctcttcctcgccaccggcatcttcttcgtcttcatcgccttcgcgctcttcctccccgtcatggtgctcatgccgcagaagttcgccatctgcttcacgcttgggtgcgcgctcatcattgcgtcgctctttgcgctcaagggaccagcaaaccagctcgcccacatgacctccaaggagaggctaccgttttcagtgggatttattggatgcatggttggtacgatttatgtttctatggtgcttcacagctatttcctctctgtgatcttctcagtccttcaggttctggcccttgcatattacactatatcctacttccctggaggatctagtggactgaaattcatctcgtctggtctgttgtcctcggcagcaagtttatttagtcgatga

SEQ ID NO: 1636 - DNA, 1034 bp, Zea mays
gcttccactcccgcccgccccgccgtcgcgatgcacaagacggctcaggcctggttcaccggcgggaccgccgcctcctccggcgccgctgccgagtcgcagccgtccctgctcgctgactggaactcgtacgccgccacccgctccgacgcctcctcctcctccccgctccccttcgacatcgaagccgccgtccgctccgccaacgacaccgtctccggcaccttaagctcggtgaccaagggcgtgcgggagctgccggggagcttccagagcgccaccagcagcttcccctccggaaaggctctcatgtacttcggcctcttcctcgccaccggcatcttcttcgtcttcatcgccttcgcgctcttcctccccgtcatggtgctcatgccacagaagttcgccatctccttcacgctcgggtgcgcgctcatcattgcctcgctcttcgcgcttaaggggccagccaaccagctcgcccacatgacttccaaggagaggctaccgttttcagttggatttattggatgcatggtcggtacaatttatgtttctatggtgcttcacagctatttcctctctgtgatcttctcagtccttcaggttctggcccttgcatattacaccatatcctacttccctggaggatctagtggactgaaattcatctcgtctggtctcttgtcctcggcaacaagctgttttggtcgatgaccttcctttgtcaattgtcatacatttatttgatcataccatgttatcgctttaagatttttgtatgtagctgctgatcatccctttgaggctttgtttggtactctagtattgactctaatcctcatgtgttgaggtggattgatgtgtaaattagtttatgttacacctcaatccacctcaatacatgtggattttggtcaatactagagtacccaaactaggtctgatagagattccatggtgtttcctctcctgtttgtttgtctagacttggactggtgttgaatatatagattatagtgtggaaatgattc

SEQ ID NO: 1637 - DNA, 1198 bp, Zea mays
aaaaacactttccgtcagctgcaagaaaggagaaccaattctccctcgaaaaaaaagtcccgtcgttttcctcacagttccttcggcctccgcttccactcccacccgccccgccgtcgcgatgcacaagacggctcaggcatggttcaccggcgggaccgccgcctcctccggcgccgctgccgagtcgcagccgtccctgctcgctgactggaactcgtacgcccccacccgctccgacgcctcctcctcctccccgctccccttcgacatcgaagccgccgtccgctccgccaacgacaccgtctccggcaccttaagctcggtgaccaagggcgtgcgggagctgccggggagcttccagagcgccaccagcagcttcccctccggaaaggctctcatgtacttcggcctcttcctcgccaccggcatcttcttcgtcttcatcgccttcgcgctcttcctccccgtcatggtgctcatgccacagaagttcgccatctccttcacgctcgggtgcgcgctcatcattgcctcgctcttcgcgcttaaggggccagccaaccagctcgcccacatgacttccaaggagaggctaccgttttcagttggatttattggatgcatggtcggtacaatttatgtttctatggtgcttcacagctatttcctctctgtgatcttctcagtccttcaggttctggcccttgcatattacaccatatcctacttccctggaggatctagtggactgaaattcatctcgtctggtctgttgtcctcggcaacaagttgttttggtcgatgaccttcctttgtcaattgtcatacatttatttgatcataccatgttatcgctttaagatttttgtatgtagctgctgatcatccctttgaggctttgtttggtactctagtattgactcatctacatgtgttgaggtggattgatgtgtaaattagtttaagttacatcccatgatcccaatccacctcaatacatgtggattgtggtcaatactagagtacccaaactaggtctgatagagattccatggtgtttcctctcctgtcatcctgtttgtttgtctagacttggactggtgttgaatatataattatatagattatagagtggaaaaaaaaaaaaaaaaaaaaaaaaaaaaaaaaaaaaaaaaataaaaaaaaaaaaaaaaaa

SEQ ID NO: 1638 - DNA, 979 bp, Hordeum vulgare subsp. vulgare
gatcatcgtcaagcgaaaaacgttcaataattatgagtctgctcgtttactccctcgatctctttcgctccctccacccccgcgactcgtcacgcacagccgcatcccagcccacctcaatctcgcctcgccgccggcagctaaacccgcatccccctgcccgcgatgcagaagacggcgcagtcctggttcaccggcggcaccgcctcccccagcaccgccgccgagtcgcagccctccctgctcgccgactggaactcctatgccgccacccgcccggacgcctcctcctcctcccccctcccgttcgacatcgaggccgccgtccgctccgccaacgacaccgtctccggcaccttcaatgtggtgaccaagggcgtgcgggagctgccggggagcttccagggcgccaccagcagcttcccctcggggaaggcgctcatgtacttcgggctcttcctcgccaccggcatcttcttcgtcttcatcgcattcacgctcttcctccccgtcatggtgctcatgccgcagaagttcgctatctgcttcacgcttggctgtgctctcatcatcgcgtcgctcttcgcgctcaaaggacccgccaaccagctcgcccatatgacgtcgaaagagaggctaccatttacagtggggttcactggatgcatggttggtacgatatatgtctctatggtgcttcacagctattttctgtcagtgatattctcgatcctccaggtcctcgctcttgcttactacaccatatcctacttccctggaggctctagtggattgaagtttctctcgtcaagtctcatgtctccagtatcaagaattttcagctagcaacccctagtggaagaaaaatgtatgtgatgatcacacctgtgcccttgtaatccctgaagtatcttttgtatgtagttgctgatcaacccattatagagatatatcagataccgtcaccccctccctttcc

SEQ ID NO: 1639 - DNA, 1086 bp, Hordeum vulgare subsp. vulgare
ggttcaataattatgagtctgctcgtttactccctcgatctctttcgctccctccacccccgcgactcgtcacgcacagccgcatcccagcccacctcaatctcgcctcgccgccggcagctaaacccgcatccccctgcccgcgatgcagaagacggcgcagtcctggttcaccggcggcaccgcctcccccagcaccgccgccgagtcgcagccctccctgctcgccgactggaagtcctatgccgccacccgcccggacgcctcctcctcctcccccctcccgttcgacatcgaggccgccgtccgctccgccaacgacaccgtctccggcaccttcaatgtggtgaccaagggcgtgcgggagctgccggggagcttccagggcgccaccagcagcttcccctcggggaaggcgctcatgtacttcgggctcttcctcgccaccggcatcttcttcgtcttcatcgcattcacgctcttcctccccgtcatggtgctcatgccgcagaagttcgctatctgcttcacgcttggctgtgctctcatcatcgcgtcgctcttcgcgctcaaaggacccgccaaccagctcgcccatatgacgtcgaaagagaggctaccatttacagtggggttcactggatgcatggttggtacgatatatgtctctatggtgcttcacagctattttctgtcagtgatattctcgatcctccaggtcctcgctcttgcttactacaccatatcctacttccctggaggctctagtggattgaagtttctctcgtcaagtctcatgtctccagtatcaagaattttcagctagcaacccctagtggaagaaaaatgtatgtgatgatcacacctgtgcccttgtaatccctgaagtatcttttgtatgtagttgctgatcaacccattatagagatatatcagataccgtcaccccctccctttccactaccatttgcagatgttaggcatcatgcgtttgtgtgtggattggaaaaggtttgttgagctactgtatctgaagttcccttgtttgcatatgttatgggaataaagttaccactaccgattctg

SEQ ID NO: 1640 - DNA, 1017 bp, Oryza sativa Japonica Group
atcttcttcttgttcttgtactaactactcctaactcccaccacctccgcctccgcgtcgccccgccgcgcgcctcctccccgcctcgccgccggcgcgcacctcctcgcggatcgcgatgcacaagacggcgcaggcctggttcaccggcggccccgccgcccccgccgcctccgccggcgagtcgcagccgtccctcctcgccgactggaactcctacgccgcctcccgccccgacgcctcctcctcctcccctctccctttcgacatcgaggccgccgtccgctccgccaacgacaccgtctccggcaccttcagcgtggtgaccaagggcgtgcgggagctgccggggagcttccagagcgcgacgagcagcttcccgtcggggaaggcgctcatgtacttcggactcttcctcgccaccggcatcttcttcgtcttcatcgcgttcgcgctcttcctccccgtcatggtgatcatgccgcagaagttcgccatctgcttcacgctcggctgcgggctcatcatcgcatccatcttcgcgctcaaaggacccgccagccagttcgcccacatgacctccatggagaggctaccatttacaggggcacttattggatgcatggttggtaccatttatgtgtcaatgtttcttcacagctatttcctctcagtgatattctctgtccttcaggttctatctcttgcttactacaccatatcctactttcctgggggttccagtggattgaaatttatctcctcgagtctcttgtcatcagtaacgagctgttttggccggtaacctgagtaggatgacaactacttgatcatatatccttcatttttcttgcaatatttttgtatgtagcactgatcaacgatagagagattgtgacacccctcctactcatgcttgttgctgtttagactaagatcaatacggggtgaaaaggtttgtcgtacttatgtatctgaaggtcatattgtggaaataaagctgtcctttccttgtgt

SEQ ID NO: 1641 - DNA, 696 bp, Ricinus communis
atgcagaaaatggcacaggggtggttttctagtagtgggactagtggtgaagatcagcagcagaaacctcaatcgtcatcgtctctacttgcggattggaattcatacgcagcatctcaagatgccgatgagagctctggattgggaattgggttcgatcttgaagccgttgttcgctccgcaaacgactccgtttctggtaccttcaatgtggtctctaaaggagtcagggatatacctggaagtttccagtctgctaccagtaatattccttcaggaaaagctcttatgtattttggtttatttctggcaactggagtgttctttgtcttcattgcatttgccttgttcctaccagtcatagtgctgatgccccagaaatttgcaatttgttttacacttggatgtgtctttattattgcatcatttgtggcactcaagggtcccaagaatcaatttgctcacatgacctcaaaagagagacttccttttacgttgggattcataggcagtatggcgggtactatatatgtctccatggtgcttcatagctacattctttctgtgctattctctgtaatacaggttcttgcccttgcatattatgccatttcctacttccctggtgggtctgctgggatgaaatttctgtcgtcgtcccttatctcatcggttacaagatgttttggggggtga

SEQ ID NO: 1642 - DNA, 960 bp, Vitis vinifera
gctgattctcagtgagctcccagcactggcgcgagagaaagcgagggaaagtgagagaaaatatgcagaagacggcgcaagcatggttcatgggaggtcccagcagcagcagcggtagggagaaatccccggcatctttgctggcggattggaacgcttacgcagcttcccaagagcctgattcctccgctttgggattcgatctcgaagctgccgtcagaaccgccaacgacaaagtctccggctccttcaacgtggtctcaaagggtgttagggatataccagggagctttcaatctgctgctaccaatgtcccttccggaaaatctcttatgtacttctccttgcttcttgctgctgggattttctttgtctttattgcctttgctatgttccttccggtcatggtgctgatgcctcagaagtttgctatctgctttacaattgggtgtgtattcattattggttctttcttcgcactcaagggcccgaagaatcagcttgctcacatgttctcgagagagaggcttccatttacattggggttcattagcagcatggtgggtactatttatgtttccatggtgcttcacagttatgttttttctgtgctcttctctgtgttacaggtccttgcgctctcttattatgctatttcctacttccctggaggatctgctggaatgaagtttctgtcttcaactctgacctctttgatattgaaatgttttggaaggtgacagtggtatcagtttttcttcattttttttttcattttactaattattctcatatatttctgcttgaaatgtccccaaagacactgtttagtatcatccagaattatgctaaattgtataggaatattacttttgtccattcaccttatcttgagagaaccatgagtattcatctttgatcctgcaatgttcacatagaaaatgatttatatgtagttcc

SEQ ID NO: 1643 - DNA, 1794 bp, Sorghum bicolor
aacctctttcaacagttctacttcctccgcaagtcgccggaccccgccgccggccgcgatgggtagcagggtggccgcggcgctgctccggcggggcagggaccaggcatccgccctgctgatgcctcgtctgccgaggaacgcccctgctccggccccaacgcctagggttggatccgcctcctcctcctcctgcggcggcggcggtggcggaagctgcctcctcccgccgaggccggggccagcgggggccttctctccggcttcccggttcggctccttctacgccttccgatccctcgcccccaaggtcatgtttggccaatgcacaaggagaatgtcaactaccgcggcaacactgaactcagctgcggccagtggagcagcaaattcaggattgaagctacttgttacgaaagggcctcaagcacagaaggcagtcgggatatggctctttgggtgtgctgcctgggtgttcagcttggtcatactcggagggattactcggctcacacgttctgggctgtcaatgactgactggaagttcacaggggaaatacctccaattacagacgatgcatggcagctggaatttgagaaatacaagcaatcacctgagtacaagagggtgaacaaaggaatgagccttgaagatttcaaatttatatactggatggagtatgcacacagaatgtggggaagagctttgggctttgtatttgcaggtccttttgcatacttcatcgcaaaaggttatgttacccgccaacttgggctcaggctgtcggctctttttgcacttggtggtgcacaaggactcattggctggtggatggtgaaaagtggccttgaggaaccaacatcggagtatgttcaaccaagggttagcccttacaggctggcaactcacctgacatctgcatttgttatatactgtggtatattgtggactgctttatcagtagtgatgcctgatcctccaaccggatcaatgagttgggtaaatggtgcagcaaaaatcagaaagttggcaattcctgtcagtgctgttgtaggcattactgcaatatctggagcatttgttgcaggcaatgatgcagggcacgcatacaattcattcccaaagatgggtgacagttggattcctgaagatgtatttagcatggagcctttcatacgcaatttttttgagaatacatctacagtacagctcaatcaccgaattctcgcaacaagcacattactctctgtgggtggattatggttggctgcaaggaaaatagacatgcatccagcagtcaagtcgctgatcggaagcacacttgggatggctgctctccaggttacattgggcatatctacactattgatgtatgttccaacctctttgggctcagcgcaccaagctggagcattgactctattgtcacttatgatccttctcactcacacgctaagaaggccgtcaccagctcttcttaaatcaatcgcaactgctgtgaaatcaacctgatactatgccttgaatttttccaccctacagttacgggttgattttcctttccccatcctaacatgcaatggtgcccgtgtttctttgcatcaactaactagtgtagcattttggaattgctggaaaagcatgcagctcttgaataaagggtcctcaatgttttctagtgccaagtgttagaaatctttcctacccttcttttaattgctagattacattttttggcacagctgtgtgcacttcttgtatccatagaagaggatgaatttgtaccgagaaat

SEQ ID NO: 1644 - DNA, 1934 bp, Zea mays
agctcgacttcctccgcaagccgccgtgccagtcgccgccggccgcgatgggtagcagggtggcagcggcgctgatccggcggggcaggtacctggcatcctccctgctgacgcctcgtctgccgagaagcgccctcgctccggctccaccgcatagggttggatctgcctcctcctcttgcggcggcggcggcggcggaagctgcctcctcccgccaaggtctgggccagcgggggccttctcttacgcttcccggttcggcaacttccacgccttccgatccctcgctcccaaggccatgtttggccaatgcacaaggagaatgtcaactacggcgacagcactgaactcaactgtggccagtggagcagcaaattcaggattcaagctgcttgttacaaaaggggctcatgtgcagaaggcggtcgggatatggctctttggttgtgctgcctgggtgttcagcttggtcatactgggagggattactcggctcacacgttctgggctgtcaatgactgactggaagttcacaggggaaatacctccaatgacagacgaagcatggcagctggaatttgagaaatacaagcagtcacctgagtacaaaagggtgaacaaaggaatgagccttgaagatttcaaatttatatactggatggagtatgcacacagaatgtggggaagagctttgggctttgtatttgcgggtccttttgcatacttcattgcaagaggttatgttactcgccaactggggatcaggctgtcggctctttttgcacttggtggtgcgcaaggactcattggctggtggatggtgaagagcggtcttgaggaaccaacatctgagtatgttcaaccaagggttagcccttacaggctggcaactcacctgacatctgcatttattatatactgtggcatattgtggactgctttgtcagtagtgatgcctgatcctccaaccggatcaatgagttgggtaaacggtgcagcaaaaatcaggaagttggcaattcctgtcagtgctgttgtaggcattactgcaatatctggagcatttgttgcgggcaatgatgcgggacatgcatacaattcattcccgaagatgggtgacagttggattcctgaagatgtatttagtatggagcctttcgttcgcaacttttttgagaacacatctacagtacagctcaatcatcgaattcttgccgcaacaacattactctctgtgggtggattatggttggctgcaaggaaaatagacatgcacccagcagtcaagtcactgatcggaagcacgcttgggatggctgctctccaggttacattgggcatatctacgctattgacgtacgttccaacctcgttgggctcagcgcaccaagctggagcgttgactctactgtcacttacgatccttctggttcacactctgagaaggccgtcgccagctcgtcttaagtcgatcgcaactgctgtgaaatcaacctgataccatttcttggattctaccatcctatagttacgagttgttgtttttttttccttttcccaccctaaggctttgtttggttactccagtattcactacaatctacatgtattaaggtggattggggtgtaaattagtttaacttacacactagtccatcttaatacatgtgaaggtgaatactagagtaacatgtaatggtgccgtgtttctttgcaccaccttaacactgctgtagcgtttcggaattgctggaaaggcatgcaagctcttgccctcaatgtgtttctagtgccaagtgttagaaataccccctagccctttcttttagtaattgctacattgcattgttgacactgagttagtgagttgcatgttgagcctccctggacaagatgctaataaaattcactgcctggagccaggtttgatttc

SEQ ID NO: 1645 - DNA, 2205 bp, Hordeum vulgare subsp. vulgare
gaaaaaccccacaatttttctcccttctaaaatctccggcgagctctgccctgccttccgctgcttcttcctccgcaagccaccgcgcaaccgcctgccatgatggggagcagggtggccgcgtcgctgctccgccggggcagggaccagggctccgccctgatgacgatccctcgcctcccgaggagtggtccagctccgccccccgctcctcctagggttggatccggctccttcggcggcggctgccgccacctacccccgccgccgcccccgcaatcgactggtggcttattcgccgcctcccgtgctgcctcgtaccacgccttccgctctttcggctccaagagttttatgggccaatgcacacggaaaatgtctactactgcagctgctctgaattcaaatatggcaaacgcaacagcaaattcagcactgaagctgctagttaccaaagggcctcaagcacagaaggcagttggtatatggctctttggatgtgctgcctgggtattcagcatggtcatacttggtggagtcactcggctcacacgttcggggctgtcaatgactgactggaagtttgccgggggcttgcctccaatgtcggaagaagagtggctactggaatttcagaaatacaagcagtcacctgagtacatgagggtgaacaaaggaatgaaccttgaagatttcaaatttatatactggatggagtatgcacacagaatgtggggaagagctctgggctttgtatttgctgttccttttgcatactttgttgcaaaaggctatgttacccgccaacttggtgtcaggctctctgctctttttgcacttggtggtgcgcaaggactaattggctggtggatggtgaaaagtggtcttgaggaaccagcatctgagtatgttgaaccaagagttagcccctacaggctggcagctcatctgacctctgcatttgttatatattgtggtatattgtggactgctctgtcagtagtaatgccagaccctccggctgaatcaatgaaatgggtaaaaggggcagcaaaatttagaaagctagcacttcctgccagtgctgttgtaggcattactgccatttctggagcattcgttgcaggcaatgatgcagggcgtgcatacaatacatttccgaagatgggtgacagttggattccagaagatgtgttcagtatggagccttttatacgcaatttctttgaaaatacatctactgtacagcttaatcaccgaattcttgctacaagcaccttattgtctgtgagtgccttatggctagctgcaaggaaagtagatatgcatccagcggtcaagtctctggttggaagcacacttgggatggctgctcttcaggttacattgggaatatctacacttttgatgtatgttcctacctcattaggttcagctcaccaagctggggcattgacactactgtcactgatgatacttctcacccacacattaagaagaccatcaccagctctcttgaagtcacttgcatctgctgtgaagtcaacctgataccacgccatggatcagtgaaaatggctatttgatattattatttttgccctcctaacgtgctaaagtactccctccgtaaactaatataagagcatttagaacactattttagtaatctaaacactcttatattagtttacagagggagtatttgttaaaaaaagaaatcagttcttgggtaaaggctgcttcatagttttctagcgccaaatatcacaagcccttgtgaaagttcctttgacttattatcacaattttgcatgcagtatctcattctgggggtgctgtccaaaagtgtgctctgatagatcttgtgtgtcgaacttactctatgtaccgaagttcatctactatagtactccctctgaagtgatctaaacactcttatatttctttacggagggagtaatgtataagtaacttccaagaactgctgatggtctgctctagttatgctcatgtcagcttgttatgttcttggtcatcagtggtatgtcctgtacgttttcatgaacctgaaagtgtacattctgcatgtgtggacgtgccccatcgttttacttggaggcagcaacacttatattgcgatttgtagcgtgctactgagatgtaaatataaggaactttggataatatgttcctgatcatagc

SEQ ID NO: 1646 - DNA, 1875 bp, Oryza sativa Japonica Group
acaattttgttcccccaaaaattctaaacctccgcgtcgccttcttcttcttcttcctccgcaagcttgctagcctcctcctcctccgcgccatgatggggagcagggtggcggcggcgctgctccgccgggggagggaccaggcgtcctcgctcatggccgctcgcctcccgaggggagcccccgctccgtctccggctgctcctagggttggatccggctccgtctgcggctgcggcggcggcggcggtttactaactggatcgaggtcgacgggatccgtcttctccgcatcgcgcctcgcctcgttccacgccttccgttcaatcggctccaagaccttgatgggccaatgcacaaggaaaatgactactactgtggcagcaatgaattcaggcgtggccaatgcagcggcatattcaggattgaagttgcttgttaccaaagggccccaagcacagaaggccatcgggatatggctcttcggatgtgccacgtgggtattcggcttggtcatacttggaggagttacacggcttacacgctcaggattgtcgatgactgactggaaatttacggggagcttgcctccaatgtcagatgaagagtggctgctggaatttgagaaatacaaactgtcacctgagtacaagagggtgaacaaaggcatgagccttggagatttcaaatttatatactggatggagtatggacacagaatgtggggaagggctctgggatttctattttctgttccttttgcctatttcattgcaaaagggtatgttacccgccaacttggactcaggctgtcaggtcttttcgcacttggtgcgggtcaaggactaattggctggtggatggtgaaaagtggtcttgaggaaccagcatctgagtatgttcaaccaagagtcagcccatacagactggcgacccatttaacgtctgcatttgttatatattgtggcatattgtggacagctctgtcagtggttatgccagaacctccggctggatcaatgaattgggtaaattctgcagcaaagattaaaaagttagcaattcctgtcagtgccgtggtaggcattactgccatatctggagcatttgttgcgggcaatgatgcagggcatgcatacaatacatttcccaagatgggtgacacctggataccagaagatgtgttcgctatggagcctttcatacgtaacttctttgagaacacgtccactgtgcagcttaatcaccgaattcttgcaacaactaccctattgtctgtgggtggcttatggttggctgcaaggaaagtggacatgcatccagcaatcaagtctcttatcggaagcacgcttggaatggctgcccttcaggttacattgggaatatctacacttttgatgtatgttcctacttccttgggctcagctcatcaagctggggcattgacactactgtcactgatgatccttctcacccacactttaagaagaccgtcaccagcccttctgaagtcacttgcatcagcagtgaaatcaacctgacaccgtgtcatgaaattttccttcaggcacagtagactgtttgatatttttcccgtcttcttatagctgacatgcggtcgcctcctttgcactacattatcaccgtactcatttggcccaaaagcattcaattcttgaataaggggccctcataattttctagtgccaaatattacgtaccttttccaagacttctttggacatgctgcattttgtcaggcaatattgcatttttgacatgctgtccgcagctgtgcactctgattagataatatctagggaaactattgtatcatgtaccaaattaataccaagtctccaaacatttctattg

SEQ ID NO: 1647 - DNA, 673 bp, Coix lacryma-jobi
atgggacaaaaaataaatccactcggtttcagacttggtacaacccaaaatcaccattccttttggttcgcacaaccaaaaaattattctgaaggtctacaggaagataaaaaaatacggaattgtatcaagaactatataaaaaagaataggaaaaaaggctcgaatagaaaaatggaatcagactcaagttctgaagtaattgcacatatagaaattcaaaaagaaatcgatacaatccacgtcataatccatattggattccccaatttattaaagaaaaagggagcaatcgaagaattagagaaagatctccaaaaggaagttaattctgtaaaccagagacttaatattgctatcgaaaaggttaaagaaccttatagacaacctaatattcttgcggaatatatagctttccaattaaaaaatagagtttcattccgaaaagcaatgaaaaaagctattgaattaactaaaaaagtggatataaagggaataaaaatccaaattgcgggtcgtctagcaggaaaagaaattgcacgtgccgaatgcatcaaaaagggtagactacccctccaaacaattcgcgctaaaattgattattgctgctatccaattcgaactatctatggagtattaggtgtcaaaatttggatattcgtagaagaagaat

SEQ ID NO: 1648 - DNA, 673 bp, Zea mays
atgggacaaaaaataaatccactcggtttcagacttggtacaacccaaaatcaccattccttttggttcgcacaaccaaaaaattattctgaaggtctacaggaagataaaaaaatacggaattgtatcaagaactatatacaaaagaataggaaaaaaggctcgaatagaaaaatggaatcagactcaagttctgaagtaattacacatatagaaattcaaaaagaaatcgatacaatccacgtcataatccatattggattccccaacttattaaagaaaaagggagcaatcgaagaattagagaaagatctccaaaaggaagttaattctgtaaaccagagacttaatattgctatcgaaaaggttaaagaaccttatagacaacctaatattcttgcggaatatatagctttccaattaaaaaatagagtttcattccgaaaagcaatgaaaaaagctattgaattaactaaaaaagcggatataaagggaataaaaatccaaattgcgggtcgtctagcaggaaaagaaattgcacgtgccgaatgcatcaaaaagggtagactacccctccaaacaattcgcgctaaaattgattattgctgctatccaattcgaactatctatggagtattaggtgtcaaaatttggatattcgtagaagaagaat

SEQ ID NO: 1649 - DNA, 675 bp, Chasmanthium latifolium
atgggacaaaaaataaatccactcggtttcagacttggtacaacccaaaatcaccattccttttggttcgcacaaccaaaaaattattctgaaggtctacaggaagatcaaaaaatacggaattgtatcaagaactatatacaaaagaataggaaaaaaggctcgaatagaaaaatagaatcagacccaagttctgaagtaattacacatatagaaattcaaaaagaaatcgatacaatccacgtcataatccatattggattccccaatttattaaagaaaaagggagcaatcgaagaattagagaaagatctccaaaaggaagttaattctgtaaaccagagacttaatattgctatcgaaaaagtgaaagaaccttatagacaacctaatattcttgcggaatatatagctttccaattaaaaaatagagtttcattccgaaaagcaatgaaaaaagccattgaattaactaaaaaagcggatataaagggagtaaaaatcaaaattgcgggtcgtctagcagggaaagaaattgcacgtgccgaatgcatcaaaaagggtagactgcccctccaaacaattcgcgctaaaattgattattgctgctatccaattcgaactatctatggagtattaggtgtaaaaatttggatatttgtagaagaagaataa

SEQ ID NO: 1650 - DNA, 717 bp, Dendrocalamus latiflorus
atgggacaaaaaataaatccactcggtttcagacttggtacaacccaaaatcaccattccttttggttcgcacaaccaaaaaattattctgaaggtctacaggaagataaaaaaatacggaattgtatcaagaactatatacaaaagaataggaaaaaaggctcgaatagaaaaatagaatcagactcaagttccgaagtaattacacataatagaaaaatggactcaggctcaagttccgaagtaattacacatatagaaattcaaaaagaaatcgatacgatccacgtcataatccatattggattccccaatttattaaagaaaaaaggagcaatcgaagaattagagaaagatctacaaaaggaagttaattctgtaaaccagagacttaatattgctattgaaaaagttaaagaaccttatagacaacctaacattcttgcagaatatatagctttccaattaaaaaatagagtttcattccgaaaggcaatgaaaaaagccattgaattaactaaaaaagcagatataaggggagtaaaagtcaaaattgcaggtcgtctcgcagggaaagaaattgcacgtgccgaatgcatcaaaaagggtagacttcccctccaaacaattcgcgctaaaattgattattgctgctatccaattcgaactatctatggagtattaggtgtaaaaatttggatattcgtagacgaagaa

SEQ ID NO: 1651 - DNA, 718 bp, Potamophila parviflora
atgggacaaaaaataaatccacttggtttcagacttggtacaacccaaaatcaccattccttttggttcgcacaaccaaaaaattattcagaaggtctacaggaagataaaaaaatacggaattgtatcaagaactatatacaaaagaataggaaaaaaggctcgaatagaaaaatagaatcagactcaagttccgaagtaattacacataatagaaaaatggaatcagactcaagttccgaagtaattacacatatagaaattcaaaaagaaatcgatacaattcacgtcataatccatatcggattccccaatttattaaagaaaaaaggagcaatcgaagaattagagaaagatctacaaaaagaagtgaattctgtaaaccagagacttaatattgggatcgaaaaagtgaaagaaccttatagacaacctagcattcttgcagaatatatagctttccaattaaaaaatagagtttcattccgaaaggcaatgaaaaaagccattgaattaactaaaaaagccgatataaagggagtaaaagtaaaaattgcaggccgtctcgcggggaaagaaattgcacgtgccgaatgcatcaaaaagggtagacttcccctccaaacaattcgcgctaaaattgattattgctgctatccaattcgaactatctatggagtattaggagtcaaaatttggatattcatagacgaagaat

SEQ ID NO: 1652 - DNA, 719 bp, Oryza australiensis
atgggacaaaaaataaatccacttggtttcagacttggtacaacccaaaatcaccattctttttggttcgcacaaccaaaaaattattctgaaggtctacaggaagataaaaaaatacggaattgtatcaagaactatatacaaaagaataggaaaaaaggctcgaatagaaaaatagaatcagactcaagtttcgaagtaattacacataataaaaaaatggactcaggctcaagttccgaagtaattacacatatagaaattcaaaaagaaatcgatacaatccacgtcataatccatattggattccccaatttattaaagaaaaaaggagcaattgaagaattagagaaagatctacaaaaagaagttaattctgtaaaccagagacttaatattgggatcgaaaaagtgaaagaaccttatagacaacctaacattcttgcagaatatatagctttccaattaaaaaatagagtttcattccgaaaggcaatgaaaaaagccattgaattaactaaaaaaacggatataaagggagtaaaagtaaaaattgcaggccgtctcgcgggaaaagagattgcgcgtgccgaatgcatcaaaaagggtagacttcccctccaaacaattcgcgctaaaattgattattgctgctatccaattcgaactatctatggagtattaggagttaaaatttggatattcgtagacgaagaata

SEQ ID NO: 1653 - DNA, 717 bp, Oryza sativa Japonica Group
atgggacaaaaaataaatccacttggtttcagacttggtacaacccaaaatcaccattccttttggttcgcacaaccaaaaaattattctgaaggtctacaggaagataaaaaaatacggaattgtatcaagaactatatacaaaagaataggaaaaagggctcgaatagaaaaatagaagcagactcaagtttcgaagtaattacacataataaaaaaatggactcaggctcaagttccgaagtaattacacatatagaaattcaaaaagaaatcgatacaatccacgtcataatccatattggattccccaatttattaaagaaaaaaggagcaatcgaagaattagagaaagatctacaaaaagaagttaattctgtaaaccagagacttaatattgggatcgaaaaagtgaaagaaccttatagacaacctaacattcttgcagaatatatagctttccaattaaaaaatagagtttcattccgaaaggcaatgaaaaaagccattgaattaactaaaaaaacagatataaagggagtaaaagtaaaaattgcaggccgtctcgcgggaaaagaaattgcgcgtgccgagtgcatcaaaaaaggtagacttcccctccaaacaattcgcgctaaaattgattattgctgctatccaattcgaactatctatggagtattaggagttaaaatttggatattcgtagacgaagaa

SEQ ID NO: 1654 - DNA, 713 bp, Oryza sativa Japonica Group
gacaaaaaataaatccacttggtttcagacttggtacaacccaaaatcaccattccttttggttcgcacaaccaaaaaattattctgaaggtctacaggaagataaaaaaatacggaattgtatcaagaactatatacaaaagaataggaaaaagggctcgaatagaaaaatagaagcagactcaagtttcgaagtaattacacataataaaaaaatggactcaggctcaagttccgaagtaattacacatatagaaattcaaaaagaaatcgatacaatccacgtcataatccatattggattccccaatttattaaagaaaaaaggagcaatcgaagaattagagaaagatctacaaaaagaagttaattctgtaaaccagagacttaatattgggatcgaaaaagtgaaagaaccttatagacaacctaacattcttgtagaatatatagctttccaattaaaaaatagagtttcattccgaaaggcaatgaaaaaagccattgaattaactaaaaaaacagatataaagggagtaaaagtaaaaattgcaggccgtctcgcgggaaaagaaattgcgcgtgccgaatgcatcaaaaaaggtagacttcccctccaaacaattcgcgctaaaattgattattgctgctatccaattcgaactatctatggagtattaggagttaaaatttggatattcgtagacgaagaa

SEQ ID NO: 1655 - DNA, 1614 bp, Sorghum bicolor
atggccgccgccgacctcacgctgctgctgcttctcctcgcacctctcctcgccatccccctctacttcctcttggccgccaccaccaccaccagacgccgcaggacgccgccacgagggagcaagccgcggctcccaccggggccgtgggcgctgccggtgatcgggcacctgcaccacctagcccggccatggggcccgggcggccgccgcctcccgcaccgcgtgatgcgggaccttgcgcgtcgccacggcccgctcatgctgctccggttcggcgaggtgcccgtcgtggtggcgtcgtccgccgccgcggcgcgggaggtgatgcggacccacgacgcggcgttcgcgtcgcggcccatcggccccatgtcgcggctctggttccagggcgccgacggcatcatcttcgcgccctacggcgacgactggcgcagcctccgcagggtgtgcacccaggagctcctcaccgcccgccgcgtccagtccttccgccccgtgcgcgaggacgagctccgccgcctgctcgcctccgtcgccgccgccgccgccgccgcctcgtcggggacggggacgaccgtcgtcaacctgacggagaagatatcgacctacatcgccgactccacggtgcgcgccatcatcggcagccgacgcctcaaggaccgcgacgcgtacctccggatgctcaagggcctcttcggcatcatgcccgggatgagcctgccggacctcttcccgtcctcgcgcctcgccatgctcctcagccgcgctcctgcccggatccaggcctaccgccgcagcatgcgacggatcatggatggcatcatcgacgagcaccgggacagggcagccgccgccgctgccgacggcggtgccgacgacgaggacgaggacgaggacttcgtcgacgtgctcctcagacttcagaaggaagtcgactcccagttcccgctcacaaccgagaacatcaaaaccgtcatgctggacatatttggcgcgagcacggagacgtcgacgacgacgctgggctgggcgatggcggagctcctgcggaacccgagggtgatggcgaaggcgcagcacgaggtccggcaagcgttcgccggccacgacacggtgaccgaggacagcctagccggcctgcgctacctgaggctcgtcatcaaggagtcgctgcggctgcacccgccggcgacgatgctggtgccacggcagtgccagagcgcgtgccaggtgctcgggttcgacgtgccggcgggcacgacggtgatcgtgaacgcgtgggcgatcggcagggacccggcgcactgggacgaaccggacgagttcttgccggagaggttcgagcagagcggcagcagggacttcaggggcgccgacttcgagttcataccgttcggtgccgggcggcggatctgccccggcatgacgttcgggctggctcacatcgagctcgcgctcgcggcgttgctgttccacttcgactggagcttgccgggtgggcttgcggccgaggagctggacatgaccgaggcatttgggatcgctgtgccacggcgttccgaccttttggtggtgccaatccctcgtgtcccactgcccaccaagtaa

SEQ ID NO: 1656 - DNA, 1722 bp, Zea mays
gtgcttcaagaattgatccgttcgcggtgcgacctccagctccaggagcagcaccaatcccccaagccgccatggccgccgaccccacgctgctgcttctcgtacctttcctcgccatccccctctacttcttcttggccaccagacgtaggacgccacgcgggggcgcgcggctcccgccggggccgtgggcgctgcccgtggtcgggcacctgcatcacctagcccggggcctcccgcaccgcgtcatgcgcgacctggcgaggcgccacggcccgctcatgatgctccggttcggcgaggtccccgtggtggtggcctcctcgccggccgcggcgcgcgaggtgatgcggacccacgacgcggcgttcgcgtcgcggcccatcggtcccgtgtcccggctctggttccagggcgccgagggcatcctcttcgcgccctacggcgacgactggcgccacctccgcagggtctgcacccaggagctcctcaccgcccgccgcgtccaatccttccgccccgtgcgcgaggacgagctccgccgcctgctcgcctccgtcgcctcgacgtcggggcccgtcaacctgaccgagaagatatcgacctacatcgccgactccacggtgcgcgccatcatcggcagccgacggctcaaggaccgcgacgcgtacctgcggatgctcaagggcctcttcggcatcatgcccgggatgagcctgccggacctcttcccgtcctcgcgcctcgccatgctcctcagccgcgctcctgcccggatccaggcctaccgtcgcagcatgcgacgcatcatggacggcatcatccaggagcaccgggacagagcagccgctggcgacggcgacgaagaggacttcgttgacgtgctcctcagacttcagaaggaagtggactcccagttcccgctcacaactgagaacatcaaaacagtcatgctggacatctttggcgcgagcacggagacgtcgacgacgacgctggattgggcgatggccgagctcctgcggaaccccagggtgatggagaaggcgcagcgtgaggtccggcaagcgctttccggccacggcgcggtgaccgaggacagactagccggcctgcgctacctgcgcttcgtcatcaaggagtcgctgcggctgcacccgccggcgacgatgctggttccacgccagtgccagagcgcgtgccaggtgctcgggtacgacgtgccggcgggcatcacggtgatcgtgaacgcgtgggcgatcggcagggacccggcccactgggacgagcccgacaagttcttgccggaaaggttcgagcagagtaccagggacttcaagggggcagacttcgagttcataccgttcggtgccgggcggcggatctgccccggcatgacgttcgggctggctcatatcgagatcgcgctcgccgcgttgctgttccacttcgactggagtttgccgggagggctagcggcggaggagctggacatgaccgaggcatttgggattgctacgccacggcgttccgaccttttggtggtggcaacccctcgtgtcccacttccacaaagttaccgtatataggcattattattctccttgagggcttgttcggttattcctatcctatgtagattggatgggattggaaaaaattatgaaagattttaacttgtttaggattgaaactcatctaaaacaaaaaaaaaaaaaarav

SEQ ID NO: 1657 - DNA, 1617 bp, Zea mays
cgcggctcccgccggggccgtgggcgctgcccgtggtcgggcacctgcatcacctagcccggggcctcccgcaccgcgtcatgcgcgacctggcgaggcgccacggcccgctcatgatgctccggttcggcgaggtccccgtggtggtggcctcctcgccggccgcggcgcgcgaggtgatgcggacccacgacgcggcgttcgcgtcgcggcccatcggtcccgtgtcccggctctggttccagggcgccgagggcatcctcttcgcgccctacggcgacgactggcgccacctccgcagggtctgcacccaggagctcctcaccgcccgccgcgtccaatccttccgccccgtgcgcgaggacgagctccgccgcctgctcgcctccgtcgcctcgacgtcggggcccgtcaacctgaccgagaagatatcgacctacatcgccgactccacggtgcgcgccatcatcggcagccgacggctcaaggaccgcgacgcgtacctgcggatgctcaagggcctcttcggcatcatgcccgggatgagcctgccggacctcttcccgtcctcgcgcctcgccatgctcctcagccgcgctcctgcccggatccaggcctaccgtcgcagcatgcgacgcatcatggacggcatcatccaggagcaccgggacagagcagccgctggcgacggcgacgaagaggacttcgttgacgtgctcctcagacttcagaaggaagtggactcccagttcccgctcacaactgagaacatcaaaacagtcatgctggacatctttggcgcgagcacggagacgtcgacgacgacgctggattgggcgatggccgagctcctgcggaaccccagggtgatggagaaggcgcagcgtgaggtccggcaagcgctttccggccacggcgcggtgaccgaggacagactagccggcctgcgctacctgcgcttcgtcatcaaggagtcgctgcggctgcacccgccggcgacgatgctggttccacgccagtgccagagcgcgtgccaggtgctcgggtacgacgtgccggcgggcatcacggtgatcgtgaacgcgtgggcgatcggcagggacccggcccactgggacgagcccgacaagttcttgccggaaaggttcgagcagagtaccagggacttcaagggggcagacttcgagttcataccgttcggtgccgggcggcggatctgccccggcatgacgttcgggctggctcatatcgagatcgcgctcgccgcgttgctgttccacttcgactggagtttgccgggagggctagcggcggaggagctggacatgaccgaggcatttgggattgctacgccacggcgttccgaccttttggtggtggcaacccctcgtgtcccacttccacaaagttaccgtatataggcattattgttctccttgagggcttttcggttattcctatcctatgtagattggatgggattggaaaaaattatgaaagattttaacttgtttaggattgaaactcatctaatcccacccaatccacatggattgagagcaaaacgaacacgccctgagatggaaaggcatagccataattatactcctcgctttc

SEQ ID NO: 1658 - DNA, 1722 bp, Zea mays; identical to SEQ ID NO: 1656

SEQ ID NO: 1659 - DNA, 1617 bp, Zea mays; identical to SEQ ID NO: 1657

SEQ ID NO: 1660 - DNA, 1614 bp, Sorghum bicolor; identical to SEQ ID NO: 1655

SEQ ID NO: 1661 - DNA, 669 bp, Sorghum bicolor
atggccgccgcagccgccgcgcggaggctcctctcccgccgcgcctcctcgtcctcgctctccgcgctcctccgccgcggcgccgccgcagagcagccgctgctgctgcgcccggccgtcgtcgcggcggcctcccgtctcggcttcccgcgcgggatggcgcggcggcccggcggggacggcttcggccctacgcggcctggcgcgggcggggaccgcgcgccctcggacatggcgccgctgttccccgggtgcgactacgagcactggctcatcgtgatggacaagcccggcggggaaggcgccaataagcagcagatgatcgactgctacatccagaccctcgccaaggtcctcggaagcgaagaggaggcgaagaggaagatctacaacgtctcgtgcgagcgctacttcgggtttgggtgcgagatcgatgaggagacatctaataagctcgaggggctccctggtgttctctttgtgctcccggattcgtatgttgatcctgagtacaaggactatggagctgaactctttgtcaatggtgagattgttcagaggcctcctgagaggcagagaagggtcgaacctgtgccacagaggtcagcagataggcctaggtacaatgacaggacgcgctatgcacgcaggagggagaaccaacgatga

SEQ ID NO: 1662 - DNA, 987 bp, Zea mays
tgccccaccctccccgctagggttttgccagcatggccgccgccgccgcccggaggctcctctcccgccgcgcctcctcgtcctccctctccgcgctcctccgtcgcggcgctgtcccggagcagtcgctggtgttgcgcccggctgttgtcgcggcggcctcccgcctcggcttccagcgcgggatggcgcggcggcctggcggggacggctacgtctcgacgcggtctggcgcgggcggggaccgcgcgcccatggccacggagatggcgccgctgttccccgggtgcgactacgagcattggctcatcgtgatggacaagcccggcggggagggcgccagcaagcagcagatgattgactgctacatccagaccctcgccaaggtccttggaagcgaggaggaggcgaagaagaagatctacaacgtctcgtgcgagcgctacttcgggtttgggtgcgagatcgatgaggagacatctaacaagctcgaggggctccctggtgttctctttgtgctcccggattcgtatgttgatgctgaatacaaggactacggagctgaactcttcgtcaacggtgagattgttcagaggactcccgagaggcagaggagggtggagcccgtgccgcagagggcagcagacaggccgaggtacaatgacagaacccgctacgcacgcaggagggagaaccagcgatgaactgtgcgataaaatcataaaaaagaccacagcaacaagtcccaggtggtttcagctctggaattcaaggatcacctagtatcacctgtattaaattggcaatctcactttacctgcagtctagagtatcgtttctatgtgctcagcttggacgtattgtattctgtaattacagctacttggagatttggaaggacctggcttgcaacgtagtataatctctagtcttttttctttgtggcaatatataattgctatgaataccagattgagatggttgcat

SEQ ID NO: 1663 - DNA, 2607 bp, Oryza sativa Japonica Group
cggccccggtgcgccggagtcgctgctgcgccccaccgtcgccgcggtctcgcgcgtcggcttccttcgcgggttcgcgcggcggccgggcggcgatgggtactccccgatgcggtccggtggcggcggaggaggaggcggagaccgcgcgccgacggagatggccccgctgttccccgggtgcgactacgagcactggctcatcgtgatggacaagccaggcggggagggcgccaccaagcagcagatgattgactgctacatccagaccctcgccaaggtcctcggaaggtgaagcctctctctccgccgatttgtctctcagtttgtgctaaccttgccatgtatttgctcctcacttccagttagttggttcggaggtcgatttcttatgtggttgtgtttgctgcagtgaggaggaggcgaagaagaagatctacaacgtctcctgcgagagatactttggtttcgggtgcgagatcgatgaggagacgtccaacaagctggaaggtttgttccttgcctatgttttggttttataaatacctggaatgagaatacttttagcgcactgtgtgtgttcatgtatctgatgcactatgtatgtgttgtatgacagggcttcctggtgttctgtttgtcctccctgattcctatgtcgaccctgagtacaaggactatggaggtagctttcttgcacaacctcacaacttctgcaggttttcttaggagatcaatggctttgtcatttcatatgatcactgattgactgatgttgtagatactatatcctaattggcccccctataggcatttgttgcttccatttttacaggataatgcgatcgaagttaaagtatattttaatagaactgcatcaaaatgaaatggaacattgtctggataccgtatgtagactgttttcatggcatgtgagcctattccgaccacatactgatgttttgctagtagtccatcttggcaaagctgtgaagccatataggcaatgccctgctttgaatgctaatggactgaaaaaaatgtctctctaacggttcggtaccttggtaaaatggggttctgatcagtggagatgagacattaagaacactttaccacctcttcagtttttgattaattcaaggctttggtctgtttaccaaacctgtagtccatcttggcaaagcggtgaagcctaatcggcaatgtcttgctttgaatgctaatggactaatagcaaatgtatctcacggttctgcaccttaccaaattggggttcagatcagtgtagatagagacactaacagtgtatttactgccacatcccccttgagtcttgatgttttactgttttttaaggatttagtatgttgttgactcaatactaaattgctgttctagacatactagtccatcttggcaaagcggtgaagcctacttggcaatgtcttgctttgaatgctaatggactaataacaagtgtctctccaacggttctgcacctcaaatgaatggggtacaggtcagtggggatgaaacatgcaatatgatcatgccattaaacatagggaaattgaaatttatgctatgatgagttagaatccacttcccaatgttccttgactagaatgtggcaaatttagctattaaaacaattttgtgtttctctcgcttgcttgtttcataacgatttggtatgttgctgactcaacagtaccaaactgctgttctagacttcacagtccatcttggcaaagtggtgaagcctatatggcaatgtcttgctttgaatgctaatggactaataaaaaatgtctcttcaacggttctgcacctcaaatgaaatgaggtacaggtcagtggggatgaaacatgccaacatggtcatgccactaaacatagggaggttgaaaattttccctatgacaagttagaatccgctttctaattttacctgatttgaaggtggcacatttagctatataaataatttagggtggctttttttatcatatcatttatggtttcttactgaatgtgaatgaatttatgcacttccccatggatttgtgccatgttatgcagtccatcttggcaaagcaagatagctatttaggcaatgccttgttttgaatgctaatggacttaaagagaactcttctttttctcttctgctcttcagtacagtgaagctgtgtggatcagttgagatgaaacatttagaacttattcgtggtcactggctttaactgtttgtatttgagacatcagaggttacattaaatgcatcattgtatttttggttaatctagtttgtttagagtagatattacatgctgaacaaaatctgaccattgtgtgaatctattggcttgaggttggtaggatgagttgctctgctgcactctgatttcttggaaagatattatactcatgccatataatctatttctattttgttttacagctgagctcttcgtcaatggagagattgttcagaggtccccggagaggcagaggcgggtagaacctgtcccacaaagagcatcagataggcctaggtacaatgacaggacccgatacgcccggaggagggagaaccaacgg

SEQ ID NO: 1664 - DNA, 1015 bp, Hordeum vulgare subsp. vulgare
gggtccgaattccccattccccatctcccttccagaaccttccacaccgccgccgccgccgccaccgctagggtccctcccaccgccgatggccgccgccgccgccgccatggcccgaaggatcctctccccatcctccacctccgccgcgcgcctcctcatctcccgccgcatctcctccgccccctccttcccgcgcgccccggcggcggcggcgaaggagatgctgcgcccggcggccgtagcgtcctcgtctttcctcctcctccgtggcgtcggtggcgccaggggcatggcgcggcggcccgggggcgacgggtactcccccgcgcgtggcgggggcgggggcggcggagaccgggcgcccacggagatggcgccgctgttccccggttgcgactacgagcactggctcatcgtcatggacaagcccggcggcgagggcgcctccaagcaccagatgatcgactgctacatccagaccctcgccaaggtcctcggaagcgaggaagaggccaagaagaagatttacaacgtctcgtgtgagcgctactttgggttcgggtgtgagattgatgaagagacatccaacaagcttgaagggattcctggcgttctctttgtgctcccggattcctatgttgaccctgagcacaaggactatggagccgagctgtttgtgaatggggagattgttcagagatctccggagaggcagaggagggtggagcctgtgccacagagagcgtcggacaggccaaggtacaacgacaggacccggtacgcacggcggagggagaaccagcagcagccgcagcgatgattcatcacacgaccgaggccagagctagaagcaacctgccgtgctgttttcgtcccctcgacacagcgagtagttgttattgctcggttttagtaatccgtttcatgttgctaccctgttatctgtatgtatttgactacttggagcttgaaactaagaatcatgatagcataaaagaattttagagctgtg

SEQ ID NO: 1665 - DNA, 1064 bp, Hordeum vulgare subsp. vulgare
gacacgcccctctcgcaccacccggaatccactgccgccgctagggttttacgcagatggccgccgccgccgcagccgccggagcccggaggctcctcgcccgccgcgcgtcctcctcccccgtctccatctccgccctcctccgccgcggcggcggcgctgcggcagcggcagcgccccacgagccgctgctgcgcccggcggcgctcgcggccgtcgcctcccgcctcggcttcctccgcgggatggcgcgccggccgggcggcgacgggtactcgccggcgcgctccggagggggcggcggaggggaccgcgcgcccaccgagatggcgccgctgttccccgggtgcgactacgagcactggctcatcgtcatggacaagcccggcggcgagggcgccaccaagcagcagatgatcgactgctacatccagaccctcgccaaggtcctcggcagcgaggaggaagccaggaagaagatttacaatgtctcctgtgagcggtactttggtttcgggtgtgagatcgatgaggaaacatccaacaaactggaaggaattcctggtgttctgttcgtgcttcctgattcttatgttgatcccgagcacaaggactatggagctgagctttttgtgaatggagagattgttcagaggtctccggagaggcagagaagggtggagcctgtgccgcagagagcatcagacaggccgaggtataacgacagaacccgctaccagcggaggagggagaaccagcaacggtgatgagccgaggtgcccgattgaagatcaaataacaagccctggtggtttccgccgggtataaatatcatctacggaatagaagaactgcatgttcactgtatgccaacacaaggtgttttcttttcttcaagttggtgatcgcgcgtcttggatgtatcaaactagttgttagggagcttggaactatttggaattgcacgttaccgtcaactctgcagtcatgtgcgttaccgtcaactctgcagtattgtgcgcttgtaaatctggtttgatggataaactgttacttttgcctgg

SEQ ID NO: 1666 - DNA, 767 bp, Oryza sativa Japonica Group
gcgttgtcccttctcccttcactccgctagggttttaccccgcgatggccgccgccgccgccgccgccgcgcggaggctcctctcccgccgcgcgccgacggagatggccccgctgttccccgggtgcgactacgagcactggctcatcgtgatggacaagccaggcggggagggcgccaccaagcagcagatgattgactgctacatccagaccctcgccaaggtcctcggaagtgaggaggaggcgaagaagaagatctacaacgtctcctgcgagagatactttggtttcgggtgcgagatcgatgaggagacgtccaacaagctggaagggcttcctggtgttctgtttgtcctccctgattcctatgtcgaccctgagtacaaggactatggagctgagctcttcgtcaatggagagattgttcagaggtccccggagaggcagaggcgggtagaacctgtcccacaaagagcatcagataggcctaggtacaatgacaggacccgatacgcccggaggagggagaaccaacggtgatctgattatcagaagccaaataacaaagccgcctgggtggcttgaggccttactagcatatgctgaatggaacaatctaaaaattgctttaatagttttgtcgctggtattgctatttttcatgctggtgattctcacatctttggatgtatcgcattctgtaattactggaaaacttgaaagtacctggcttggaatgcattgctgctgctgaactcttcggcc

SEQ ID NO: 1667 - DNA, 2737 bp, Zea mays
cctctctctctctgtcctctccccagcccgcctccgcttctcgccggactccggccgccgcccgcaacctgtgcctagggctcccgcttccgccacacctgcgcactcggccccggagacggctccttgacgagaggcctgtgggaggagttgcagctgggacgcccggtcggacttgcgtctccgcagctgggagatgctcagctcgtcggcgtccaggagggacgccgcgaggagcggcgcggagctccctcggccgcacgcggtggcagggatggcgcggagcggggagctgcccaagggcgccccctccgcgacggcccctgatgcggtgcggtgcgagggatggatggtgcgccacggccggaggaagatcgggaggtccttcttccacacgcgctacttcgtcctcgacaacggcgtgctcgcgtactacaagaagaagccgagggaccacatgatcccactcaagtcaattattattgatggaaattgcagagtggaggatagagggcttaaaacacatcatggtcaaatgatttatttgctatgcatttacaacaagaaagaaaaggagaaccaaatcacgatgggtggatacgatattgaagatgccctagcctggaagaggaagatagagcttctgattgatcagcaacaggatactacgacagctaaaaaccataaagcttttgcttcgttggactttgatatagatcttggaggaccattttcgttctctgaccatgacagcggacccgaagatgaagaagagccccgacccaccttgcttcgcaggacaactatagggaatggccctcctgattctgtacttgattggaccaaagaggctgacagtgggctgtcaaatcagaatgccaccagtcaggcttactccagaaagaactggaggcttcttagatgccagaatggattgcgcatctttgaagaacttgtggaggttgaataccttgcaagaagctatagtcgagcaatgagggctgtaggagtggtggaagcctcatgcgaggccatttttgggcttgtaatgagcatggatgcatcacgatatgaatgggattgtagcttccaatatgggagtttagttgaagaggtcgatggtcatactgcaatactgtaccatcgtctacaactgaactggttttcaatgttggtctggccacgagatctttgttatgtacgctattggcggcgcaacgatgatggaagctatgttgtgctgtttcgatctaccgaaaatcagaactgtgggcctcaaccaggatttgtgagagcttctatcgaaagtggaggtttcaagatttcccctctcaaaagcctcaatgggaggccccgcactcaagttcaacaccttatgcagattgatgttaggggatggggcgtgaactatttaccatcattccagtactactctttgctgcagatgctgaactgtgttgctggattgcgtgaatatttttcgcaaacagatgaaattcatacagttccaaggattccggtgatgcataccatggttaatgcggcctcaatgaaaaaggaccaaaaccttcaagaaccagactcgaagaccaaacaagctgataacaaacatttggatatggtagatgaagagtcggaagatgatgatgactatcaagttcctgatgctgatgtggaggaagaacctaccaaatctgacagtgatgctaagaactcagacccaatagatttgtcttggttttcgggcattattcgtcaggatacaaatgagaaaagtcgtaactgttgggcagtgcctgatagcaagatctttaaagttcgtagcaagaactttccacatgacaaatcaaaggtaccagcaggtaagtatctaatggagctcgtagcagttgactggtttaaggacgccaagcgcatggatcatgtcgctaggcggaaaggatctgcggttcaggttgccgctgagaagggaatgttcactttcctggtaaacatacaaattcctggaccaagtcattacagcttggtcctttattttgtctcaaactccttgaagaaaggatcgctgttgcagcgttttgccgatggtgatgatgattttagaaacagcagactgaagcttatcccatctgttccaaaggggtcttggatagtgcggcaaagtgttggaagcacaccttgcttgctggggaaagccgtggactgcagctatttgcgtggtcctgactacttagaagtggatgtagatatcggttcgtccgcggtagccaacggggtcctgggcttggtgtttggcgttgttaccaccttggtagtcgacatggcgtttcttatacaggcaaacacgtacgacgagctcccagagcagctcctaggcgctgcgcggctgtcacacatcgaaccttctgcggccgtgtatcctgtccttgacaacatttcctgaacgggacggacaaatcaacctgtgcagattctttcgttctttccgtccgccccgccacaaaaaggctctcccaatttgttcagccactgcagcattgtgcagctcgatacatttgaggttcagacagacagactgcagcagtccacaagtgccttgtacccttcatacagttttgccatttttttaggtcttttcttttacattttactttactcggtgtagtttgagcttcctacagatattgtaatgcaatagacacatcaaagtgagatatacagatacagcatggttcag

SEQ ID NO: 1668 - DNA, 2422 bp, Sorghum bicolor
atggcgcggagcgaggagctgcccaagggcggctgcgcgggcccgacccccgccgcggtgcggcacgaggggtggatggtgcgccacggccggaggaagatcgggaggtccttcttccacacgcggtacttcgtcctcgacaacagggtgctcgcctactacaagaagcagcccagggacagcatgattccactcaagtcaattgttattgatggaaactgcagagtggaggatagagggcttaaaacacatcatggtcaaatgatttatttgctatgcatttacaacaagaaagaaaaggagaaccaaatcacgatgggtggatacaatattcaagataccttagcctggaagaggaagatagagcttctgattgatcagcaacaggatactacgacagcgaaacaccgtaaagctttcgcttctttggattttgacatagatcttggaggaccattttcgttctctgatcatgacagcgggcaagtgaaacctgaagatgaagatgatgaagaagaagagccccggcccaccttgcttcgcaggacaactatagggaacggattgcgcatctttgaagaacttgtggaggttgaataccttgcgagaagctgtagtcgagcaatgagggctgtcggagtggtggaagcctcatgcgaggccatttttgggcttgtaatgagtatggatgtaacacgatatgaatgggattgtagcttccaatatgggagtttagttgaagaggttgatggtcatactgcaatactgtaccatcgtctacaactgaattggtgttcaatgttggtctggccccgagatctttgttatttacgatattggcggcgcaacgatgacggaagctatgttgtgctgtttcgatctaccgaacatcagaactgtggccctcaaccaggatttgtgagagcttctatcgaaagtggaggtttcaagatttcccctctcaaaagcctcaatgggagaccgcgcactcaagttcaacaccttatgcaaattgatgttaggggatggggcgtgaactacttaccatcattccagtaccactctttgttgcagatgctgaactgtgttgctggattgcgtgaatatttttcgcaaacagatgaagttcatacagttccaaggattccagtgatgcataccatgtttaatgcggtctcaatgaaaaaggaccagaaccttcaagaacctgactcaaagaccaagcaaactgatagcaaacatttggatatggtagatgaagagtcggaagatgatgatgactaccaagcccctgaagctgatttggaggaagaacctaccaaatccgacagtgatgctaagagctcagacccaatagatttgtcttggttttcgggcactattcgtcaggatacaaatgagaaaagtcgtaactgttgggcagtacctgatagcaagatctttaaagttcgtagcaagacctttccacatgacaaatcaaaggtaccagcagggaagtatcttatggagctcgtagcgattgactggtttaaggacaccaagcgtatggatcatgttgctaggcggaaaggatctgcggctcaggttgctgctgataagggaatgttcactttcctggtaaacatacaaattcctggaccaagtcattacagcttggtcctttattttgtctcaaattccttggagaaaggatcactgttgcaacgttttgccgatggtgatgatgattttcgaaacagcagactgaagcttatcccatctgttccaaaggggtcttggatagttcgacaaagtgttggaagcacaccttgcttgctggggaaagccgtggactgcagctatttgcgtggccctgactacttagaagtggatgtagatattggttcatccgcggtagccaatggggtcctgggcttggtgtttggtgttgttaccaccttggtggtcgatatggcgtttcttatacaggcaaacacttatgacgagctcccagagcagctcctaggagctgcacggctatcacacatcgaaccttccgcagcagtgtgtcctgaccttgaaaacatttgagcgggacaaatcaatctgtgcagattctttcattctttcccccccaaaaaggcccaaacgctctcaatttgttcagtcactgcagcattttgcagttcgatacagtgaggttcagacagactgcagcagtccacaagtgccttgtacctcgcctttatacagtttttgactttttttgggtcttttttttattactttactggtgtagcttgggcttcttacagatattgtaatgcagtagatacatcaaagtgagatatacagatacagcatggttcggaaaccaattcgtgtacattagcagccggcagccctgcaacgaggatacatcaatgctatagtatattggttg

SEQ ID NO: 1669 - DNA, 2952 bp, Oryza sativa Japonica Group
gttctctcctccctagctgcggacggacttggatccatccatctcccattcattcattcattcattcatgtggccatccatccaccatcttgcatgctagctagctaccctgcaggcccataacgacattattcaattcgaattaattccatcatcatataataatatatatgatgctgagctcgtcggcgtcgaggcgggaggtcggcggcggcggcgccgcctccagcaccaagagcggcgagctgtccctgtccaaggtggccagcgtggccatacgggagtcgtcgggctcgggctcgggcgggatttccaagagcagcgaattgctgtcgagggcaggaaccatggcggcggcgagggaggcggcggcggcggcggtacaccacgaaggatggatggtgcgctacggccggaggaagatcggcaggtccttcttccacacccgctacttcgtcctcgacagcaggctcctcgcctactacaagaagaaacccaaagacaacatggtgccactaaaatcgctgctgatagacgggaattgcagggtggaggatagaggactcaaaacacatcatggacaaatggtctatgtcctgtgcgtttataataagaaagaaaaggagcatcagatcacgatgggcgcgtatgatattgaggatgctctggcctggaaaaagaatatagaactcattatcgatcagcaagaaaatatgacctccaaaaaccgcaaggcctttgcttcaatggactttgatacggaactaggagggcagtttatattctcagaccatgacagcgcagctgaagatgaagaggaacgacctatgttgattcgcaggacaactatagggaatggtccccctgaatcaatacatgactggaccaaagagcatgatatcggtccacccaatcagattgaccccattcaagttagctccaagaagaattggcgcctacttagatgccaaaatggactacgcatctttgaagaacttctggaattcgattatcttgcaagaagctgtagcagagctatgcgagctgttggtgttgtggaagccacatgcgaagccatttttgggctggtgatgagcatggatgtaacaagatatgagtgggactgcagctttcgctatggtagtttagttgaagaggttgacggccacaccgctatactgtatcataagttgcagttgcactggtgcccaatgttagtatggcctcgagacctatgttatgttcgctattggcggcgtaatgacgatggaagttacgttgtgctgtttcgatctacagagcatccaaactgtggacgtcaaaaaggatatgtgagggcttttattgaaagtggaggtttcaagatttctcctctcaagtgtcgcaacggaagaccccgcactcaagttcaacacctaatgcagattgatctcaggggatggctcctcaactactctccttcctttcagtatcattctttgctgcagatacaaaactgtgtagccggcctacgagaatacttctcccaaacagacgaaacacatataactccaaggattcctgtgatggaaaacatggttgacacatctgcagtacagaaagatgacaagaagagtaccgaagaagtagactccaagactaaaacaccagatcgaggacaagcggacagtaaaaacatgggaatcattgatgaagaaacagacgaggatgaggactatcaggttcctgaagctaacatagaggaagatcctaacaaagatgctaagcgtgcagacgaaccaccagaaaagattgatctatcatgcttttcgggcattcttcgttgcgatgcggatgagaaaagccgaaactgttggacagtacctgacagcaagctgtttaaagtccgtagcaagaacttcccgcatgataaatcaaagatacctgcagcgagttacctgatggagcttgcggccattgactggtttaaggacagcaagcgtatggataacgtaggcaggcagaaaggctgtgtagcccaggtagctgctgagaaagggatgcatacatttgttgccaacatacagatccctggatcaactcattacagcttggtgatgtacttcgtgacaaagtcgctgaagaagggatcactgctgcagcgattcttcgatggggatgatgagttccgcaatagcaggctgaagctgataccctctgtacccaagggatcatggatagtgcggcagagtgtagggagcacgccgtgcttgctggggaaggcggtggattgcagctacgtgcgtggagccggatacctggaggtggacgtcgacattgggtcgtcggcggtggccaacggggtgctgggtttggtgtttggtgtggtgacgacgctggtggtggacatggcgttcctaatacaggccaacacctacgaggagctccccgagcaggtcatcggcgccgcccgtctcgctcacgtcgaacccgccgccgctatcgtcccccaggaccttactccccctcctcctgcccttgccgacgacgacaacgccgctgcttcttcctccgaggatgatcatttgtccaagaaaaccaactaagctagcacctctctcaacgcacgcactgcaacttatcaatcatttatcttcttgtaatttctaattatttccgaggctcatagcaagctttgttttttttcttttcatctttttttttatctcgttaagttgtttgcaaagtacagctggttttcttctacgtaggaacaaagataaatctagctagtgacagtatttcgttggaacctaatattatagactgagatattttgtttaggcttagatttgctgtctttggctttaagtcagacttttaattaacttacactccctccatttttttaattgacgacgccattgacttttgaacacatgtttgaccattcgctttatttaaaaattttat

SEQ ID NO: 1670 - DNA, 1348 bp, Zea mays
caaaaccaaactgtaagcgcaccgcccaaaaccctataaaccatctcccatctctctggctcgctcgtctagcagatgcacagcagcaggcgtcccctgtcttcgtccttccgaaatcccaatcctccctccgagtcccccatcccaaaactcggagctccgaagctggcactggcatcgcggcaatgccgaggccgcccacaatggtgatccaggacgactacatcgacatggacctgaccccggcagccacaccggagccctcgccagcctcgccccgcttcgagttccagagcgccggcgccggcgccgccggcgacaggcatagggaggcggcgttcgcgtcccccgcggacgagctgttctacaagggcaacctgctgccgctccacctgccgccgcggctgcagctcgtgcagaggctcctccaggaccaggagcagccgccgccgctgcgaggggcgaagcgggatgcggagtcggatgccacggcggcggcggcggcagagcgaggagacgccgacgctgccgctgccgccagcaaggtgtgcgccgccaagaagccgtcttgggccaagaagctcaaggtggttaagcggtgggcgtcgaaggagtacatccggtcgctcttcctggccaggccgccgttgccgagcgacatcgtcgccgccgccggtggcgccagcgccagcggccacggcatcggcagcgtcagcgcgagggggagcgtcctagagcaggaggaggtgtgccagtgccagcaccgcaagtccttctccggcatcatccgccgggtgcgcctcgtggcgaccaaggcgcctgggacctcgccgctgtgctcctcctcgtcctcgtcctcctcgtcgtccacgccgtcgtgccgcaacgcaaacgggttcttcttccggacgccggcgtcggcggcgggggcgacgccggcgctgaagcggagcagcagcgccgggtcgtccgaggagggcgccatccagggcgccatcgcgcactgcaagcgttcccagctgctgcagcccgggatggtggcctcggcggcggcgcggaggagcgtcagcgacgtcatgttctactcggtgaccaacacgcccagagcctcttccgtgaccgccggcgaggtggcgcaggagaggaggcaggagatgtgcaggggctgatgatggccgatgacatgccacccatggatcaaaagcgacattcttttgtttcttttcttttttgtttattttgcttgtgaagatgatgagcaatgtgatgtgggttgctctggtgatgatcaggacgcaatgtgctgtgactgtttccccggttcccttgattctttgcgatcttctcc

SEQ ID NO: 1671 - DNA, 1273 bp, Sorghum bicolor
agacgtcccctgtcttcttccttcgaaaattccaatcccctctcctcccttctctcacagtcggccagtcccaaagctcggagctccaaagctggcattggcattgcggcaatggcgaggccaccccccacaatggtgatccaggacgactacatcgacatggacctgaccccatcggtgccgccgccatcctcgccacgcttcgagttccagagcgccggggctgccggtgccgacgccaggcacagggaggcggcgttcgcgtccccggcggacgagctgttctacaagggcaacctgctgccgctccacctgccgccaaggctgcagctcgtgcagaggctcctccaggaccaggagcagccgccgccgctgcgaggggcgaagcgggacgcggagtcggatcccgcggcggcgacagagagtggggactccgacgccgacgctgccgccgcggctgccggcggcaaggcgtgcgcagccaagacgaagccgtcttgggccaagaagctcaaggtggtgaagcggtgggcgtcgagggagtacatccggtcgctgttcctggccaggccgccgttgccgagcgacatcgtcgccggcgtcggcgccggcgccggcgccagcgccagtgggcacggcatcggcagcgtgagcgcgagggggagcgtcctggagcaggaggaggcgtgccagtgccaccaccgcaagtccttctccggcatcatccggagagtgcgcctcgtggcgaccagcaacaaggtgcccgggacctcgccgctctgctcctcgtcttcgtcctcctcgtcgtcgacgccgtcgtgcggcaacgccaacggcttcttcttccggacggcggcagcttcggcggggacagcgacgccggcgctgaagcggagcagcagcgcggggtcgtccgaggaaggcgccatccagggcgccatcgcgcactgcaagcgctcccagctgctgcagcctgggatggtggtctcgtcggcggcggcggcgcggaggagcgtcagcgacgtcatgttctactcggtgaccaacacgcccagagcctcctccgtggccgccggcgaggtggcgcaggagaggcggcaggagatgtgcaggggttgatgccatggctcgtgccatgccaccccatggatcatcaaagcaacattcttttgtttcatttttggtttcttttgcctgtgaagatgatgagcaatgtgctgtggattgctcctgtgatgatgaggacgcaatgcaatgtgctgtgattgtttcc

SEQ ID NO: 1672 - DNA, 1294 bp, Zea mays
ttttgcttggctccgcacccgcgcccggctcgtcgtcaatccacccatccatctactgcgccgaaggaacgccccgccgctccggcggcgtacgcggggagaggagaggagatgagacgaagtgcgacggggtgggcatgaggtgcaagaagcacccgtaccaggtcggcggcggtggcgtctgtgccacgtgcctccgcgaccgcctgatcgcgctggaggccgcgcagaacggcgacgcgtcgtcgtcgccgccgccgcccgccgcggcgcccgcgttcccgaggtcggtgtccccgtacgtgtcccgcaggaagtcggacacgtcgggcgggggcggcgcgctcaggcaccacccgagcctgctcttcttccggacgccgcaggtagggcccgcctacggcggcggcgcgttggaggaaggcgacataggctacgagtacaagaggcggcgcgccggcaagttctccgtgctcgccacgctcttcggccaccaccacggtcacagatcggaagagacgcaccaggaaggcgccacggagcggaagaaacattcttggttcgccgcgatcatgccgcgccgccgcaagaagcaggcggcgccggcctcgatcacctcgccacggtcagccccgccgaggcgctcctgccgcgtggtcagcaaccgggggctgtcgccggagcgggacagccacggcagcggcgacgagagcagctcgcccgccgcggatcccccgtggcggccgtccccgtcccccatgcggaggacccgctgccggcgccgccagacgaacagcatgccgtcgggtttcgccgtctgcctcagcccgctcgtgcggcccagcccggggcgccgccgccacgtccagccgccggacccgggctccttctcctccgagttccggccgtcgccgctccacagtctctcgtctgctgcctccgttacgcgctgtcgctccaggaagctcgccgacgtcggccgcttccggtgatgattgcttccaccttcaccattttcgtccttccattccatgcaccaaatccagattagtccacgttttaaaatttctttttgttttttttttttttttttttttggatttattacattttgtctatccgtgaagaagaagagtatgcaagactggcacacacaccccaaaccaagtccaaaacacccccgttgacatatatactactgcgtagtttagtactgcttgtcggcccaacattttgtggcgatgtaacgagctgcttgtactgcttccaagtaactacatattcatgtttgtac

SEQ ID NO: 1673 - DNA, 1347 bp, Zea mays
atctgcccagtcgctaattttgcttggctccgcgcccgctcccggctcgtcgtcaatccacccacccatctactgcgccgaaggaacgcccagccgctccggcggcgtacgcgggtagaggagaggagatgagacgaagtgcgacggggtgggcatgaggtgcaagaagcacccgtaccaggtcggcggcggtggcgtctgtgccacgtgcctccgcgaccgcctgatcgcgctcgaggccgcgcagaacggcgacgcgtcgtcgtcgccgccgcccgccgcggcgcccgtgttcccgaggtcggtgtcgccgtacgtgtcccgcaggaagtcggacacgtcgggcgggggcggcgcgctcaggcaccacccgagcctgctcttcttccggacgccgcaggtagggcccgcctacggcggcggcgcgttggaggaaggcgacataggctacgagtacaagaggcggcgcgccggcaagttctccgtgctcgccacgctcttcggccaccaccacggtcacagatcggaagagacgcaccaggaaggcgccacggagcggaagaaacattcttggttcgccgcgatcatgccgcgccgccgcaagaagcaggcggcgccggcctcgatcacctcgccacggtcagccccgccgaggcgctcctgccgcgtggtcagcaaccgggggctgtcgccggagcgggacagccacggcagcggcgacgagagcagctcgcccgccgcggatcccccgtggcggccgtccccgtcccccatgcggaggacccgctgccggcgccgccagacgaacagcatgccgtcgggtttcgccgtctgcctcagcccgctcgtgcggcccagcccggggcgccgccgccacgtccagccgccggacccgggctccttctcctccgagttccggccgtcgccgctccacagtctctcgtctgctgcctccgttacgcgctgtcgctccaggaagctcgccgacgtcggccgcttccggtgatgattgcttccaccttcaccattttcgtccttccattccatgcaccaaatccagattagtccacgttttaaaatttctttttgttttttttttttggatttattacattttgtctatccgtgaagaagaagagtatgcaagactggcacacacaccccaaaccaagtccaaaacacccccgttgacatatatactactgcgtagtttagtactgcttgtcggcccaacattttgtggcgatgtaacgagctgcttgtactgcttccaagtaactacatattcatgtttgtacagctacttgtgtaatttcgatttcatcttctacaaaaaaaaaaaaaaaa

SEQ ID NO: 1674 - DNA, 1437 bp, Sorghum bicolor
attttttggccgaaagcaaggaaggcaggtgcatctccgccgtcgcaaatttcgcttcgctccgcacccgcacccgcgaccgcctcgtcgtgaattcgtccacccacccccacccatctaccgcgccgagggaacgccaccggcgaggaggttacgcggggagaagagaggagaggagaggagatgagatgagatgagatgagacgaggcgcgacggggtggtgggcatgaggtgcaagaagcacccgtaccaggccggcggcggcgtgtgcgccacgtgcctctgcgaccgcctgctcacgctcgaggccgcgcagaacggcgacgcatcgtcgccgccgcacgcgcaggcccctccggttccgcccgccgagcccctggcgttcccgaggtcggtgtcgccgtacgtgtcgcgcaggaagtcggacacggcgggcgcgctcaggcaccacccgagcctgctcttcttccggacgccgcaggtcgggcccgcctacggcggcggcgctggcggcgcgttggaggaaggcgacatagcctacgagtacgagaagcggcgcgcgcgcaagttctccgtgctcgccacgctcttcggccaccaccaccaccaccaccaccacagatcggaagagaagcatcaccatcagcaggaaggcgcccccaaggagcgcaagaagcgttcttggacttggttcgccgggatcataccgcgccgccgcaagaagcagtcagcggcggcggcggcggcggtctcggccacctcgccacagtcagccccgccgaggcgctcctcctgccgcgcggtcagcaaccggggcctctcgcctgagcgggacagccacggcggcagcggcgacgagagcagctcgcccgccgccgcggatcatcccccgtggcggccgtccccgtcccccatgcggcggacaccctgccggcgccgccagacgaacagcatgccgtcgggtttcgccgtctgcctcagcccgctcgtgcggcccagccccggccgccgccaccgccacgtccagccgccggaccccggctccttctcctgcgagctccggccgtcgccgctccacagcctctcgtccgccgcctccgttactcgctgtcgatccaggaagctcgccgactgcggtcgcttccggtgatctttgcttccattttcctcctttcattccatggttcccaccaccacctaatccagattactagtccactttttagaatttctttttctttttggatttattacattttgtctgtccgtgaggaagagtctgtaagattggcacacccaaaccaagtccaaaccaccccgttgacatataaaactgcgtactactaggtcactactgcttgtcggcccaacattttgtggcaatgtaacgagctgcttgtactactatcaagtagaaaaactacatgttcatgttt

SEQ ID NO: 1675 - DNA, 1548 bp, Oryza sativa Japonica Group
cgaaaaaaaagaggaaaaaaaaatcccctcgccaaaacgcgcaccaatctccgttttaaaaaactcgcccaaatttcaagggaagggaaggggaagaaggaaggcaggtgcgcgtgcgccgttgtagattgctccttcctcgtggccggagcgcgcggcggcggcggcggcgacggcggcgagatgagtcgatgagatggggatgaggtgcaagaagcacccgtaccaggcgggcggcggcgtctgcgccacgtgcctcaacgaccgcctgctcgcgctcgccgccgcgcagaacggggcgtcgtcgtcgcctcctcctccggctgcgccaccggccgcggcggcgccggcgttcccgaggtcggtgtcgccgtacgtgtcccgcaggaagtcggattcctcgggcggcggcgcgcttaagcatcatcccagcctcctcttcttccggacgccgcaggtcggccccgcctacggcagcagcggcgggctcgaggagggggacatcgggtacgagaagcggcgcgcggggaagttctccgtcatcgccacgctcttcggccaccaccaccaccatcacagatcggaggagaaggacaagggaggcgacaacagggagagcagaaaccgttcttggctcgccgggttcatgccgcgccgccgcaagaagcagccgccagcgccagccgcagccgcagccgcctcgtcgcccccgcctaggcgctcctgccgcgtggtcagcaaccgtgggctctcgccggagcgggactgcgacggcagcgacgaggagagcagctcgccgactgatcccccatggcagccatctccttcaccgatgcggaggaccccatgccggcggcgccaaaccagcaccatgccatcgggcttcgccgtctgcctcagccctctcgtgcggcccagccccgggcgccgccaccgccacgcccatccgcccgacccaggcaccttctcctgcgagctacggccatcgccgctccacaacctctcctccgccgcctccattactcggtgccgctccaggaagctcgccgacggcggacgcttccggtgatcttttcacgttttctttttcacctttttcatcttctcttcaccgcttatcaccacctaatcccaattaccatcctttttagatttttcttctcctttcttactcgcattttgtccatccatgaaaagtctctataagattttatactcccaactccaaaccacttcgttgacatataggttactactgctcgtcagccgaccattactgtaagagctgcttgtttgtttgtacagctagttgtctaatcttgatttgcaaaattgttaattaaccttagtttcttttttttttctttgatgcttgggtttaagaatgagtggacttgttgatgtgcatggactgcacggtacaggtcgtttgtacacaggattaaatgctggatttatgagtgagagggatctgagtagagggggataggagtgtatgtggctttgtgcacagggattaaaagaaggttcttgattgttttgtgtctg

SEQ ID NO: 1676 - DNA, 1398 bp, Sorghum bicolor
gctctctactgcctctcgccgtcgccacggttcgcgatgggctgcttccttggctgcttcgggggggccaaggagcgccgccgccgccgcaagcggtcgccgtcacagtcccccaacggccgcgcccgggccgtgccgcgggtttcgccgaagaaggttgatctggatggggaggccgcctccgccgccgcgccgctcttagcgacgctcctcgagctgagggactccacggacgacatgtgcctggccgtcgtgaagaagaaggtgacgttcgatcccaacgtcaccaccttcgaggccgccccgatccctgaggacgacggcgagggagccgatccggaggatggtgaggatagcagggagaaaggatggatgttgacgccggattgcgccaagtccgaggccttccccttgaaccacaggtacagcaactgcgctggcattgagagcgacagcgactacgaggacgccgaggaggacgagtttgaagactacgacgacgacgacgacgaggaggaggaggaaggggaagacgggctcgacgagtgcgcgatcgacgacgacgacgacgagcacggcctccttggcatcggccgcagcgaggaggacgcgtgcgagtcgctcttcctgcttccgttcggcaagacgtccaaggattccggaggccaggtagcggcgcccgtcgtgcccccggcagagtccccctcggtgctcagctccgtggagaacctcaacctcacccgctggaaggaatccaagccccgcgctgccgccgcgcccaagtcctcggacaaggagaacgtcactgtggggcaggagaaccggatggccctcctcgccgagccaccagcggcggccaagaggaaggaggagaggccggcggtgtcggactacagctacacccccagaacgccgagcaagcaggaggcctccgtggacgccagcctctccacgtggctcggttcctcggggacgcccgagagcaactcggtccggtcctactcgccgatcagccgtgaggagcggccgatccttggggccctcaccgtggaggacatcaagatatcgtcggccaactcaacgccgaggaggtcgaggtccccgagcccgagcccggatgacatgccgatcctggggacggtgggggcttactggaactgcagtgccaaggaggctgatccggtcacaagaggagggtttatgaggaccagaaccagatttggccagaattttgcaggataaaatggtggattgctactgaatagtgaacacctcctgctaggaggagacagagagtgccgagctgggtggaaatgcaaagttacagagtttgtgagaattcgagattgtgaaaccagtttacatttctgtgatccatattctttcatatgtttgtaa

SEQ ID NO: 1677 - DNA, 1599 bp, Zea mays
atcactagtcaccacttccccgcgctgccctcccactcccacacaccttctgctgcctctcgccgcggccgatgggctgcttccttggctgcttcgggggggccaaggagcgccgccgccgccgccgcaagcggtcgccgtcacagtcccccaacggccgtgctcgggccttgctgcgggttacgccgaacaaggttgatctggatggggaggccgtctccgccgccgcgccgctactagcgacgctcctcgagttgagggactccacggacgacatgtgcctggccctcgtgaagaagaaggtgacattcgaccccaacgtcaccacattcgaggcggccccgatcccggaggacgacggcgaggaagccgatccggaggatggtggggatagcagggagaaggggtggatgctggcgtcggagtgcgccaagtccgaggccttccccttgaaccacaggtacagcaagctcgccggcagcggcaacgtcagcgactacgaggacgccgaggaggacgaattcgaagacgaggaggaggaggacgacgacgacgaggaggatgaggaaggggaagacgggctcgatgagtgcgcgatcgacgacgacgaagacgagcatggcctcctcggcatcggacgcagcgaggaggatgcgtgcgagtcgctcttcctgtttccgtttgggaagatgtccagggattcgggcggccaggtagcggcgcccgtcgcgcccccggtgctcggctcggtagagaacttcaacctcacccggtggaaggaacccatggctgccgccgcgcccaagacctcggacaaggagaacgtcactgtggggcgggagaaccggatggacttcctcgcggaaccacccgcggtggcggccaacaggaaggaggagcagatgccggcggtctcggacaacagatacacccccagcacgccgagcaagcaggaggcctccgtggacgccagcctctccacgtggctcggttcctcggggacgcccgagagcaactcggtccggtcctactcgccgatcagccgggacgaacggccgatcctcggcgccctcaccgtggaggacatcaaggtgtcgtccgccaactcaacgcctcggaggtcgaggtccccgagcccgagtcccgatgacatgccgatcctggggacggtgggggcttactggaactgcagtgccaaggagtctgatccggtcacgagaggagggtttatgaggaccagaaccagatttggccaggtcaggtgagcagctttgtctcggtagtctgacttgactgttgtaatccatgtttgcttttcctagtataatcttctgttgaaataatggaacacctcccgctaggaggagagagagagggggggagggtaccgaacctgggtgggaatgcaaagatataaaagtctgtgtgagaatgcgagatcgtgaaaccagatagatttgtgtgatcatattctttcatatgtttgtaaacattacattgccatccatattctaggatggtgttttttttttgtagcttcaatgtcattctttttgtcaatatgatcgattgtttttgtgcaaaaaaaaaaaaaaaaaa

SEQ ID NO: 1678 - DNA, 1593 bp, Zea mays
cgctcccccaaatgccgcctcctcatcactagtcaccacttccccgcgctgccctcccactcccacacactttctgctgcctctcgccgcggccgatgggctgcttccttggctgcttcgggggggccaaggagcgccgccgccgccgccgcaagcggtcgccctcacagtcccccaacggccgtgcccgggccttgccgcgggttacgccgaacaaggttgatctggatggggaggccgtctccgccgccgcgccgctactagcgacgctcctcgagttgagggactccacggacgagatgtgcctggccctcgtgaagaagaaggtgacattcgaccccaacgtcaccacattcgaggcggccccgatcccggaggacgacggcgaggaagccgatccggaggatggtggggatagcagcgagaaggggtggatgcaggcgtcggagtgcaccaagtccgaggccttccccttgaaccacaggtacagcaagttcgccggcagcggcaacgtcagcgactacgaggacgccgaggaggacgaattcgaagacgaggaggaggaggaggacgacgactacgaggatgaggaaggggaagacgggctcgatgagtgtcggatcgacgacgacgaagacgagcacggcctcctcggcatcggacgcagcgaggaggatgcgtgcgagtcgctcttcctgtttccgtttggcaagatgtccagggattccggcggccaggtagcggcgcccgtcgcgcccccggcggaggcccccgcggtgctcggctccgtagagagcctgaacctcacccggtggaaggaacccaagcctcgcggtgccgccgcgcccaagtcctcagacaaggagaacgtcactgtggggcgggagaaccggatggacttcctcgccgaaccacccgcggtggcggccaaggggaaggaggagaggccggcggtctcggacaacagctacacccccagcacgccgagcaagcaggaggcctccgtggacgccagcctctccacgtggctcggttcctcggggacgcccgagagcaactcggtccggtcctactcgccgatcagccgggacgaacggccgatcctcggcgccctcaccgtggaggacatgaaggtatcgtccgccaactcaacgcctcggaggtcgaggtccccgagcccgagccccgatgacatgccgatcctggggacggtgggggcttactggaactgcagtgccaaggagtctgatccggtcacgagaggagggtttatgaggaccagaaccagattttgccaggtcaggtgagcagctttgtctcggtagtctgacttgactgttgtaatccatgtttgctataatcttctgttgaaataatggaacacctcccgctaggaggagagagagagagagagagagggagggtaccgaacctgggtgggaatgcaaagatataaaagtctgtgtgagaatgcgagatcgtgaaaccagatagatttgtgtgatcatattctttcatatgtttgtaaacattacattgccatccatattctaggatggtgttttttgtagcttcaatgtcattcttttcgtc

SEQ ID NO: 1679 - DNA, 1545 bp, Zea mays
caccagttttcctccccttcccgctcatcagacccagatgccgcctcctcatcactaatcaccactgccccgcgctcccctcccactcgctttgtgctgcctctcgccgtcgctcgcggttcccgatgggctgcttccttggctgcttcgggggggccaaggagcgccgccgccgccgcaagcggtcgccttcacagtcccccaacggccgcgcccgggctgtgccgcgggttacgccgaagaaggttgatgtggatggggaggccgcggcctccgccgccgcgccgctcctagcgacgctcctcgagttgagggactccacggacggcatgtgcctagccgtcgtgaagaagaaggtgacgttcgaccccaacgtcaccaccttcgaggcggccccgatcccggaggacgacggcgagggaaccgatccggaggatggtggggctagcagggagaaggggtggatgctggtgccggagtgtgccaagtccgaggccttccccttgaaccacaggtacagcaactgcgccggcagcgacaccgacagcgactacgaggacgccgaggaggacgagttcgaaggcgacgaggacgacgaggaggaagacgaagacgggattgatgagtgcgcgatcgacggcgacgaggacgaagacgagcacggcctcctcggcatcggacgcagcgaggaggatgcgtgcgagtcgctcttcctgcttccgtttggcaagacatccaaggattccttcggccaggtagtggcgcccgccgtgcccccggcggcggaggcccccgcggtgctcggctccgtagagaatctcaacctcgcccggtggaaggaacccaagccccgggctgccgctgcactcaagtcctcggacaaggagaacgtcactgtggggcaagagaaccggatggacgacctcctcgccgagccaccagcggccaagaggaaggaggagaggccggcggtctcgggctacacccccagcacgccgagcaagcaggaggcctccgtggacgccagcctctccacgtggctcggttcctcggggacgcccgagagcaactccgtccggtcctactcgccgatcagccgggaggaccgcccgatccttggggacctcaccgtggaggacatcaagatatcgtcggccagctcaacgccgaggaggtcgaggtccccgagcccgagcccggatgacatgccgatcctggggacggtgggcgcttactggaactgcagcgccaaggaggccgatccggtgacaaggggagggtttatgaggaccagaaccagatttgggcagggttttgcaggatgaaatggtggattgctactgaacagtggacacacctctcctcccgctaggagggtagaatgcaagagtgaaaaccagtttgcatttctttcatatgttgtaaaacattacatggtcaccagatcagtattctagtatgatattttttgtggcacttgtcaatatgatgcagtatttcatattattcttttgtcaatatgatcaatttgtatttgtgcgtgtt

SEQ ID NO: 1680 - DNA, 1623 bp, Zea mays
gaaaatcactaatcaccactgccccgcgctcccctcccactcgctttgtgctgcctctcgccgtcgctcgcggtccccgatgggctgcttccttggctgcttcgggggggccaaggagcgccgccgccgccgcaagcggtcgccttcacagtcccccaacggccgcgcccgggctgtgccgcgggttacaccgaagaaggttgatgtggatggggaggccgcggcctccgccgccgcgccgcttctagcgacgctcctcgagttgagggactccacggacggcatgtgcctagccgtcgtgaagaagaaggtgacgttcgaccccaacgtcaccaccttcgaggcggccccgatcccggaggacgacggcgagggagccgatccggaggatggtggtggggctagcagggagaaggggtggatgctggtgccggagtgcgccaagtccgaggccttccccttgaaccacaggtacagcaactgcgccggcagcgacaccgacagcgactacgaggacgccgaggaggacgagttcgaaggcgacgaggacgacgaggaggaagacgaagacgggattgatgagtgcgcgatcgacggcgacgaggacgaagacgagcacggcctcctcggcatcggacgcagcgaggaggatgcgtgcgagtcgctcttcctgcttccgtttggcaagacatccaaggattccttcggccaggtagtggcgcccgtcgtgcccccagcggcggaggcccccgcggtgctcggctccgtagagaacctcaacctcgcccggtggaaggaacccaagccccgggctgccgccgcgctcaagccctcggacaaggagaacgtcactgtggggcaagagaaccggatggacgacctcctcgccgagctaccagcggccaagaggaaggaggagaggccggcggtctcgggctacacccccagcacgccgagcaagcaggaggcctccgtggacgccagcctctccacgtggctcggttcctcggggacgcccgagagcaactccgtccggtcctactcgccgatcagccgggaggaccgcccgatccttggggccctcaccgtggaggacatcaagatatcgtcggccagctcaactccgaggaggtcgaggtccccgagcccgagcccggatgacatgccgatcctggggacggtgggcgcttactggaactgcagcgccaaggaggccgatccggtgacaaggggagggtttatgaggaccagaaccagatttgggcagggttttgcaggatgaaatggtggattgctactgaacagtgaacacacctctcctcccgctaggaggggagaacgcaagagtgaaaaccagtttacatttctttcgtatgttgtaaaacattacatggtcaccagatcagtattctagtatgacatttttttgtggcacttgtcaatagatgcagtatttcaatattattcttttgtcaatatgatcaatttgtatttgtgcgtgttatataccctcctctcctttttggaatattttgtaccagcatctgcagtaccagaatcgctcaaaattcaacacttctgttagacaggagatctcaccttccatcaaaaaaaaaaaaaaaa

SEQ ID NO: 1681 - DNA, 1619 bp, Oryza sativa Japonica Group
gcttgcgttgcgccccaaattccgcctcctcttcttcactagctcttccaccctctccaatcccctctccctttctctccctctccctcttgccttcgccatgggctgcttccttggctgcttcgggggggccaaggagcgccgccgccgccggaaacgctcccctgcgcactccccctccggccgcgcccgggccacgccgcggctttccccgaagaaggctgccgctgccgccgcgttggatggagacgttgtttccgccgccgcgccgctgctggcgacgctcctggagttgagggattccactgatgacttgtgcttgaccgtcatcaagaagaaggtgacgtttgatcccaacgtcaccacttacgaggcggctgcgatcccggaggcggaggaggaggatgatgaggaggccgagccggcggcgggtgacgacaaggatgaggcgaggtggatgctggcaccggattgcgcgaaatccgaggctttcccgctgaaccacaggtacagcaactgcgcctacggcgacaatgacagcgagtacgacgaggacgaggacgaggacgaggaggaagacgaggacgaagaggaagaggcggatgggctcgacgagtgcgcgatcgacgacgaggacgacgacggccttctcggcatcgggcgcggcgaggacgaggcgtgcgagtcgctcttcctgcttccaatgagcaagactaaggagagcggcggcggccatgaagcggcttccggcgtcacctcgccggaggcgccgcccgcgcctcaacagacgcgcgacgcgaatccggtgctcagctcggtggagaatctcacccagtggaaggacgccaaggcccgcgccgccaccgccaccgccgcgccgaatgcttcggacaaggagaacagaacgacggcgaacttgctccccgagccggcgatcccagccaagaagagagagtggcaggtggtctgctccgactacagccccagcacgccaagcaagcaagaagtctcggtggacgcgagcctctcgacatggctgggctcttcggggacgccggagagcaactccgtccggtccttctcgccgatcagccgagaagaccggccgatccttggggccctgaccgtggaggacatcaagatatcctctgccaactcgtctccgaggaggtcgaggtctccgagcccgagccctgacgacatgcccatcctgggaaccgtgggggcttactggaattgcagctccaaggctggtgatccggtgacaagaggagggtttatgaggactagaacaaggtttgggcagaactttgcaggatgaagtggtgaattgctactgaaagcttccaagctggaagctggaagagtttggtttcaggaggaaaattgcagaagatgcatacatgcttttgtgagaagaacatacatatagagtcagtgagattgtggaagtagtggcatgctttattcaaagatgttgcttgtcaaattcttttatttgttgtaaacaatgtccatccatattctattatggtgatctttttttttttggcgctgtcgatatggtgtattgtttcgatgttacattgtcaatatggtgtattgcacttatgcctttc

SEQ ID NO: 1682 - DNA, 1036 bp, Zea mays
gtccagggtagagagagagagggatggtgtgagggagggaagggagcaaaggcaaagcagccaacgaccagagagacacggaggctgagagagagagagagagagagatttgggaatcgagaaagcagcgaggaagaagaagatggagcaggaggaagcgtgcacctcgtcgctgcggcagtgcaggatttgccacgacgaggaggacgagcggcgctccgccatggagtcgccctgcgcctgttccggctccctcaagtacgctcacaggggatgcgtgcagaggtggtgcgacgagaagggaagcgccgtctgcgagatttgcctccagaactttgagccgggctacaccgttcctcccaagaaaacccaacctgctgatgtcgcggtgaccatcagagacagcgtgggggtgcccaggccgcagcacgagcctgaagaggaggagcaggagcaggtggacgcggcgttgatcggaggcagcgacccggagtacgccgagtgcgcgcgcgccgccggcaggagcgcgtcctggtgccggtcggtggccgtcacgttcacggtcgtcctgctgctgaggcacctggtcaccgtggtcacggtcggagcggccaaccagttcgccttcggtctcctcacggtatacttgctgcgggcgagcgggatcctgcttccgttctacctcgtcatgaggctcatctccgtgatccagcaggggcagaggcagtaccgcctccggctgctccaggagcagaggaggcacgcgttgaggtcggcccggctgcacggccaggaacaggaacagcatgtcatcctggttcgctgaggaacgagccattcattcaccttggtgtccatacattccattcatccgtcgtacgcgtacaaggttgtaagatgtaccactccatttttttgttcaggcctttacaagcctaaaaaaagcttatatgtaccaccacttcatttgtaaaccctcaaaatttgttgctgagaagatcgacatatcatgtatagatcaaaaaaaaaaaaaaaa

SEQ ID NO: 1683 - DNA, 910 bp, Oryza sativa Japonica Group
agaaaaaaaacagaggggtagcagaggagcaaccaatcgcgagagagaaggaaggttgaggaagaggaggaggaggaggaggaagaagaagacgagatggagagagatgaggtgtgctgttcttgcgccatgaggcagtgcaggatctgccatgaggaggaggaggaagggtgcaccgccatggagtccccctgcggatgctctggctccctcaagtacgcgcacagggggtgtgtgcagagatggtgcgatgagaaggggagcacgctctgcgagatttgccttcagaatttcgaaccaggctacactgctcctcccaagaaagctcaacctgcccatgtcgcagtgaccatcagagagagccttgaggttcccaggccaagctacgagccggaggacacgccgttgatcggcgagcaggattacgccgagtgcgccggagcggccggcaggagcgccacctggtgcagatcggtggccgtcacgttcacggctgttctgctgctgaggcatctcgtcgctgtcgtgacggtcggagctgcacaccagtacgccttcagcctcttgacgatatacttgctccgggctagtggaatcttgctgccgttctacgtcgtcatgaggctcatctccacggttcagaagggtcagaggcaataccagctgcagctgctccaggagcaaaggagaaatgcagctagaatgcacaggttgcatggtcaagaagaacaaaatcaacatgccattcttgtccggtgaacaaagaatgaagtggttctcctgtagaaaagactgcaaaattgtattattactgatgggaaaaggaaaataaacattgttcataagctttccactatatgtacatgtccacatttgttgcaaagatgattacaccagagctttgagtact

SEQ ID NO: 1684 - DNA, 2614 bp, Sorghum bicolor
caatcccaactggtaaaataagatcccgttccttcccatcacgcccatcgttttccgctctccattccgttctgcatccgtcaatccactcccccacggcgccgacgactcgggctcccggctcccccccttggactcggacgggaacagcacgtcggggaaaggaagcaagcgtccgcgagtaggaacagtgacgagtgacggcagcagggggagggacgggacacgggaggaggggaggggacagaggaggagcttgggcggtggagctggtggactggtggtatatagctaggcgggcgggccgtgggcgggcagccaatgccgtcgggcgcgcagggctaggaggatgggcggagggggcgcgatcgtccacggcttccgccgctggttccaccgccggaacggctccacctccggctccaaccagtcgtccgtcgccggcgagggggacgacggctcgtccgatctcgaggtcatcgaggacccggatctcgtcgcactccgcgccatccgcgtgcccaagcgcaagatgccgctgcccgtcgagagccacaggaagaactcggtggaaatggagttcttcacagagtacggagaggcaagccagtaccagatccaagaagtcattggtaaagggagctacggagtagttgctgcagctgtagatacccgcaccggtgagcgggttgctatcaagaagatcaatgatgtgtttgagcacgtctcggatgccacacgcatactgcgggagatcaagctccttcggttgcttcgccacccagacatagttgagattaagcacattatgctccctccttctcggagggagttccaagacatctatgttgtttttgagctcatggagtcggatctccatcaagtgatcaaggcaaatgatgacctcacccctgaacatcaccagtttttcttgtaccaacttcttcgtgctctaaagtacatacatgctgctaatgtatttcatcgcgacctaaagcccaagaatatactggctaactcggactgcaaactgaaaatatgtgacttcggacttgcccgtgcatcatttaatgatgccccttcagctatattttggacagattatgtggcaacaaggtggtaccgggcacctgaactttgtggttcctttttctccaaatacactcctgcaattgatatttggagcattgggtgcatatttgctgaacttctcactggaaggccattatttcctgggaagaatgttgtgcaccaattagatcttataacggatcttcttggaactccatcatctgagaccttatctcggattcgaaatgagaaggccaggagatacttgagctgcatgcggaaaaaatatcctgtgccctttactcataaatttcgaaatgctgatcctttggctcttcgtcttctagagcgtttacttgcatttgatcctaaagatcggcctactgcagaagaggctctagcagatccatactttgcatcccttgctaatgtggaacgtgagccatcaagacatccaatttctaaacttgagtttgaatttgaaagaaggaagctggccaaagatgatgttagagaattgatctatcgagagattttggagtatcatccacagatgctggaggagtacatgaaaggtggagaacagattagcttcctctatccaagtggagttgatcggttcaaacggcagtttgcacatcttgaggagcattatagcaaaggagaaagaggttctccactgcaaagaaagcatgcttccttaccaagggaaagagtggttgtatcgaaggatggcaatactgaacaacatattaatgatcaggagaggagtgcagattctgttgcccgcactactgtgagccctccaaggtcagaagatgccgacatgaatgatgtgaaatccacaagtttaagctctcggagctacctgaagagcgcaagcataagtgcttccaagtgtgtcgttgtcaaaaataaacacccagaggatgatgaaatcccagaggaaatggaaggcgtcgtcgatggattgtctgaacaggtctccaggatgcactcctaggcaggtctgtccacggcgacagcaatcttggtgcaaggtttctatctggtacactgtatgtcgacgatgatacagaggacagcctgggaaagcgaaacactctatggtacactgcccacagctagtacttgggtagaagaggaatatgccaccgtctgatggttctttcttcatcatctgtatttccaccgtgtcatgccagcatgttgtggcgtctctggaagccctgcatggattcatgaagaattcctgagatgtagcactagttagtccatggagggaacagaatgaacaatgaagtatgatcagcctgtcgaccatgaagatgttttcttgcaatggagtctggacctatgtttgagttttattacaacggcttctgccgtacgaagtgtcagcactcagcagtgtatcatccttttttccattttgaggggatatcactacagtgcacattttgcctgtcaagaaactcatgagtaatttctccagtcatataactcataagtacactgaacttccttgggtaacaccttactt

SEQ ID NO: 1685 - DNA, 2339 bp, Zea mays
cacgcccatcattttccgttcttcaatccgtcaatccagtccccatccccacggcgccgacgactcgggggcttccccccttggacttggcccgggtgggagtagcacgtcggggaagggaagcaagcgtccgcgagtaaggacagaaaaccgaagggaggagtggagaggaggagcttgcttggagcgggtggacgtgtggtgtgtatatagttaagcgggcgggcgggcgggcagccaatgccgtcgggcgcgcagggctaggagcatgggcggagggggcgcgatcgtgcacggcttccgccgctggttccaccgccggagcgaaggctccacctccaactccaaccagtcgtccctcgccggcgagggggaagcggacgacggctcatccgatctcgaggtcatcgaggacccggatctcctcggcctccgcgccatccgcgtgcccaagcgcaagatgccgctgcccgtcgagagccacaggaagaactcagtagaaatggagttcttcacagagtacggagaggcaagccagtaccagatccaagaagtcattggtaaagggagctacggagtagttgctgcagctgtggacacccgcaccggtgagcgggttgctatcaagaagatcaatgatgtgtttgagcacgtctcggatgccacacgcatactgcgggagatcaagctcctccggttgcttcgtcacccagacatagtcgagattaagcacatcatgctccctccttctcggagggagttccaagacatctatgttgtttttgagctcatggagtcggatctccatcaagtgatcagggcgaatgatgacctcacccctgaacatcaccagtttttcctgtaccaacttcttcgagctctcaagtacatacatgccgctaatgtattccatcgtgatctaaagcccaagaatatactggctaactcggactgcaaactgaaaatatgtgactttggacttgcccgtgcatcattcaatgatgccccttcagctatattttggacagactatgtggcaacaaggtggtaccgggcacctgaactatgtggttcctttttctccaaatacactcctgcaattgatatttggagcattgggtgcatatttgctgaacttctcactggaaggccactatttcctgggaagaatgttgtacaccaattagatattataacagatcttcttgggactccatcatctgagaccttatcccggattcgaaatgagaaggccaggagatatttgagctgcatgcggaaaaaatatcccgtgccctttactcataaatttcgacatgctgatcctttggctcttcgtcttctagagcgtttgcttgcatttgatcctaaagaccggcctagtgcagaagaggctctagctgatccatactttgcatcccttgctaatgtggaacgtgagccatcaagacacccgatttctaaacttgagtttgaatttgaaagaaagaagctggccaaagatgatgttagagaactgatctatcgagagattttggagtatcatccacagatgctggaggagtacatgaaaggcggagaacagattagcttcctctatccaagcggagtcgaccgcttcaaactgcagttcgctcatcttgaggagcattacagcaaaggagaaagaggttccccactgcaaagaaagcatgcttccttaccaagggaaagagtggttgtatccaaggatggcaatactgaacaacaaattaatgaccaggagagaagcgcagattctgttgcccgcactaccgtgagccctccaaggtcagaggatgctgacatggatgatgtgaaacccacaagcttaagctctcggagctacctgaagagtgcaagcataagcgcttccaagtgcgtcgttgtcagaaataaacacccagagccagaggatgatggaatacctgaggagatggaaggcaccgtcgatggattgtctgaaaaggtctccaggatgcactcctaaggcaggactgtccatggcgacagcaatctcgacacaagatttctgtctggtgcactgtaatgccgacgacacactgtttggatcttgtgtacacccacagctagttcaactaagatgtagcactagttcgtccatggaggaagcagaatggacgatgaagtgtggtcagcctgtcgaccatgaggtgttttcttccaatggagtctagggtatgtttgagttctacaacggcttgtgccgtacgaagtgtcagcagtgtacgaggaggaggatatcgttgtcagtacacattttgcctgtctagaaaattatgagtactttctccgatcaa

SEQ ID NO: 1686 - DNA, 2344 bp, Zea mays
atcgttttccgtcctccagtccgtcaatccagtccccatccccacggcgccgacgactcgggggcttcccccccttggacttggcccgggtgggagtagcacgtcggggaagggaagcaagcgtccgcgagtaaggacagaaaaccgaagggaggagtggagaggaggagcttgcttggagcgggtggacgggtggtgtgtatatagttaagcgggcgggcgggcagccaatgccgtcgggcgcgcagggctaggagcatgggcggagggggcgcgatcgtgcacggcttccgccgctggttccaccgccggagcgaaggctccacctccaactccaaccagccgtccctcgccggcgagggggaagcggacgacggctcatccgatctcgaggtcatcgaggacccggatctcctcggcctccgcgccatccgcgtgcccaagcgcaagatgccgctgcccgtcgagagccacaggaagaactcagtagaaatggagttcttcacagagtacggagaggcaagccagtaccagatccaagaagtcattggtaaagggagctacggagtagttgctgcagctgtggacacccgcaccggtgagcgggttgctatcaagaagatcaatgatgtgtttgagcacgtctcggatgccacacgcatactgcgggagatcaagctcctccggttgcttcgtcacccagacatagtcgagattaagcacatcatgctccctccttctcggagggagttccaagacatctatgttgtttttgagctcatggagtcggatctccatcaagtgatcagggcgaatgatgacctcacccctgaacatcaccagtttttcctgtaccaacttcttcgagctctcaagtacatacatgccgctaatgtattccatcgtgatctaaagcccaagaatatactggctaactcggactgcaaactgaaaatatgtgactttggacttgcccgtgcatcattcaatgatgccccttcagctatattttggacagactatgtggcaacaaggtggtaccgggcacctgaactatgtggttcctttttctccaaatacactcctgcaattgatatttggagcattgggtgcatatttgctgaacttctcactggaaggccactatttcctgggaagaatgttgtacaccaattagatattataacagatcttcttgggactccatcatctgagaccttatcccggattcgaaatgagaaggccaggagatatttgagctgcatgcggaaaaaatatcccgtgccctttactcataaatttcgacatgctgatcctttggctcttcgtcttctagagcgtttgcttgcatttgatcctaaagaccggcctagtgcagaagaggctctagctgatccatactttgcatcccttgctaatgtagaacgtgagccatcaagacacccgatttctaaacttgagtttgaatttgaaagaaagaagctggccaaagatgatgttagagaactgatctatcgagagattttggagtatcatccacagatgctggaggagtacatgaaaggcggagaacagattagcttcctctatccaagcggagtcgaccgcttcaaactgcagttcgctcatcttgaggagcattacagcaaaggagaaagaggttccccactgcaaagaaagcatgcttccttaccaagggaaagagtggttgtatccaaggatggcaatactgaacaacaaattaatgaccaggagagaagcgcagattctgttgcccgcactaccgtgagccctccaaggtcagaggatgctgacatggatgatgtgaaacccacaagcttaagctctcggagctacctgaagagtgcaagcataagcgcttccaagtgcgtcgttgtcagaaataaacacccagagccagaggatgatggaatacctgaggagatggaaggcaccgtcgatggattgtctgaaaaggtctccaggatgcactcctaaggcaggactgtccatggcgacagcaatctcgacacaagatttctgtctggtgcactgtaatgccgacgacacactgtttggatcttgtgtacacccacagctagttcaactaagatgtagcactagttcgtccatggaggaagcagaatggacgatgaagtgtggtcagcctgtcgaccatgaggtgttttcttccaatggagtctagggtatgtttgagttctacaacggcttgtgccgtacgaagtgtcagcagtgtacgaggaggaggatatcgttgtcagtacacattttgcctgtctagaaaattatgagtactttctccgatcgaaaaaaaaaaaaaaaa

SEQ ID NO: 1687 - DNA, 2542 bp, Zea mays
gctttgcatccgccaatctgcttgccatcagcccccacgggccacggcgccgacgactcagcatcccgccttggacttggacgggatcagcacgtcggtcggggaagcaagtgtccagtccatccatccgcgaccgcgagtaggaacagtaactgacggcggcaagggagtagaggagggacgggacacgggaagagaggaggagcttgcttggacagccggtggactggtgctggtatatagatagctactagaggtaggcgggcgggcgggcggccaatgctgtcaggcgcgtagggctaggagcatgggcggagggggcgcgatcgtccacggcttccgccgctggttccaccgccggagcggctccacctccaatcagtcgtccatcgccggcgacggcgagggggaggcggacggcggctcgccggatctcgagatcgtcgatgacccggatctcctcggcctccgcgccatccgcgtgcccaagcgcaagatgccgctccccgtcgagagccacaggaaggactcggtggaaatggagttcttcaccgagtacggagaggcaagccagtaccagatccaagaagtcattggtaaaggcagctacggggtagttgctgcagctgtagatacccgcaccggtgagcgggttgctatcaagaagatcaacgatgtgtttgagcatgtctcggacgccacacgcatactgcgggagatcaagctccttcggttgcttcgtcacccagacatagttgagattaagcacatcatgctccctccatctcggagggagttccaagatatttatgttgtttttgagctcatggagtctgatctccatcaagtgatcaaggccaatgatgacctcacccctgaacatcaccagtttttcctgtaccaacttcttcgtgctctcaagtacatccatgctgctaatgtatttcatcgtgacctaaagcccaagaatatactggctaactcggactgcaaactgaaaatatgtgactttggtcttgcccgtgcatcatttaatgatgccccttcagctatattttggacagattatgtggcaacgaggtggtaccgggcacctgaactatgtggttcttttttctccaaatacactcctgcaattgatatttggagcattgggtgcatatttgctgaacttctcactggaaggccactatttcctgggaagaatgttgtacaccaattagatattataacagatcttcttggaactccatcatctgagaccttatctcggatccgaaatgagaaggccaggagatacttaagctgcatgcggaaaaaatatcccgtgccctttactcataaatttcgaaatgccgatcctttggctcttcgtcttttagagcgtttacttgcatttgatcctaaagatcggcctactgcagaagaggctctagctgatccatactttgcatcccttgctaatgtggaacgtgagccatcaagacacccaatttctaaacttgagtttgaatttgaaagaaggaagctggccaaagatgatgttagagaattgatctatcgagagattttggagtatcatccacagatgctggaggagcacatgcaaggtggagaacagattagcttcctctacccgagtggagttgatcggttcaaacggcagtttgcacatcttgaggagcattatagcaagggagaaagaggttctccactgcaaagaaagcatgcttctttaccaagggaaagagtggttgtatcgaaggacggtgatactgatcaacatattaatgaccaggagagaagtgcagattctgtcgcccgcaccactgtgagccctccaaggtcagaagacgacgacatgagcgatgtgaaatccacaagcttaagctctcggagctacctgaagagtgcgagcataagtgcttccaagtgtgtcgttgccacgaagaaacacccggaggacgatggaatcgctgaggaaatggaaggcgccgtcaatggattgtctgaaaaggtctccaggatgcactcgtaagcaggactgcccctggcaacagcaaccttgttgcaaggtttctgtctctggtacactgtattccgacgacagccttggaaaggcaaacactgtatgtcacacagcagtacagcacactgtgctgcgaggttgggttttgcttgcgtacatccatccacagctagttcgactttacctgggtggaagaggaacacaccaccgcctgatggccctttcttcatcgtctgcatttccaccgtgtcatgccagcgctgcgtggcacctctagaaggtagaagccctgcatggattcatgaagaattcctaagatgtagcactagtcagtgcatggaggaaacatagtcggcctgtcgaccatgagatgttttcttgcaaatggagtctggacctatggttttcagttttattacaacggcttctgccgtaggaagtgtcagcagtgtatcatccctgtaatacccaatttataagagaccatataaaaggagaaaaatcatttgcttt

SEQ ID NO: 1688 - DNA, 2451 bp, Oryza sativa Japonica Group
atcaccaccaccaccaccatcgctttcttcctcctcgccttctgcttctgcatccatccatccatccattactcgccgaagacttcgcgcggggagagaggaggcaagcttggtcgcgggaacgcgggaagaaaggtccgagcttggaaggagaagaagaagtagccaagaacgcgagagcttggaaggcgagctgcggtggtgtagctagccaatgccggcggggaactggtagggagggggatggggggagggggcacgctcgtcgacggattccgccgcctcttccaccgccgcacggcgtccggctccaaccagtcgtccaacgccggcgaggaggccgcctcctccgacctcgaggtcgccgacgacccggatctcgtcgccctccgctccatccgcatccgcgtgcccaagcgcaagatgcctctccccgtcgagagccacaagaagaacacagtggaaatggagttcttcactgagtatggagaagcaagccagtaccagatccaggaagtcattggcaaaggaagttatggagtagttgctgctgcagtagatacccgcacgggtgagcgggttgcaatcaagaagatcaatgatgtgtttgagcatgtatcagacgctacgcgcatattgcgtgagatcaagctccttcgtctgctccgtcacccagacatagttgagatcaaacacattatgcttcccccttctcgaagggagttccaagatatttatgttgtttttgagctcatggaatcagatctccatcaagtcatcagagcgaacgatgacctcaccccggagcactaccagtttttcctgtaccaacttctccgtgctctcaagtacatccatgcagctaatgtatttcatcgcgatctaaagcccaagaatatactggcaaactcagactgcaaattgaaaatatgtgatttcggacttgcccgagcatcattcaatgatgccccttcagcaatattttggacggattatgttgcaacgaggtggtaccgagcacctgaattatgtggctcatttttctccaaatacactcctgcaattgatatttggagtattgggtgcatatttgctgaacttctcactgggagaccactatttcctgggaagaatgttgtgcaccaattagatattataacagatcttcttggaactccatcatcagaaaccttatccaggattcgaaatgagaaggccaggagatacttgagcaccatgcggaaaaaacatgctgtccccttctctcagaagttccgcaatactgaccccttggctcttcgtctgctagagcgtttactggcatttgatcctaaagatcggtcttcagctgaagaagctttggctgatccgtacttcgcaagtcttgctaatgtggaacgtgagccctcaagacatccaatctcaaaacttgagtttgaattcgagagacggaagctgacaaaagatgatgttagagaattaatttatcgagagattttggagtatcacccacagatgctgcaagagtatatgaaaggtggagagcagattagcttcctctatccaagtggggttgatcgcttcaaacgacagtttgcacaccttgaggagaactacagcaaaggagaaagaggttctccactgcagaggaagcatgcttctttaccgagggagagagtaggtgtatcaaaggatggttataaccaacaaaacaccaatgaccaagagaggagtgcagattccgttgcccgcactacagtaagccctccaatgtcacaagatgcacaacaacatggatctgctggccaaaatggtgtgacatccacagacttgagttcgaggagctatctgaagagtgcaagcattagtgcttccaagtgtgtcgctgtcaaggacaataaagaaccagaggatgattacatctctgaagaaatggaagggtcggtcgatggattgtctgaacaagtctccaggatgcactcctagtgcacaacgatgacgatgatcagtgcaagattctgtgaggcgcaccagatgctgataatttccaagcagaatgctgcactgcaagtttggactttggacaatgcaagtatgcaacagccagcccgagatgattggcatcttcttatgctcatccatgttcacatattcttcttgccattgtgctgtctgtcactacaggacccctgcatggattaatgtattatccctctgatgtaacactagattagtccatctgtccatggaggaatgaatagcaagcagccagcttgtgcatcatgtgggcatgttcattttccagtgagatctagtcatatccatgctttttttgtaatggtatatgaaacagtttatcagtgagactctggtccattcctctttgaagaactgctgagacagtgatccattcctctttgaagaactgttcattttcagtacattaagcct

SEQ ID NO: 1689 - DNA, 2356 bp, Triticum aestivum
ggcgagggccgaaaaaggagagaaaattccttccgccccgcccccaaatcgcgccgggcagtataagagcagagcagaccccgccgtttgcgccccgcatccaatccgtccgtcctcagcgccgacgacaccgccggggacagcgcggcggagagagtgagtgagctgccttgagtggcggcgggagggggagaggcaagaggacgaggaggaggaggaggagctgtgggctgtggctggaggaggcggctagcagctagccaatgccgcaggggtagggaggggatacatggggggagggaacggcatcgtcgacggcttccgccgcttgttccaccgccgcacgccctccggctccgtgctcggcagttccaaccagtcctccgccggcgaggactcctccgacgtcgaggccgccgagggcctggatctcgtgggcctccgctccatccgcgtccccaagcgcaagatgccgctccccgtcgagagccacaagaagaacataatggagaaagaattcttcacagagtatggagaggcaagccagtaccaaatccaagaagttgttggcaaggggagttatggagtagttgctgctgcaatagatacccgcaccggcgagcgggttgcgattaagaagatcaacgatgtgtttgagcacgtctcggatgccacgcgcatcctccgcgaggtcaagctccttcggctgctacgtcatccagacgtggtggagatcaagcacataatgctccctccttctcggagggagttccaagatatatatgttgttttcgagctcatggagtcggatctccatcaggtcatcagagctaatgatgacctcacggcggagcattaccagtttttcctttaccagcttctccgcgctctcaagtacatccatggagctaatgtatttcatcgcgatctgaagcccaagaatatactggccaacgcagactgcaaactgaaaatttgtgactttggacttgcgcgtgtatcatttaatgatgctccttcagctatattttggacggactatgtagcaacaaggtggtatagagcccctgaattatgtggctcctttttctcgaaatacactcctgctattgatatttggagtattggatgcatatttgctgagcttctcactggacggccactctttcctgggaagaatgtcgtacaccagttagatataataacagatcttcttggaactccatcatcagaaaccttatctcggattcgaaatgagaaggccaggaggtacttaagttgcatgcgaaaaaaacaccctgtacccttgactcagaaatttcctaatgctgatccattggcggttcgcctactgggtcgtttacttgcatttgaccctaaagaccggccttcagctgaagaggctttagcagacccatattttgcatctcttgccaatgtggagcgtgagccatcaaggcatccaatttcgaaactcgagtttgagtttgagagacgaaaggttacaaaagatgatgttagggaattgatctatcgagagattttggagtaccatccacagatgctggaggaatacatgaaaggtggagaccagattagcttcctctatccaagtggtgttgaccgctttaaacggcagtttgcacacctggaggagcattacagcaaaggagaacgaggttccccgctgcaaagaaagcatgcttctctaccaaggcagagagtaggtgcatcaaacgacggtaataatgaacagcatattagtgatcaggagatgagtgcagagcctgatgcccatggcacagtgagccctcaaaagtcacaggatgcagccggtgttggccagaatggtctgagccctaccagcttgagctcgcggacctacctcaagagcgcgagcattagtgcttccaagtgcgtcgttgtcaacccgaataaacagccagagtatgacgacgcgatctctgaggaaacggaaggggccgtcgacggactatccgagaaggtctccaagatgcatgcctagtgcagcaacaacgacggaagtcggcaccacatttctcatttctgtcaggtacaccggatgctgatagcaaagcagtgcactgcaagttggagatggtttagcgagtgcatgttcctgtcaagcgtcgttgctgcacgcaggggctggccctgcatggattgatgtatttttacactcaagctcgcaatgtaacaccgagatttgttgttctctagcatctactactatacgtgattgcaacgaacggaccaagacatctgatgaacacttgtcatgtttccctgtcgaacatccttaatatatcaagaagcgttgctgctctgcatctaa

SEQ ID NO: 1690 - DNA, 2000 bp, Triticum aestivum
gaggaggagtaggaggagctgtgggctgtggctggaggaggcggctagcagctagccaatgccgcaggggtagggaggggatacatggggggagggaacggcatcgtcgacggcttccgccgcttgttccaccgccgcacgccctccggctccgtgctcggcagctccaaccagtcctccgccggcgaggactcctccgacgccgaggccgccgaggacctggatctcgtgggcctccgccccatccgcgtccccaagcgcaagatgccgctccccgtcgagagccacaagaagaacataatggagaaagaattcttcacagagtatggagaggcaagccagtaccaaatccaggaagttgttggcaaggggagttatggagtagttgctgctgcaatagatacccgcaccggcgagcgggttgcgattaagaagatcaacgatgtgtttgagcacgtctcggatgccacacgcatcctccgcgaggtcaagctccttcggctgctacgtcatccagacgtggtggagatcaagcacataatgctccccccttctcggagggagttccaagatatatatgttgttttcgagctcatggagtcggatctccatcaggtcatcagagctaatgatgacctcacggcggagcattaccagtttttcctttaccagcttctccgtgctctcaagtacatccatggcgctaatgtatttcatcgcgatctgaagcccaagaatatactggccaacgcagactgcaaactgaaaatttgtgactttggacttgcgcgtgtatcatttaatgatgctccttcagctatattttggacggattatgtagcaacaaggtggtacagagcccctgaattatgtggctcctttttctcgaaatacactcctgctattgatatttggagtattggatgcatatttgccgagcttctcactggacggccactctttcctgggaagaatgttgtacaccagttagatataataacagatcttcttggaactccatcatcagaaaccttatctcggattcgaaatgagaaggccaggaggtacttaagttgcatgcggaaaaaacaccctgtacccttgactcagaaatttcctaatgccgatccattggcggttcgcctactgggtcgtttacttgcatttgatcctaaagaccggccttcagctgaagaggctttagcagacccatattttgcatctcttgccaatgtggagcgtgagccatcaaggcatccaatttcgaaactcgagtttgagtttgagagacgaaaggttacaaaagatgatgttagggaattgatctatcgagagattttggagtaccatccacagatgctggaggaatacatgaaaggtggagaccagattagcttcctctatccaagtggtgttgaccgctttaaacggcagtttgcacacctggaggagcattacagcaaaggagaacgaggttctccgctgcaaagaaagcatgcctctttaccaaggcagagggtaggtgcatcgaacgacggtaataatgagcagcatattagtgatcaggagatgagtgcagagcctgatgcccatggtgcagtgagccctcaaaagtcacaggatgcacccggtgttggccagaatggtctgagccccaccagcttgagctcgcggacctacctcaagagcgcgagcattagcgcttccaagtgcgtcgttgtcaacccgaataaacagccagagtatgacgacgcgatctctgaggaaacagaaggagccgtcgatggactatccgagaaggtctccaagatgcatgcctagtgcagcaacgacgacggaagtcggcaccgcatttctcatttctgtcaggtacaccggatgctgatagctgatagcaaagcactgcaagttggagatggtttagcggagtgcatgttcctgtcaagcgtcgttgctgcacacaggagctggccctgcatggattgatgtatttttacact

SEQ ID NO: 1691 - DNA, 2153 bp, Triticum aestivum
gaggaggaggaggaggagctgtgggctgtggctggaggaggcggctagcagctagccaatgccgcaggggtagggaggggatacatggggggagggaacggcatcgtcgacggcttccgccgcttgttccaccgccgcacgccctccggctccgtgctcggcagttccaaccagtcctccgccggcgaggactcctccgacgtcgaggccgccgagggcctggatctcgtgggcctccgctccatccgcgtccccaagcgcaagatgccgctccccgtcgagagccacaagaagaacataatggagaaagaattcttcacagagtatggagaggcaagccagtaccaaatccaagaagttgttggcaaggggagttatggagtagttgctgctgcaatagatacccgcaccggcgagcgggttgcgattaagaagatcaatgacgtgtttgagcacgtctcggatgccacacgcatcctccgcgaggtcaagctccttcggctgctacgtcatccagacgtggtagagatcaagcacataatgctccccccttctcggagggagttccaagatatatatgttgttttcgagctgatggagtcagatctccatcaggtcatcagagcgaatgatgacctcacagctgagcattaccagtttttcctttaccagcttctccgcgctctcaagtacatccatggggctaatgtatttcatcgcgatctgaagcccaagaatatactggccaacgcagactgcaaactgaaaatttgtgactttggacttgcgcgtgtatcatttaatgatgctccttcagctatattttggacggattatgtagcaacaaggtggtacagggcccctgaattatgtggctcctttttctcgaaatacactcctgctattgatatttggagtattggatgcatatttgccgagcttctcactggacggccactctttcctgggaagaatgtcgtacaccagttagatataataacagatcttcttggaactccatcatcagaaaccttatctcggattcgaaatgagaaggccaggaggtacttaagttgcatgcgaaaaaaacaccctgtacccttgactcagaaatttcctaatgctgatccattggcggttcgcctactgggtcgtttacttgcatttgatcctaaagaccggccttcagctgaagaggctttagcagacccatattttgcatctcttgccaatgtggagcgtgagccttcaaggcatccaatttcgaaacttgagtttgagtttgagagacgaaaggtgacaaaagatgatgttagggaattgatctatcgagagattttggagtaccatccacagatgctggaggaatacatgaaaggtggagaccagattagcttcctctatccaagtggtgttgaccgctttaaacggcagtttgcacacctggaggagcattacagcaaaggagaacgaggttctccgctgcaaagaaagcatgcctctttaccaaggcagagggtaggtgcatcgaacgacggtaataatgagcagcatattagtgatcaggagatgagtgcagagcctgatgcccatggtgcagtgagccctcaaaagtcacaggatgcacccggtgttggccagaatggtctgagccccaccagcttgagctcgcggacctacctcaagagcgcgagcattagcgcttccaagtgcgtcgttgtcaacccgaataaacagccagagtatgacgacgcgatctctgaggaaacagaaggagccgtcgatggactatccgagaaggtctcaaagatgcatgcctagtgcagcaacgacgacggaagtcggcaccgcatttctcatttctgtcaggtacaccggatgctgatagctgatagcaaagcactgcaagttggagatggtttagcggagtgcatgttcctgtcaagcgtcgttgctgcacacaggagctggccctgcatggattgatgtatttttacactcaatgtaacactgggattagttcctacacctatcatctatgcatgattgtaacaacgaacagagcaagacatcttgacgctgtcatgtttcgctgtcgaaaattcttaatatatcaagaagcgttactgctgtgcaaaaaaaaaaaaaaaaaa

SEQ ID NO: 1692 - DNA, 1748 bp, Triticum aestivum
gatacatggggggagggaacggcatcgtcgacggcttccgccgcttgttccaccgccgcacgccctccggctccgtgctcggcagctccaaccagtcttccgccggcgaggactcctccgacgtcgaggccgtcgaggacctggatctcgtgggcctccgccccatccgcgtccccaagcgcaagatgccgctccccgtcgagagccacaagaagaacataatggagaaagaattcttcacagagtatggagaggcgagccagtaccaaatccaagaagttgttggcaaggggagttatggagtagttgctgctgcaatagatacccgcaccggcgagcgggttgcgattaagaagatcaatgacgtgtttgagcacgtctcggatgccacacgcatcctccgcgaggtcaagctccttcggctgctacgtcatccagacgtggtggagatcaagcacataatgctccccccttctcggaaggagttccaagatatatatgttgttttcgagctgatggagtcagatctccatcacgtcatcagagcgaatgatgacctcacagctgagcattaccagtttttcctttaccagcttctccgcgctctcaagtacatccatggggctaatgtatttcatcgcgatctgaagcccaagaatatactggccaacgcagactgcaaactgaaaatttgtgactttggacttgcgcgtgtatcatttaatgatgctccttcagctatattttggacggattatgtagcaacaaggtggtacagggcccctgaattatgtggctcctttttctcgaaatacactcctgctattgatatttggagtattggatgcatatttgccgagcttctcactggacggccactctttcccgggaagaatgtcgtacaccagttagatataataacagatcttcttggaactccatcatcagaaaccttatctcggattcgaaatgagaaggccaggaggtacttaagttgcatgcgaaaaaaacaccctgtacccttgactcagaaatttcctaatgctgatccattggcggttcgcctactgggtcgtttacttgcatttgatcctaaagaccgtccttcagctgaagaggctttagcagacccatattttgcatctcttgccaatgtggagcgcgagccttcaaggcatccaatttcgaaacttgagtttgagtttgagagacgaaaggtgacaaaagatgatgttagggaattgatctatcgagagattttggagtaccatccacagatgctggaggaatacatgaaaggtggagaccagattagcttcctctatccaagtggtgttgaccgctttaaacggcagtttgcacacctggaggagcattacagcaaaggagaacgaggttccccgctgcaaagaaagcatgcctctttaccaaggcagagagtaggtgcgtcgaacgacggtaataatgaacagcatattagtgatcaggagatgagtgcagagcctgatgcccatggcacagtgagccctcaaaagtcacaggatgcacccagtgttggcccgaatggtctgagcccaactagcttaagctcgcggacctacctcaagagcgcgagcattagtgcttccaagtgtgtcgttgtcaacccgaataaacagccagagtatgacgatgcaatctctgaggaaacggaaggggccgtcgatggactatccgagaaggtctccaagatgcatgcctagtgcagc

SEQ ID NO: 1693 - DNA, 3564 bp, Oryza sativa Japonica Group
atctcccccttccttccctacaccgaaagcccgaaacccaccttgcctcgcctcgcctcgccggatccagatctccaccgcctcgcctcgccgcgccgccaccaacccactcgccgtcgccgtcgccggcggcggatcggccccacatcacctcggcctccccgagcaaaccggcgggggacgcccccgggcaacgggcgggcgaagaggggcgcaatggagcagctgcggacgatcgggcgggagctggcgatggggtcgcagggagggtgggggcagtcgaaggagttcctcgaccttgtcaagtccatcggcgaggcgcggtccaaggcggaggaggaccggatcatctcgcgggagctggatcacctcaagcgccgcctcgccgaccccgacgtgccccgccggaagatgaaggagctcctcctccgcctcgtctacgccgagatgctcggccacgacgcctccttcggccacatccacgccgtcaagatgacccacgacgagtccctcccgctcaagcgcacgggctacctcgccgtctccctcttcctcgacgagcgccacgacctcgtcatcctcgtcgtcaacaccatacagaaggacctcaggtccgacaactacctcgtcgtctgcgccgcgctcaccgccgcctgccgcctcatcggggaggaggccatcccggccgtgctgccccaggtcgtcgagctgctcgcgcatcccaaggaggccgtgcggaagaaggccgtcatggcgctccaccgattctaccagcgatccccctcatccgtctctcaccttgtctccaacttccgcaagaggctctgtgataatgatcctggggtcatgggtgcaactttatgccccctctatgacctgattttggaagatccaaattcgtacaaggatttggttgttagttttgttaacatcctcaaacaagttgcagagaggaggcttccaacttcctatgattaccaccaaatgcctgcaccatttattcagattaaactattgaaaatacttgcggtgctgggtagcggtgataagcaggcaagtggaaatatgtacatggtcttgggtgacatattcaggaagggtgacactgcaagcaacattggcaatgcaatattgtatgagtgcatatgctgtatttcatccatattcccgaacgctaagatgcttgatgctgcagctgaaacaacatcaaagtttctgaagagtgatagccataatcttaagtacatgggcattgatgctcttggccggttaattaaaataaatccagatatcgcagaagagcaccagctggctgttattgattgcttagaggatcctgatgacactttgaaacgcaagaccttcgagcttctttacaagatgacaaaatcaacaaatgttgaagtgattgttgatcgaatgattgagtatatgattaacatcactgatcaccattacaagacagaaattgcatctcgttgtgttgagctagcagaacaatttgcacctagcaatcagtggttcatccagaccatgaacaaagtctttgagcatgctggagatcttgtcaacatccgagttgcacataatttaatgcgacttattgctgaaggctttggagaggaggatgaaggtgctgatagccaactaagatcgtcagctgtagattcctatctacggattgttggggagccaaagcttccttcttcgtttctgcagataatatgctgggttttgggagaatatggaacagcagatgggaaatattcagcttcatatattattgggaagctgtatgatgtggcagaggcccacccaactgatgacactgtcagggcttatgcaatctccgcaattttgaagatctttgcgtttgaaatcgctcttggaaggaagatcgatatgctacccgagtgccaatcgttgatagatgaattgtcagcttcgcattcaacagacttgcagcagcgtgcatatgagctacaggctttgctaggtttggacaaacaggctgttgagaatgtaatgccagccgatgcaagctgcgaagatattgagatcgacagaaacctctcgtttctaaatggttatgtgcagcaagccattgaaaatggtgctgcaccctacattcctgagagtgaacgctcaggagtggtaagtgttggcaactacaaggcccaggatcaacaagagacatctgcccatgctcttagattcgaggcctatgagctacctccagcagcttcacaggccagtatttccccaactactgacctggttccagttccagaaccaagctactataaggaagatcaccaaatgtcaagatcccagccatcaggcgattctctttctggtgaatttggtctcaaacttcgtcttgatggagttcagaagaaatgggggagaccagcctattcctcctcatctacgccttcaagttcaacatctagtcaacaagcaaccaatggaggcgttagttctgaggtgggagggtcaacaagttcacaggctcgggaatccacatatggttccaagagacagcaggccactgaagtttcagcggaaaagcaacggttggctgcttcactctttggtaaagctgataggaagacccaggctgggcgaaagacagcaaaggagagttcctcaactgagaaagtagctactgctaatgcaacaccgcagccagccaaagagcaagtaatcccttctgccccaccacctgatcttctggatctgggagagccagtttcatcaagtcctccattagctgatcctttcacacagttagaaggtcttctcggaccagcatcagcctctcctgtggtttctgaaaccccagcttcgagcacttcgaaaacaccagatcttatgtcaatcttttcggatgatgtacaaactggagtgaccagtggatccacagaaccatcactcggggtaaatgtggtcgctgcaaagaagggccctagccttcaagatgccttgcagaaggacgcagcggcccggcaagttggtgtgacgccgacagggaacaaccctattctattcaaggacttgttaggctagaatatacagcatatgttcagcgtgctcaaattgggtaagtggagtttgcctccaagatggtcttgattgcctgatcggtgaaccagtaatgaatgatgctgttcgatcagcacagggcacatgagggcatgaggtaaatttggttttgattcacaggacacgaccttttaccctcccaattgggagaaggtaggtttgggatgagatgtggatggttgcgggtctttttcctgttgcgtttttcacatggtaatttcttgtcgagacttagtgtacatgtgtttattacatgatgtgtaatttgtacatgatgagaccgtggtccagaagcgtgtgccggcgctttttttcggttcatctggcagggagtatatgttttgagatttacccacattggatatacagtagctgctgggcactagaaactcggttgccacttcctctgaaactggctggaataataaaatgtaagttttttcttccccttacgctttc

SEQ ID NO: 1694 - DNA, 3574 bp, Sorghum bicolor
cactcgccgatccagatctcctccacctctccactcccccactccaaccggacgccctccgccgtcgccggcggcggtcgagccacacgcgcgcgccgcagtggaagccggagcgggcgccggcaatggagcagctgcggacgatcgggcgggagctggcgatggggtcacagggcgggtgggggcagtccaaggagttcctcgacctcgtcaagtccattggcgaggcgcgctccaaggcggaggaggaccgcatcatcgcgcgcgagctcgagcacctcaagcgccgccttgcggaccccgacgtgccacgccgcaagatgaaggagctcctcctccgcctcgtctacgccgagatgctcggccacgatgcctccttcggccacatccatgccgtcaagatgacccacgacgaatcgctcccgctcaaacgaaccggctacctcgccgtcgcgcttttcctcgatgagcgccacgaccttgtcatcctcgtggtcaacaccatccagaaggacctcaggtcggacaactacctcgtcgtctgcgcagcgctcaccgccgcgtgccgcctcatcggtgaggaggccatccctgccgtgctgccccaggtcgtagagctgctcgcgcaccccaaggaggctgtgaggaagaaggccgtcatggcactacaccggttctaccagcgatcaccctcctccgtctcccaccttgtctccaacttccggaagaggctctgtgataatgatcccggggtgatgggtgcaactctatgccccctctatgacctgattttggaggaaccaaattcgtacaaggatttagttgttagttttgttaacatcctaaaacaagttgcggagaggaggcttccgacttcctatgattatcaccaaatgcccgcaccgtttattcagataaaactattgaagatacttgctgtgcttggtagtggtgataaacaagcaagtgggcatatgtacaccgtattgggtgacatattcaggaagggtgacactgcgagcaacattggcaatgctatactgtatgaatgcatatgctgtatttcatccattttcccaaaccctaagatgctagaggctgcagcagaaacaacatcaaagtttctgaagagtgatagtcataatcttaagtacatgggcattgatgctcttggccggctaataaaaataaatccagatattgcagaagagcaccagctggctgtcattgattgcttagaggacccagatgatactttgaagcgcaagacctttgagcttctttataagatgacaaagtcaacaaatgttgaagtgattgttgataggatgattgagtacatgatcaatataactgatcatcattacaagacagaaattgcatcacgttgtgttgaacttgcagagcaatttgcgcctagcaatcagtggttcatccagaccatgaacaaagtctttgagcatgctggagatcttgtcaacatcagagtggcacacaatttgatgcggctaattgctgaaggctttggagaggaggatgaaggtgctgacagtcagctaagatcatcggctgtagattcctatctccgcattgtcggagagccaaagcttccttcttcgttcctgcagataatatgctgggttttgggggaatatggaacagcagatggaaaatattctgcatcttatattatcgggaagttgtgtgatgtggcagaggcccacctcactgatgacactgtcaaggcgtatgcgatctcagcaattctgaagatatttgcgtttgaaatcgcacttggaaggaagattgatttgctgcctgagtgtcaaacactggtagatgaattgtcagcttcacattcaacagacttgcagcaacgtgcatatgagctacaggctttactaggcttggacaaaaatgctgttgaaagtgttatgcctgcagatgcaagttgtgaagatattgaggtcgacagaaacctctcatttctaaacagttatgtgcagcaagccttggaaaatggtgcgtccccttacattccagagagtgaacgctctggtgttataagtgttggcagctacagaagccaagaacaacaggaaacatctgcccatactcttagatttgaggcctatgagatgcctaaaccttcgttgccactagcaacttcacaaacaagcatttccacaccaactactgacctggttccagttccagagacaggctactataaggaagaccatcaaacatcaaggtctcaaccaccaggtgatgcagtttctggtgagtttggtgtcaaacttcgccttgatggggttcaaaagaaatggggaaggccaacatattcctcttctacaccctcaagctcgacgtctagtcaacaaactaccaatgggacctctcattccgatgggggagggtcaagttcgcagccacgggagtcctcgtatggttctaagagacagcagggcacagaagtttcagcagaaaagcaacggctggctgcttcactttttggttcggcagcagctaaagctgataggaaagcacaagcttctagaaagacagcaaaggacagtccctcaactgagaaagtagctaccactaatgtgactgcccagcctgttaaggagcaagtaatccctgctgcaccaccgcctgatctgctggatctgggtgatgagccagtttcatcaaatcctccattggctgatcctttctcacagttagaggggcttcttggaccagcatcggctgctccggtgctttctggaactccggctaccggcgcttccaaagcaccagatctgatgtcaatcttctcagatgatgtaccaactggagtggctagtggatccaccgatcccactctaggtgatgttaattcgacgagctcccacaaaggagcaactgcagtggcttcaaagaagggtccaagccttcaagatgccttgcaaaaggatgctactgcacggcaagtaggcgtgacaccaacagggaacaatcccaatctcttcaaggacttgctaggctaaagaggacagtaggacacaccatatgctccgtgtgtctttgggtaaatggagttcatctccaacatggttccatcaatgaaacagtgatgatctcgctgtttgatcagcataggaaaaaaagggttacaagggctatatttgtttgagagtcagaatacacgacctatctcctttccaattgggagggggttgcactgttgagatttgtggatggttgcgggtatttttcctttaacctcttgtaattttgtgctgagactagtgtacatgtgtttacattacatgatgtgtaatttgtacatgagaccgtggtccagaagcgtgtgctggcgcttttttgttcagctgggaggggcctgctcatctgtgcttttatagtttaccatatttgatgattgatatacactacagtagctgggcattggaaagtataataataattggtgtcattatctgtaactgggtggaataaaatgttaaatgtgtaaggttgttggtcgccttgttttagctgataaaaaccgttgccggatttttac

SEQ ID NO: 1695 - DNA, 3451 bp, Zea mays
cccccactcgccgatccagatctcctccactccaaccggacgcctccgccgccgctggcatcggtcgagccacacgcgcacgccgctgaggaacccggagcgggcgccggcaatggagcagctgcggacgatcgggcgggagctggcgatggggtcgcagggcgggtgggggcagtccaaggagttcctcgacctcgtcaagtccatcggcgaggcgcgctccaaggcggaggaggaccgcatcatcgcgcgcgagcttgagcacctcaagcgccgcctcgccgaccccgacgtgccacgccgcaagatgaaggagctcctcctccgcctcgtctacgccgagatgctcggccacgacgcctccttcggccacatccacgccgttaagatgacccacgacgagtcgctcccgctcaagcggaccggttacctcgctgtcgcgctctttctcgacgaacgccacgacctcgtcatcctcgtggtcaacaccatccagaaggacctcaggtcggacaattacctcgtcgtctgcgcagcgctcaccgccgcgtgccgccttatcggtgaggaggccatccctgccgtgctgccccaggttgtagagctgctcgcgcaccccaaggaggctgtgaggaagaaggccgtcatggcactacaccggttctaccagcgatccccctcctccgtctcccacctcgtctccaacttccgcaagaggctctgtgataatgatccaggggtgatgggtgcaactctttgccccctctatgacctgattttggaggaaccaaattcgtacaaggatttggttgttagttttgttaacatcctcaaacaagttgcagagaggagactaccgacttcctatgattaccaccaaatgcccgcaccgtttattcagataaaactattgaagatacttgctgtacttggtagtggcgataaacaagcaagtgggcatatgtacactgtattgggtgacatattcaggaaaggtgacactgcaagcaacattggcaatgctatactgtatgaatgcatatgctgtatttcattcattttcccaaaccctaagatgctagaggctgcagctgaaacaacatcaaagtttctgaagagtgatagtcataatcttaagtacatgggtattgatgctcttggccggctaataaaaataaacccagatattgcagaagagcaccagctagctgtcattgattgcctagaggatccagatgacactttgaagcgcaagacctttgagcttctttataagatgacaaaatcaacaaatgttgaagtgattgttgataggatgattgaatacatgatcaacataactgatcatcattataagacagaaattgcatcacgttgtgttgaacttgcagagcaatttgcgcctagcaatcagtggttcatccagaccatgaacaaagtctttgagcatgccggagatcttgtcaacatcagagtggcgcacaatctgatgcggctaattgctgaaggctttggagaggaggatgaaggtgctgacagtcagctaagatcatcggctgtggattcatatctccgcattgtcggagagccaaagcttccttcttcgtttctgcagataatatgctgggttttgggggaatatggaacagcagatggaaaatattcagcttcttatattattgggaagttgtgtgatgtggcagaggcccacctcactgatgacactgtcaaggcatatgcgatctcagcaattctgaagacatttgcgtttgaaatcactcttggaagaaagatcgatttgctgcctgagtgtcaaacattggtagatgaattgtcagcttcacattcgacggacttgcagcaacgggcatacgagctacaggctttactaggcttggacaaaactgctgttgaaagtgttatgcccgcagatgcaagctgtgaagacattgaggtcgacagaagcctctcatttctaaacagttatgtgcagcaagccttggaaaatggtgcgtccccttacattccagagagtgaacgctctggtgttataagtgtcggcagctacagaagccaagaacaacaggaaacatctgcccatactcttagatttgaggcctatgagatgcctaaaccttcgttgccactagcaacttcacaaaccagcatgtccacaccacctactgatctggttccagttccagaggcaggctactacaaggaagacaatcaaacatcaatgtctcaaccaccaagtgatgcaatttctggtgagtttggtgtcaaacttcgccttgatggtgttcaaaagaaatggggaaggccaacatattcttcttctacaccctcaagctcgatctctagtcaaccaacacccaatggggcctctcattctgatgggggagggtcaagttcgcaaccacgggagtcatcatacggttctaagagacagcagggcacggaagtttcagcagaaaagcaacggctggctgcttcactttttggttcagcagcagctaaagctgataggaaagcacaagcttctcgaaagacagcaaaggacagtccctcaactgagaaagtggctaccactaatgtgactgcccagcctgttaaggagcaagtaatccctgctgcaccaccgcctgatctgctggatctgggtgatgagcctgtttcatcgagtccaccgtcggctgaccctttctcacagctagaggggctccttggaccagcatcggctgccccggtgctttctggaactccggctaccagcacttccaaagcaccaggccttctgtcaatcttctcagatgatgtaccaaccggagtgactagtgtgtccaccgatcccactctaggtgatgttaattcgatgggctcccgcaaaggagcagctgcagtggcttcaatgaagggcccgagcctccaagatgccttgcaaaaggatgcggctgcacgacaagtaggagtgacaccaacagtgaacaaccccaatcttttcaaggacttgctaggctgaaggggacagtagggcacaccatatgctctgtgtggcctctttgggtacgtggagttcgtctccgacatggttcgatcaccgaaacgacgccgaactcgctgtttgatcagcgtaggctggggttttagggttacaagggctaatatttgtttgagagtcacaagacacgacctatctccttccaattgtggtttgtggagatttgtggatggttgcgggtattttttttcctttacgctcttgtaattttgtcctgagactggtgtacatgtgtctacatgatgtgtaatttgtacatgaagaccatggtccgtccagaagcgtatgccgtcgtctttttgttcattcatgtaggaggggcatgctcatctgtgctttcagagtttcccatatatgttgattaatataacaattgatgtcattctctgg

SEQ ID NO: 1696 - DNA, 3566 bp, Hordeum vulgare subsp. vulgare
ggccgatcttccccttctacccccgacgaaacccacctccccccctacccggccgatccagatctccactccctcacacctcccccgccccccctcaccggagactcccgtcgccggcggccaccgaccggcctccgccccctccgcatctcccggcgggcggacgcacgcaatggagcagctccggacgatcgggcgggagctggcgatggggtcgcagggcgggtgggggcagtcgaaggagttcctggacctggtcaagtccatcggcgaggcgcgctccaaggcggaggaggaccgcatcatctcccgcgagctcgagcacctcaagcgccgcctcgccgaccccgacgtcccgcgccgcaagatgaaggagctcctcctccgcctcgtctacgccgagatgctcggccacgacgcctccttcggccacatccacgccgtcaagatgacccacgacgagtccctcccgctcaagcgcaccggctacctcgccgtcgcgctcttcatcgacgagcgccacgacctcgtcatcctcgtcgtcaacaccatccagaaggacctcaggtccgacaactacctcgtcgtctgcgccgcgctcaccgccgccagccgcctcatcggcgaggaggccatccccgccgtcctgccccaggtcgtcgatctcctcgcgcaccccaaggagtccgtcaggaagaaggccgtcatggcgctccaccgattctaccagcgatccccttcctccgtttcccacctcgtctccaacttccgcaagagactctgtgataatgatcctggggtgatgggtgcaactctgtgcccactctatgacctgattttggaagatccaaatgcctacaaggatttagttgttagttttgttaacatcctcaaacaagttgcggagaggaggcttccgacttcctacgattaccatcaaatgcccgcaccattcattcagataaaactactgaaaatacttgctgtgctgggtagcggcgacaagtcagcgagtggtcatatgtacactgtcttgggcgacatattcaggaagggtgacacagcaagcaacattggcaatgcaatattgtatgaatgcatatgctgtgtctcatgcattttcccaaactctaagatgctagatgccgctgctgaaacaacatcgaaatttttgaagagtgatagccataatcttaagtacatgggaattgatgctcttggacgactaataaagataaatgctgatattgcagaacagcaccaattggctgttatcgattgcttagaggatcccgatgacactttgaagcgcaagacctttgagcttctttataagatgactaaatcaactaatgttgaagtgattgttgatcggatgatcgagtacatgatcagcataactgatcaccattataaggcagaaattgcatcgcggtgtgttgagctagcagaacaatttgcgcccagcaatcagtggttcattcagaccatgaacaaagtctttgagcatgctggggaccttgtcaacattagagtggcgcacaatttaatgcggcttattgctgaaggatttggagaggaggatgaaggtgccgatagtcaattgagatcatcagctgtcaattcctacctccggattctgggggagccaaagcttccatcctcatttttgcagatcatatgctgggttttgggggaatatggaacagcagatgggaagcatcctgcttcttatattatcgggaagttatgtgatgtggcagaggcccacccaactgatgacactgtcaggggttatgcagtctcagcaattttgaagatatttgcatttgaaattgctgttggaaggaaatctgatatgttgcctgagtttcagtcattggtagatgaattgtcatcttcacattcgacagacttgcagcagcgtgcatatgaggtacaagccttgctaggcttggacaaacaggctgttgaaagtgtaatgcccatagatgcaagctgtgaagatattgaggtcgatagaaacctctcatttctgaacagctatgtgcagcaagccttggaaaatggtgcgacaccttacattcctggaagtgaacgctcaggtgttgtaagtgtcggtaactacagagcccaagaccaacatgagacatctgctcatgctcttagatttgaagcctatgagctacctaaaccttcactacctacagcaacctcacaaagtagtgtttccctgccaactactgaccttgttccagttccagaaccaagtcactatagggaagaccatcatcagacaaggtcccagccatcaggcaatgcagtttctggtgaatttggtgccaaacttcgtcttgatggggttcaaaagaaatggggaagggaatcctatgcctcctcttctacaccttcaagctcggcatctagccaacaaccagccaatgggggctctaactctgacgggggaggcttggtaacttcacaggcacgggagtcctcgtatggttccaagacccagccgggaacagaagtttcagcagaaaagcaacggctggctgcttcactttttggttcctcagctgctaaacctaatcggaagggacatgctggtcggaaggcaacaaaagagagttcctcgactgagaaagcagcacctcagcctgctaaggagcaagtaacccctgctgctccaccaccagatctgttggaccttggtgaagagcctgtttcatcaagtgctccatctgctgaccccttctcgcagttggacgggctccttgggccagcatcagcctctcccgcgcttgccggaacctcagctcccagcgcttcaaacacaccagaccttatgtccatcttctcggatgatgtgcaaactggagccacaagtgcatccacagaacccgcacaaaaaggagcaacgacgaaaaagggccatagccttcaagacgcattgcagaaggacgccaccgcgaggcaggttggcgtgaccccaacagggaacaacccaaatcttttcaaggaccttctaggctagaatataccgcagaatttcagtgtgcacaagttgggcaaaatgaggctgcccccaagagggtcttgtcggtgaacggctgcttgatcagcacaggagcaagcggtgtatttggtttttgagtcgcaaggcacgaccttccttgtccaagttgggaatggggttgatgggcggacgtgtctgcggggtaattttcctgtcgcgtttttttcgcatggcaaaaattcgtgtcaagacttagtgtgtacatgtgtttattacatgatgtgtaatctgtacatgatgatgagtcccagggtccagaagcgtttcttttgttgagctcgagggagggggggagggcctgtggtgtcgagtcgatgtttgttattttacccatattggacatacacagtagactggacactggaaaactagaaataccttgtgttgtcaattccttttagaactgggcggaataaaatgtaagtttatcattgacgagagacacattgtggcctcctggtgtgaagtttaattccttgtttggttc

SEQ ID NO: 1697 - DNA, 3367 bp, Populus trichocarpa
atggagcaactaaaaacaataggaagggagctggcgatggggtctcagggaggattcggccaatccaaagaattcctcgatctcgtcaaatcaatcggcgaggctcgatctaaggccgaagaagatcgaattgtccttcgggagatcgaatccctcaaacgacgcatcgttgaacccggcatccctaagcgcaagatgaaggagtacataatccgtttagtctacgtcgagatgctcggccacgacgcgtcgttcggatacatccacgccgttaaaatgactcatgacgacaatttggtcctcaaacggactggttacttggccgtcactttgttcttgaacgaagatcatgatctcattatcttgattgtcaatacgatacagaaggacttgaaatcggacaattatttggttgtttgtgcggctttgaatgccgtttgtaagttgatcaatgaggagaccatacctgctgtattgccgcaagtggttgagttgttagggcattctaaggaggctgttaggaagaaggccattatggctcttcatcgcttctatcataagtctccgtcctctgtttcacatctcctttccaatttccgcaagaagctttgcgatagtgatcctggcgtaatgggtgcaacactctgcccactttttgatcttataacaatagatgcgaattcttataaggatttagtggtcagcttcgtcagcattcttaaacaagtagctgaacgcagattgccaaaggtttatgactatcatcagttgccagctccgttcattcagatcaggttgctgaaaattctagccttgctaggaagtggtgacaagcaagcaagcgagcacatgtatactgttgtgggtgacatattcgggaagtgtgactcatcaagtaatataggaaatgctgtcctttatgagtgtatatgttgtgtttcttcaatacatcccaatcctaagctattagaagctgctgccgatgtaatagcaagatttttgaagagtgacagtcacaatctgaaatatatgggcattgatgcccttggtcgattgataaaacttagtccagagattgctgaacaacaccaattggctgtgatagattgcttagaggatccagatgatactttgaagagaaaaacatttgagctcctgtataaaatgactaaatcctctaacgtggaagtgattgttgaccgcatgattgattacatgattagcattaatgacaatcattacaagactgaaatagcatctcgatgtgttgaacttgctgagcaatttgcacctagcaaccactggtttattcagaccatgaataaagtctttgagcatgcgggagatctggtgaatattaaggtggcacataacttgatgcgcctgattgctgagggatttggggaggatgatgatactgcagatagccagctgagatcatctgctgttgagtcatatttgcatattattggggagccgaagcttccatctgtgtttcttcatgtcatttgttgggtcttgggggaatatggaactgctgatggaaagttctctgcttcatatgtcactggaaagttatgcgatgtggcagagtcatattcaagtgatgaaactgtcaaggcatatgcggttacagcgctcatgaaaatatatgcatttgaaatagctgctgggagaaaattggatatactacctgagtgtcaatctctgattgaggaattatcagcttcccactcaacagacttgcagcagcgtgcgtatgaactccaagcagtcattggcttagatgtgagagcaattggatctattatgccatcagatgcaagctgcgaagacattgaggttgacaagtgtctttcttttcttaatggttatgttcagcaatcactagagaaaggggctcagccctatattccagagaatgaacgttctggaatggtaaatatcagcaacttcagaaaccaagaccaacttgaagttgcatctcatggtcttaggtttgaggcttatgaacttccaaagccctcagtgcagtcatggactccacctatgtcagtggcatcttcaaccgaacttgtccccgttcctgagccatcttattatagagagaccccacaaacagcatcagtgccatcttcatctgatacagggccatcgggactcaagctgcgacttgatggggttcaaaagaagtggggcaggccaacttattcctcttcttcagcttctacttcaaattcttcttcactgaaagcggtgaatgggatcacacaagtagatggggtgagcaccggaaattcaaaaacacatgaaacttcatacgattcaaggaggccacaagttgaaatctctgaagaaaaacagaagcttgctgcatcattatttgggggttcatcaaaaactgagaggagatcgtctacaggccataaggttgcaaaggcaagcagccacgctgctgaaaagctccacactccaaagtccacagctatctctagcgctgacaatgcagtggaaaaaccaaatcttgttcaaccacctccagatttgcttgacttgggcgaaccaattgttacaagtagtgctccatcagtagatccattcaggcaactggaagggttgctggacgcaacccaagttcctggtaccttggggggtaccaaagcacctgattttatggcattatatgcagagacacctgcaagtgggcagagtgctggtgtttctcatcccttgtcattgattagggatgaaatcaatttagtacctgggttgtcaaatgcaagtagcaatactgttcatggtggagctacagcggcgaacccctcgcaaattagcaaaggtccaaatgtcaaggatgccttagaaaaggatgcacttgtaaggcagatgggtgtgacgccatcaggtcaaaatcccaacttattcaaggatttgttcggctagaattggacatacacttgcgagtttaaaatctttaatcttgagatcagttgccatgtcatttccacatggttattgcaaagactgctggctggcttgatgatttcacttttaacttggaatggagccagtggcctcctggagtcttgttaaaaaccaggtacaggtttcaatttgttgtacggcgtaagtatgttgttaactcttttttagtagcaggaacagagctgggggttacacagggtatttaggcccttttgagtggtgaatcggtgtagagcttctttttagcgcctctgggtggacgaatgggtcgtgcaatccatgtttgactggttctgcgtcagatgagttttgagtgagtcaaaacctgttataataatgctgcaacaataagttctatgtatggtctgtgtccttttttatt

SEQ ID NO: 1698 - DNA, 3235 bp, Ricinus communis
atggagcaactaaagacaataggaagggagctagcgatgggttcacagggcggtttcggtcaatcaaaagagttcctcgatctcgtcaaatcaatcggagaagcacgatctaaagcagaagaagatcgaattgtgttaagcgagatcgaaaccctaaagaaacgcattgtggaaccagacatacctaaacgcaaaatgaaagagtacataatacgcctcgtttatgtcgagatgcttggacatgacgcctcgttcggttacattcacgccgttaagatgactcacgatgacaatttacttcttaaacggactggttatcttgctgttacgctgtttctgaatgaagatcatgatttgattatattgattgtcaatactatacagaaggatttgaagtctgataattatttagtggtttgtgcggctctgaatgctgtttgtaagttgatcaatgaggaaaccattcctgctgttttgcctcaggttgttgagttgttaggtcattccaaagaagctgttagaaagaaagctattatggctcttcatcgcttttaccataagtctccctcgtctgtttctcacctcgtttccaattttcgtaagaggctttgtgataatgatcctggagtgatgggtgcaacactttgtcctctttttgatcttataactgtagatgttaattcttacaaagaattggtggttagctttgtaagcattctcaaacaagtagctgagcgcagattaccaaaaagttatgattatcatcagatgccagcaccttttatacagatcaagttgctaaaaatcatggcactgctaggaagtggcgacaagcaagcaagtgagcacatgtatactgttgtgggtgacatattgaggaagtgtgattcatcgagtaatataggaaatgctgtactttatgagtccatatgctgtgtttcttcaatacatccaaatcctaagctactagaggctgctgctgatgtgatagctaggttcttgaagagcgacagtcataatctaaaatatatgggaattgatgcccttggtcgattgataaagctaagtccagacattgctgaacaacaccaattggctgtaatagattgcttagaggatccagatgacactctaaagcgaaaaacctttgaactgttatataagatgacgaagtcctccaatgtggaagtgattgttgatcgcatgattgattacatgatcaatattaacgacagtcattacaaaactgaaatagcatctcgatgtgtagaacttgctgagcaatttgcacctagcaaccactggtttattcagaccatgaatagagtctttgagcatgcgggtgatctggtgaaaagtaaggtggctcataacttgatgcgtttgattgctgaaggatttggggaagatgatgataatgcagacagtcagttgagatcatctgctgtggagtcatacttgcatattattggagacccaaagcttccatctgtatttctccaagtcatatgttgggtattgggagaatatggaactgccgatggaaagttttctgcttcatacatcactgggaagttatgtgatgtggcggatgcatattcaaatgatgaaactgttaaggcatatgcagttacagcactcatgaaattatatgcatttgaaatagctgctggaaggaaagtggatattctacctgagtgtcagtctttgattgaagaattatcagcatcgcactcaacagacttgcagcagcgtgcgtatgaacttcaagcagtcattggcttggatgctcatgctgttgaatgtattttgccgtcagatgcaagttgtgaagatattgagattgatgataacctctcattcctcgatggctatgtccaacagtcaatagaaaagggggctcagccttatattccagagagtgaacgttctggggtgttaaacattagcagttttaggaaccaagatcagcatgaagcttcaagtcacggtcttaggtttgaggcttatgagcttccaaagccctcggccccatctaggatacctccagtagcacttgcaccctcaagggaactcgttccagttcctgagccatcttattatggagaagcccaacaggcagcaatagctgcatcttcatctaacactggatcatcagaagtcaagctacggcttgatggagtccaaaagaagtggggtaagccaacttactcctctcctgcgacatctacctcaagttccagttcccagaaaacagtaaatggagtcggccctgtagatggggttggtaatgtaaattcaaaagcacctccaccctcttatgattcgaggaggccacaagttgaaatctctccagaaaaacaaaagcttgctgcatcactttttggaggttcatcaaaaacagagagaaggacatcttcaattggccataaggttgccaggggaagcagccatgttccgaagcccgcggctgtatctgcaactgatgttgcagtagagaggaaaactactcctgttcaaccgcctcctgatttgctcgacctgggtgaatcaactgttaaaagtagcgatctattggtggatccatttaagcaattggaagggctgcttgaccaaacccaacttagttcaagtgctaattctggcatgaatagtgcttctagtgcacccgatatcatgcagttatatgcagacacatctgcaagtgggcagagtggcaatcttgtgtctcctttatcatctcataaaagtgatgataatcttgtatctggatccacaaatgctattgcaaaccctgctcaaagtggaagtacagttctgagctcgacgcaatttagtaagggcccaaaccttaaagattcattggaaaaggatgcacttgtgaggcagatgggtgtgaccccacaaagtcaaaatcccaacttattcaaagatttgctaggctaaaatcagacatgttggagctagaaatcacaaatattggggatagattgctacatgattaccacatgcagaggtggctggctgtactttgtgcatttattcaatgatagagcttaccacttaccagaagcagaattatgagagtttgcagagttaaaaggtactgccttcctttgcggtgataaaaccaggtacagtcttcctttgcggtgataaaaccagatacagattgtatttgttgctgcacattaattagttagtagttcaaagagaaccaaggctggtgtacatg

SEQ ID NO: 1699 - DNA, 798 bp, Zea mays
gagaagactccatcaagcagctcatacgtatatcacttgccatgccagcctagcttcttccgtgtctttctttctcaataaatacatgccactcacatggtgctcctccatcttccaagtcaccaacgcaaattgcaccaagaaatccatcgagaggccgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggaggtgcagaggggattcgccgccaccctcgtcacggaggccgagtgcaacctggccaccatcagcggcgtcgccgaatgcccctggattctcggcggcggaacgatgccctccaagtaactgcgaagagcatagtgcatgaggaatgagcttgtagctagctcatatgtctgaataataagcacagcaagaagatgaatgcatttctcggatcgttcatccggaacaataattaaaggggatccggatttgttcttgtgaaaaaaaaaaaaaaa

SEQ ID NO: 1700 - DNA, 712 bp, Zea mays
catccatcgagaggccgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgcctggcccggacgcgcagctggagggccgcctagaggacctgccgggctgcccgcgggaggtgcagaggggattcgccgccaccctcgtcacggaggccgagtgcaacctggccaccatcagcggcgtcgccgaatgcccctggattctcggcggcggaacgatgccctccaagtaactgcgaagagcatagtgcatgaggaatgagcttgtagctagctcatatgtctgaataataagcacagcaagaagatgaatgcatttctcggatcgttcatccggaacaataattaaaggggatccggatttgttcttgtgatataattaacgattcctgttatacttggaagtagctaggctcgtccccatccaatgcaagcaaaaaaaaaa

SEQ ID NO: 1701 - DNA, 629 bp, Zea mays subsp. parviglumis
accaagaaatccatcgagaggccgtcggcaggggaattaatggcgtcgtcgtctagcagcagccaccgccgcctcatcctcgcagccgccgtcctgctctccgtgctcgcggccgccagcgccagcgccgggacctcctgcgtgccggggtgggccatcccgcacaacccgctcccgagctgccgctggtacgtgaccagccggacatgcggcatcgggccgcgcctcccgtggccggagatgaagaggagatgctgccgggagctggcggacatcccggcgtactgccgatgcacggcgctgagcatcctcatggacggcgcgatcccgccgggcccggacgcgcagctggagggccgcctggaggacctgccgggctgcccgcgggaggtgcagaggggattcgccgccaccctcgtcacggaggccgagtgcaacctggccaccatcagcggcgtcgccgaatgcccctggattctcggcggcggaacgatgccctccaagtaactgcgaaaagcatagtgcgcatgtgggatcttgtagctagctcatggctgaataataagcacagcaagaagatgaatgcatgtctcggatcgttcatccggaacaataaataaaggggatcc

SEQ ID NO: 1702 - DNA, 705 bp, Zea mays subsp. parviglumis
gattcgagcaacgcaaattgcaccaagaaatccatcgagaggccgtcggcaggggaattaatggcgtcgtcgtctagcagcagccaccgccgcctcatcctcgcagccgccgtcctgctctccgtgctcgcggccgccagcgccagcgccgggacctcctgcgtgccggggtgggccatcccgcacaacccgctcccgagctgccgctggtacgtgaccagccggacatgcggcatcgggccgcgcctcccgtggccggagatgaagaggagatgctgccgggagctggcggacatcccggcgtactgccggtgcacggcgctgagcatcctcatggacggcgcgatcccgccgggcccggacgcgcagctggagggccgcctggaggacctgccgggctgcccgcgggaggtgcagaggggattcgccgccaccctcatcacggaggccgagtgcaacctggccaccatcagcggcgtcgccgagtgtccctggattctcggcggcggaacgatgccctccaagtaactgcgaagagcatcatacatgctgctgcgcatagtgcatgtgggatgagcttgtagctagctagctcatggctgaataataagcacagcaagaagatgaatggatgtctcggatcgttcatccggaacaataaataaaaaaaagggatccggatttgttcttgtgataatcactagt

SEQ ID NO: 1703 - DNA, 652 bp, Zea mays subsp. parviglumis
accaagaaatccatcgagaggccgtcggcaggggaattaatggcgtcgtcgtctagcagcagccaccgccgcctcatcctcgcagccgccgtcctgctctccgtgctcgcggccgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccaggagctggcggacatcccggcgtactgccggtgcacggcgctgagcatcctcatggacggcgcgatcccgccgggcccggacgcgcagctggagggccgcctggaggacctgccgggctgcccgcgggaggtgcagaggggattcgccgccaccctcgtcacggaggccgagtgcaacctggccaccatcagcggcgtcgccgaatgcccctggattctcggcggcggaacgatgccctccaagtaactgcgaagagcatcgtacatgctgctgcatagtgcatgcatgtggtcagcttgtagctagctcatggctgaataataataagcacagcaagaggatgaatgcatgtctcggatcgttcatccggaacaataaataaaggggatcc

SEQ ID NO: 1704 - DNA, 680 bp, Zea mays subsp. parviglumis
gattcgagcaacgcaaattgcaccaagaaatccatcgagaggccgtcggcaggggaattaatggcgtcgtcgtctagcagcagccaccgccgcctcatcctcgcagccgccgtcctgctctccgtgctcgcggccgccagcgccagcgccgggacctcctgcgtgccggggtgggccatcccgcacaacccgctcccgagctgccgctggtacgtgaccagccggacctgcggcatcgggccgcgcctcccgtggccgaagctgaagaggagatgctgccgggagctggcggacatcccggcgtactgccgatgcacggcgctgagcatcctcatggacggcgcgatcccgccgggcccggacgcgcagctggagggccgcctggaggacctgccgggctgcccgcgggaggtgcagaggggattcgccgccaccctcgtcacggaggccgagtgcaacctggccaccatcagcggcgtcgccgaatgcccctggattctcggcggcggaacgatgccctccaagtaactgcgaaaagcatagtgcgcatgtgggatgagcttgtagctagctcatggctgaataataagcacagcaagaagatgaatgcatgtctcggatcgttcatccggaacaataaataaaggggatccggatttgttcttgtgataatcactagt

SEQ ID NO: 1705 - DNA, 663 bp, Zea diploperennis
accaagaaatccatcgagaggccgtcggcaggggaattaatggcgtcgtcgtctagcagcagccaccgccgcctcatcctcgcagccgccgtcctgctctccgtgctcgcggccgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgtgatcccgccgggcccggacgcgcagctggagggccgcctggaggacctgccgggctgcccgcgggaggtgcagaggggatttgccgccaccctcgtcacggaggccgagtgcaacctggccaccatcagcggcgtcgccgagtgtccctggattctcggcggcggaacgatgccctccaagtaactgcgaagagcatcataaatgctgctgcatagtgcatgcatgtggccatgcgggatgagcttgtagctagctcatggctgaataataagcacagcaagaagatgaattaatgcatgtctcggatcgttcatccggaacaataaataaaggggatcc

SEQ ID NO: 1706 - DNA, 698 bp, Zea mays
atcttccaagtcaccaacgcaaattgcaccaagaaatccatcgagaggccgycgacaggggaattaatggcgtcgtcgtctagcagcagccaccgccgcctcatcctcgcagccgccgtcctgctctccgtgctcgcggstgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggaggtgcagaggggattcgccgccaccctcgtcacggaggccgagtgcaacctggccaccatcagcggcgtcgccgaatgcccctggattctcggcggcggaacgatgccctccaagtaactgcgaagagcatagtgcatgaggaatgagcttgtagctagctcatatgtctgaataataagcacagcaagaagatgaatgcatttctcggatcgttcatccggaacaataattaaaggggatccggatttgttcttgtsatataaaaaaaaaaaaaaaaaagc

SEQ ID NO: 1707 - DNA, 632 bp, Zea mays subsp. parviglumis
accaagaaatccatcgagaggccgtcggcaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccgacgtactgccggtgcacggcgctgagcatcctaatggacggcgcgatcccgccgggcccggacgcgcagctggagggccgcttggaggacctgccgggctgcccgcgggaggtgcagaggggattcgccgccaccctcgtcacggaggccgagtgcaacctggccaccatcagcggcgtcgccgaatgcccctggattctcggcggcggaacgatgccctccaagtaactgcgaagagcatagtgcatgaggaatgagcttgtagctagctcatatgtctgaataataagcacagcaagaagatgaatgtatttctcggatcgttcatccggaacaataattaaaggggatcc

SEQ ID NO: 1708 - DNA, 657 bp, Zea mays subsp. parviglumis
accaagaaatccatcgagaggccgtcggcaggggaattaatggcgtcgtcgtctagcagcagccaccgccgcctcatcctcgcagccgccgtcctgctctccgtgctcgcggccgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccgacgtactgccggtgcacggcgctgagcatcctcatggacggcgcgatcccgccgggcccggacgcgcagctggagggccgcctggaggacctgccgggctgcccgcgggaggtgcagaggggattcgccgccaccctcatcacggaggccgagtgcaacctggccaccatcagcggcgtcgccgagtgtccctggattctcggcggcggaacgatgccctccaagtaactgcgaagagcatcatacatgctgctgcgcatagcgcatgtgggatgagcttgtagctagctagctcatggctgaataataagcacagcaagaagatgaatgcatgtctcggatcgttcattcggaacaataaataaataaaggggatcc

SEQ ID NO: 1709 - DNA, 1092 bp, Sorghum bicolor
ggcttgtccacctgtattttagggggcggaggggcgtgggggtacggccacccgcacaagcacaagaagctgcgctgcaagcgcgagcaaacagccaaaaaggaggaaggaaaggggagagagcagttagcttgagcgcgcgcgcgacagagtcgagtcgagtcgagggggaatcaccgccggagaatggggatgagcagggctccgcgacgacgggcgtccccatccgcggcggcggctgtgccttggctgcttctcttcgccgttctattcgtgggccgggcgacggcgcaaggccccggcgcgacgccgctgtccaagcacgcgtcgttcttcgaccgcaacggcgacggcgtcgtctccttcgaggagacgtacggcgcgtttcgggctctcgggtttggattcggcatgtccggcgtcagcgctgccttcatcaatggcgctcttggtagcaagtgcagacctcaaaatgcaacgtcatcgaagttggacatctacattgaggacatctataaggggaaacatggaagcgattcaggctcatatgacaccgaaggaaggtttgttcctgataagttcgaagcgatattcgccaatcacgcaaagactgtccctgacgccctgacatcggacgagatcgaccagctgctccaagcaaacagagagcccggggactacaccggatgggccggcgcagaagcggagtggaagatcctgtacagcctcggcaagaaccagaacggcctcctccacaaggacgtcgcaagaagcgtctacgacgggacgctgttccacaggctcgcgcccaactggaaacctctcgacaaggagagcgtgatcagggagaactgaaccgagaggaccgtgccatctgcgttctcttgcgttacttgttggtacaagcaaatccgattaagataaggactgtgggctctgaacatgttgtcaagcaacttgtaaagcggtgtgaacaagtgtgtatattaaattataactaagtacatcatcacgttacgagcactctgcaatataatatgtataccaactatttcttcatctattatattttactcacgcttttcatagctc

SEQ ID NO: 1710 - DNA, 1012 bp, Zea mays
aagctgcgctgccagtgccagcgctcactcgaacgccgagacccgagaggagcaaacagccaaaaagaacggaaaggggagagcaaacagccaaaaaaggacggacttgcgcgacagggtcgaagactcagaaggggaatctccggaggatggaggtgggcaggactccgcggcgacgggcgtccccagcggcagcggcggcggcggcggcggcggctgtgccttcgctgcttctgttcgccgtgctattcgtgggccgggcggcggcagcgttgggcggcccggggccggcgctatacaagcacgcgtcgttcttcgaccgcgacggcgacggcgtcgtctccttcgcggagacgtacggcgcgtttcgggccctcgggtttggactcggcctgtccagcgccagcgccgccttcatcaatggcgcccttggcagcaagtgcagacctcaaaacgcgacgtcgtcgaaactggacatctacatagaggacatccggagagggaagcacgggagcgactccggctcgtacgacgcccaaggaaggttcgttccggagaagttcgaggagatattcgccaggcacgcgaggacggtccccgacgccctgacctcggacgagatcgaccagctgctccaagcgaacagagagcccggggactacagcggctgggctggcgcggaagcggagtggaagatcctgtacagtctcggcaaggacggggacggcctcctccgcaaggacgtcgcgaggagcgtctacgacgggacactgttccaccggctcgcgcccagatggaaatctcccgacagcgacatggagagaagctgataagcgtggtccgggagaactgaaccgagaggaccgtcctattgatgtcgtcttgcgctgggctgctctgaactgaacaagtctggacatgccgtcaagcgacatgtgggtgtgaacactctttcgggtcagattattaacaagaagggtgtgaccgtgtgagtgcaaaaaaaaaaaaaaaa

SEQ ID NO: 1711 - DNA, 988 bp, Zea mays
cactttttagggggtgccgaggggcgtgggggtacggccgtccgcacaataatctgcgctgcgcggaagaagggaaggggaaaagcagttaagcttgagcgcgcgcgacagggtcaagtcgagggccggggaatcgccggagaatggaggtgggcagggctccgcgacgacgggtgtccccagcggcggcggcggcggctgtgccttcgctgcttctgttcgccgttctattcgcgggccgggcggcggcgttcggccacctgcaaggcgccggcgcgacggcgctgtacaagcacgcgtcgttcttcgaccgcgatggcgacggcgtcgtctccttctcggagacgtacggcgcgtttcgggcactcgggtttggattcggcctgtccagcgtcagcgctgccctcatcaatggcgcccttggtagcaagtgcagacctcaaaatgcaacgtcatcgaagttggatatctacatagaggacatccagaaagggaaacatggaagcgattcagggtcatacgacgccgaaggaaggtttgttcctgacaagttcgaagagatattcgccaagcacgccaagactgtcccagacgccctgacgtcggacgagatcgaccagctgctgcaggcgaacagagagcccggggactacagcggatgggctggcgctgaagcggagtggaagaccctctacagcctcggcaaggacaaggacggcctcctccgcaaggacgtcgcgagaagcgtctacgacgggacactgttccacatgctcgcgcccaactggaaatctcccgacgaggaggaggaacaggaactaagcgtgatccgggagagctgaaccgagaggtacaagcaaagtctggttgagagataaggactctgggaccctctgaacatgctgtcaagcaacatgtactactagcggtgtgaacgggtggtgtgaacactcttttcatatcacatcataaaaaaaggtgtgaacag

SEQ ID NO: 1712 - DNA, 1079 bp, Zea mays
gcaccctcacaagctgcgctgccagtgccagcgctcacacgaacgccgagacccgagaggagcaaacagccaaaaagaacggaaaggggagagcagttaccttgcgcgcgcgcgcgcgacagggtccaatactcgaaggggaatctccggaggatggaggtgggcaggactccgcggcgacgggcgtccccagcggcggctgtgccttcgctgcttctgttcgccttgctattcgtgtgccgggcggcggcagcgttgggcggcccggcgccggcgctatacaagcacgcgtcgttcttcgaccgcgacggcgacggcgtcgtctccttcgcggagacgtacggcgcgtttcgggccctcgggtttggactcggcctgtccagcgtcagcgccgccttcatcaatggcgcccttggcagcaagtgcagacctcaaaacgcgacgtcgtcgaagctggacatctacatagaggacatccggagagggaagcacgggagcgactccggctcgtacgacgcccaaggaaggttcgttcccgagaagttcgaggagatattcgccaggcacgcgaggacagtccccgacgccctgacctcggacgagatcgaccagctgctccaagcgaacagagagcccggggactacagcggctgggctggcgcggaagcggagtggaagatcctgtacagtctcggcaaggacggggacggcctcctccgcaaggacgtcgcgaggagcgtctacgacgggacactgttccaccggctcgcgcccagatggaaatctcccgacagcgacatggagagaagctgataagcgtggtccgggagaactgaaccgggtctggacatgctgtcaagcgacatgtactggcggtgtgaacgggtgtgaactcactttcgggtcagattattaacaagaagggtgtgaccgtgtgagtgtgaacagaatcggccgaggaggtccaccagaccagacgacgacgaatgcttcggttgcgtgcggtgcggtctgtctgtttgtatcccgtgagcgcgatggttgcaataatctctactcctaaaaaaaaaaaaaaaaaa

SEQ ID NO: 1713 - DNA, 1123 bp, Zea mays
gacgacggcgacgcttcagttgagtgcgggtgtagtgctcctgcgacttcggcctgtccactttttagggggcgccgaggggcgtgggggtacggccgtccgcacaataatctgcgctgcgcggaagaagggaaggggaaaagcagttaagcttgagcgcgcgcgacagggtcaagtcgagggccggggaatcgccggagaatggaggtgggcagggctccgcgacgacgggtgtccccagcagcggcggcggcggctgtgccttcgctgcttctgttcgccgttctattcgcgggccgggcggcggcgttcggccacctgcaagccgccggcgccggcgcgacggcgctgtacaagcacgcgtcgttcttcgaccgcgacggcgacggcgtcgtctccttctcggagacgtacggcgcgtttcgggcactcgggtttggattcggcctgtccagcgtcagcgctgcgctcatcaacggcgctcttggtagcaagtgcagacctcaaaatgcaacgtcatcgaagttggatatctacatagaggacatccagaaagggaaacatggaagcgattcagggtcatacgacgccgaaggaaggtttgttcctgacaagttcgaagagatattcgccaagcacgccaagactgtcccagacgccctgacgtcggacgagatcgaccagctgctccaggcgaacagagagcccggggactacagcggatgggctggcgcagaagcggagtggaagaccctctacagcctcggcaaggacaaggacggcctcctccgcaaggacgtcgcgagaagcgtctacgacgggacactgttccacatgctcgcgcccaactggaaatctcccgacgaggaggaggaacaggaactaagcgtgatccgggagagctgaaccgagaggtacaagcaaagtctggttgagagataaggactctgggaccctctgaacatgctgtcaagcaacatgtactactagctaagtttttacaatatatattcttattgtgtaattaaactttaaatgggttaatttcacaattaaaatcattgaaagggaaatagttttaaaactatttcttatattttggtgctcaaaaaaaaaaaaaaaa

SEQ ID NO: 1714 - DNA, 2808 bp, Sorghum bicolor
ccccgacccgaacctgctcgccgtcgcctccgcttggtctcgctctcgccgcattcgtcttccccgcccgtcccgtcccgtcccctgatctcagatccagaccaaacgaactccgcactaaacccccccttgccccaggcggcgcacgcatgaaaccctagtgaccccatacagatctccgcgtccggatcactgcgcggcgccaccatggcgacctctgcgctggactccctcccggcgccgctccggtcgctgcggctcaagacgaagcagcaggagctcctgctccgcgtctcggcgctggcgctcatctacgtgctcgccttcgccgtccgcctcttctccgtcctccgctacgagtccatgatccacgagttcgacccctacttcaactaccgcaccacgctcttcctcaccgagaacggcttcagcgagttctggaactggttcgactccgagagctggtacccgctcggccgcgtcgtcgggggcacgctcttcccgggtctcatggtgaccgccgcactgctccaccgcctcctccgcgcgctctccctcgccgtccacatccgcgaggtctgcgtactcacggcgcccttcttcgccgccaacaccacgctcgtcgcctacgccttcggccgcgagatctgggactccggggcggggctcgtcgccgccgcgctcatcgccatcgttcctggctacatctcccgctccgttgcggggtcctacgataacgagggcgtcgccatcttcgccctgctgctcaccttctacctcttcgtgcgcgccgtcaacacggggtcgctcgcctgggcgcttgcctcggcgttcggctacttctacatggtgtcggcgtggggaggctacgtgttcatcatcaatctaatcccactctacgtgcttgtgctgcttgtcactgggaggtattcgcagaggctctacgtggcctacaattgcatgtatgtgcttgggatgttgcttgcgatgcagatccgttttgttggattccagcatgtgcagtccggggagcacatggctgctatgggagtcttcttcctcttgcaggttttcttcttcttggactgggtgaaatacctgctaaatgatgccagactattcaagtcattccttcgaactactcttacatgtgtgattactgttggcaccctggctcttggaattggtactgcatcaggttacatctccccttggacaggacggttttactccctgcttgatcctacctatgcaaaggaccatataccaatcattgcgtctgtttctgagcatcagccaacagcatggtcatctttcatgtttgacttccacatcctccttttcctgttcccagctggcctttatttctgtttcaaacgcctgtcagatgccactatattcattgttatgtatggcctcacgagtatgtactttgctggtgtgatggtccggttaattcttgtggcagcaccagccgtttgtcttattagtgctattgctgcatctgctacaataaagaatctgaccactttgatccgggcaaagagcagaagtccacagactacttctggaaaaacaactggctcaaaggcagctgcaaagggtgcagttgatcaaagtttaccattccaacacaatgcagctattgctcttcttctgggtgccttttacttgctaagtaggtatgccatacactgcacttgggtgacatctgaggcttattcttctccatctatagttttggccgcaaggggtcataatggtggaagagtcatctttgatgattatcgtgaggcatactattggcttcgtcagaacactcctcctgatgctaagattatgtcttggtgggactatggataccaaattacagctatgggtaacagaactgtcattgttgataataatacatggaataacacacacatagctacagttggacgtgctatgtcatcttatgaagatgaagcatatgagatcatgcaatcacttgatgtgaactacgtgcttgttgtatttggaggtgttaccggatattcttcagatgatatcaacaagttcttatggatggtacgcattggtggaggagttttccctgtaatcaaagagccagattaccttgttaatggggagtatcgtattgacaagggggcagcaccaaaaatgctgaactgcctaatgtacaagctttgttactaccgatttggagaacttaccacggaatatggaaagcctccagggtatgatcgtgtaagaggagtggagattggcaacaaagacataaaacttgaatacttggaggaggcatttacaacttcaaactggatagtgcgcatatacaaggtgaaacccccaaagaacaggtcctgaggcatcttcgctagtgaaatggttagagctattacctcagacaagtacattattgtcaaaaatctgagtggcagatggcggggtggttgttattggcacctgctttggcgagactgactagtagccatagcatcagttcagctcaaaagtcaagaagatctttcccctcatttggtttaggtgtgatgggtgtcattcagaaccaagtgtgacaacagcgagtactttttgattgttaagcatgtcatgaccgaactttgaaagtttttgtaggcgcagtgacatatttgagtagaaaacttgtctttgatcaatgcaaggcaatgcaaattttccagcactaaacacaaaatatgaactgttggttctgttctctctattatgtgtttacatcatccagtgtaggcgcattgagcagtttttatgctgtctttcgtc

SEQ ID NO: 1715 - DNA, 2558 bp, Zea mays
atgaaatgaaaccctagtgagtagtgaccctgtccggatcactgcgtggcgccgccatggcaccctccgctctggcctccctcccggcgccgctccggtcactgcggctcaagacgaagcagcaggagctactgctccgcgtctcggcgctggcgctcatctacgttctcgccttcgccgtccgcctcttctccgtcctccgctacgagtctatgatccacgagttcgacccctacttcaattaccgcaccacgctcttcctcaccgagaacggctttagcgagttctggaactggttcgattccgagagctggtacccgctcgggcgcgtcgtcggggggactctcttcccgggtctcatggtgaccgccgcgctgctccaccgcctcctccgcgcgctctccctcgctgtccacatccgcgaggtctgcgtcctcaccgcgcctttcttcgccgccaacaccactctcgtcgcctacgcctttggccgcgagatctgggactccggggcggggctcgtcgccgccgcgctcatcgccaccgtccctggctacatctcccgctccgtcgcggggtcctacgataacgagggcgtcgccatcttcgcgctgctgctcaccttctacttcttcgtgcgcgccgtcaacaccgggtcgctcgcctgggcgcttgcctcggcgttcggctacttctacatggtgtcggcatggggaggctacgtgttcatcatcaatctcgtcccgctctatgtgcttgtgctgcttgttaccgggaggtactcacaaaggctctacgtggcctacaattgcatgtatgtgcttgggatgttgcttgcgatgcagatccgttttgttggattccaacatgtgcagtccggagagcacatggctgctatgggagtcttcttccttttgcaggttttcttcttcttggactgggtaaaatacctgctaaacgatgccagactgtttaagtcattccttcgaattacccttacatgtgtgattactgttggcaccctggctcttggtattggcactgcatctggttacatctctccttggacaggacgattttactccctgctagatcctacctatgcaaaggaccatataccaatcatcgcatctgtttctgagcatcaaccaacagcatggtcatctttcatgtttgacttccacatcctcctttttctgttcccagctggcctttatttctgtttcaagcgcctgtcagatgccacaatatttattgttatgtatggcctcacaagtatgtactttgctggtgtgatggtccggttaattcttgtggcagcaccagccgtttgccttattagtgctattgctgcatctgctacaataaaaaacctaaccactttgatcaggacaaagagcagaagtccacagactacttctgggaaaacaactggctcaaagtcagctgctaagggtgtagttgatcaatctttaccattccaacacaatgctgctattggtcttcttctgggtgccttttacttgctcagtaggtatgccatacactgcacttgggtgacatctgaggcttactcttctccatctatagttttggccgcaaggggtcataatggtggaagagttatctttgatgattatcgtgaggcatactattggcttcgtcagaacactcctcctgatgctaagattatgtcttggtgggactatggataccaaattacagctatgggtaacagaactgtcattgttgataataatacatggaataacacacacatagctactgttggacgtgctatgtcatcttatgaagatgaagcatatgagatcatgcagtcacttgatgtgaactatgtgcttgttgtatttggaggtgttactggatattcttcagatgatatcaacaagttcttatggatggtacgtattggtggaggggttttccctgtaatcaaagagccagattaccttgttaacggggagtatcgtattgacaagggggcagcaccaaaaatgctgaactgcctaatgtacaagctttgttactaccgatttggagaacttaccacagaatatggaaaacctccagggtatgaccgtgtacgaggagtggagattggcaacaaagatataaagcttgaatacttggaagaggcatttacaacttcaaactggatagtgcgcatatacaaggtgaaacccccaaagaacaggtcctgaggcgtcatcgctagtgaagtggttggagagctattacctcagacaagtacatattgtcaaaaaatctgaatctgagtggcctcaggagagggcggggtcgttgttatgggcacctgctttggcgagagtgactattagcagccatagcatcagttcagctcgaagtcaagaacatctttcccctcattcggtttaggtgtaatcggtgaggaaccaattgtggcaacagcgagtaatttttaattgttgagcatccatggccgaactattaaagtttttgtaggcgcaatgacatatttgaatagaaacttgtctttgatcataaaaaaaaaaaaaaaa

SEQ ID NO: 1716 - DNA, 2567 bp, Zea mays
ccccgcccgtccgtccgcccgctgatctcagatccagaccaaacgaactccacactaccctctgcccagctcgcgcacgcatgaaaccctagtgaccccgtccagatctcggcgtccggatcactgcgcggcgccgccatggcgccccccgcgctggactctctcccggcgccgctccggtcgctgcggctcaagacgaagcagcaggagctcctgctccgcgtctcggcgctggcgctcatctacgtgctcgccttcgccgtccgcctcttctccgtcctccgctacgagtccatgatccacgagttcgacccttacttcaactaccgcaccacgctcttcctcaccgagaacggcttcagcgagttctggaactggttcgacttcgagagctggtacccgctcgggcgcgttgtcggggggacgctctacccgggtctgatggtgaccgccgcgctgctccaccgcctcctccgcgcgctctacctcaccgtccacatccgtgaggtctgcgtcctcaccgcgcccttcttcgctgccaacaccacgctcgtcgcctacgccttcggccgcgagatatgggactccggggcggggctcgtcgccgctgcgctgatcgccatcgtccctggctacatctcccgctccgtcgcggggtcctacgacaacgagggcgtcgccatcttcgcgctgctgctcaccttctacctcttcgtgcgcgccgttaacactgggtcgctcgcctgggcgctcgcctcggcgttcggttacttctatatggtgtcggcatggggaggctacgtgttcatcatcaatctcgtcccgctttatgtgcttgtgttgcttgtcactgggaggtactcgcagaggctctacgtggcctacaattgcatgtatgtgcttgggatgttgcttgcaatgcagattcgttttgttggattccagcatgtgcagtccggagagcacatggctgctatgggagtcttcttcctgttgcaggttttcttcttcttggactgggtgaaatatctgctaaatgatgccagactattcaagtcattccttcgaattaccctcacatgtgtgattactattggcaccctggctcttggacttggtactgcatctggttacatctccccttggacaggacggttttactccctgcttgatcctacctacgcaaaggaccatataccaatcatcgcatctgtttctgagcatcagccaacagcatggtcctctttcatgtttgacttccacatcctacttttcttgttcccagctggcctttatttctgtttcaagcgcctgtcagatgccacgatatttattgttatgtatggcctcacaactatgtactttgctggtgtgatggtccggttaattcttgtggcagcaccagccgtttgccttattagtgcgattgctgcatctgctacaataaaaaatctaaccactttgatccggacaaagagcaaaagtccacagactactggaaaaacaactggttcaaaggcaggtgcaaagggagcagttgatcaatctttaccattccaacacaatgcagctattgctcttcttctcggtgccttttacttgctcagtaggtatgcaatacactgcacttgggtgacatctgaggcctactcttctccatctatagttttggctgcaaggggtcataatggtggaagagtcatctttgatgattatcgtgaggcatactattggcttcgtcagaacacgcctcctgatgctaagattatgtcttggtgggactatggataccaaattacagctatgggtaacagaactgttattgttgataacaatacatggaataacacacacatagctacagttggacgagctatgtcatcttatgaagatgaagcatatgagatcatgcagtcacttgatgtgaactatgtgcttgttgtgtttggaggtgttactggatattcttcagatgatatcaacaagttcttatggatggtacgtattggtggaggagtttttcctgtaatcaaagagccagattaccttgttaatggggagtatcgtattgacaagggggcagcacccaaaatgctgaactgcctaatgtacaagctttgttactaccgatttggagaacttaccacagaatatggaaaacctccagggtatgatcgtgtacgaggagtggagattggcaacaaagacataaagcttgaatacttggaggaggcatttacaacttcaaactggatagtgcgcatatacaaggtgaaacccccaaagaacaggtcctgaggtagttggtattacctcaggcaagtaaattattgtcaaaaatctgagtgtccagaggagacggcagagtggttattatgggcacctgcgttggcgagacttgctgtagtggccatagcatcagttcaggtcgaaggtcctcatttggtttaggtgtggtcggtgccattcagaagaaccaattgtgacaacagcgagtactttttgattgttaagcatttcttgacctaactctggaagtttttgtaggcgcaatgacatatttgagt

SEQ ID NO: 1717 - DNA, 2818 bp, Oryza sativa Japonica Group
ctcctcctcgatctcccagatccaaaccgaacccaaccaagcggccgcggcgctctaaaacctctcccgctccacgcgcggggcgcatgaaaccctagcgagaggcgccagatctcccgcatccggatcgccgccatggccgccgccaccgcgctggactcgctgccggcgccgctccggtcgctgcggctgaagacgaagcagcaggagctcctgctccgggtctcggcgctggcgctcatctacgtgctcgcgttcgtcgtccgcctcttctccgtgctccgctacgagtccatgatccacgagttcgatccctacttcaactaccgcaccacgctcttcctctccgaccatggattcagcgagttctggaactggttcgatttcgagagctggtacccgctcggccgcgtcgtcggcggcaccctcttcccgggcctcatggtcaccgccgcgctgctccaccgcctcctccgcgcgctctccctcgccgtccacatccgcgaggtctgcgtcctcaccgcccccttcttcgccgccaacaccacgctcgtcgcctacgccttcggccgcgagatctgggactccggcgcgggcctcgtcgccgccgcgctcatcgccgtctgccccggctacatctcccgctccgtcgcgggctcctacgacaacgagggcgtcgccatcttcgcgctgctgctcaccttctacctcttcgtgcgcgccgtcaacacgggatctctcgcatggtcgctcgcctcggcgttcggctacttctacatggtctccgcgtggggaggctatgtcttcatcatcaatctgttgccgctgtacgtgctcgtgctgctcgtcacggggaggtactcgcagaggctctacgtggcctacaattccacgtatgtgcttggaatgctacttgcgatgcagatccggttcgttgggttccaacacgtccagtctggggagcacatggccgctatgggagtattcttccttttgcaggttttctttttcttggactgggtgaagtacctgctgaatgatgccaaactattcaagtcattcctgagaatcaccctgacatgtgtgataactgttggcaccctagctcttggaattggtaccgcgtcaggttacatctccccttggacagggcggttttactccctgcttgatccaacctatgcaaaggaccatataccaatcattgcatcagtatctgagcatcaaccaacagcgtggtcttcgttcatgtttgatttccacatccttcttttcctgttcccagcaggcctctacttctgtttcaagcgcttgtcagatgccacaatatttatagttatgtatggcctcacgagtatgtactttgctggtgtgatggttcggttaattcttgttgcagcgccagctgtttgccttattagtgccattgcagcatcagctacaataaaaaatctgactaccttgattcggacaaaaagcaaaagtccacaaactgtctctggaaaatcatctggctcaaaggcagctgcaaagggtgcagttgatcaatccttgcctttccagcagaatgtggccattgctttacttctgggtgctttctacttgcttagtagatatgctgtacactgcacttgggtgacatctgaagcttactcttctccttccattgttctggccgcaaggggtcataatggaggcagggtcatatttgatgattatcgtgaagcgtattattggcttcgtcagaacactccttctgatgcaaagattatgtcatggtgggattatggataccaaatcacagctatggggaacagaactgttattgttgataacaacacatggaataatacacatatagctacagttgggcgtgcaatgtcatcctatgaagatgaagcgtatgagataatgcagtcactggatgtgaattatgtgcttgtcgtatttggtggtgttactggttattcttcagatgacattaacaagttcttatggatggtgcgcattggtggtggagtttttcctgtaatcaaagagcctgattaccttgttaatggggagtatcgtgtcgacaagggggcagcaccaaaaatgttgaattgcttaatgtacaagctttgttattaccgttttggagaactgaccacagaatatggaaaacctccaggatacgatcgagtacgaggagtggagattggcaacaaagacattaagcttgagtacttggaggaggcattcacaacttcgaactggatagtgcgcatatacaaggtcaaacccccgaagaataggtcttgaggagaggaatcatctcttggttagtatctggtgctattaccttgaggtacattgtgtcaagtcaaaacgtattggagttcctacaggagacgggcaattgatttgaaaatctgcatcagctgcccccaagtgcgatcttttgttttggtgagactgacggaagtagaccataggtcagtttgaagtaacgatcatccgtcttcccctatatcattttgttagatgtaatcaggtgccattcagaactagcaattgcgacgaccgagtactttttgattgctgagcatggtatgacagtactccagatgtttttgtaagcacaacagcttatttgcgtagtaactttagatcgggttacacgggacacttgcaattttctggtgttgaagacaacaatgaataacttaactgtggttgctctgttttcctctgtgagctctcatcatcttgtggcaatcgcagtagtcgtttttatgttaataaatgatgcctataaacttgcatcatctcattagtt

SEQ ID NO: 1718 - DNA, 2581 bp, Hordeum vulgare subsp. vulgare
ggggacccactccgccaccatcgtcttccccgatctcccagatccacaccaccaaaccacacgagctccgccactcccctaaacccaacccccgccccgcgcgcggatgaaaccctagtagcccagatcccccgccccgcccgccgtccatggccgccgccgccgcgacgacgacgatgctggactccctcccggcgccgctgctgcgggcgctgcggctcaagacgaagcagcaggagctgctgctgcgcgtgtccgcgctggcgctcatctacgtgctcgccttcgccgtgcgcctcttctccgtgctccgctacgagtccatgatccacgagttcgacccctacttcaactaccgcaccacgctctacctcacggagcacggctactccgagttctggaactggttcgaccacgagagctggtacccgctcggccgcgtcgtcgggggcacgctcttccccggcctcatggtcaccgccgccctcctccaccgcctcctccgcgcgctctccctcgccgtccacatccgggaggtctgcgtcctcaccgcccccttcttcgccgccaacaccacgctcgtcgcctacgccttcggccgcgagatctgggactccggggccggcctcgtcgccgccgccctcatcgccgtctgccccggttacatctcccgctccgtcgccgggtcctacgacaacgagggcgtcgccatcttcgcgctgctgctcaccttctacctcttcgtccgcgccgtcaacaccggatccctcgcctggtcgctcgccgccgcgttcggctacttctacatggtctccgcctgggggggctacgtctttatcatcaacctccttccgctctacgtgctcgtcctgctcgtcaccgggaggtactcgcagaggctctatgtcgcctacaattgcacctatgtgctgggaatgctgctcgggatgcagatccgcttcgtcggcttccagcatgttcagtctggggaacacatggccgccatgggagtcttcttcctgttacaggttttcttcttcctggattgggtgaaatacatgctgaatgatgtcaaactattcaagtcattcttgagaattactctgacctgtgtgataagtgttggtacccttgctcttgggattggtactgcatcaggttacatctccccttggacagggcggttttattccctgcttgatccgacctatgcgaaagaccatatacctatcatcgcatctgtttctgaacatcagcctacagcatggtcttcttttatgtttgatttccacatccttcttttcctgttcccagcgggcctttatttctgcttcaagcgcctgtcagatgccacaatatttatagttatgtatggcctcacgagtatgtactttgctggtgtgatggtaaggttgattcttgttgcagcaccagcagtttgccttattagtgccattgctgtatctgctacagtaaagaatctgacaacattgatccggtcaaaaagcaaaagtccacagactacaggaaaaacaacaggctcgaaggcagctgcaaagggagcagttgatcaacccttgcctttccaacataatgtggctgttgctttacttgtgggcgctttctacttgctcagtagatatgccatacactgcacttgggtaacctctgaggcttactcttctccttccatcgttctgtccgcaaggggtcacaatggaggaagggttatatttgatgattatcgtgaggcatactactggcttcgtcagaacactcctacagatgccaagattatgtcatggtgggactatgggtaccaaattacagccatgggtaacagaactgttattgttgataataacacgtggaataatacacacatcgcaactgttggacgggcaatgtcatcttatgaagacgaggcatatgagataatgcagtcattggacgtgaattatgtgcttgtcgtatttggaggtgttacagggtactcctctgacgacatcaataagttcttatggatggtccgtattggtggaggagtttttcctgtaatcaaagagtctgattaccttgtcaatggggaatatcgtgttgacaagggggcgtcgccaaaaatgttgaactgtctaatgtacaaactctgttattatcgatttggagaactgaccacagaatatggaaaacctccaggatacgaccgagtgcgaggagtggagataggcaacaaagacgtgaagctcgagtacttggaggaggcattcacaacatcaaactggatagtgcgcatatacaaggtcaaacctccaaagaatagatcctagggtttcgtcccaagagggaagtggcaagcgagagagaacggtttgggggtgattgctttgacattggtcacatgaggagggtgcctagtcgtgaaccttttgttttcgcaagactaacagtaacccatactgttgtttcaaagttgaggacctggtagttgtgatagctggtcactcatttttgtttggcatactgtgatggaattctcagaaacttttgggtagcaagtaattttagatcaatatgccagttg

SEQ ID NO: 1719 - DNA, 4136 bp, Oryza officinalis
aagacgaagcagcaggagctcctgctccgcgtctcggcgctggcgctcatctacgtgctcgcgttcgtcgtccgcctcttctccgtgctccgctacgagtccatgatccacgagttcgatccctacttcaactaccgtaccacgctcttcctctccgagcatggattcagcgagttctggaactggttcgactccgagagctggtacccgctcggccgcgtcgtcgggggcaccctcttcccgggcctcatggtcaccgccgcgctgctgcaccgcctcctccgggcgctctccctcgccgtccacatccgcgaggtctgcgtcctcaccgcccccttcttcgccgccaacacaacgctcgtcgcctacgccttcggccgcgagatctgggactccggcgcgggcctcgtcgccgccgcgctcatcgctgtctgccccggctacatctcccgctccgtcgcgggctcctacgacaacgagggcgtcgcaatcttcgcgctgctgctcaccttctacctcttcgtgcgcgccgtcaacacgggatctctcgcctgggcgcttgcctcggcgttcggctacttctacatggtctccgcgtggggaggatatgtcttcatcatcaacctattgccgctctacgtgctcgtgctgctcgtcaccgggaggtactcgcagaggctctacgtggcctacaattccacgtatgtgcttggaatgctgctcgcgatgcagatccggttcgttgggttccagcacgtccagtctggggagcacatggctgctatgggagtattcttcctgttacaggtattccgtacacatatttttatgaaacaattgcaacgattcatccatagcgatgaagtgccttctaatgttagtagataggtaaagctctggttttttagacggttagtttagtcaattagctacagttgactttaaaaggtttgattcatatgaaaagtcctgctaattgtttagtcaatttgcaccaccagtattaattggcttggaatgcattaagattatttgtaattgagaaaggaacaaacacttaatggaaggtaaactgatcttagtagttggcgaactattggagtataaattagacaggtaattttaattttgtagaacagttcagatcaaatggcttgttagtgcttattgttagtttcatataatctagatgattagatggaactgttaccgatcatagtaaggttttgctgttacaaacaccaaaacataaatatatgggaatgccatcggaatgccaaacataatcttatgttttttacaacatgagctgatgatggcatccacaaggattcacttgactgatgtgctcagaccactggagcattggcatttgtatcagatgctgctctcattttgcctcttcagatagatcgtgttcactatgtagatagattatggaactgggtatccttgtatatttactgattggtagcccatttatgtctggtggttaaatgttagatgtaatactccttactcttgaatatgtccacagctaacataacttaatattgttatcatgtttgttgcgtatttatatcagacatagcgagaggccaagagtgcagatctaatgttatattttttaacctttgttagtatttgttagtatgaatgcttcgacaattatttattctattatgagggactttgtgtactttgtatagatgtagcacacgtataagagagctatcataaaccctttcctctttttgcaggttttctttttcttggactgggtgaagtacttgctgaatgatgccaaactattcaagtcgtttctgagaattaccctgacatgtgtgataactgttggcaccctagctcttggtattggtactgcgtcaggttacatctccccttggacaggacggttttactccctgcttgacccaacctatgcaaaggaccatataccaatcattgcatcagtatctgagcatcaaccaacagcatggtcttcattcatgtttgatttccacatccttcttttcctgttcccggcaggcctctacttctgtttcaagcgtttgtcagatgccacaatatttatagttatgtatgggctcacgagtatgtactttgctggcgtgatggttcggttaattcttgttgcagctccagctgtttgccttatcagtgccattgccgcatcagctacaataaaaaatttgactactttgattcggacaaaaagcaaaagtccacaaactgtctctggaaaatcaactggctcaaaggcagctgcaaaggtattcttttttttttcatctatgcttgtttgcatgctttatattttgtagatggatagctaaaataaataaatttgatggagcctgaaatctgaaacatacttggataaaatcaagtggtacaattgaaatccttgtttccgccaatcaataccctctaaaagtctagagaatcatgccattttgaaatactgggctgcaattttgtcagaatataaggctggcaaactgcataggtgataagaatatgaggatttgtgccttttgtcagacaattctaattctagtaggttcaattgcatataaatttgtgattttcagtttatttgtaccaattattttaagtttctggtttcttcgctcagaagctgacttggtttcttgtgtaagcagggagcagttgatcaatccttgcctttccagcagaatgtggccattgctttacttctgggtgctttctacttgcttagtagatatgccgtccactgcacttgggtgacatctgaggcttactcttctccttccattgttctggccgcaaggggtcataatggaggcagggtcatatttgatgattaccgtgaagcgtattattggcttcgtcagaacactccttctgatgcaaagattatgtcatggtgggattatggataccaaatcacagccatggggaacagaactgttattgttgataacaacacatggaataatacacatatagctacagttgggcgtgcaatgtcatcctatgaagatgaagcatatgagataatgcagtcactggatgttaattatgtgcttgttgtatttggtggtgttactggttattcttcagatgatattaataagtaaattcatccattgaattcaatcaatcctttatgctattggtctcatttgaattagtattgaacatttttttttaaaaaaaaactgaactgcaaaacagattcttacttctgcttatttcaggttcttatggatggtgcgcattggtggtggagtttttcctgtaatcaaagaacccgattaccttgttaatggggagtatcgtgttgacaagggggcagcaccaaaaatgttgaactgcctaatgtaagtatgaaaagcatttatgagtctgtaagtttttttttttggtggtggggtggggtgggggtgggtgaggagttaacactacattactgctttcttctattattatgtgttggagaacttatttgtgagcacgtgcattctttgttaggagtatttatcaaacctttgaaagttatcacaatatttgacatgtaaacagtcatctttctagacatgtgttactgctatccctccatcacctctaattgtctcccctctcttgtttggcaggtacaagctttgttattaccgttttggagaactgaccacagaatatggaaaacctccagggtatggcacatccttaccatcgttattgatcatttgcgtgcatcttataagtttgagacttagtttaaacttaagatgctttcacttcaatgatttatttaaatagagattacatatttattatattttggttatgaatggcttccctaataagccaggtaccataatttgccggttgtaacttgcatggtcctatttgtatagcaaagcatgtttttgatacggcaatggatgctagcaactgatggatatgatacatcactctgcaatttattttgtatgtagatacgatcgagtacgaggagtggagattggcaacaaagacattaagcttgagcacttggaggaggcattcacaacttcgaactggatagtgcgcatatataaggtcaaacccccgaagaataggtcttg

SEQ ID NO: 1720 - DNA, 2520 bp, Vitis vinifera
atggaggccgtcaacggcgtcaaatctggatcgaattcaaccgcatcaaccttccaatccgccttcttcaagccagatctctccctcaaatccctgaagctcaagaccaagcagcaggagctcctgatccgggtctccatcctcactctcgtctacatcctcgccttcatcaccaggctcttcagtgtcctccgctacgagagcatgatccacgagttcgatccctacttcaattaccgaaccactgtttttttgaccgagaagggattctacgagttctggaattggttcgactccgagagctggtaccctctcggtcgaatcatcggcggcacgctctatcctggactgatggtcacagcagcactgatctactcaattattcgatttctccggttcgcggtccatatccgtgaagtttgcgtgctaactgctccgttcttcgcatcaaacaccaccattgtcgcgtatttctttgggaaagagctttgggactcgggcgcaggcctggttgcagcggcattgatcgccatttgccctggttacatctcgagatcggtggcggggtcttatgacaacgagggagtggcgatttttgctttgttattgacattttacttgtttgttaaggcggtcaacacgggttcgcttgcttgggccctggcttcggcttttggatacttctacatggtttcggcttggggtggttatgtgtttattatcaatttgattccgctttatgccatggtgcttttgattacgggcaggtattcgatgaggttgtatgtggcgtataactgcatgtatatattgggaatgctgcttgctatgcagattcgatttgtgggctttcagcatgtgcagtctggggagcatatggctgcaatgggtgtgtttttcttgatgcaggtattttacttcttagattgggttaagcacctgctaagtgatacaaaattgtttcaagccttcctgaggattactgtgacatgtgcagttggtgttggtgccattgcactgggagttggtactgcatctgggtatatctctccatggacaggtcgattttactctttgcttgatccaacatatgcaaaggatcacatcccaataattgcatctgtatctgagcatcagccaacagcttggtcatcgttcatgtttgattttcatatcctacttttcttattccctgcgggtctgtatttctgcttcaagcggttatctgatgccacaatattcatagttatgtatggtctcacaagcatgtattttgctggtgtcatggttcggttgattcttgttgctacacctgcaatgtgccttatcagtgccattgcagtttctgccactataaagaatttgactcagttggtaaggacaaagagcaaggttgctcatactggttctaccaaaggtaccactagcggaaaggcgtcttctaaggcttcacttgatcaatctctgcctttccaaagaaatggagccattgcactgctcattggtgctttttatctgctctgtaaatatgctacccactgtacctgggttacatcagaggcatactcatctccatcaattgtcttggctgcaaggggtgcctatggcaacagggtcatctttgatgattatcgtgaagcgtacttttggcttcggcagaatactcctccagatgccaaggtgatgtcctggtgggattatgggtaccagatcacagccatgggaaacagaactgttattgttgacaacaacacctggaacaacacacacattgctactgttggacgtgcaatgtcatcttatgaagatgaagcatatgagataatgagatcacttgatgtggattatgtactagttgtctttggaggtgttacgggttattcttctgatgatattaacaaatttttgtggatggtgaggattggtggtggagttttccctgttatcaaggaacctgattatcttgttaatggcgagtatcgtgttgacaaaggtgctgcaccaaagatgttgaattgtctcatgtacaagctatcttattatcgatttggagagctgcaaacagaatatggcaaacctcctgggtatgatcgcgcgaggggggttgaaattggaaataaggatatcaaactcgagtacttggaagaggcattcacaacatctaactggattgttaggatatacaaagtgaaaccacccaacaataggtggtgaggctctctttatctctttttgcgggacagaaaagggtaatgtgagaactttgagtgaagctgagttttagaagttttatgttctatttatactacttttagatagaattgatccatgttttgcttagactcttcaggtgtaacattcatggtgggaaactccctctctttggacttttttttcttgatatcctttcaccgttatccatgtgcttgtatggttgataatgataaagcaagtctcttgaatccttagtagcaacaatgtaacccgctgggttgatgcggtttatagttttcttttaac

SEQ ID NO: 1721 - DNA, 2417 bp, Populus trichocarpa
atgtctcttaaatcggatctgctgtcaacactatcgctcaaatcactgaaactcaagaccaaacaacaagaactcctgatccgtgtctcaatactctgtttagtctatgttttagcttttatcactcgtttgtttagtgtcttacgttatgagtcaatgatccatgaattcgatccttacttcaattatcgaactacccttttcttaactcaaaagggtttttatgaattctggaattggttcgattccgagagttggtaccctcttggacgtatcattggaggaaccctttatcctggattgatggttactgcagccattatgtactggggtttgcgattcttacgttttgctgttcatattcgcgaagtttgtgtgttgacagcaccgttttttgcgtcgaatactacgcttgttgcgtattttttcggcaaagagatatgggacactggtgctgggttggttgctgctgttttgattgcgatttgtcctggttatatatcgcgatctgttgcagggtcttatgataatgaaggggttgcgattttcgcattgttgctgactttttatttctttgttaaggcagtgaatacggggtctttagcgtggggattggcatcggcttttgggtatttttatatggtttctgcttggggaggttatgtttttattattaatttgataccgctctatgtgttggtgttgctgattaccgggaggtattcgatgaggttgtatgtggcctataattgtatgtatgtgttgggaatgttgcttgctatgcagattcggtttgtggggtttcaacatgtgcagtccggtgagcacatggcagctatgggtgtgttcttcttgatgcaggtgttttatttcttagattgggttaagtatctgctaaatgataaaaagttgtttgaagccttcttgaggattactgtgacctgcgcagtgggtgtaggtgctattgctcttggagttggcacagcatctgggtatatttcaccgtggactggcagattttactctctgttggatccaacatatgctaaggatcacatccccatcattgcatctgtctctgagcatcagccaacagcttggtcatctttcatgtttgatttccacatcctacttttccttttccctgctggtctgtatttctgcttcaagcggctgtcagatgccacaatattcattgttatgtatggcctaacaagcatgtattttgctggtgtcatggttcggttaattcttgttgctacacctgcggtatgcttaattagcgccattgctgtttctgccactataaagaatttgactatgctgttaaggactaagagcaaggtttcccaaactggttctactaagggaacaggtggtggaaaggcttcttctaaggctttgcttgatcagtctcaaccttttcaaaacaatggtgctattgcattgctttttggtgcattttacttgctcagtaggtatgccatacattgtacctgggttacatcagaggcctactcgtctccttcaattgtcttggctgcaaggggtgcccatggtaatagggtgatctttgatgattaccgtgaggcttacttttggcttcgacagaatactcctccagatgctaaggtgatgtcatggtgggattacgggtatcagatcactgccatgggaaacagaacagttattgttgacaataatacctggaacaatacacacattgccactgttggccgtgcaatgtcatcttatgaagatgaggcgtatgagataatgaaatcacttgatgtggattatgtgctagttgtcttcgggggtgttacaggctattcttctgatgatatcaacaagtttttatggatggtgagaattggaggcggagtattccctgtaattaaggaacccgactatcttgtcaatggggagtatcgtgttgacaaaggtgcagctcccaagatgttgaactgtctcatgtacaagctatcctactatcgatttggagagctggtgacagagtatgggaaacctccagggtatgatcgagcaaggggggtcgaaattggaaacaaggacattaaacttgaacacttggaagaggcatttacgacatctaattggattgttcgtatttacaaggtcaagccaccaaataacaggtggtgaaatctctcattccactgaggaggagaagggatttggttgttgaactgcaatcttgattcttgagagatagatgtggccatagaagtagaaaattattagtaagagattgagcttgtaacattcgaggcttttgaattttctgggcccgaattttggtgtttcctccatcccttcacccccatccatcagaaccatttatcatgctatattgctgataaaccatcttagatcctcgactggttagtatcaaa

SEQ ID NO: 1722 - DNA, 2257 bp, Arabidopsis lyrata subsp. lyrata
tcgtccatttcctcaaagcaatgggaggaaaatcagagccaacgaaatcggaatccatggcgacgaagacgacgaatccagatctactcaacagtagtttcttccctttcaaatccctaaaattgaagacgaagcaacaagagctcttgctccgtatctcgatccttggtctcgtctatatcttagccttcatagctcgtctcttcagtgttctccgatacgaatcaatgatccacgaattcgatccgtatttcaactaccgtacgactcttttcctcacagagaaaggcttctacgagttttggaactggttcgattccgagagttggtatccgctaggtcgaatcatcggcggtacgctttatcctggtcttatggtcacagctgcgttaatctactggacattgcggtttctccgattctttgttcatatccgtgaggtttgtgtgttaaccgcaccgtttttcgcgtcgaatacgactttagttgcgtatttctttggtaaagagatttgggatacaggagctggtcttgttgctgctgttttaatcgctatttgccccggatacatttctcggtctgtagccgggtcgtatgataacgaagctgtcgcgattttcgctcttttgttgacgttttatctgtttgttaaagcggttaacactggttcattggcttgggctcttggctctgcgtttggttacttttatatggtttctgcttggggaggatatgtgtttattatcaacttggttccgctttatgtgttggtgttgttgatcactggaaggtattcgatgaggctttacattgcttataactgtatgtatatcttggggatgttgctcgcgatgcaaattcggtttgttgggtttcaacatgttcaatctggtgagcatatgggtgcaatgggcgtcttcttattgatgcaggtgttttacttcttggactgggtgaagtaccagctcaatgacaccaagttgttccaaacctttttgaggataactgtgacatcggctattttggttggtggtattgctttgggtgttggaacagcgtctggctatatatctccatggactggtcgattttactcgttgcttgacccgacttatgcaaaggatcatattcccattattgcatctgtttctgagcatcagcctacggcttggtcgtctttcatgtttgactaccatattctgctctttcttttccctgcgggtctttacttctgtttcaagcgtttgacggatgctacgatatttattgtcatgtatggtctcactagcttgtactttgctggtgtcatggttcggcttattctcgtcgccactccagcagtttgtcttatcagtgccatagctgtctctgccactgtcaagaatttaacttctctgttaaggacaaaacaaaaggtttctcagactggttccacgaaaggagctggtagttcaaaagcctcttcaaaggttacacttgatcagtctcagcctttccagaagaatggtgccattgctcttcttcttggtgtattttatttgctgagtagatatgccattcactgcacatgggtgacatcagaggcatattcatctccctcaattgtcttagctgcaagaggagcccatgggaacagaatcatctttgatgattaccgcgaggcctactactggcttaggcaaaacactcccactgatgctaagatcatgtcgtggtgggactatgggtaccaaatcactgccatgggaaacagaactgtcattgtcgataacaatacctggaacaacacacatattgctaccgttggacgtgccatgtcttcttatgaagatgaggcgtatgacattatgaggtcacttgatgtgaactatgtattggtcgtctttggtggtgttactggttattcttcagatgatatcaacaagttcttgtggatggtgagaattggaggcggagtattcccagtgatcaaggaacctgattaccttgtgaatggtgaattccgtgtagataagggtgcatcaccaaaaatgctgaactgtcttatgtacaagttatgctattacaggttcggtgagctgaccacagaatacggcaagccacccgggtatgatagagcaagaggagtggagatagggaacaaagatatcaaacttgaacacttagaagaagcttacacaacatccaactggatagttcgcatttacagagtcaaacctcctacgaacaggttgtgacgcttcaatgttatgaaaat

SEQ ID NO: 1723 - DNA, 2616 bp, Populus trichocarpa
tcacatctccttgaaaccccaaagctcaagctccactctgtcttctttctccatcaacatgaaaccttaaaaatgctaaaaccataaaagtcgcaaaaacacacttcaatttctctcaaaaagaccaaactatggaagtcaccaaaacagaacccataacgaacaaatcatcgtcatcatcagtgtctgtgaaatcagatctgatgtcaactctttcactcaaatcattcaaactcaaaaccaaacaacaagagcttctgatccgtgtctcaatcctctgtttggtctatattttagctttcattactcgtttgtttagtgtcttacgttatgagtcaatgatccatgaatttgatccatattttaattatcgaactaccctcttcttaactcaaaaaggtttttatgaattttggaattggttcgattccgagagttggtaccctcttggacgtatcattggaggaaccctttatcctggattaatggttactgcagccattatgtactggggtctccgattcttacgtttcgctgttcatattcgtgaagtttgtgtgttaacggcaccatttttcgcgtcgaatactacacttgttgcgtattttttcggtaaagagatatgggatactggtgctgggttggttgctgctgtattgattgcgatttgtcctggttatatatcgcgatctgttgcagggtcttatgataatgagggggttgcgattttcgcattgttgttgactttttatttgtttgtcaaggcagtgaatacggggtctttagcgtggggagtggcgtcggcttttgggtatttttatatggtttcggcttggggaggttatgtttttattattaatttggttccactttatgtgttggtgttgttgattactgggaggtattcgatgaggttgtatgttgcctataattccatgtatgtgttgggaatgttgcttgctatgcagattcggtttgttgggtttcaacatgtgcaatctggggagcacatggcagctatgggtgtgttcttcttgatgcaggtgttttacttcttaggttgggttaagcacctgctaggtgacaaaaagaagtttgaagcctttttgaggatcactgtgacatgtgcagtaggtgtaggcgctattgctctcggagttggcacagcatctgggtatatttcaccgtggactggcagattttactctctgttggatccaacatatgccaaggatcacattcccatcattgcatctgtttctgagcatcagccaacagcttggtcatctttcatgtttgatttccatatcctgcttttccttttccctgctggtctgtatttctgcttcaagcggctgtcagatgccacaatattcatagttatgtatggtcttacaagcatgtattttgctggtgtcatggtgcggttaattcttgttgctacgcctgcggtatgcctcattagtgccattgctgtttctgccacaataaagaatttgactacactgttaaggactaagagcaagcaggctttgcctgatcagtctcagccttttcaaagaaatggtgctattgcattgcttttcggtgcattttacttgctcagtaggtatgctatacattgtacctgggtgacctcagaggcctactcatctccctcaattgtcttggctgcaaggggtgcccatggtaacagggtcatctttgatgattaccgtgaggcatactattggcttcgacagaatactcctccagatgctaaggtgatgtcatggtgggattatgggtatcagatcactgccatggggaacagaacagttattgttgacaataatacctggaacaatactcacattgccactgttggccgtgcaatgtcatcttatgaagatgaggcatatgagataatgagatcacttgatgtggattatgtactagttgtctttggtggtgttacagggtattcttctgatgatatcaacaagtttttgtggatggtgagaattggaggtggagtattcccagtaattaaggaacctgactatcttgtcaatggggaatatcgtgttgacaaaggtgcagctcccaagatgttgaactgtctcatgtacaagctatcctactatcgatttggagagctggtaacagaatatgggaaacctccagggtatgatcgagcaaggggggttgaaattggaaataaggacattaaacttgaacacttggaagaggcattcacgacatctaattggattgttcgcatctacaaggtcaagccaccaaataataggtggtgaaatctctcattccatgtaggcgagaaggaaattggtagttggactgcaatcgagtcttgagagggagggagagagagagagttggccatagaggtagagtactagtaagaggttgagcttgtagtattcaaggctttttaaattttctgaacctgaattttggtctctggaacagcccttcacgtcatccattttgaactatttgtcatgttatattgcagacagataagccatcttagatcctcgactagttagtatcaaatgtaacttgctgacttttttgagcaatttatagatcttaattggaagaaagatttta

SEQ ID NO: 1724 - DNA, 2265 bp, Sorghum bicolor
ctcagacgcagtgttccattccaacatttagctagccaacaaggatcatcggagctcgggctcaagtacttgttcttagctgacttcttcattgtaggaaacaatggctacctcctatctgctgccttgctatgtcctcatcactgtgctcgtgctcttcttctccgtcgacgttacggaaggggccatcagggagtaccagttcgatgtgcaaatgacgaatgtgacgcggctgtgcagcagcaagagcatcgtgacggtgaacggtcagttcccggggccgccggtgttcgctagggagggcgacttcgtcgtcatccgcgtcgtcaaccacgtcccctacaacatgagcatccactggcacggcgtccggcagctgcggagcgggtgggcggacgggccggcgtacatcacgcaatgcccgatccagagcgggcagagctacgtgtacaagttcaccatcacggggcagcgcggcacgctgtggtggcacgcgcacatctcctggctgcgcgccaccgtctacggcgccatcgtcatcctgcccaagcccggcgtcccttacccgttcccggcgccctacaaggaggtccccgtcatcttcggcgagtggtggacggcggacacggaggcggtgatcagccaggcgctccagaccggcggaggacccaacgtctccgacgccttcaccatcaacgggctgcctggcccgctctacaactgctctgcaaaagacacgttcaagctgaaggtgaagcccgggaagacgtacatgctccgcatcatcaacgctgcgctcaatgacgagctcttcttctccatcgccggccacccactcaccgtcgtcgacgtcgacgcggtctacatcaagcccatcaccgtcgacaccatcctcatcacccccgggcagaccaccaacgtgctcctcaccaccaagccgtcctaccccggcgccacctactacatgctggccgcgccctactccaccgccaggccgggcaccttcgacaacaccaccgtggccggcatcctcgagtacgaggaccccacgtcccctcccccgcacgcggccttcaacaagaacctcccggcgctgaagccgacgctgccgcagatcaacgacacgagcttcgtcgccaactacacggccaagctccgcagcctcgccaccgcggagtaccccgccgccgtgccgcaggaggtggaccggcggttcttcttcacggtcgggctgggcacgcacccgtgcgccgtgaacgggacgtgccagggccccaccaacagcagccggttcgcggcgtccgtgaacaacgtctccttcgtgctcccgacgacggcgctgctgcagtcgcacttcgccggaaagtccaagggggtgtactcgtccaacttccccgccgcgccgctcgtcccgttcaactacacggggacgccgcccaacaacaccaacgtggccaacggcaccaagctggtggtgctgccgtacggcgccagcgtggagctggtgttgcagggcaccagcatcctcggcgccgagagccacccgctgcacctccacggcttcaacttcttcgtggtcggccaagggttcggcaacttcgaccccgccaaggacccggccaagtacaacctcgtcgaccccgtcgagcggaacaccgtcggcgtgccggcggccggctgggtggccatccggttccgcgcagacaatccaggggtatggtttatgcattgccacttggaggttcacgtcagctggggcctgaaaatggcatggctggtgctggacggagaccgccccaacgagaagctgctgcctccgccgtctgatctccccaggtgctgaggcagacgacacgaggaattgctgcccggcctgcaggtcgccatcaacggccgtgatcgattgggcccggccggccgtcttggaacagggattgcgtgctctctaatttgcataggatatcttaatcatcttttggttgtgctggggttggtgttatgcgatgctttcattaatagaggtgtgcttttccgggttgagtcgtcgtctggttagctgtgtgagtgagagtcacacgggcaggaaggttcataccacttactcagtataaggcaaacgccatgtattttttgattgtttatgagttactgtactaccatcttttgtaaatcagattcttgtcgtcggggaactggatagtgtatccaggcgtgcctcccaaataatatgtttacgactatcagcattgttggaatttatttttg

SEQ ID NO: 1725 - DNA, 2213 bp, Zea mays
aatcgctaccactgcacccctcaaacccagtgacccaacccactacacatcggagtctcgcgcgcgggctcaagcacttgttcttagctgcttagctgctttcttcgttgtaggaactgcaacaatggctaccccctaccgtcttccttgctgctgctatgccctcgtcactgtgctcgtgctcttcttctccgtcgacgctacggagggcgccatcagggagtaccagttcgatgtgcaaatgaccaatgtgacgcggctgtgcagcagcaagagcatcgtgacggtgaacggccagttcccggggccgacggtgttcgcgagggagggcgacttcgtcgtcatccgcgtcgtcaaccacgtcccctacaacatgagcatccactggcacggcatccggcagctgcggagcgggtgggcggacgggccggcgtacatcacgcagtgcccgatccagagcggccagagctacgtgtacaagttcaccatcacggggcagcgcggcacgctgtggtggcacgcgcacatctcctggctgcgcgccaccgtctacgggcccatcgtcatcctgcccaagcccggcgtcccttacccgttcccggcgccctacgacgaagtccccgtcttgttcggggagtggtggacggccgacacggaggcggtgatcagccaggcgctccagaccggcggaggccccaacgtctccgacgccttcaccatcaacgggctgcctgggccgctctacaactgctctgcaaaagacacgttcaagctgaaagtgaagcccgggaagacgtacatgctccgcatcatcaacgctgcgctcaatgacgagctcttcttctccatcgccggccacccgctcaccgtcgttgacgtcgacgcggtctacatcaagcccatcaccgtggagaccatcattatcacccctgggcagaccaccaacgtgctcctcaccaccaagccgtcctaccctggcgccacctactacatgctggctgcgccctactccaccgccaggccgggcaccttcgacaacaccaccgtcgccggcatcctcgagtacgaggaccccacgtcgtcccctcccccgcacgcggccttcgacaagaacctcccggcgctgaagccgaccctgccgcagatcaacgacacgagcttcgtcgccaactacacggccaggctccgcagcctggccaccgcggagtacccggccgacgtgccgcgggaggtgcacaggcggttcttcttcacggtcgggctgggcacccacccgtgcgccgtgaacgggacgtgccagggccccaccaacagcagccggttcgcggcgtccgtgaacaacgtctccttcgtgctccccaccacggcgctgctgcagtcgcacttcgccggcaagtccaggggggtgtactcgtccaacttcccggccgcgccgctggtcccgttcaactacacggggacgccgcccaacaacaccaacgtgtccaacggcaccaagctggtggtgctgccgtacggcaccagcgtggagctggtgatgcagggcaccagcatcctcggcgccgagagccacccgctgcacctccacggcttcaacttcttcgtcgtcggccaagggttcggcaacttcgaccccgccaaggacccggccaagtacaacctcgtcgaccccgtcgagcgtaacaccgtcggcgtgccggcggccgggtgggtggccatccggttccgcgcagacaatccaggggtgtggttcatgcattgccacttggaagttcacgtcagctggggcctgaaaatggcatggctggtgctggacggagaccgccccaacgagaagctactgcctccgccatcggatctgcccaaatgttagacgacacgaggaattgctggcctagtcgtcgccatcaacggccgtgattgatcggcccggaccatcttggaacagggattgcgtgctctctaatttgcacaggatatcttaccgtcttttgcttgtgctggggttggtgttatgcttccatttagtggtgtgctttttccggcttgagtcgtcgtctggttagctgtgtgagagacacgggcaggaaggtccgttgatgctactagacagacgccatttttttttattatactttgagttactaccatcttttgtactgcctcagtcctaaaataattgacattcttgtttttaaaaaaaaaaaaaaaaa

SEQ ID NO: 1726 - DNA, 2187 bp, Zea mays
ctgcacccctcaaacccagtgacccaacccactacacatcggagtctcgcgcgcgggctcaagcacttgttcttagctgcttagctgctttcttcgttgtaggaactgcaacaatggctaccccctaccgtcttccttgctgctgctatgccctcgtcactgtgctcgtgctcttcttctccgtcgacgctacggagggcgccatcagggagtaccagttcgatgtgcaaatgaccaatgtgacgcggctgtgcagcagcaagagcatcgtgacggtgaacggccagttcccggggccgacggtgttcgcgagggagggcgacttcgtcgtcatccgcgtcgtcaaccacgtcccctacaacatgagcatccactggcacggcatccggcagctgcggagcgggtgggcggacgggccggcgtacatcacgcagtgcccgatccagagcggccagagctacgtgtacaagttcaccatcacggggcagcgcggcacgctgtggtggcacgcgcacatctcctggctgcgcgccaccgtctacgggcccatcgtcatcctgcccaagcccggcgtcccttacccgttcccggcgccctacgacgaagtccccgtcttgttcggggagtggtggacggcggacacggaggcggtgatcagccaggcgctccagaccggcggaggccccaacgtctccgacgccttcaccatcaacgggctgcctgggccgctctacaactgctctgcaaaagacacgttcaagctgaaagtgaagcccgggaagacgtacatgctccgcatcatcaacgctgcgctcaatgacgagctcttcttctccatcgccggccacccgctcaccgtcgttgacgtcgacgcggtctacatcaagcccatcaccgtggagaccatcattatcacccctgggcagaccaccaacgtgctcctcaccaccaagccgtcctaccccggcgccacctactacatgctggccgcgccctactccaccgccaggccgggcaccttcgacaacaccaccgtcgccggcatcctcgagtacgaggaccccacgtcgtcccctcccccgcacgcggccttcgacaagaacctcccggcgctgaagccgaccctgccgcagatcaacgacacgagcttcgtcgccaactacacggccaggctccgcagcctggccaccgcggagtacccggccgacgtgccgcgggaggtgcacaggcggttcttcttcacggtcgggctgggcacccacccgtgcgccgtgaacgggacgtgccagggccccaccaacagcagccggttcgcggcgtccgtgaacaacgtctccttcgtgctccccaccacggcgctgctgcagtcgcacttcgccggcaagtccaggggggtgtactcgtccaacttcccggccgcgccgctggtcccgttcaactacacggggacgccgcccaacaacaccaacgtgtccaacggcaccaagctggtggtgctgccgtacggcaccagcgtggagctggtgatgcagggcaccagcatcctcggcgccgagagccacccgctgcacctccacggcttcaacttcttcgtcgtcggccaagggttcggcaacttcgaccccgccaaggacccggccaagtacaacctcgtcgaccccgtcgagcgtaacaccgtcggcgtgccggcggccgggtgggtggccatccggttccgcgcagacaatccaggggtgtggttcatgcattgccacttggaagttcacgtcagctggggcctgaaaatggcatggctggtgctggacggagaacgccccaacgagaagctgctgcctccgccatcggatctgcccacatgttagacgacacgaggaattgctggcctagtcgtcgccatcaacggccgtgattgatcggcccggaccatcttggaacagggattgcgtgctctctaatttgcacaggatatcttaccgtcttttgcttgtgctggggttggtgttatgcttccatttagtggtgtgctttttccggcttgagtcgtcgtctggttagctgtgtgagagacacgggcaggaaggtccgctgatgctactagacagacgccatttatttttttgattacttatgagttactaccatcttttgtactgcctcggtcctaaaataattgacattcttgttttt

SEQ ID NO: 1727 - DNA, 2210 bp, Oryza sativa Japonica Group
atcgatctcaaacacattcatagcccattagccgacgagagctctcagtgtacgtaagtcgagagctcgaggaggcatccatggctatctcctaccttctccgttcctccatcctcgccgtcgccgcgctactgctcttctccgtcaacctggccaagggcgacattagggaataccaattcgatgtgaaaacgacgaacgtgacacggctgtgcagcagcaagagcatcgtgacggtgaacgggcagttcccggggccgactgtgttcgcgagggaaggcgacctcgtcgtcatccgggtcatcaaccactccccctacaacatgagcatccactggcacggcatccggcagctgcggagcgggtgggcggacgggccggcgtacatcacgcagtgcccgatccagccgggcggcagctacgtgtacaagtacaccatcaccgggcagcgcggcacgctgtggtggcacgcgcacatctcctggctccgcgccaccgtgtacggccccatcatcatcctccccaaggccggcgtcccctacccgttcccggcgccggacaaggaggtccccgtcgtcttcggcgagtggtggaaggcggacacggaggcggtgataagccaggcgacgcagaccggcggaggcccgaacgtctccgacgcgttcaccatcaatggcctccctgggccgctctacaactgctctgccaaagatacgttcaagctgaaggtggaggccgggaagacgtacatgctgcggctcatcaacgctgcgctcaatgacgagctcttcttctccatcgccgggcacacgctcaccgtggtcgacgtcgacgcggtctacgtcaagccattcaccgtggacaccctcctcatcaccccgggccagaccaccaacgtgctcctcaccaccaagccgtcgtaccccggtgcgacgttctacatgctggcggcgccatactccacggcgatgtccggcacgttcgacaacaccaccgtcgcgggaatcctcgagtacgaggaccccagctcccactccaccgcggcgttcaacaagaacctcccggtgctcaggcccaccctgccgcagatcaacgacaccagcttcgtctccaactacaccgcaaagctccgcagcttcgccacggcggagtacccggcgaacgtgccgcagcaggtggacacgcggttcttcttcaccgtcggcctgggcacgcacccctgcgccgtgaacgggacgtgccagggtcccaacgggagccggttcgcggcggccgtgaacaacgtctccttcgtgctcccctccacggcgctgctgcagtcgcactacaccggcaggtccaacggggtgtacgcctccaacttcccggccatgccgctgtcgccgttcaactacaccgggacgccgccgaacaacaccaacgtgtccaacgggacgaggctggtcgtgctcccgtacggcgcgtcggtcgagctggtgatgcagggcaccagcgtccttggcgccgagagccacccgttccacctgcacggcttcaacttcttcgtcgtcggccaagggttcggcaacttcgaccccgtgaacgacccggccaagtacaacctcgtcgaccccgtcgagcgcaacaccgtcggcgtgccggcggccggctgggttgccattcgcttcctcgtggacaatccaggggtatggttcatgcattgccacttggaggtgcacgtcagctggggcctgaagatggcatgggtggtgcaggacgggagcctacccaaccagaagatcctccctccgccgtccgatctccccaaatgctaaccgatcgacaccggccgaccagagacagagattgcgtcttgctcatcagcttccctgtaggatactcggatactcctctgcttttgctagcttgcttctgttgattgctcgcggttggtgctatggaatgcttttcttgtagtggtgtgcctttccgaagttgtgtcgtcatctggttagctgatgtacgaatgatcatgggcaagtttcttgatcagacgcaaggcctttaattttgggcttctcattattatttgtcaccttttgtaacatatgagggagctggatcataaatccacgttcatcccaataatttgtaccatcatttgatgtacggcaaaggatttttttatgtactatttcatattaatcaatgtttgttatattgttttggag

SEQ ID NO: 1728 - DNA, 2155 bp, Hordeum vulgare subsp. vulgare
gcgcagcagagccattgatttagccatccagagctcagggaaggggagctagctgagccgtacagaaatggcggccatcctcgtcgccgccgtgatggtagtggtgctgtccgtcaacgcggcggagagctccacggtggagtaccagttcgatgtggcgacgatgaacgtgacgcggctgtgcggcagcaagagcatcgtggcggtgaacgggcagttcccaggccccacggtgtcggcgagggagggcgacctcgtcgtcgtccgggtcgtcaacaaggcccagtacaacatgagcatccactggcacggcgtccggcagatccggagcgggtgggcggacgggccggcgtacatcacgcagtgcccgatccagccgggccagagctacgtctacaagttcacggtgaccgggcagcgcggcacgctgtggtggcacgcgcacatctcctggctccgcgccaccgtctacggccccatcgtcatcctccccaagctcggcgtcccctaccccttcgccgccccctacaaggaggtgcccctcatgttcggcgaatggtggaaggcggacacggaggcggtgatcagccaggcacttcagaccggaggaggcccgaatgtctccgacgccttcaccatcaatggcctcccagggccgctctacaactgctccgccaaagacacgttcaagctcaaggtgaagcccgggaagacgtacatgctccgcatcatcaacgccgcactcaacgacgagctcttcttctccatcgccggacacccgctcaccatcgtcgacgtcgacgccgtctacatcaagcccatcaccgtcgagaccctcatcatcaccccgggccaaaccaccaacgtcctcctcacggccaagccgtcctaccccggggcgacctactacatgctggccgcgccctactccacggcggcctccgggaccttcgacaacaccaccgtcgccggcatcctcgagtacgtggaccccagctccccctcctccgcgggcttcaacaagaacctcccgctgctcaggccgaccctgccccagatcaacgacacgagcttcgtctccaattacaccgacaagctccggagcctcgccacggaggagtacccggcggcggtgccgcaggaagtggacaggcggttcttcttcacggtggggctgggcacccacccctgcgccgtcaacgggacgtgccaggggccgacgaacgacagccggttcgcggcggccgtgaacaacgtctccttcgtgctccccacgacggcgctgctgcagtcgcattacacggggatgtccaacggggtgtactcgtccaacttccccgccgtgcccaagtcgccgttcaactacacgggcacgccgccgaacaacacgaacgtgtccaacgggaccaggctggtcgtgctgtcgtacggcgacgccgtggagctggtgatgcagggcaccagcatcctcggcgccgagagccacccgttccacctgcacggcttcaacttcttcgtggtcgggcaggggttcggcaacttcgaccccgtccacgacccggccaagtacaacctcgtcgaccccgtcgagcgcaacaccgtcggcgtgccggccgccgggtgggtggccatccgcttccgtgctgataatccaggggtgtggttcatgcattgccacttggaggtgcacgtcagctggggcctgaaaatggcgtgggtggtgcaggacgggagcctcccggaacagaagctgctccctccgccgtccgatctccccaaatgttaggaagagattgcgtcttctccaattcccgcaggacattcacccgcttttgcttgcgttgcgttgcgtgcgtgcgtgcacaactgattgcttgtgtgtcgcgcgtgcgcgcggttggtgccatcaagtgctttcttagctgtgtgctctttaattttcatgtcaagtcctcgtctgattaattggtgagagtcatgggcaggtttcttgatcagaagcaacaagtgtaggactttcattttggattgctgattagtcccatctcttttgtaacgtactggagctgggtcatatgcctatgagcctgcccaataatttgtaccaacattcctttggtttatggcaacaagattattatcggttatttaatcg

SEQ ID NO: 1729 - DNA, 2042 bp, Hordeum vulgare subsp. vulgare
agcagcagagccattgatttagccatccagagctcagggaaggggagctagctgagccgtacagaaatggcggccatcctcgtcgccgccgtgatggtagtggtgctgtccgtcaacgcggcggagagctccacggtggagtaccagttcgatgtggcgacgatgaacgtgacgcggctgtgcggcagcaagagcatcgtggcggtgaacgggcagttcccaggccccacggtgtcggcgagggagggcgacctcgtcgtcgtccgggtcgtcaacaaggcccagtacaacatgagcatccactggcacggcgtccggcagatccggagcgggtgggcggacgggccggcgtacatcacgcagtgcccgatccagccgggccagagctacgtctacaagttcacggtgaccgggcagcgcggcacgctgtggtggcacgcgcacatctcctggctccgcgccaccgtctacggccccatcgtcatcctccccaagctcggcgtcccctaccccttcgccgccccctacaaggaggtgcccctcatgttcggcgaatggtggaaggcggacacggaggcggtgatcagccaggcacttcagaccggaggaggcccgaatgtctccgacgccttcaccatcaatggcctcccagggccgctctacaactgctccgccaaagacacgttcaagctcaaggtgaagccccggaagacgtacatgctccgcatcatcaacgccgcactcaacgacgagctcttcttctccatcgccggacacccgctcaccatcgtcgacgtcgacgccgtctacatcaagcccatcaccgtcgagaccctcatcatcaccccgggccaaaccaccaacgtcctcctcacggccaagccgtcctaccccggggcgacctactacatgctggccgcgccctactccacggcggcctccgggaccttcgacaacaccaccgtcgccggcatcctcgagtacgtggaccccagctccccctcctccgcgggcttcaacaagaacctcccgctgctcaggccgaccctgccccagatcaacgacacgagcttcgtctccaattacaccgacaagctccggagcctcgccacggaggagtacccggcggcggtgccgcaggaagtggacaggcggttcttcttcacggtggggctgggcacccacccctgcgccgtcaacgggacgtgccaggggccgacgaacgacagccggttcgcggcggccgtgaacaacgtctccttcgtgctccccacgacggcgctgctgcagtcgcattacacggggatgtccaacggggtgtactcgtccaacttccccgccgtgcccaagtcgccgttcaactacacgggcacgccgccgaacaacacgaacgtgtccaacgggaccaggctggtcgtgctgtcgtacggcgacgccgtggagctggtgatgcagggcaccagcatcctcggcgccgagagccacccgttccacctgcacggcttcaacttcttcgtggtcgggcaggggttcggcaacttcgaccccgtccacgacccggccaagtacaacctcgtcgaccccgtcgagcgcaacaccgtcggcgtgccggccgccgggtgggtggccatccgcttccgtgctgataatccaggggtgtggttcatgcattgccacttggaggtgcacgtcagctggggcctgaaaatggcgtgggtggtgcaggacgggagcctcccggaacagaagctgctccctccgccgtccgatctccccaaatgttaggaagagattgcgtcttctccaattcccgcaggacattcacccgcttttgcttgcgttgcgttgcgtgcgtgcgtgcacaactgattgcttgtgtgtcgcgcgtgcgcgcggttggtgccatcaagtgcttttttagctgtgtgctctttaattttcatgtcaagtcctcgtctgattaattggtgagagtcatgggcaggtttcttgatcagaagcaacaagtgtaggactttcattttggattgctgattagtccc

SEQ ID NO: 1730 - DNA, 2192 bp, Zea mays
aacacacacatcgttcttcttcttcttcctccgtctcttcgatcgcctggccggccgtgtcgtcccccctctactagacctcaagagcaactctggatagctgcttatcggagcctagagctagaggttgaaccagtccatcatcaactagcgtggccggccatggcgatctcctctgctcttccatgctcctccctcctcatggcggctgcccaactgatgctcctcgcctccgtcgtcgtccaagtgcaaggcatcacgaggcactacgacttcaatgtgaccatggcgaacgtgacacggctgtgcgccagcaagagcatcatcacggtgaacgggcagttccccgggcccaagatcgtggcgagggaaggcgaccggctcgtcatccgcgtcaccaaccacgcccagcacaacatctcgctgcactggcacggcatccggcagctgcgcacggggtgggcggacgggccggcgtacatcacgcagtgcccgatccagacggggcagagctacgtgtacaactacaccgtcgtggggcagcgcggcacgctgtggtggcacgcgcacatctcctggctgcgcgccaccgtctacgggcccctcgtcatcctgcccaagctcggcgtcccctacccgttcccggcgccctacaaggaggtccccgtcatcttcggtgagtggtggctggcggacacggaggtggtgatcaagcaggcgcttcagctcggcgctggccccaatgtctctgacgcccacaccatcaacggcctgccagggccgctctacaactgctctgccaaagacacgtacaagctgaaggtgaagcccgggaagacgtacatgctgcgcctcatcaacgcggcgctcaacgacgagctcttcttctccgtcgccaaccactcgctcacggtcgtcgaggtcgacgccgtctacgtcaagcccttcaccgtcgacacgctgctcatcgcgccgggccagaccaccaacgtgctgctcgccgccaagccatcctacccgggcgccaactactacatgtccgccgcgccctactccacggccaggccggccaccttcgacaacaccaccgtcgccggcatcctcgagtacgagctgtaccccgacgcgccccggccctccgcctccgcggggagcttcaacgaggccctgccgctctacagaccgaccctgccgcagctcaacgacaccagcttcgtcggcaacttcacggccaagctccgcagcctcgcgacgccgcggtacccggcggccgtgccgcggacggtggacaggcggttcttcttcgcggtcgggctcggcacgcacccgtgccccgccaacgccacgtgccagggccccaccaacaccacgcagttcgcggcgtccgtcaacaacgtctccttcgtgctccccaccaaggcgctgctgcactcccacttcaccggcctgtccagcggcgtctactcgccggacttccccgtcgcgcccctggcgccgttcaactacacggggacgccgcccaacaacaccaacgtggccagcgggaccaagctcatggtcgtcccgtacggcgccaacgtggagctcgtcatgcagggcaccagcatcctcggcgtcgagagccacccgctgcacctgcacggcttcaacttcttcgtggtcggccaagggtacggcaactacgaccccgtcaacgacccgtccaagttcaacctcgtcgaccccgtcgagcgcaacaccgtcggcgtgccggccggcggatgggtggccatccgcttcctcgccgacaaccccggggtctggttcatgcattgccatttggaggcgcacacaacatggggcctcaggatggcatggttggtgctcgacggcagcctcccgcaccagaagctgctcccgccgccgtcagacttacccaaatgttgattagactcttcctctatctctatcctgccggtcgcttcaaattaaagggaattgtgaattagacaaatgtttgtttgtttttttgtttactttcttcattgccaattgcaattttttcaacttgcattttaactagtccgttccgttcctagctgacctggacttttttgtaatttttttcttccatttgtttgccaccacaaatgtttttgtacactcctctgaaaataaagaatggcgtgacttgcaccagataaaaaaaaaaa

SEQ ID NO: 1731 - DNA, 2006 bp, Zea mays
gcacacattattcttcctccacccatctcttgagtcgcctggccggccgccgtcttggttcccctctagagctcaacagcagagcagctgtgtagcatagagcgaggtttaaccatcagcgcatggccatggcgatctcctctgctcttccgtgctccctcctcgtggcggccctgatgctcctcgcctccgtcgtccaagtgcaaggcatcacgaggcactacgacttcaatgtgaccatggcgaacgtgacacggctgtgcgccagcaagagcatcatcacggtgaacgggcagttccccgggcccaagatcgtggcgagggaaggcgaccggctcgtcatccgcgtcaccaaccacgcccagcacaacatctcgctgcactggcacggcatccggcagctgcgcacggggtgggcggacgggccggcgtacatcacgcagtgcccgatccagacggggcagagttacgtgtacaactacaccgtcgtggggcagcgcggcacgctgtggtggcacgcgcacatctcctggctgcgcgccaccgtctacgggcccctcgtcatcctgcccaagctcggcgtcccctacccgttcccggcgccctacaaggaggtccccgtcatcttcggtgagtggtggctggcggacacggaggtggtgatcaagcaggcgcttcagctcggcgctggccccaatgtctctgacgcccacaccatcaacggcctgccagggccgctctacaactgctctgccaaagacacgtacaagctgaaggtgaagcccgggaagacgtacatgctgcgcctcatcaacgcggcgctcaacgacgagctcttcttctccgtcgccaaccactcgctcacggtcgtcgaggtcgacgccgtctacgtcaagcccttcaccgtcgacacgctgctcatcgcgccgggccagaccaccaacgtgctgctcgccgccaagccgtcctacccgggcgccaactactacatgtccgccgcgccctactccaccgccaggccggccaccttcgacaacaccaccgtcgccggcatcctcgagtacgagctgtaccccgacgcgccccggccctccgcctccgcggggagcttcaacgaggccctgccgctctacagaccgaccctgccgcagctcaacgacaccagcttcgtcggcaacttcacggccaagctccgcagcctcgcgacgccgcggtacccggcggccgtgccgcggacggtggacaggcggttcttcttcgcggtcgggctcggcacgcacccgtgccccgccaacgccacgtgccagggccccaccaacaccacgcagttcgcggcgtccgtcaacaacgtctccttcgtgctccccaccaaggcgctgctgcactcccacttcaccggcctgtccagcggcgtctactcgccggacttccccgtcgcgcccctggcgccgttcaactacacggggacgccgcccaacaacaccaacgtggccagcgggaccaagctcatggtcgtcccgtacggcgccaacgtggagctcgtcatgcagggcaccagcatcctcggcgtcgagagccacccgctgcacctgcacggcttcaacttcttcgtggtcggccaagggtacggcaactacgaccccgtcaacgacccgtccaagttcaacctcgtcgaccccgtcgagcgcaacaccgtcggcgtgccggccggcggatgggtggccatccgcttcctcgccgacaaccccggggtctggttcatgcattgccatttggaggcgcacacaacatggggcctcaggatggcatggttggtgctcgacggcagcctcccgcaccagaagctgctcccgccgccgtcagacttacccaaatgttgattagactcttcctctatctctatcctgccggtcgcttcaaattaaagggaattgtgaattagacaaatgtttgtttgtttttttgtttactttcttcattgccaattgcaattttttcaacttgca

SEQ ID NO: 1732 - DNA, 2167 bp, Sorghum bicolor
acgcacacacacaaacacattattcctccatctcctcgatcgcctggccggccgtcttggttgccctctagagctcgagagcaactcaagatatagctagctagctgctcatcggagtctagctagaggtttaaccatcagctagctagctggccatggcaatctcctctgctcttccctgctccctcctcatggcggccctgatgctcctcgcctctgccgtcgaagtgcaaggcatcacgaggcactacgacttcaatgtgacaatggcgaacgtgacacggctgtgcgccagcaagagcatcatcacggtgaacgggcagttccccggccccaagatcgtcgcgagggaaggcgaccgcctcgtcatccgcgtgaccaaccacgcccagcacaacatctcgctgcactggcacggcatccggcagctgcgcacggggtgggcggacgggccggcgtacatcacgcagtgcccgatccagacggggcagagctacgtgtacaactacaccatcgtcgggcagcgcggcacgctgtggtggcacgcgcacatctcctggctgcgcgccaccgtctacgggcccctcgtcgtcctgcccaagctcggcgtcccctacccgttcccggcgccgtacaaggaggtccccgtcatcttcggtgagtggtggctggcggacacggaggtggtgatccagcaggcgcttcagctcggcgctggtccgaatgtctctgacgcccacaccatcaacggcctaccaggaccgctctacaactgctctgccaaagacacgttcaagctgaaggtgaagccagggaagacgtacatgctccgcctcatcaacgcggcgctcaacgacgagctctttttctccatcgccaaccactcgctcaccgtcgttgaggtcgacgccgtctacgtcaagcccttcaccgtcgacaccctggtgatcgccccgggccagaccaccaacgtgctcctcgccgcgaagccgttctacccggccgccaactactacatgaccgccaggacctactccaccggccggccggccaccttcgacaacaccaccgtcgccggcatcctcgagtacgagtaccccgacgcgccctccgccgcggcgagcttcaacaaggccctgccgctctacaggccggcgctgccgcagctcaacgacaccagcttcgtcggcaacttcacggccaagctcctcagcctcgcgacgccggagtacccggcggcggtgccgcagacggtggacaagcggttcttcttcacggtggggctgggcacgcacccgtgcccggccaacaccacgtgccagggccccaccaacacgacgcagttcgcggcgtccgtgaacaacgtctccttcgtgctcccgaccaaggcgctgctgcactcgcacttcgccggcctgtccagcggcgtctacgagtcggacttccccgtggcgccgctggcgccgttcaactacacggggacgccgcccaacaacaccaacgtggccaacgggaccaagctgatggtcatcccgtacggcaccaacgtggagctggtgatgcagggcaccagcatcctcggcatcgagagccacccgctgcacctgcacggattcaacttcttcgtcgtcggccaaggctacggcaactacgacccggtgaacgacccgcccaagttcaacctcgtcgaccccgtcgagcgcaacaccgtcggcgtgccggccggcggctgggtggccatacgcttccttgccgacaaccccggggtatggttcatgcattgccatttggaggtgcacacaacatggggcctcaggatggcatggttggtgcttgacggcagcctcccgcaccagaagctgctcccgccgccgtccgatcttcccaaatgctgattagactccctccctcagctctctatctctctcctgcgccggtcgcttcaaagggaattgtgaattagacttgatcacaaatgttgattttttgtttgtttactttcttcattgccaattgcaattctttcagcttccatttaaactagtccgttcctagctgacctggactttttgtaatcttttcttctatttgtttgccaccctctgtaatgacaaaatgtttttgggagaataaagaatggcgtgacttgcaccagatccatagaatt

SEQ ID NO: 1733 - DNA, 2167 bp, Sorghum bicolor; identical to SEQ ID NO: 1732

SEQ ID NO: 1734 - DNA, 2192 bp, Zea mays; identical to SEQ ID NO: 1730

SEQ ID NO: 1735 - DNA, 2096 bp, Zea mays
gcaactctggatagctgcttatcggagcctagagctagaggttgaaccagtccatcatcaactagcgtggccggccatggcgatctcctctgctcttccatgctcctccctcctcatggcggctgcccaactgaagctcctcgcctccgttgtcgtccaagtgcaaggcatcacgaggcactacgacttcaatgtgaccatggcgaacgtgacgcggctgtgcgccaccaagagcatcgtcacggtgaacgggcagttccccggccccaagatcgtcgcgagggaaggcgaccgcctcatcatccgcgtcaccaaccaggcccagcacaacatctcgctgcactggcacggtatccggcagctgcgcacggggtgggcggacgggccggcgtacatcacgcagtgcccgatccagacggggcagagctacgtgtacaactacaccgtcgccgggcagcgcggcacgctgtggtggcacgcgcacatctcctggctgcgcgccaccgtctacgggcccctcgtcgtcctgcccaggcccggcgtcccctacccgttcccggcgccgtacaaggaggtccccgtcatcttcggtgagtggtggctggcggacacggaggtggtggtcgagcaggcgctccagctcggcgctggcccgaacgtctccgacgcccacaccatcaacggcctgccaggaccgctctacaattgctctgccaaagacacgtacaagctgaaggtgaagccagggaagacgtacatgctccgcctcatcaacgcggcgctcaacgacgagctcttcttctccgtcgccaaccactcgctcaccgtcgtcgaggtcgacgccgtctacgtcaagcccttcaccgtcgacaccctgcccatcgccccgggccagaccaccaacgtgctcctcgcagccaagcccttctacccgggcgccaactactacatgtccgccaagccctactccaccgccaggccggccaccttcgacaacaccaccgtcgccggcatcctcgagtacgagtaccccgacgcgccatcctcctccgcggcgagcttcgacaaggccctgccgctccacaggccgaccctgccgcagctgaacgacaccagcttcgtcggcaacttcacggccaagctccgcagcctcgcgacgccgcagtacccggcggccgtgccgcggacggtggacagagcgttcttcttcacggtggggctcggcacgcacccgtgccccgggaacgccacgtgcctgggccccaccaacacgacgcagttcgcggcggccgtgaacaacgtctccttcgtgctcccgaccagggcgctcctgcactcgcacttcgccggcctgtccagcggcgtctactcgtcggacttccccgtcgcgcccctcacgccgttcaactacacggggacgccgccaaacaacaccaacgtggccagcgggaccaagctgatggtcgtcccgtacggcgccaacgtggagctggtgttgcagggcaccagcatcctcggcgtcgagagccacccgctgcacctgcacggcttcaacttcttcgtcgtcggccaaggctacggcaactacgacccggtgaacgacccgcccaagttcaacctcgtcgaccccgtcgagcggaacaccgtcggcgtgccagccggcggctgggtggccatccgcttccttgccgacaaccccggggtatggttcatgcactgtcacttggaggtgcacacaacatggggcctcaggatggcatggttggtgctcgacggcagcctcccgcaccagaagctgctcccaccgccgtccgatcttcccaaatgttgattagactcccctctatatatcctgtgctggtcgcttcaaagggaactgtgaattagacttgatcacaatgttgatttttttgtttactttcttcattgccaattgcaattctttcaacttccattttaactagtccgttctattcccatctgacctggactttttgtaattttttcttccatttgcttaccaccctgtaatgataaatgtgtttggtacactattttgagaacaacgaatggcgcggcttgcaccagagatccat

SEQ ID NO: 1736 - DNA, 2006 bp, Zea mays; identical to SEQ ID NO: 1731

SEQ ID NO: 1737 - DNA, 2064 bp, Oryza sativa Japonica Group
aacattcattccatccttgccaggccatctcccactcaaagtctcacagagctagctgatcaagagccattacagattgtggctcaaagcttaggctacacaaattaagatgaccatggctatctcctctgctcttcctagccctctactcttggcggcttccctactgcttctcatcgtccaagctcagggcatcactaggcactacgaattcaatgtgcaaatggcgaacgcgacgaggctgtgcaacaccaagagcatggtgacggtgaacgggcagtgccccgggccggagctggtggcgagggaaggcgaccgcgtcgtcatccgcgtcaccaacaacgtcgcgcacaacatctcgttgcactggcacggcgtccggcaggtgcggaccgggtgggcggacgggccggcgtacatcacgcagtgcccgatccagacggggcagagctacgtgtacaacttcacggtggccgggcagcgcggcaccctgtggtggcacgcccacatctcctggctccgcgccaccgtctacggcgccctcgtcatcctccccaagctcggcgtcccctaccccttccccgccccgcacaaggaggtccccgtcatcttcggcgagtggtggaacgcggacacggaggaggtggtcaaccaggcggtccagaccggcggaggcccgaacgtctccgacgccttcaccatcaacggcctccccggccctctctacaactgctctgcccaagacacgttcaagctgaaggtgaaacccgggaaaacgtacatgctgcgcctcatcaacgccgcgctcaacgaggagctcttcttcgccgtcgccaaccacacgctcaccgtcgtcgaggtcgacgccgtctacgtcaagccgttcaccgtcgacaccctggtgatctcgccggggcagaccaccaacgtgctcctcaccgccaagccgtactaccccggcgccaacttctacatgtccgccgcgccctactccaccgccaggcctgggaccttcggcaacacgaccgtcgccggcatcctcgagtacgagaaccccgccatgtcgccctccgcggcgagcttcgtcaagggcttgccgctgttcaagccgacgctgccgcagctcaacgacaccgacttcgtcaccaacttcaccgacaagctccgtagcctcgcgacgccggagtacccggcggccgtgccgcagtcggttgacaagcgattcttcttcacggtcgggctgggcacgctgccgtgcccggcgaacatgacctgccagggccccaacaacacgcagatggcggcgtccatgaacaacgtctccttcgtgctcccggcgagggcgctgctgcagtcccacttcaccggactctccagcggcgtgtacgcgccggacttccccgtcgcgccgctgtcgccgttcaactacacggggacgccgccgaacaacaccaacgtgaagaccgggaccaagctgctggtgctgcggtacaacacgtcggtggagctggtgatgcaggacaccagcatcctgggcatcgagagccacccgctgcacctgcacggcttcaacttcttcgtgatcggccaagggttcggcaactacgacgccgtgaacgacccggccaagttcaacctcgtcgaccccgtcgagcgcaacaccgtcggcgtgccggccggcggatgggtggccatccgtttcctcgctgacaacccaggtgtatggttcatgcactgtcatttggaggcgcacacgacgtggggcctgaggatggcatggctagtgttggatgggagccatccgaaccagaagctgcttcctccgccgtccgatctgcccaaatgctagtcgggaccttaccacagatgccgttgattcttctttcctcatttcatttgttcgccaatttgcgattgctttctcctgaaggagattttagtgtgttagcccgttcttagctaacttttgtgacattattttgttcttttttcttttatttgtgtacaactatacaatgacactgttttgatgcttctttgaataaaaaaatgggcattaattgc

SEQ ID NO: 1738 - DNA, 2078 bp, Hordeum vulgare subsp. vulgare
gacatccatccagcccgtcctgcatatcctcacctggccatcagctctctcctcgagagctctggaccattcccatatatagagcggctagctccaagctagcctagctagagccctagctagacaccgccggccatggccatgactatctactccggtcttcactgttctctcctcatggcaaccctgacgctgctcgtcgtccaggcgcagggcatcacccggcactacgatttcaacattcaaatggcgaacgtgacgaggctgtgcggcacgaagagcatcgtgacggtgaacgggcagttcccggggccggagctgatcgcgagggagggcgaccgcgtgcacgtccgcgtcaccaaccacgtcgcgcacaacatgtcaatccactggcacggcgtccggcagatgcggactggatgggcggacgggccggcgtacatcacgcagtgcccgatccagacggggcagacctacgtgtacaagttcacggtgaccgcgcagcgcggcacgctgtggtggcacgcgcacatctcctggttccgctccaccgtctacggcgccatcgtcatcctccccaagctcggcgtcccctacccgttcccggcgccgcacaaggagctccccgtcatcttcggtgaatggtggttgtcggacaccgaggccatagtcagcacggccctcaaggtgggcggagcccccaacatctccgacgcgttcacgatcaacggccttcctgggccgctctacgactgctccgccaaagacacgttcaagctgaaggtggagcccgggaagacgtacctgctgcgcctcatcaacgccgcgctcaacgacgagctcttcttctccgtggccaaccacacgctcactgtcgtcgaggtcgacgccgtgtacgtgaagccgttcaccgtcaagaccctggtcatctccccgggccagaccaccaatgtcctgctcgccaccaagccggtctaccccggcgccaacttctacatgttggcccggccctactccaccatcaggcccggcaccttcgacaactccaccgtcgccggcatcctcgagtaccgcaaccccggctcgccctcttcgtcaagcttcgacaaggccttgcccatcttcaagccgatgctgccctactacaacgacaccaacttcgtcaccaacttcacgaccaagctccgcagcctcgccacaaaacagtacccggcggccgtgccgcagtcggtggacaggcgcttcttcttcaccatcgggctgggcacgctcccgtgccccaagaacatgacgtgccaggggcccaacggcacgcagttcgcggcggccgtgaacaacgtctccctcgtgctcccgtccacggcgctgctgcagtcgcacttcaccggcctcaccagcggcgtctacgcggccaacttcccggtcatgcccctgtcgcccttcaactacacggggacgccgccgaacaacaccaacgtggccaccgggaccaagctcctcgcggtgtccttcaacacgtcggtggagctggtgatgcaggacacgagcatcctcggcatcgagagccacccacttcacctccacggattcaacttcttcgtggtcgggcaaggcttcggcaactacgacgccgtgaacgacccggccaagttcaacctcgtcgaccccgtcgagcgcaacaccgtcggcgtgccggccggcgggtgggtggccattcgattcctcgctgacaacccaggtgtatggttcatgcattgccatttggaggtgcacacgacatggggtctgagaatggcgtggctggtgcaggacggcagcaagccgagccagaagctgctgcccccgccgtctgacatgcccaaatgctgaatggatcacttcaccacagctgatgcttaatttgcccccatcattttgatttactcgccaatttgcgattgttttctcccgcgggagattttagtgtgtttagcccgttcatagctgactttcttacaattcttttttattttcaccactttctgatggacatgttttgatacttcttgaataaacaacgatgtgaagaattgcacgag

SEQ ID NO: 1739 - DNA, 2265 bp, Sorghum bicolor; identical to SEQ ID NO: 1724

SEQ ID NO: 1740 - DNA, 1874 bp, Oryza sativa Japonica Group
cgcgtccgcccacgcgtccgcaatgtgcaaatggcgaacgcgacgaggctgtgcaacaccaagagcatggtgacggtgaacgggcagtgccccgggccggagctggtggcgagggaaggcgaccgcgtcgtcatccgcgtcaccaacaacgtcgcgcacaacatctcgttgcactggcacggcgtccggcaggtgcggaccgggtgggcggacgggccggcgtacatcacgcagtgcccgatccagacggggcagagctacgtgtacaacttcacggtggccgggcagcgcggcaccctgtggtggcacgcccacatctcctggctccgcgccaccgtctacggcgccctcgtcatcctccccaagctcggcgtcccctaccccttccccgccccgcacaaggaggtccccgtcatcttcggcgagtggtggaacgcggacacggaggaggtggtcaaccaggcggtccagaccggcggaggcccgaacgtctccgacgccttcaccatcaacggcctccccggccctctctacaactgctctgcccaagacacgttcaagctgaaggtgaaacccgggaaaacgtacatgctgcgcctcatcaacgccgcgctcaacgaggagctcttcttcgccgtcgccaaccacacgctcaccgtcgtcgaggtcgacgccgtctacgtcaagccgttcaccgtcgacaccctggtgatctcgccggggcagaccaccaacgtgctcctcaccgccaagccgtactaccccggcgccaacttctacatgtccgccgcgccctactccaccgccaggcctgggaccttcggcaacacgaccgtcgccggcatcctcgagtacgagaaccccgccatgtcgccctccgcggcgagcttcgtcaagggcttgccgctgttcaagccgacgctgccgcagctcaacgacaccgacttcgtcaccaacttcaccgacaagctccgtagcctcgcgacgccggagtacccggcggccgtgccgcagtcggttgacaagcgattcttcttcacggtcgggctgggcacgctgccgtgcccggcgaacatgacctgccagggccccaacaacacgcagatggcggcgtccatgaacaacgtctccttcgtgctcccggcgagggcgctgctgcagtcccacttcaccggactctccagcggcgtgtacgcgccggacttccccgtcgcgccgctgtcgccgttcaactacacggggacgccgccgaacaacaccaacgtgaagaccgggaccaagctgctggtgctgcggtacaacacgtcggtggagctggtgatgcaggacaccagcatcctgggcatcgagagccacccgctgcacctgcacggcttcaacttcttcgtgatcggccaagggttcggcaactacgacgccgtgaacgacccggccaagttcaacctcgtcgaccccgtcgagcgcaacaccgtcggcgtgccggccggcggatgggtggccatccgtttcctcgctgacaacccaggtgtatggttcatgcactgtcatttggaggcgcacacgacgtggggcctgaggatggcatggctagtgttggatgggagccatccgaaccagaagctgcttcctccgccgtccgatctgcccaaatgctagtcgggaccttaccacagatgccgttgattcttctttcctcatttcatttgttcgccaatttgcgattgctttctcctgaaggagattttagtgtgttagcccgttcttagctaacttttgtgacattattttgttcttttttcttttatttgtgtacaactatacaatgacactgttttgatgcttctttgaataaaaaaatgggcattaattgcatg

SEQ ID NO: 1741 - DNA, 2004 bp, Sorghum bicolor
atcgccaactcggaaaccttcagaggaaagccactgctagcaaatccccccgcggttccatcgagagccaacgccgccgcggcaacatttcgttctcgccatggcgtcgctgtcgtcgacctggctgctccttctcctctcctgcctcgcgcttgcgctgctcgcggcggacgccgaagtgcaccaccatgagttcgttgtccaagagacgccggtgaagaggctgtgcaagacacacaacatcatcacggtgaacggacagtttccggggccgatgctggaggtcagggagggcgacacgctcgtgatcaacgtcgtcaaccgggcgcagtacaatgtcaccatccactggcacggcatccggcagatgaggactgggtgggcggacgggcctgagttcgtgacgcagtgccccatcaagcccggcggcagctacaagtaccggttcaccatcgaggggcaggagggcacgctgtggtggcacgcgcacagctcctggctcagggccaccgtctacggcgggctcatcatccgccccagggagaacaagacctaccctttcgccaagccctcccgcgaagtccccctcatcctcggggagtggtgggatgcgaacccgatcgatgtcatccgggaggctcagaagacgggcggcggtcccaacgtctccgacgccttcaccatcaacggccagcccggtgacctgttcaaatgctcccagaaagagacgacggccattccggtgaaggccggcgagacggcgcttctacggttcatcaacgcggcgctcaaccacgagctgttcgtcaccatcgcgcagcacaagatgacggtggtcgccaccgacgcgtcctacaccaagcccttcaccacctcggtgctcatgatcgcgccgggccagaccaccgacgtgctcgtcaccatggaccaggcgcccacccggtactacgtcgccgcgcgcgcctacgtctccggccagaacgtggccttcgacaacaccaccaccacggccgtcctcgagtacgactgcggctgcgcctccgacttcggccccaagatacagccggcgttcccggcgctgccggccttcaacgacaccagcgccgccaccgccttcgccgcggggatcaagagccccaacagggtcaagatccacgagaacgtcgacgaatacctcttcttcaccgtcggcctcgggctgttcaactgcaagccgggccagctctgcaagggtcccaacaacaacacccgcttcacggccagcatgaacaacgtctccttcgtcttccccaagtccgactccctcctccacgcgcactactacaaggtccccggcgtcttcaccaccgacttcccggcgtacccgccggtgcagttcgactacacgggaaacgtcagccaggcactgtggcagccggtccccgggaccaagctgtacccgctcaggttcggttccgtggtgcaggtcgtcctgcaggacaccagcatcgtcacgccggagaaccaccccatccacatccatggctacgatttcttcatcctcgccgagggcttcggcaacttcgaccccaagaaggacgtcgagaagttcaactacgtcgacccgccgcagcggaacaccgtggcggtgcccgtcaacggctgggcggtcatccagttcgtcgccgacaacccaggtgtgtggctcatgcattgccatctggacgtgcacatcacctggggcctggcaatggctttcctagtggaggacgggtatggcgaactgcagtccctggagccgcccccagttgatcttcccatgtgctaatgatcagcctgaagacactgtgttgaggaatccgaagactgtttcacgttgtatgttaattatgacttttttgggtatatatttgtgatcttatttctaggggacttgattttccagcttgttttgaacttttcccctgtaaatctatgtaactttcattgccattcagcatattatttgagaataaattatttctt

SEQ ID NO: 1742 - DNA, 2040 bp, Zea mays
atcgcaaactcggaaaccttgagaggaaagccaccagcagcaagcgaagaccaccagcagcagcgcagcggcgacgtgtttcgctctcgccatggcgtcgtcgtcctcgtcccggctgctgctcctcctcctcccgtgcctcgcgctcacgctgctcggcgcggcagacgccgaagtgcaccaccacgagttcgttatccaagagacgccggtgaagaggctgtgcaagacgcacaacatcatcacggtgaacgggcagtacccggggccgacgctggaggtcagggagggtgacacgctcgtcatcaacgtcgtcaaccgggcgcagtacaacgccaccatccactggcacggcatccggcagataaggactgggtgggcggacgggccggagttcgtgacgcagtgccccatcaggcccggcggcagctacaagtaccggttcaccatccaggggcaggagggcacgctgtggtggcacgcgcacagctcctggctcagggccaccgtctacggcgcgctcatcatccgccccagggagaacaagacctacccattcgccaagccctcgcgagaagtccccgtcatcctcggtgagtggtgggatgcgaacccgatcgacgtcatccgggaggcgcagaggaccggcggcggtcccaacgtctccgacgcgttcaccatcaacggccagcccggcgacctgtacaaatgctccaacaaagagactacggccatcccggtggaggccggcgagacggcgctgctgcggttcatcaacgccgcgctcaaccacgagctgttcgtcaccatcgcgcagcacaagatgacggtcgtcgccaccgacgcgtcctacaccaagcccttcaccacctcggtgctcatgctcgcgccgggccagaccaccgacgtcctcgtcaccatggaccagccgcccacccgctactacgtcgccgcgcgcgcctacgtctccggccagaacgtggccttcgacaacaccaccaccacggccgtcctcgagtacgactgcggctgcgcctccgacttcggccccaagatacagccggcgttcccggcggcgctaccggccttcaacgacacgtccgccgccaccgccttcgccgccgggatcaggagccccgaccgggtcaaggtccacgagaacgtcgacgagtacctcttcttcaccgtcggcctcggcctcttcaactgcaagccgggccagctctgcgccgggcccaacaacaacacccgcttcgcggccagcatgaacaacgtctccttcgtcttcccgcagaccgactccctcctccacgcgcactactacaagatccccggcgtcttcaccaccgacttcccggcatacccgccggtgcagttcgactacacggggcagaacgtcagccaggccctgtggcagccggtccccgccaccaagctgtacccgctcaggttcggctccgtggtgcagctcgtcctgcaggacaccagcatcgtcacgcccgagaaccaccccatccacatccacggctacgatttcttcatcctcgccgagggcttcggcaacttcgaccccaagaaggacgtcgagaagttcaactacgtcgacccgccccagaggaacaccgtggcggtgcctgtcaacggttgggcggtcatccagttcgtcgccgacaacccaggtgtgtggctcatgcattgccatctggacgtgcacatcacctggggcctggcaatggctttcctagtggaggacggctatggcgaactgcagtcgctggagccgcccccagttgatcttcccatgtgctagtggaggacggatatttgtgttgaggaagaaagcctgttcacgttgtatgttaattgttactcttttttggtggaggggggcgtgttcgtgatcttaaattcttaggggacttgattttccagcttgatttgaagtttcttctgtaaatctatgtaattttcaattaatgacattcagcatattatttgagaataaattatttctttgtacgaacaaaaaaaaaaaaaaaa

SEQ ID NO: 1743 - DNA, 2148 bp, Zea mays
cgatggtcgaattcgaaggttcgaaacctagctagtcgaccgaacaaacacccacaggccgtagcggggacgccatggagcgagagcctgcgcgctccctggaacgcgctatatatgccgtgcgtgctcggtggcgaagaagcctctcatcgccaactcggagaccttgagaggaaagccaccgcgcgctagggcctagggcagggcacgagcaaaggccctcccgcgggttccattggagcgcgagcgaacggcgccgacgcggcaacacacattcgctttatttgccatgacatcgccgtcctcgtcgtcgtcctggctgctgctgctcctctcgtgcctcgcgcttgccctgctcgcggcggacgccgaagtgcaccaccatgagttcgttgtccaagagacgccagtgaagaggctgtgcaagacgcacaacgtcatcacggtgaacgggcagtacccggggccgacgctggaggtcagagagggcgacacgctggtgatcaacgtcgtcaaccgggcgcagtacaacgtcaccatccactggcacggcatccggcagatgaggaccgggtgggcggacgggccggagttcgtgacgcagtgccccatcaggcccggcggcagctacaagtaccggttcaccatcgaggggcaggagggcacgctgtggtggcacgcgcacagctcctggctcagggcaaccgtctacggcgcgctcatcatccgccccagggagaacaagacctaccccttcgccaagccctcgcgcgaagtccccgtcatccttggggagtggtgggacgcgaacccgatcgacgtcatccgggaggcgcagaggacgggcggcgcccccaacgtctccgacgcgttcaccatcaacggccagcccggcgacctgtacaaatgctcccagaaagagactacggccatcccggtgaagcccggcgagacggcgcttctgcggttcatcaacgccgcgctcaaccacgagctgttcgtcaccatcgcgcagcacaggatgacggtggtcgccaccgacgcgtcctacaccaagcccttcaccacctcggtgctcatggtcgcgccgggacagaccaccgacgtcctcgtcaccatggaccaggcgcccgcccggtactacgtcgccgcgcgcgcctacgtctccgggcagaacgtggcgttcgacaacaccaccaccacggcggtcgtcgagtacgactgcggctgcgcctccgacttcggccccaagatccagccggcgttcccgtccctcccggccttcaacgacaccgccgccgccgccgccttcgccgcggggatcaagagccccggcagggtcagggtccacgagagcgtcgacgagcacctcttcttcaccgtcggcctcggcctgttcaactgcgagccgggccagctctgcgccgggcccaacaacagcacccgcttcacggccagcatgaacaacgtctccttcgtcttcccgcggaccgactccctcctccacgcgcactacttcaagacccccggcgtcttcaccaccgacttcccggcgcacccgccggtgcagttcgactacacggcgcagaacgtcagccaggccctgtggcagccggtccccgcgaccaagctgtacccgctcaggttcggctccgtggtgcagctcgtcctgcaggacaccagcatcgtcacgcccgagaaccaccccatccacatccatggctacgatttcttcatcctcgctgagggctttggcaacttcgaccccgagaaggacgtcgacaagttcaactacgtcgtcccgccgcagcggaacaccgtggcggtgcccgtcaacgggtgggcggtcatccagttcgtcgccgacaacccaggtgtgtggctcatgcactgccacctggacgtgcacatcacctggggcctggcaatggctttcctagtggaggacgggtatggagagctgcagtccctggagccgcccccagttgatcttcccatgtgctaatgctgaccagaagcaactgtgttgaggaatcgaaagcatgttcacgcttccagcttgttttgaagttttcccctgtaaatctatgtaattttcaatgacattcagcatattattagagaataaattatttctttttgtgtatg

SEQ ID NO: 1744 - DNA, 2022 bp, Oryza sativa Japonica Group
atcgccacacagaaaccttcagggcaagagctatagctaagctactgtgtcacccgttcgatcggtgagccgacgccagcacacgcgccgcaacgtttgcgcttagccggcatggcgtcgtcctcgtcgtcccggctgctcttcctcctctcgtgcagcgtgctcgcgctgctcgccggcgccgaagtgcaccatcatgaattcattgttcaagagacgccggtgaagaggctgtgcaagacacacaacgtgatcacggtgaacgggcagctgccggggccgacgctggaggtccgggagggcgacaccgtggtgatcaacgtcgtcaaccacgcgcagtacaacgtcaccatccattggcacggcatccggcagttcaggacggggtgggcggacgggccggagttcgtgacacagtgcccgatcaagccgggcggcagctacaagtaccggttcaccatcgaggggcaggagggcacgctgtggtggcacgcgcacagctcctggctcagggccaccgtctacggcgcgctcatcatccgccccagggagaacaagacctaccccttcgagaagcccgcgcgagaagtcccccttattctcggggaatggtgggacgcggacccgatccaagtcatcagggaggctcagaggaccggcgccgcgccgaacatctccgacgcgtacaccatcaacggtcagcctggtgatctgtacaactgctccaaggaagagaccacggctgtcccggtgaagcccggcgagacggcgctgctgcggttcatcaacgcggcactcaaccaggagctgttcgtctcgatcgcgcagcacaagatgaccgtggtcggcgtcgacgcgtcctacaccaagccgttcaccacctcggtgctcatgatcgcgccgggccagaccaccgacgtcctcgtcaccatggaccaggcgcccacccggtactacctcgccgcgcgcgcctacgactccgcgcagggcgtggcctttgacaacaccaccaccacggccgtcatcgagtacgactgcggctgcgccaccgacttcggcccctccatcccgccggcgttcccggtcctcccggcgttcaacgacaccaacaccgccaccgccttcgccgcgggcatcaggagcccccacgaggtcaagatccccggccccgtcgacgagaacctcttcttcaccgtcggtgtcggcctgttcaactgcgagcccgggcagcagtgcggtggcccgaacaacactcgcttcacggccagcatgaacaacatctccttcgtcttcccgcagaccacctcgctcctccacgcgcactactacggcatccccggcgtgttcaccaccgacttcccggcgtacccgccggtgcagttcgactacacggcgcagaacgtcccccgctacctgtggcagcccgtcccggcgacgaagctgtacaagctcaagttcggctccgtggtgcagatcgtcctgcaggacaccagcatcgtctcgccggagaaccaccccatccacatccacggctacgacttctacatcctcgccgagggcttcggcaacttcgaccccaagaaggacgccaagaagttcaactacgtcgacccgccacagaggaacaccgtcgcggtgccgacaaacggctgggccgtcatccggttcgtcgccgacaaccctggggtgtggctcatgcattgccatcttgacgtgcacataacctggggcctggcaatggcgttcctggtggaggatgggtatggcaaactggagactctggaggcgcctcctgttgatcttccaatgtgctagtgatcagcattcggcagatgatgatactgcgttaagaatacaaaatcccgttcatgtcgtattccaaattgatgctttttgggggtttattttgtgatctccagtactaggggttgatttttcatcttgatttgagctttcccctgtaaagttaagagtttttatgtgatttctatgcattattttggaataaatcctttttgtagc

SEQ ID NO: 1745 - DNA, 2127 bp, Zea mays
cttgagaggaaagccaccagcagcaagcgaagaccaccagcagcagcgcagcggcgacgtgtttcgctctcgccatggcgtcgtcgtcctcgtcccggctgctgctcctcctcctcccgtgcctcgcgctcacgctgctcggcgcggcagacgccgaagtgcaccaccacgagttcgttatccaagagacgccggtgaagaggctgtgcaagacgcacaacatcatcacggtgaacgggcagtacccggggccgacgctggaggtcagggagggtgacacgctcgtcatcaacgtcgtcaaccgggcgcagtacaacgccaccatccactggtacgtacgtcgttgaagctcgtttttctcaaccgtgagtgacatgacatgacatgacatcgatcgtctggtctgtctatactctctcccgttcatggccggctgtctcgatcaatgcgcgctgcatgcatggcgtgtgcaggcacggcatccgccagataaggactgggtgggcggacgggccggagttcgtgacgcagtgccccatcaggcccggcggcagctacaagtaccggttcaccatccaggggcaggagggcacgctgtggtggcacgcgcacagctcctggctcagggccaccgtctacggcgcgctcatcatccgccccagggagaacaagacctacccattcgccaagccctcgcgagaagtccccgtcatcctcggtgagtggtgggatgcgaacccgatcgacgtcatccgggaggcgcagaggaccggcggcggtcccaacgtctccgacgcgttcaccatcaacggccagcccggcgacctgtacaaatgctccaacaaagagactacggccatcccggtgaaggccggcgagacggcgctgctgcggttcatcaacgccgcgctcaaccacgagctgttcgtcaccatcgcgcagcacaagatgacggtcgtcgccaccgacgcgtcctacaccaagcccttcaccacctcggtgctcatgctcgcgccgggccagaccaccgacgtcctcgtcaccatggaccagccgcccacccgctactacgtcgccgcgcgcgcctacgtctccggccagaacgtggccttcgacaacaccaccaccacggccgtcctcgagtacgactgcggctgcgcctccgacttcggccccaagatacagccggcgttcccggcggcgctaccggccttcaacgacacgtccgccgccaccgccttcgccgccgggatcaggagccccgaccgggtcaaggtccacgagaacgtcgacgagtacctcttcttcaccgtcggcctcggcctcttcaactgcaagccgggccagctctgcgccgggcccaacaacaacacccgcttcgcggccagcatgaacaacgtctccttcgtcttcccgcagaccgactccctcctccacgcgcactactacaagatccccggcgtcttcaccaccgacttcccggcatacccgcccgtgcagttcgactacacggggcagaacgtcagccaggccctgtggcagccggtccccgccaccaagctgtacccgctcaggttcggctccgtggtgcagctcgtcctgcaggacaccagcatcgtcacgcccgagaaccaccccatccacatccacggctacgatttcttcatcctcgccgagggcttcggcaacttcgaccccaagaaggacgtcgagaagttcaactacgtcgacccgccccagaggaacaccgtggcggtgcctgtcaacggttgggcggtcatccagttcgtcgccgacaaccctggtgtgtggctcatgcattgccatctggacgtgcacatcacctggggcctggcaatggctttcctagtggaggacggctatggcgaactgcagtcgctggagccgcccccagttgatcttcccatgtgctagtggaggacggatatttgtgttgaggaagaaagcctggtcacgttgtatgttaattgttactcttttttggtggaggggggcgtgttcgtgatcttaaattcttaggggacttaattttccagcttgttggtttgaagtttcttctgtaaatctatgtaattttcaatgacattcagcatattatttgagaat

SEQ ID NO: 1746 - DNA, 1932 bp, Populus trichocarpa
aaaatggaggttatcaagtctatctttgctgatcgtcattgttctttcttcctggtcgtgctgcttctagcctcaacaatgtcattagcgattgcagagatccaccaccatgattttgttgttcaagcaacgaaagtgaagaggctgtgcaaaacccacaatagcatcacagtcaatgggatgttcccagggccaaccctggaagtgaaaaatggagacactctagttgtaaaagttgtcaacaaagcccgatacaacgttaccattcactggcatggtattaggcaaatgagaacgggctgggcagatgggccagaatttgtgacacaatgcccgatcagaccaggtgggagttatacctacaggtttaatattgaaggacaagaagggacactttggtggcatgctcatagctcttggcttagagccaccgtttatggtgctctaattatccatccaagagaaggatcctcgtatccgttcgctaagccaaagcgtgaaacacccatacttcttggcgaatggtgggatgcgaatcccgttgatgtggtgagggaggcaactagaactggagcagctccaaatatatctgatgcatataccattaatggtcaacctggtgatctttataattgttccagcgaagatactaccatcgttccgatcgcctctggtgagacaaacctccttcgagtcatcaatgctgcactcaatcaaccgcttttcttcacaatagccaatcacaagttcacagttattggtgctgatgcctcttatcttaaaccctttactacctcggtcataatgctaggaccaggccaaaccactgatgttttgatctcaggcgaccaactacctggccgatattacatggcagctcgagcttatcagagtgcgcaaaatgcaccatttgacaatactacaaccactgccattcttgaatacaaatctgccctttgccctgctaagtgtacaacaaaaccagttatgcctcgacttccagcttataacgacacagctacagttacagcattcagtggaagccttagaagccctcgaaaagtcgaggtcccaacagatattgacgagaacctcttcttcacaattggtctagggcttaacaactgtcctaaaaattccagagctaggcggtgtcaaggacccaacggcactcgcttcaccgctagcatgaacaatgtttcttttgtgtttccttcaaacattgcgttactgcaggcgtatcagcaaaaagttcctggaatttacaccactgactttccagcaaaaccaccagtaaagtttgattacactggtaatgtgagtcgttccctctttcagcctgttcgtggaactaagctgtacaagttgaagtacggatcaagggtgcagattgtgttgcaggacacgagcattgtcacaccagaaaaccacccaatccatcttcatggatacgacttctacatcattgcagaaggatttggaaatttcaatcccaaaactcataaatctaaatttaatcttgttgatccaccaatgaggaatacagttgcagtgccttcgaatggatgggcagtcattagatttgttgctgacaatccaggtgtgtggctaatgcactgtcacttggatgttcacatcacatggggtttggccatggctttcttggtagaggatgggattggggaattacagagtgtagagcctcctccagcagatctgccgatatgttaattatgatcgaaacataaaagaagattttacccattgttgacaaggattttctttctgttgttcttccctacatttggggacatagctcaatattgtatttttcctctctgcctttgaaacaagagtcgccatctcatgttagtgactgacctgcttgtttcttgattttagagctattcttctctcttcgttaataataca

SEQ ID NO: 1747 - DNA, 1980 bp, Populus trichocarpa
ttgctcctgcttctggcctcagcaatgtcattagctattgcaaaaacccaccaccatgattttactgttcaagcaacaaaagtgaaaaggctatgcaaaacccacaacagcatcacagtaaacggaatgttcccggggccaaccttggaagtgaagaacggagacactctagttgtaaaagttgtgaacagagcccgatataatgttaccattcactggcacggtattaggcaaatgagaacgggctgggcagatgggccagaatttgtgacacaatgcccaattagaccaggtggaagttacacctacaggtttactattgaaggacaagaaggaacactttggtggcatgctcatagctcctggcttagagccactgtttatggtgctctaatcatccatccaagagaaggatcatcgtatccattctctaagccaaagcgtgaaacacccatactccttggtgaatggtgggatgcgaaccctattgatgtggtgagggaagcaactagaaccggagcggctcctaatatatctgatgcttataccattaacggtcaacctggtgatctttttaactgctccagcaaagatactaccatcgttccgatcgactctggtgagacaaacctcctccgagtcatcaatgctgcactcaatcaaccacttttcttcaccatagccaaccacaagtttacagttgtcggtgccgatgcatcctatcttaagccctttaccacctcggtcatcatgctaggacctggccaaaccacagatgttttgatctctggcgaccaactacctggccgatattacatggcagcccgagcctatcaaagtgcgcaaaatgcaccatttgacaatactaccaccactgccattcttgaatacaaatctgttctttgccctgcgaagtgtacaaagaaaccatttatgccaccacttccagcttacaatgacacagctacagtcacagccttcagtagaagctttagaagtcctcgaaaagttgaggtcccgaccgatattgatgagaacctcttcttcacaatcggcctaggactcaacaattgtcccaaaaactttagagctaggcggtgtcaaggacccaacggcactcgtttcactgctagtatgaacaatgtgtcctttgtgtttccttcaaaagcctcgctattgcaagcatataagcaaaaaattcctggagtcttcaccaccgattttccagcaaaaccacaagtaaaatttgactacactggcaatgttagtcgttccctctttcaacctgctcgtggaactaagctgtacaagttgaagtacggatcaagggtgcagattgtgctacaggacacgagcatcgtcacaccagaaaaccatccgatccatctccatggatacgacttctacatcatcgctgaaggatttgggaatttcaatcccaaaactgataaatccaaattcaaccttgttgatccaccaatgaggaatacagttgcagtacccgtgaatggatgggcggttattagatttgttgctgacaacccaggtgtgtggctaatgcactgtcacttggatgttcacatcacatggggtctggccatggcgtttttggtagaagaggggattgggattttacagagtgtcgagcctcctccagccgatctgccaatatgttaattaatatcaatacataaaagaagattttacccattgttgacactcatagaagccaacaactacaggattttctttcacctttttttctgtttcttgtagtcaatttcccatgttgttcttccctgcatttggggacatatttcattattgtattcttcctctctgggcttacaagccttagaaacaagagctgccatcttattttagttattgacctgcttgttattgattttccagagctgtttttgtttctcttcgttaataatacattcaaactttttgaaaaaaaaaaaaaaaaaaaaa

SEQ ID NO: 1748 - DNA, 2018 bp, Populus trichocarpa
atggaggttatcaaccgtatctttgctaatcgccattgttctttcttcttgctcctgcttctggcctcagcaatgtcattagctattgcaaaaacccaccaccatgattttactgttcaagcaacaaaagtgaaaaggctatgcaaaacccacaacagcatcacagtaaacggaatgttcccggggccaaccttggaagtgaagaacggagacactctagttgtaaaagttgtgaacagagcccgatataatgttaccattcactggcacggtattaggcaaatgagaacgggctgggcagatgggccagaatttgtgacacaatgcccaattagaccaggtggaagttacacctacaggtttactattgaaggacaagaaggaacactttggtggcatgctcatagctcctggcttagagccactgtttatggtgctctaatcatccatccaagagaaggatcatcgtatccattctctaagccaaagcgtgaaacacccatactccttggtgaatggtgggatacgaaccctattgatgtggtgagggaagcaactagaaccggagcggctcctaatatatctgatgcttataccattaacggtcaacctggtgatctttttaactgctccagcaaagatactaccatcgttccgatcgactctggtgagacaaacctcctccgagtcatcaatgctgcactcaatcaaccacttttcttcaccatagccaaccacaagtttacagttgtcggtgccgatgcatcctatcttaagccctttaccacctcggtcatcatgctaggacctggccaaaccacagatgttttgatctctggcgaccaactacctggccgatattacatggcagcccgagcctatcaaagtgcgcaaaatgcaccatttgacaatactaccaccactgccattcttgaatacaaatctgttctttgccctgcgaagtgtacaaagaaaccatttatgccaccacttccagcttacaatgacacagctacagtcacagccttcagtagaagctttagaagtcctcgaaaagttgaggtcccgaccgatattgatgagaacctcttcttcacaatcggcctaggactcaacaattgtcccaaaaactttagagctaggcggtgtcaaggacccaacggcactcgtttcactgctagtatgaacaatgtgtcctttgtgtttccttcaaaagcctcgctattgcaagcatataagcaaaaaattcctggagtcttcaccaccgattttccagcaaaaccacaagtaaaatttgactacactggcaatgttagtcgttccctctttcaacctgctcgtggaactaagctgtacaagttgaagtacggatcaagggtgcagattgtgctacaggacacgagcatcgtcacaccagaaaaccatccgatccatctccatggatacgacttctacatcatcgctgaaggatttgggaatttcaatcccaaaactgataaatccaaattcaaccttgttgatccaccaatgaggaatacagttgcagtacccgtgaatggatgggcggttattagatttgttgctgacaacccaggtgtgtggctaatgcactgtcacttggatgttcacatcacatggggtctggccatggcgtttttggtagaagaggggattgggattttacagagtgtcgagcctcctccagccgatctgccaatatgttaattaatatcaatacataaaagaagattttacccattgttgacactcatagaagccaacaactacaggattttctttcacctttttttctgtttcttgtagtcaatttcccatgttgttcttccctgcatttggggacatatttcattattgtattcttcctctctgggcttacaagccttagaaacaagagctgccatcttattttagttattgacctgcttgttattgattttccagagctgtttttgtttctcttcgttaataatacattcaaactttttgaattctctgct

SEQ ID NO: 1749 - DNA, 1839 bp, Zea mays
ctgattctgattctgattccagccaccctgaccggcgaagcgcggctgacatttcccccccaccataccgccaccacctgagaagagatcgatccaatcagattaaccaattagcagggagggaggagaggggcaaaggcaatggccgggacggaggtggaggacccgccggcggcggcgttggaggtgcccgcgaaacgcggccttctgcggtacaactcgccgctggcgcaggtgtccctgctgggcctcatctgcttctgctgccccggcatgttcaacgcgctgtcgggcctcggcggcggaggccaggtcgaccccaccatcgccgacaacgccaacaccgcgctctacgcctgcttcgcggtgttcggcgtgctgggcggcgccgcgcacaacctgctgggcccgcgcgcgacgctgctggccggcgcgctcacgtacccgctctacgccggctccttcctctactacaaccaccgcccgggctcgcaggtgttccccgtcacggcgggcgccctgctcggcgccggcgcgggcttcctctgggcggcgcagggcgccgtcatgacgtcgtacccgccgcccaaccgccggggcacctacatctccctcttctggtgcctcttcaacctgggcggcgtcctcggcggcctcctccctttcgccctcaactacaaccgcggggacaagaaagggagcgtcagcgacggcacgtacatcgccttcatggcattcatgctcgtcggcgccgcgctcaccgtgctcgtgctgccgcccgccaggatcgtccgcgacgacggcaccagggccaccagggtcaccttctcctccccggccaccgagggcgccgagatcctcaagctcttcgccaactggaagatgctgctcgcgctgccggccgcctgggccagcaacttcttctacacctaccagttcaacaacgtcaacagcggcctcttcacgctccgcaccaggggcctcaacaacgtcttctactggggcgcgcagatgatcggctccgccggcatcggctacttcctcgacttcggcttcgccagccgccgaaagagggggctgttcggggtcgccgccgtcgccgccgtcggaacggccatctggggaggcggtctggccaaccagctcagctacaatgccgtgccggtgcccgaccccatcgatttcaaggacggccaccgctacgccgggcccttcctgctctacttcagctacggactgctagatgccatgttccagagccttatctactggatcatcggcgcactcgccaacgactcccaaatcctcagcaggtacgtcgggttctacaagggggtgcagagtgcgggagcggcggtggcatggcaggtggacaggcgccacacgcccctcatgtcccagctgatcgtcaactgggggctcatgaccatcagctaccccttgcttgcgctgctggtgttcctggccgtgaaggacgagagctactcggtttcgtcggtggaggacggccgggagaaggacagcaagctgtccgcgccgaccagcttccactgatgaagaagaagaaggatagaccaagatgcacgtcactgtaattgtaacacggtgtttccatccaagtaagttttagtagtagaaatcaagaaacaactggagcatactcagggtgtggcgttcgtttttaagtaagttgtagtagtattcgttttggtgattgttatttattatagcacctctgggttagcttgagcatcatgcttccttgtcagtggtgtgaccaagaaattggatagaatctatatgaaggaattcttttgctatttaaaattgttctctctc

SEQ ID NO: 1750 - DNA, 1679 bp, Zea mays
gccgggacggaggtggaggacccgccggcggcggcgttggaggtgcccgcgaaacgcggccttctgcggtacaactcgccgctggcgcaggtgtccctgctgggcctcatctgcttctgctgccccggcatgttcaacgcgctgtcgggcctcggcggcggaggccaggtcgaccccaccatcgccgacaacgccaacaccgcgctctacgcctgcttcgcggtgttcggcgtgctgggcggcgccgcgcacaacctgctgggcccgcgcgcgacgctgctggccggcgcgctcacgtacccgctctacgccggctccttcctctactacaaccaccgcccgggctcgcaggtgttccccgtcacggcgggcgccctgctcggcgccggcgcgggcttcctctgggcggcgcagggcgccgtcatgacgtcgtacccgccgcccaaccgccggggcacctacatctccctcttctggtgcctcttcaacctgggcggcgtcctcggcggcctcctccctttcgccctcaactacaaccgcggggacaagaaagggagcgtcagcgacggcacgtacatcgccttcatggcattcatgctcgtcggcgccgcgctcaccgtgctcgtgctgccgcccgccaggatcgtccgcgacgacggcaccagggccaccagggtcaccttctcctccccggccaccgagggcgccgagatcctcaagctcttcgccaactggaagatgctgctcgcgctgccggccgcctgggccagcaacttcttctacacctaccagttcaacaacgtcaacagcggcctcttcacgctccgcaccaggggcctcaacaacgtcttctactggggcgcgcagatgatcggctccgccggcatcggctacttcctcgacttcggcttcgccagccgccgaaagagggggctgttcggggtcgccgccgtcgccgccgtcggaacggccatctggggaggcggtctggccaaccagctcagctacaatgccgtgccggtgcccgaccccatcgatttcaaggacggccaccgctacgccgggcccttcctgctctacttcagctacggactgctagatgccatgttccagagccttatctactggatcatcggcgcactcgccaacgactcccaaatcctcagcaggtacgtcgggttctacaagggggtgcagagtgcgggagcggcggtggcatggcaggtggacaggcgccacacgcccctcatgtcccagctgatcgtcaactgggggctcatgaccatcagctaccccttgcttgcgctgctggtgttcctggccgtgaaggacgagagctactcggtttcgtcggtggaggacggccgggagaaggacagcaagctgtccgcgccgaccagcttccactgatgaagaagaagaaggatagaccaagatgcacgtcactgtaattgtaacacggtgtttccatccaagtaagttttagtagtagaaatcaagaaacaactggagcatactcagggtgtggcgttcgtttttaagtaagttgtagtagtattcgttttggtgattgttatttattatagcacctctgggttagcttgagcatcatgcttccttgtcagtggtgtgaccaagaaattggatagaatctatatgaaggaattcttttgctattt

SEQ ID NO: 1751 - DNA, 1569 bp, Sorghum bicolor
atggccacgacgacggaggtggagggcccgccgccgccgccggcgaagcgcggcctcctgcggtacaactcgccgctggcgcaggtgtccctgctggggctcatctgcttctgctgcccgggaatgttcaacgcgctgtcgggcctcggcggcggcgggcaggtggacgccagcaccgccgacaacgccaacacggcgctctacgccttcttcgccgtcttcggcgtgctcggcggcgccgcccacaacctcctcggcccgcgcgtgacgctgatgctgggcgcgctcacctacccgctctacgccggctccttcctcttctacaaccaccacccgcacaagcaggcgttccccgtcacggccggcgcgctgctcggcgccggcgcgggcttcctctgggcggcgcagggcgccgtgatgacctcgtacccgccgcccaaccgccggggcacctacatctccctcttctggtgcctcttcaacctcggcggcgtcctcggcggcctgctccctttctccttcaacgtgctcgtgctgccgcccgccaggatcgtccgcgacgacggcaccaaggccaccagggtcaccttctcgtccccggccaccgagggcgtcgagatcctcaagctcttcgccaactggaagatgctgctcgtgctcccggccgcctgggccagcaacttcttctacacctaccagttcaacaacgtcaacggcggactcttcacgctccgcaccaagggactcaacaacgtcttctactggggcgcgcagatgatcggctccgccggaatcggctacttcctcgacttcggattcgccagccgcaggaagagagggctggtcggagtcgtcgccgtcgccgtccttggaacggccatttggggagggggtctggcgaaccagctcaagtacagaactgtgccgttgctccaccccatcgatttcaaggatggccaccgctacgccggaccgttcctgctctacttcagctacggcctgctggatgccatgttccagagcctcatctactggatcatcggtgccctcgccaacgactcccaaatcctcagcaggtacgttgggttctacaagggagtgcagagtgcaggagcggcggtggcatggcaagtggacaagcaacacacgcccctgatatcccagctgattgtgaactgggggctcatgaccatcagctacccattgcttgtgctgctggtgttcctggccgtgaaggacgaggactactctgtttcttcagtggaggaggacggcaaggagaaagatagtaagctgtcagcaccaaccagcttccactaaggatgatagatcacgatgttacgggtttttcatcaaagttgtagaaatcaagaaacaactgaagtacctatgcaaagaatatttagggtgtggcgtttttatgtatgtggattacctgatggggatgacagtattcgtttggtgattattactattctctccgtgttagattgagcatgcttgcatctactccttgtccgtggtgtaacatatgccatttttgagcaatgaaaggtttattatattcct

SEQ ID NO: 1752 - DNA, 1440 bp, Sorghum bicolor
atggccgtgacggacgtggagggcacggcggcgccggcggcattggagttggaggtgcccgcgaagcgcagtatcctacggtacaactcgccgctggcgcaggtgtccctgctggggctcatctgcttctgctgccccggcatgttcaacgcgctgtccggcctgggcggcggcgaccaagtcgacgcctccacggccgacaaggccaacacggcgctctacgcctgcttcgccgtcttcgccatcctcggcggcggcgcgcagaacctccttggcccgcgcgcgacgctgatgctgggcgcgctcacctacccactctacgccggctccttcctctactacaagcaccacccggagtcgcaggcgttccccgtcacggcgggcgcgctgctcggcgccggcgcgggtttcctctgggcggcgcagggcgccgtgatgacctcgtacccgccgcctaaccgccggggcacctacatctccctcttctggtgcatcttcaacctcggcagcgtcctcggcggtctcctccctttctccttcaactaccaccgcagcaacaagcagcctgccagtgtcgtcaacaacagcacgtacatcgccttcatagccttcatgctcgtcggcgccgggctcaccgtgctcgtgctgccgccggccaagatcgtccgcgacgacggcaccaaggccactactaccactagtagggtcgtcgtcgtccccttctcgtccccggccgccgccgagggcgccgagatcctcaagctcttcaccaactggaagatgctgctcgtgctcctgcccgcctgggctagctcttctaccggaacgctcttcttctacaccgaccagttcaacggcggcgtcttcacgctccgcaccaaggggctcaacaacgtcgtcttctggggtgcgcagatgatcggctccgccggcatcggctacttcctcgacttcggattcgccagccggaggaagagagggctgttcggagtcgtcgccgtcgccgtcgtcggaacggccatctggggaggcggtctggcgaaccagctcaagtacagaggagtggagttggtcgaccccatcgatttcaaggacggccaccaccgctacgccgggccgttcatgctctacttctgctacggactgctggatgccatgttccagaccgtcatctactggatcatcggcgccctcgccattaatgactcccaaattctcagcaggtacgttgggttcttcaagggagtgcagagcgcgggagcggcagtggcatggcaagtgaacaggcgccacacgccgctaagatcccagctgattgtgaactgggcgctcattaccgttagctaccccttgcttgcactgctggtgttcgtggccgtgaaggacgaggactactcggtttcttcagtggaggacggcaaggagaatgatagtaattaa

SEQ ID NO: 1753 - DNA, 2610 bp, Oryza sativa Indica Group
atggccgtgacggcggaggtggagtcgtcgccggcggcgacggggaagctgcggtacaactcgccgctggtgcaggtgtccctgatcgggttggtgtgcttctgctgccctggcatgttcaacgccctgaccgggctcggcggcggcgggcagctggaccactccaccgccgacaacgccaacaccgccctctactcctgcttcgccgtcttcggcgtcctcggcggcgccgcccacaacctcctcggcccgcgcgttaccctcctcgccggcgccctcacctacccgctctacgccgcctccttcctctactacaaccaccacccctcccgccaggccttccccgtcaccgccggcgccctcctcggcgtcggggccggactcctctgggccgcgcagggcgccatcatgacgtcatacccacccccgtcccgccgcggctcctacatctccctcttctggtgcctcttcaacctcggcggcgtcctcggtggcctcctccccttctccctcaactaccaccgcgccgctgacgccgccagcgtcaacgacgccacctacatcgccttcatggcgttcatgctcctcggcgcgggcctcgccctcctcctcctgccggcctccaggatcgtccgcgacgacggtagccgcgccaccaggatgagctactcctccgtgtccaccgaggggtgggagatcctcaagctgttcgccaactggaggatgctgctcgtcctccccgccgcatgggccagcaacttcttctacacctaccagttcaacaacgtcaatggccgcctcttcacgctccgcaccaagggcctcaacaacgtcttctactggggcgcccagatgctcggctccgcggccatcggctacttcctcgacttcggattcggatcctccagcaggaggaggaggggcctgtgcggggtcgcggccgtcgccgtgctcggcaccgccatctgggccggcggcctcgccaaccagctccgctacgccgacggcaattggggggagaggctcatcgatttcaaggatgggcggcggtacgcggggcccttcctgctctacttcagctacggattgctggacgccatgttccagagcctcatctactggatcatcggcgccctcgccaacgacacccaaatcctcagcaggttccctacctaacttcattcatttctaacaacaattaagtcaccaacaaatatgatatggctgagtttttaatctcttttgttattattattattattattattattattattattattattattattattacctcgtactgatgactaaggatttgtagaacagttcaaactgtctgtggttttagtatgttatttaggatggtcaattaacaatcagattaagattggaatcggatagcagacctcctgctttacggctcagaaacacactctgcttgctggaatctgactcttttcctgttcaaacatacagagccataataattaaatagaaaaaaacaatatgtttctctgataactaaagaacgtgtattcgattgtcctggtcgcagatttgcagtgttacaattgataaaatagtccatttagtgttttctgaaacgaaaccagtttcgcttcgctggtgattatagacatatagagaaagcactgacactgtacattgtataaagggggaaagaaaaactaaagactcctcttgattttcgttgaactcttcaaatttattgttcgttttcagtagtgcccctagccggatatgataattattggtatgttccatttcatctggcatctcaatcatcatgcatttcgaaagggtgtgagcttttcaagtaaggcatgtaactgaaggcttgcgaattttagattctttgggctattgaccaacatgaaagagacatgctaagaaaagcaatgcgtgtctctatcctctatatccctgtggtttgtaagctgccacctgcaagcttgacaacaaaagcatcatttgatcttcttttttcctgcagaaattagcagtttcttactgtctgtaacttaattgtacagcagatttaccctcaggattctagtatctttacatagcaaccgaaattccaacaataaatttgaaagtgtacgagagaaaaggattcttatccaattagcatttcctttaaagttactaccatgattgctctgcaaagtcatccgtttcaaaagtgaatctttgaatgtttgctgtgtgtgttaaaagttttgccaagtaaagagatccaactgatggttgtagaaagatccatcttttaacttttaaatatgcatgtcgagcagaccaaatcacaaaaatacttgtctcagttaaatgtgtattttttgtgcagatatgttggattctataagggagtgcaaagtgctggagcagctgtggcatggcaaattgatacccacaagacaagcctaatttcgcaactgattgtgaattgggcgcttactaccgtgagctaccccttgcttgcactcttggtgttcttagctgtgaaggaggaggacagttctgtttcttctgttgaggatggcaaagagaaagatagcaaactgtctgctccaaccagcttccact

SEQ ID NO: 1754 - DNA, 1836 bp, Hordeum vulgare subsp. vulgare
ggccttcgtctccgccgatttgtctccacccacccacctcactcctctccgccggccggtccattcagaggcacgaaatggccgtgacggagctgccggaggccgggtcatccccgcaggagcaggcgacggaggcgacggcgccgcccaggcccggcctgcggtacaactcgccgctggtccaggtgtcgctgatcgggctggtgtgcttctgctgcccgggcatgttcaacgcgctgtccgggctgggcggcggcgggcagttcgaccacaccacggccgacaacgccaacacggcgctctacgcctgcttcgccgtcttcggcgtcctcggcggcgccgcccacaacctgctcggcccgcgcctcacgctcctcctcggcaccctcacctacccgctctacgccgcctccttcctctactacaaccaccgaaagtcacaggttttccccatcacggccggcgcgctcctcggcgccggcgcgggcctgctctgggcggcgcagggcgccatcatgacctcctacccgccgcccaaccgccggggcagctacatctcgctcttctggtgcctcttcaacctcggcggcgtgctcggcggcctcctccccttctccttcaactacacccgcacggacgcgggcagcgtgaacgacgccacctacgcggccttcatcgccttcatgctcctcggcgccgcgctcaccttcctcgtcctgccgcccgccaggatcgtgcgcgacgacggcacgcgcgccaccagggtgacctactcctcggtgtccacggaggggtgggagatcctcaagctgtttgccaactggaggatgctgctcatcctgccggcggcatgggccagcaacttcttctacacctaccagttcaacaacgtcaatggcctcctcttcaccctcaggaccaagggcctcaacaacgtcttctactggggcgcgcagatgctcggctccgccggcatcggatacttcctcgacttcggcttcgccagccgcaggaagaggggcctcatgggcgtcgccgccgtcgccgtcctcggcaccgccatctgggccggcggcctggcaaaccaattgaggtacctcgacggcaccttcccagaccagatcgacttcaaggagggacgccgctacgccggacccttcctgctctacttcagctacggcctgctcgacgccatgttccagagcctcatctactggatcatcggcgcgctcgcaaacgatacccagatactaagcagatatgttggtttctacaagggggtgcagagcgctggagcggcggtggcatggcaggtggacacccacaagacgtccctgctgtcgcagctgatcgtcaactgggggctgaccaccgtcagctacccgctgctggccgtcctggtgctcctggccgtgaaagacgaggactactccgtgtccaacgtcgacgacgccggcaaggagaaagacaccaagatggccgcgccgtcaagcttccactgaggagagctcgctagtgttttctcagtccttcatcagcgtgttcgtctgcagcgatcgtcttgcgagtgcagtggtgcaggcgcgagtgctctagctgctcgatcgccgcgcaatcttcgcgtcctgtcagattgttaatccggtgtgtgatcttcgtgttgtgtccaactgttactccagtgtgtgtatgtgtgtgtgtagttcatggcggcggtggtggtgttcattggtaacatcatgtgataattttttctctgttttcattgccttcggtccacttaaattagcttcagtaaatggtgacagtacagagaatacagtttcgttgcttgct

SEQ ID NO: 1755 - DNA, 1123 bp, Zea mays; identical to SEQ ID NO: 1713

SEQ ID NO: 1756 - DNA, 988 bp, Zea mays; identical to SEQ ID NO: 1711

SEQ ID NO: 1757 - DNA, 1012 bp, Zea mays; identical to SEQ ID NO: 1710

SEQ ID NO: 1758 - DNA, 1079 bp, Zea mays; identical to SEQ ID NO: 1712

SEQ ID NO: 1759 - DNA, 1092 bp, Sorghum bicolor; identical to SEQ ID NO: 1709

SEQ ID NO: 1760 - DNA, 1731 bp, Sorghum bicolor
atggcggcgccatcatctcttgcattcctcctgttctttggtacgttgctagcattgccgcagtcgtcgcacggcgcaaccagatactacaccttcaatgtgacgatgcagaaggtgacgcggctgtgcaccacccgcgccatcccgacggtaaacggcaagttcccggggcccaagatagtcaccagggagggcgatcgcgtcgtcgtcaaggtggtgaacaatgtcaaggacaacgttaccatccactggcacggcgttcggcagctgcggacggggtggtcggacgggccggcgtacgtgacgcagtgccccatccagacggggcagagcttcgtgtacaacttcaccatcacggggcagcgcggcaccctgttctggcacgcgcacgtctcctggttgcgcgccacgctctacgggcccatcgtcatcctccccaagcgcggcgtcccctacccgttcctcccggttaaaccctacaaggaggtccccatcatcttcggagagtggttcaacgcggatcccgaggcaattatcgcccaggcgcttcagactggagcaggcccaaatgtgtctgacgccttcaccatcaacgggcttccaggccccttgtacaactgctccagcaaagacacgttcaagctgaaggtgctccccggcaagtggtacctgctccggctcatcaacgccgcgctcaacgacgagctcttcttctccatcgccaaccacacgctcaccgtcgtcgacgtggacgcctcctacgtgaagccgttccacacggacatcgtcctcatcacgccgggccagaccaccaacgtgctcctgcgcgccgagcccgacgccgggtgcgccgcggccacgcacctcatgctggcgcgcccctacggcacgggccagccgggcaccttcgacaacaccaccgtcgccgccgtgctcgagtacgcgccggcggcggcggcggggcacatcaagagcctcccgctcttccggccctcgctccccgcgctcaacgacacggccttcgcggccaactacagcgccaggctccggagcctggccacaccggagttccccgccaccgtgccccgcgccgtggaccgctccttcttcttcgccgtggggctcggcaccaacccttgccctgccaaccagacgtgccagggccccaccaaccggaccaagttcacggcgtccatgaacaacgtgtccttcaccatgcccaccaccgcgctcctgcaggcgcactacgacaacatcgccggcgtgtacacggccgacttccccgtcgcgccgctggagccgttcaactacacgggcacgacgcccaacaacaccaacgtctccagcgggaccaaggtggtggtgctggagtacaataccagcgtggaggtggtgctgcagggcaccagcgtcctgggcgccgagagccacccgctgcacctccacggcttcgacttcttcgtcgtcggccaaggcttcggcaactacgactcgtcaaaggacccagccaagttcaatctagacgacccggtgcagaggaacaccgtcggcgtgccgtccggtggttgggtcgccatcaggttcttcgcggataatcccggtgtttggttcatgcattgccacttggaggttcacacaagctgggggttgaagatggcatgggttgtcaacgacggcccgttgcctgagcagaagctgatgccgccaccgcccgatcttcccaagtgttga

SEQ ID NO: 1761 - DNA, 1947 bp, Zea mays
ctatcttgctgcggccggccatatataacaaccgtacgtcctcgatctctcgtccgagatcgatctgcgtgccaagggaagggagatgggggcggcgccgccatcgtcgtggcttgcgttcatcctgttcttcggcacgttggtagcgttgccgcagtcgtcacacggcggcggcacaaccagacactacaccttcaacgtgacgatgaagaaggtgacgcggctgtgcaccacccgcgccatcccgacggtgaacggccagttccccggccccaagatagtcaccagggagggcgaccgcgtcgtcgtcaaggtgctgaacaatgtcaaggacaacgttaccatccactggcacggcgttcggcagctgcgcacggggtggtcggacgggccggcgtacgtgacgcagtgccccatccagacggggcagagcttcgtgtacaacttcaccatcacggggcagcggggcaccctgttctggcacgcgcacgtctcctggatgcgcgccacgctctacggggccatcgtcatcctccccaagcgcggcgtgccatacccgctcccggttaaaccctacaaggacgtcccagtcatcttcggagagtggttcaacgcggatccagagacaattgtcgcccaggcgcttcagactggagcaggcccaaacgtgtcggacgccttcaccatcaacgggctcccgggccctttgtacaactgctccagcaaagacacgttcaagctgaaggtgctgcccggcaaatggtacctgctccgtctcatcaacgccgcgctcaacgacgagctcttcttctccatcgccaaccacacgctcaccgtcgtcgacgtcgacgccgcctacgtcaagccgttccgcacggacatcgtgctcatcacgccgggccagaccaccaacgtgctcctgcgcgccgagcccgacgcggggtgccccgcggccacgcacctcatgctggcgcgcccctacggcacgggccagccgggcaccttcgacaacaccaccgtcgcggccgtgctcgagtacgcgccgccgggccacatcaggagcctcccgctcttccggccctcgctccccgcgctcaacgacacggccttcgccgcgaactacagcgccaggctccggagcctggcaaccccggactacccggccaacgtgccccgcgccgtggaccgctccttcttcttcgccgtcgggctcggcaccaacccctgccccgtcaaccagacgtgccaggggcccaacgggaccatgttcacggcgtccatgaacaacgtgtccttcaacatgcccaccaccgcgctcctgcaggcgcactacggcagcgtcgccggcgtgtacacgcccgacttccccgtcgcgccgctcgagccgttcaactacacgggcacgccgccgaacaacaccaacgtctcccacgggaccaaggtggtggtgctggactacaataccagcgtcgaggtcgtgctgcaggccaccagcatcctcggcgccgagagccacccgctgcacctccacggattcgatttcttcgtcgtcggccaaggcttcggcaactacgactcgtccaaggacccacccaagttcaacctagtcgacccggtgcaaaggaacaccgtcggcgtgccggcagggggctgggtcgccatcaggttcttcgcggataatcccggtgtttggttcatgcattgccatctggaggtgcacacaagctgggggttgaagatggcatgggtggtcaacgatggcccgttgcctgagcagaagctgatgccgccgccggccgatcttcccaagtgctgaagatccaccgcgcgttgacattgtccaacattatgattcgtttctactgcataaacatatcaatggagatacacattgtcgtcgtacatatagcgtcgtacacagcgtttaaagaggctttgtggtttctc

SEQ ID NO: 1762 - DNA, 2205 bp, Oryza sativa Japonica Group
gttctagtatctatagctagctaactgttactgtacctcctcccatatatcatcttcatatttttgcagatcgataagcgagaaaaatgggagcacgctgcctcgcattgcttctcctctatggcacgttgctgctgctgttgctgctgccacagctgccgctcgccggcgcggcgacgagatactacaccttcaatgtgaagcttcagaatgtgacacggctgtgcaacacccgggcaatcccgacggtgaacggcaagttccccgggccgaaaatagtcaccagggagggagaccgcgtcgtcgtcaaggtggtcaacaatatcaaggacaacattaccatccactggcacggggtgaggcagatgcggacggggtggtcggacgggccggcgtacgtgacgcagtgcccgatccagacggggcagagctacgtgtacaacttcaccatcaacgggcagaggggcaccctgttctggcacgcgcacgtctcctggctgcgatccacgctgtacggccccatcatcatcctccccaaggccggcctcccgttgcccttcaccgagccgcacaaggacgtgcccatcatcttcggagagtggtttaacgcggaccctgaggcgatcgtcgcgcaggcgcttcagaccggcggtgggcccaacgtctccgacgcctacaccatcaacgggcttcccggcccattgtacaactgctcaagcaaagacacgtttaggctcaaggtgcagcccggaaagatgtacctgctccggctgatcaacgctgcgctcaacgacgagctcttcttctcggtggccaaccacacgctcaccgtcgtcgacgtggacgcctcctacgtcaagccgttcgacacggacgtggtcctcatcacgccggggcagaccaccaacgtgctgctccgcgccaagccgacggccgaggccgccggcgccacgcacctcatgatggcgcgcccctacgccacgggccgccccggcacctacgacaacaccaccgttgccgccgtcctggagtacgcgccaccggggcacatcaagagcctcccgctcctccgcccgtcgctgccggcgctcaacgacacggccttcgccgccggcttcgccgccaagctccgcagcctggcctgcccggactacccgtccaacgtgccgcgccgcgtcgacaagcccttcttcttcgccgtggggctcggcaccaccccgtgcccgggcagcaacaaccagacgtgccagggccccaccaacaccaccaagttcacggcgtccatcaacaacgtctccttcgacatgcccaccaccgcgctcctgcaggcgcactacaccggccagtccgccggcgtgtacaccgccgacttccccgcctcgccgctggagccgttcaactacacgggcacgccgcccaacaacaccaacgtgtcgaacgggaccagggtggtggtgctgccgtacaacgcgagcgtggaggtggtgctgcaggacaccagcatcctgggcgccgagagccacccgctgcacctccacggcttcgacttcttcgtcgtcgggcagggcaccggcaactacgacccgtccaagcacccggcggagttcaacctggtcgacccggtgcagaggaacaccgtcggcgtgccggccggcggctgggtcgccatcaggttcttcgcggataaccctggtgtctggttcatgcattgccacctggaggttcacacaacctgggggttgaagatggcatgggtggtcaacgacggcccgttgcctgagcagaagctgatgcctccgccgtccgatcttcccatgtgctagagatcgatcaatcgttgacattatttgaccaaggctgtgattcgtttattccgtttggtttgctacacataatttgtcaatggataatgccgtacgtacatacctgcaggattgaggtcttgttttccattcttccaaaggtgttgtttattcttgtaaggggtttgccattgttttttttttaaattctacaagtacttttagctcgaaagttcggccgtatatggtcaataagaatagtttgactcttacattttgacacccacgatgggctcaatctcagatgactatattacggactagtattttacaagcgcgaactatgtatgatactggactgttacaacaagaattcatataagatcatataagcttgtagtcg

SEQ ID NO: 1763 - DNA, 1831 bp, Ricinus communis
taccaaagaagtctctttggacaacaacccaatagcaagtactaggagtctcttataaccttttgtccaaaaaggtgaaaaagaggcagcaaatcaagaaatgggttctccttttcttcttccaaaaccatcatttcttggagtttctctctttattttggttactttctgccttcttcctgaacctgcatttggcagaaccaggcattacaagtttgatatcaagttgcaaaatgtgactcgtttgtgccacaccaagagcatagtaactgtaaatggaatgtttcctggacctcgcattgtagctagggagggtgacaatcttcttattaaggtggtcaaccatgtccaaaacaacatctctctccattggcatggaattaggcagcttcgaagtgggtgggccgatggaccggcatacataacacaatgtcctatccaaactggtcagcactatttatacaactatactgttgttggccagagaggcaccctttggtggcatgcacatatttcctggttaagatcaactctttatggccccattatcattttccccaaacgcggagttccttacccttttgctaagccatacaaggaagtacccatcacctttggagagtggtttaatgcagatactgaaactatcattaaacaggccttgcaaacaggtggaggtccaaatgtttctgatgcctatacgattaatgggcttccagggccattgtataactgctctgccaaagatacatttaaactgaaggtgaaaactggcaagacttacatgcttcgcctgatcaacgctgcactcaacgatgagctcttcttcagtatagcaaaccacacactaacagttgttgatgttgatgctgtttatgttaagcctttcgaaaccaagatattgctgattgcaccaggacaaactacaaatgttcttcttaagaccaaacccagtttcccaaatgccgcatttttcatgactgctagaccttatgttactggacaaggcactttcgacaattcaactgtggcaggaattttagaatatgaaccctcaaccctctctaacaaaaagcttccactcttcaaaccatctttgcctgctcttaacgacactgcctttgccactaattttacgaatagacttcgtagcttggcaagtgcccaattccctgccaatgttcctcaagtggtagataagcaatttttcttcacagtaggcctagggacaaacccttgcccgaaaaaccaaacttgccaaggaccaaatggaactaagtttgctgcctcaattaacaacatatcttttgcaatgccaactacagctttgctccaagcacattattccggccaatcaaagggtgtttattctccttatttcccaattagtccaataataccatttaactatactggcaatccaccaaacaatactatggtcagcaatgggactaagcttgttgtcctttcttataacactagtgtggagctaattctgcaggataccagcattcttggtgctgagagtcaccctcttcacttgcatggattcaatttcttcgttgtcggtcaaggttttgggaactttgatccaaagaaagatcctgctaagtacaatcttattgaccctgttgagaggaacactgttggtgtgccctctggcgggtgggttgctataaggttccgtgctgataatccaggggtatggttcatgcattgccatctagaagtgcacacaagctggggtttgaagatggcttgggttgtattggatggaaagcttcccaaccagaagttgcgccctccaccagctgatcttccaaaatgttga

SEQ ID NO: 1764 - DNA, 1755 bp, Vitis vinifera
atgggtgcctctcttctttcatcaacagcaattttcagagtcatgttcatagttttgaacactctgtggctctctcctgagcttgccagtagtgctggcgttactagacattacaagttccatatcaagctgcagaatgtgacaagattgtgccacacgaagagcattgtgagtgtgaatgggcagtttccaggacctcccatcattgctagagaaggagatcaagtggtggttaaggtgattaaccatgtgcagaacaatgtcaccatccattggcatggagttcgacagcttcgaagcgggtgggctgatgggcctgcatatgtgactcagtgccctattcaaacaggccagacctatgtatacaatttcaccatcactggccaaaggggaaccctgttttggcatgctcacatttcatggctaagagccactctctatggacccatcatcatcctaccaaagaaaaatgtgccttacccatttgtcaaaccctacaaggaagttcccatcatatttggagaatggtggaatgctgatcctgaggcagtcatcacccaggccctgcagaatggaggaggccccaatgtctccgatgcctacaccatcaacggcctccctggccccttgtacaactgctcagctcaagatactttcaagctaaaggtgaaacctggaaggacatacctcctgagattgatcaatgctgcactcaatgatgagctcttcttcagcattgccaatcacacccttacagtggttgatgtggatgctatttatgtcaaaccctttaaaactgatacaattctgatcacaccaggccaaaccaccaacctcctcctcaaagccaaaccccacttccctaatgccaccttccttatggctgctcgcccttatgccactggccgtggaacttttgacaattccactgtcaccggtctcctccactatgaaacaccacccaaatcctctccctctgcctcctcatttaaaaatcttcccctcttcaaaccaacactccctcctctaaacgacacttcctttgcagccaacttcactcacaaactccgcagtttagcaaatagtcagttccctgctaatgtacctcaaaaggttgataaacgatttttcttcacggttgggctggggacaaacccttgcccccagaaccagacttgtcaaggacccaataatagcaccaagttttcagcttcggttaacaacgtctcctttgttctacccaccacagccatcctccaagcacacttttttcagcaatccaatggcgtctacaccactgattttccagccactccaatctttcctttcaattatacggggacaccacccaacaacaccatggtgaacaatggaactaaggtggtggtgcttccatttaacaccagtgtggagttagtgctgcaagatactagtattcttgggattgaaagccaccccttgcaccttcatgggttcaacttctttgtggttggtcaaggctttgggaacttcgattcaaagaaggatcctcccaaattcaatctcgtagacccagttgagaggaacacggtgggcgtgccttctggaggatgggtggctattcgcttccttgctgacaacccaggtgtatggttcatgcactgccacttcgaagttcacatgagctggggcttgaaaatggtttggatggtaatggatgggaaactgcctaaccagaagctgcctcctccaccctctgatcttccccaatgttga

SEQ ID NO: 1765 - DNA, 1752 bp, Vitis vinifera
atgggttcttctcttctttcatcagcagcaatgttcagagttctgttcctagttttgaactctctgtggttgtttcccgagcttgccagtgctggcatcactaggcattacaagttcaatatcaagttgcagaatgtgacaaggttgtgccacacgaagaacattgtgagtgtgaatgggcagtttccaggacctcgcatcattgctagggaaggagatcgagtggtggttaatgtggttaaccatgtcccgaacaatgtcactatccattggcatggagttcgacagcttcggagtgggtgggcagatgggcctgcatatgtaactcagtgccctattcaaacaggccagacctatgtatacaatttcaccatcactggccaaaggggaaccctgttttggcatgctcacatttcatggctaagatccactgtctatggacccatcatcatccttccaaagaaaaatgtgccttacccgtttgtcaaaccctacaaggaagttcccatcatatttggagaatggtggaatgcggatccagaggcagtcattacccaggccctgcagaatggaggtggccccaatgtctctgatgcctataccatcaacggcctccctggccccttgtacaactgctcagctcaagatactttcaagctaaaggtaaaacccgggaagacctacctcctgagattgatcaacgctgcactcaatgatgagctcttcttcagcattgccaaccacacccttacagtggttgatgtggatgccatctacgtcaaaccctttaaaaccgatacaattttgatcactcctggccaaaccaccaacctcctcctcaaggccaaaccccacttccctaatgccaccttcctcatggctgctcgcccttatgccaccggccgtggaacctttgacaattccactgtcgccggtctcctccactatgaaccaccacaaaaatcctctccctctgcctcctcctttaaaaaccttcctgtcttcaaaccaacactccctcctctaaatgacacttctttcgcggccaacttcaccagaaaactccgaagcttggcaaacagtcagttccctgccaatgtaccgaaaaaggttgacaaaagatttttcttcacagttgggctagggacaagcccttgccctcagaaccagacctgtcaaggtcccaacaacagtaccaaattttcagcctcggttaataatgtctcctttgttctacccaccacagccatcctccaagcacacttttttcagcaatccaatggcgtctacaccacagattttccagccactccaatctttcctttcaattacacagggacaccacccaacaacaccatggcgagcaacggaactaaggtggtagtgcttccatttaacacgactgtggagttggtgctacaagatactagtattcttggaattgaaagccaccctttacaccttcatggcttcaatttctttgtggttggtcagggttttgggaactttgactctaagaaggaccctcccaaattcaatcttgtagaccctgttgaaaggaacacagtcggtgtgccgtccggcggttgggtagctattcgcttcgtcgctgacaacccaggtgtatggttcatgcattgccacctggaagtccacacaagctggggtttgaagatggcttggatagtaaaggatggcaaactgcctaatcagaagctgcctccgccaccctctgaccttccccagtgttga

SEQ ID NO: 1766 - DNA, 1755 bp, Vitis vinifera
atgggtgcttctcttctttcatcaacagcaattttcagagtcctgttcgtagttttgaacactctgtggctctttcccgagcttgccagtagtgctggcatcactaggcattacaagttcaatatcaagctgcagaatgtgacaagattgtgccacacgaagagcattgtgagtgtgaatgggcagtttccaggacctcacatcattgctagggaaggagatcgagtggtggttaaggtggttaaccatgtccagaacaatgtcaccatccattggcatggagttcggcagcttaggagtgggtgggcagacgggcctgcgtatgtgactcaatgcccaattcaaacaggccagacctatgtatacaatttcaccatcactggccaaagaggaaccctgttttggcatgctcacatttcatggctaagatccactctctatggacccatcatcatccttccaaagaaaaatgtcccttacccgtttgtcaaaccctacaaggaagttcccattatatttggagaatggtggaatgcggatccggaagcagtcattacccaggccctgcagaatggaggtggcccaaatgtctctgatgcctataccatcaacggcctccctggccccttgtacaactgctcagctcaagatactttcaagctaaaggtgaagcccggaaagacatacctcctgagattgatcaatgctgcactcaatgatgagctcttcttcagcattgccaaccacacccttacagtggttgatgtggatgccatttacgttaaaccctttaaaaccgatacaattttgatcactcctggccaaaccaccaacctcctcctcaaggccaaaccccacttccctaatgccaccttcctcatggctgctcgcccttatgccacaggccgtggaacctttgacaattccactgtcgccggaatcctccactatgaaccaccacccaaatcctctccctctgcctcctcatttaaaaaccttccactcttcaaaccaacactccctcctctaaatgacacttccttcgcggccaacttcactggcaaactccgaagtttagcaaacactcagttccccgctaatgtaccccaaaaagttgatcaacgctttttcttcacggttgggctgggtacaaacccttgcccgcagaaccagacctgtcaaggacctactaatatcaccatgttttcagcttcggttaacaatgtctccttcgttcttcccaccacagccatcctccaagcccactttttccaacaatccaaaggcgtctacaccacagatttccccaccacgccaatctttcctttcaattatacagggacaccacccaacaacaccatggtgagcaatggaactaaggtagtggtacttccgtttaacacaagcgtggagttggtgttacaagatactagtattcttggaattgaaagtcaccccttgcaccttcatgggttcaacttttttgtggttggtcaaggttttgggaacttcgattcaaagaaggatcctcccaaattcaatctggtagaccctgtcgagaggaacaccgtgggtgtgccttccggcggatgggtagctatccgctttcttgctgacaatccaggtgtgtggttcatgcactgccacttggaagtccacacaagctggggtttgaagatggcgtggatagtaatggatggaaaactgccaaatcagaaattgcctcccccaccttctgatcttcccaagtgttga

SEQ ID NO: 1767 - DNA, 2148 bp, Zea mays; identical to SEQ ID NO: 1743

SEQ ID NO: 1768 - DNA, 2040 bp, Zea mays; identical to SEQ ID NO: 1742

SEQ ID NO: 1769 - DNA, 2004 bp, Sorghum bicolor; identical to SEQ ID NO: 1741

SEQ ID NO: 1770 - DNA, 2022 bp, Oryza sativa Japonica Group; identical to SEQ ID NO: 1744

SEQ ID NO: 1771 - DNA, 2127 bp, Zea mays; identical to SEQ ID NO: 1745

SEQ ID NO: 1772 - DNA, 1932 bp, Populus trichocarpa; identical to SEQ ID NO: 1746

SEQ ID NO: 1773 - DNA, 2732 bp, Vitis vinifera
gaggccttgagctgctgcattgccaattctaggtctttcctcttgggccttttgcttctccttgcttctgcagtgttctttacagaagccgaaacccaccatcatgattttgttgtatgtcttctcttcttccttccttccttttacttgcttctttcctctcttggccttggattctgactatctgcattgatgtaacaggttcaagccaccccggtgaagaggctgtgcaaaacccacaacaccataacagtgaacgggcaatacccggggccaacgttggaaataaacaatggagacaccctagaagtcaaagtcaccaacaaagctcgatacaatgttaccattcactggtaattccatgcatgcatacatgtttcctctgtacaaaaatgaattgaattgaaggtatctggatagggcatgaatgcatgcaggcatgcaggcatgctcctacaaaagaaccaaccaaagtatatatttcatccaatgaacatactaatgtatatagaaagactcttcctaccttctatacttatcttactattatttctctccaggcacggtatacggcagatgagaacaggatgggcagatgggccagagtttgtaactcagtgcccaattcgaccaggaggaagttacacctaccggtttacagttcaaggacaggaaggcactctatggtggcatgctcatagctcatggctcagagccactgtctatggtgccctcatcatccacccaaaaccaggatcctcctatccattcactaagccaaagcgagaaacacccattcttcttggtaatgatcacttctctaatcactaacaacagatgatgataatgatgtggataataggataacaatttggatgcctatgactgagaatgatagattaacggtgagcataatgatgttcaggagaatggtgggatgcaaaccccatcgatgttgtgaggcaggcgactaggacaggagcagctccaaatgtgtctgatgcatacaccatcaatggtcaacctggtgatctttacaactgctccagcaaaggtttgcttcttttcacaaatactttgctctgctgacgagttcatgcaatatgcctagattttccctagtgggccatttcctccacacaaagacatatgatgtccgtggatgctcctagaaattataggaaaaaaaattaatccagtttttggaagacatccaaacttgtcctctcggggcaaaagagggccaccaatttaccggggcattctctgtcctttagaaaaagatgacacacctaaagaaatcagagcaattccttcaaatttttgaagcaaatccttactcttccaactcgaatccataaccagcttgacactggggactgggagagtggatttgaccatatttacccggaggttcatacattggacagaaccaaacacccaggaagcaaccaatttctactgtcctataacagctaaaacttaaatcttcatcatggatgcttagatcatgcctacaaaaaatcttctgaccttgttttattggtatgcagacactgtgatagttccaattgacagtggtgagaccaacctcctccgagtcatcaactctgggcttaaccaagagctcttcttcactgttgccaaccacaagtttacagttgtctcagctgatgcatcctataccaaacccttcaccacctcagtcatcatgctaggacctggtcaaaccactgacgtcctaatcaccggtgatcagccaccagctcgttattacatggccgcacgtgcctatcaaagtgctcaaggtgcaccatttgacaatactaccaccacagccatacttgaatacaagtctgctccttgtcctgctaagaagggtgtctccaccacccctgttttcccttctttgcctgctttcaatgacacggccactgtcacagccttcagtaagagcttcagaagtcctgctaaagtcgaagtccccacagacattgatgaaagcctcttcttcactgttggcctagggctcaataggtgcccaccaaagtttaaatccagccagtgtcaaggtcccaatggaacccgcttcaccgccagcatgaacaatgtctcttttgttctcccatccaacttttccttactgcaagctcaccagcaaggtatccctggagttttcaccactgattatcccgcagctccaccagtaaaattcgattacactggtaatgtgagccggtcactctggcaacccgttccaggtactaagttgtacaagttgaagtatgggtcaagagtccaggttgtattacagggaacaagtatcttcacagctgagaaccaccccatccatcttcatggatacgatttctacatcattgcagaaggtttcggaaacttcaaccccagtactgatacatccaagtttaatcttgttgatccacctcttaggaatacagtggccgtacctgtgaatggttgggcagtcatcagatttgttgccgataatccaggtaaaattacttgaatttcccaaaaattctacttccaatatatttcaaatttttgccctcaactttcaattcatttgtctggcaaaaacaggagtttggctaatgcactgccacttggatgttcatatcacctggggtctggccatggctttcctggtggagaatggagttggggctttgcaatcgatagagactcctccagcggatttgcctctgtgc

SEQ ID NO: 1774 - DNA, 2044 bp, Vitis vinifera
atggaggccttgagctgctgcattgccaattctaggtctttcctcttgggccttttgcttctccttgcttctgcagtgttctttacagaagccgaaacccaccatcatgattttgttgttcaagccaccccggtgaagaggctgtgcaaaacccacaacaccataacagtgaacgggcaatacccggggccaacgttggaaataaacaatggagacaccctagaagtcaaagtcaccaacaaagctcgatacaatgttaccattcactggcacggtatacggcagatgagaacaggatgggcagatgggccagagtttgtaactcagtgcccaattcgaccaggaggaagttacacctaccggtttacagttcaaggacaggaaggcactctatggtggcatgctcatagctcatggctcagagccactgtctatggtgccctcatcatccacccaaaaccaggatcctcctatccattcactaagccaaagcgagaaacacccattcttcttggagaatggtgggatgcaaaccccatcgatgttgtgaggcaggcgactaggacaggagcagctccaaatgtgtctgatgcatacaccatcaatggtcaacctggtgatctttacaactgctccagcaaagacactgtgatagttccaattgacagtggtgagaccaacctcctccgagtcatcaactctgggcttaaccaagagctcttcttcactgttgccaaccacaagtttacagttgtctcagctgatgcatcctataccaaacccttcaccacctcagtcatcatgctaggacctggtcaaaccactgacgtcctaatcaccggtgatcagccaccagctcgttattacatggccgcacgtgcctatcaaagtgctcaaggtgcaccatttgacaatactaccaccacagccatacttgaatacaagtctgctccttgtcctgctaagaagggtgtctccaccacccctgttttcccttctttgcctgctttcaatgacacggccactgtcacagccttcagtaagagcttcagaagtcctgctaaagtcgaagtccccacagacattgatgaaagcctcttcttcactgttggcctagggctcaataggtgcccaccaaagtttaaatccagccagtgtcaaggtcccaatggaacccgcttcaccgccagcatgaacaatgtctcttttgttctcccatccaacttttccttactgcaagctcaccagcaaggtatccctggagttttcaccactgattatcccgcagctccaccagtaaaattcgattacactggtaatgtgagccggtcactctggcaacccgttccaggtactaagttgtacaagttgaagtatgggtcaagagtccaggttgtattacagggaacaagtatcttcacagctgagaaccaccccatccatcttcatggatacgatttctacatcattgcagaaggtttcggaaacttcaaccccagtactgatacatccaagtttaatcttgttgatccacctcttaggaatacagtggccgtacctgtgaatggttgggcagtcatcagatttgttgccgataatccagtttggctaatgcactgccacttggatgttcatatcacctggggtctggccatggctttcctggtggagaatggagttggggctttgcaatcgatagagactcctccagcggatttgcctctgtgctaagatcatcaacataaaaaccacccacagttgaacttcatatatatgccttataaaaggggcacctatttttctactcttagcatacggattattcagtgttgttttccccgcatttggggccttagttcttgctttctatttcattgttctttttgatagataaagcgggtccagatggtgctgtgttgcatcacagagcgccatcagatttaaaatcagaccccatttgtttccttgttttttttcttttttcggttgtattgtttcaagaaacatcatcagagataaattgaagttcagaaagttattatta

SEQ ID NO: 1775 - DNA, 2192 bp, Zea mays; identical to SEQ ID NO: 1730

SEQ ID NO: 1776 - DNA, 2006 bp, Zea mays; identical to SEQ ID NO: 1731

SEQ ID NO: 1777 - DNA, 2096 bp, Zea mays; identical to SEQ ID NO: 1735

SEQ ID NO: 1778 - DNA, 2167 bp, Sorghum bicolor; identical to SEQ ID NO: 1732

SEQ ID NO: 1779 - DNA, 2064 bp, Oryza sativa Japonica Group; identical to SEQ ID NO: 1737

SEQ ID NO: 1780 - DNA, 1874 bp, Oryza sativa Japonica Group; identical to SEQ ID NO: 1740

SEQ ID NO: 1781 - DNA, 2078 bp, Hordeum vulgare subsp. vulgare; identical to SEQ ID NO: 1738

SEQ ID NO: 1782 - DNA, 2265 bp, Sorghum bicolor; identical to SEQ ID NO: 1724

SEQ ID NO: 1783 - DNA, 1635 bp, Sorghum bicolor
atggcaacggtgacgcggctgtgcgtgacgaagagcatccccacggtgaacggccggttcccggggccgaggatcgtcgtgcgcgagggcgaccgcctcgtggtgcaggtccacaataacatcaacaacaacgtcacgttccactggcacggcgtccggcagctgcgcagcgggtggtcggacggtccgtcgttcatcacgcagtgcccgatccgtcccgggcagagctacgcctacgacttccgcatcgtggggcagcgcggcacgctgtggtggcacgcgcacttctcctggctccgcgccacgctctacggcccgctcgtcatcctcccgccgcgcggcgtcccctacccgttccccaagccccacgccgaagtgcccctcatgctcggcgagtggttcaacgccgacccggaggccgtcatcaagcaggcgctgcagaccggcggtgggccgaacgtctccgacgcctacaccttcaacggcctgcctggcccgacctacaactgctccggcggcggcgccggcgacacgttcaagctgagggtcaagcccggcaagacgtacctgctgcggctcgtgaacgcggcgctcaacgacgagctcttcttcgcggtcgccaaccacacgctgacggtggtgcaggcggacgccagctacgtgaagccgttcacggccgacacgctggtcatctcgccggggcagaccatggacgtgctcctcaccgcggccgccgcgaccgccccttcctcgaccgccgcctacgccatcgccgtcgcgccctacaccaacacggtcggcacgttcgacaacaccacggccatcgccgtcctcgagtactacggcgcgccgccgcagagcgccgcggcgctccggaacctcccgctccccgcgctgccgctgtacaacgacacaggcgcggtggccaacttctcggcgaagttccggagcctcgcgagcgcgcagtacccggcgctggtgccgcggacggtggaccggaggttcttcttcgccgtcgggctcggcgccgacccgtgccagagcagggtgaacgggacgtgccaggggcccaacggcaccaggttcgcggcgaccatgaacaacgtgtcgttcaccatgcccaagacgtcgctcctccaggcgcactaccagcggcggtacagcggcgtgctcacggccaacttccccggggtgccgccgacgccgttcaactacacggggacgccgcccaacaacacgttcgtcacgcacggcaccagggtggtgccgctcagcttcaacaccaccgtcgaggtggtgctgcaggacaccagcattttgggcgccgagagccacccgctgcacctgcacggctacgacttcttcgtcgtcggccaggggttcggcaactacgacgccggcaacgacacggccaagtacaacctcgtcgacccggtgcagcggaacaccatcagcgtgcccaccgccggctgggtcgccatccgcttcgttgccgacaaccccggcgtgtggatcatgcattgccacctggacgtgcacctcagctggggtctggcaatggcgtggctcgtcaacgacgggccgctgcccaaccagaagctgccgcctccgccgtccgatatccccaggtgttga

SEQ ID NO: 1784 - DNA, 2188 bp, Zea mays
ctctctctctctctctctctctctctctctctctctctctctcgcttcagttcggttcggacacagctagctagctgatcgatcgagaggcgagagcaagcaatggccgtcggccgtcgtctctcccctgcgtgcctcctcctccttcgtctcaccgtcgccctcgtggtcctcaccgccctgccggagctcgccgctgcccgcacccgccgctacacgttcaatgtgacgatggcaacggtgacgcgcctgtgcgtgacgaagagcgtccccacggtgaacgggcagttcccggggccgaggctcgtcgtgcgcgagggagaccgactcgtggtgcaggtccacaacaacatcaacagcaacgtaacgttccactggcacggcgtccggcagctgcgcagcgggtgggcggacgggccgtcctacatcacgcagtgcccgatccggcccggccagagctacgcctacgacttccgcatcgtggggcagcgcggcacgctctggtggcacgcgcacttctcctggctccgagccacgctctacggcccgctcgtcatcctcccgccgcgcggcgtcccctacccgttcccaaagcccgacagacaagtcaccctcatgctcggtgagtggttcaacgcggacccggaggccgtgatcaagcaggcgctgcagaccggcggggccccgaacgtctccgacgcctacaccttcaacggcctgcctggccccacctacaactgctcctccggcgacgacacgttcaggctgcgggtgaggcccggccggacgtacttgctgcgcctcgtcaacgcggcgctcaacgacgagctcttcttcgcggtggccaaccacacgctgacggtggtgcaggcggacgccagctacgtcaagccgttcgcggccgccacgctggtcatctcgccgggccagaccatggacgtgctcctcaccgcctccgcctccgccgccccgtcgtccgccttcgccatcgccgtcgcgccctacaccaacaccgtcggcacgttcgacaacaccaccgccgtcgccgtcgtcgagtacggcccgcaccagtccgccgcggcgctccggagcctgcccttgccggcgctcccgcggtacaacgacacggccgcggtggccaacttctcggccatgttccggagcctcgcgagcgcgcggtacccggcgcgcgtgccgcggaccgtggaccgcaggttcttcttcaccgtcgggctgggcgcggacccgtgccggagccgcgtcaacggcacgtgccagggccccaacggcaccaggttcgccgcgtccatgaacaacgtgtccttcgccatgcccaggaccacctccctcctgcaggcgcactaccagcgccgctacagcggcgtgctcgcggccaacttccccgccgtgccgcccacgcgcttcgactacaccggcgcgccgcccaacaacacgttcgtcacccacggcacccgggtcgtgccgctcagcttcaacaccaccgtcgaggtggtgctgcaggacaccagcgtcctgggcgccgagagccacccgctgcacctgcacggctacgacttcttcgtcgtcggcacgggcttcggcaactacgacgccaccaacgacaccgccagatacaacctcgtcgacccggtgcagcggaacaccgtcagcgtccccaccgccggctgggtcgccatccgcttcgtcgccgacaaccccggcgtgtggatcatgcattgccacctggacgtgcacctgacctggggtctggcaatggcgtggctcgtcaacgacgggccgctgcccaaccagaagctgccacctccaccgtccgatatccccaggtgttgatacaatcacgagacattagtctgcagtggttttgatccgtgcacgcgcacatggcggaaccgactcaaatcgattggcctgtgcaacgcgaattttgtgatgatgtctggttttgtcgctgcactgtttcggagacatacaagatccgtaaaagcaagtttattggggtcatgtgtcgttgcgccatttttcttttttttaacgattgtttcatcgcaacttttgtttttttaatgctggacattgttagtgcgtccagtgtgtaaggtatatgttacatatataatgtatcagtcgattggaccagctaatgattcttttttatcaaaaaaaaaaa

SEQ ID NO: 1785 - DNA, 1542 bp, Oryza sativa Japonica Group
atggcgacggtgacgcggctgtgcgtgacgaagagcgtccccacggtgaacggccagttcccggggccgaagctcgtcgtgcgggagggcgacaccctcgtgatcagggtcaccaacaacatcaacaacaacgtcaccttccactggcacgggattcggcaggtgcggagcgggtgggcggacgggccggcgtacatcacgcagtgtccgatccgctccgggggaagctacgtgtacaggttcaccgtgacggggcagcgggggacgctgtggtggcacgcgcacttctcctggctccgcgccacgctctacggcccgctcgtcatcctcccgccccgcggcgtcgcctacccgttccccaagccccatcgcgaggtgcccctcctgctcggtgagtggttcaacgccgacccggaggccgtgatcaagcaggccctgcagacgggaggagggcccaacgtctccgacgcctacacgttcaacggcctccctggcccaacctacaactgctcctcctccaacgacacgttcaagctgagggtgaggcccgggaagacgtacctgctgcggctgatcaacgcggcgctcaacgacgagctcttcttcggggtggccaaccacacgctgatggtggtgcaggcggacgccagctacgtcaagccgttcgccgccacggcgctcgtcatctcgccggggcagaccatggacgtgctcctcactgcggcggccaacaacccgccgtcccgctccttcgccatcgccgtcgcgccgtacaccaacaccgtcggcacgttcgacaacaccaccgccgtcgccgtgctcgagtactacggcgccgcgacgtccgccgccgcgctccggagcctcccgctgccgtccctcccggcgtacaacgacaccggcgcggtggccaacttctcggcgagcttccggagcctcgcgagcgcgcagtacccggcgcgggtgccgcggacggtggacaggcacttcttcttcgccgtcgggctcggcgccgacccgtgccagagcccggtgaacgggacgtgccaggggcccaacaacaccaggttcgcggcgtccatgaacaacgtgtcgttcgtgatgcccaggacgtcgctcctccaggcgcactaccagcggcggtacaacggtgtgctcgcggccaacttcccggcggcgccgcggacgccgttcaactacaccggcacgccgccgaacaacacgttcgtgacccacggcaccagggtggtgccgctcagtttcaacacaaccgtggaggtggtgctgcaggacaccagcatcctcggcgccgagagccacccgctgcacctgcacggctacgacttctacgtcgtcggcaccgggttcggcaactacgacgccagcaatgacaccgccaagtacaacctcgtcgaccccgtgcagcggaacaccatcagcgtgcccaccgccggctgggtcgccatccgcttcgtcgccgacaaccccggttggttacccgctctatacttataccttcatttaaaaagggaatttttatga

SEQ ID NO: 1786 - DNA, 1932 bp, Sorghum bicolor
cttcaaagcgcaaacacacataagaagcagggcggagcggttgtcatcagagaatgggctcgcgtcatggcctccggcgaggcggccaagccgctgccgtcttctccgcatgtcccttcctcgccttcgccgtcctcctcgccttgccgggcctcgcagccggcgacacccattactacacgttcaacgtgcaaatgacgaacgtgacacggctgtgcgtgaccaagagcatcccgacggtgaacgggcagttcccggggccgaagctggtcgtgcgggaaggcgaccgtctcgtggtcaaggttcacaaccacatcaactacaatgtctcgttccactggcacggcgtccggcagctgcgcaacgggtgggcggacgggccggcgtacatcacgcagtgcccgatccagggcgggcagagctacgtgtacgacttcaccatcacggggcagcgcgggacgctgtggtggcacgcgcacttctcctggctgcgcgtgcacctctacggcccgctcgtcatcctccccaagcgcggcgagggctacccgttcccgcgcccctacaaggaggtgcccatcctcttcggtgaatggttcaatgcggacaccgaggccgtcatcaaccaggccctgcaaactggcggcggcccaaacgtctccgatgcctacaccttcaatgggcttccaggcccgacatataactgctcctctaaagacacgtacaagctgaaggtaaagcccgggaggacgtacatgctccggctcatcaactccgcgctcaacgacgagctcttcttcggcatcgcaaaccacacgctcaccgtcgtcgaggcggacgccaactacgtcaagccattcaccgtgaacacgctcgtcatctcgccggggcagaccatgaacgtgctcctgacgacgcctccaaacccggcctccccggcctacgccatggcgatcgcgccctacaccaacacgcagggcacgttcgacaacaccaccgcggccgccgtcctcgagtacgccccgacgacgacgacgctgccgcccttgcccctgccggccctgccgctgtacaacgacaccggcgcggtgaccaacttctcgcgcaacttccgcagcctgaacagcgcgcagtacccggcgcaagtgccggcggcggtggaccggcacctgctcttcaccgtggggctcggcacggacccgtgcccgtccaaccagacgtgccagggccccaacggcaccaagttcgcggcgtccatcaacaacaactccttcttccggccccggaccgcgctcctcgaggcgcactaccagcgccgctacgccggcgtgctcctcgccgacttccccaccaccccgccgcaccccttcaactacacggggaccccgcccaacaacacgttcgtgcagcacggcacccgggtggtgccgctcaggttcaacacctccgtggagctggtgctgcagggcaccagcatccagggcgccgagagccacccgctgcacttgcacggctacgacttcttcgtcgtcggacaggggttcggcaacttcgacccggtgaacgacccgcccaactacaacctcgccgaccccgtggagcggaacaccatcagcgtgcccaccgccggctgggtcgccgtccgcttcctcgccgacaacccgggggtgtggctgatgcattgccacttcgacgtgcacctgagctggggcctgtccatggcgtggcttgtcaacgacggcccgctgccgaatcagaagatgttgcccccgccatccgatcttccaaaatgctgatgactgatcgttcatcatccgagggggggtagatgggcatttaacaaggttttggtgcacgtctgcgtactttcttacgatgtttgaaacaatttggtctgggatatttaattgcagtgtgccgatttttggcaagtgc

SEQ ID NO: 1787 - DNA, 2156 bp, Zea mays
gcaccacttcacttgcttcaaagcgcaaacacacaagaagggcggagctgttgtcatcctgacaatgggcgcgcgtcgtggtctccggcgaggccaagccgccgccgccgccttctccgcatgtcccttcctcgccctcgccgtcgtcctcctcgccttgccggagctcgcagccggcgacacccactactacacgttcaacgtgcaaatgaccaacgtgacacggctgtgcgtgactaagagcatcccgacggtgaacggggagttcccggggccgaagctggtcgtgcgggaaggcgaccgcctcgtggtcaaggttcacaaccacatcaactacaatgtctcgttccactggcacggcgtccggcagctgcgcaacgggtgggcggacgggccgtcgtacatcacgcagtgcccgatccagggcgggcagagctacgtgtacgacttcaccgtcacggggcagcgcggcacgctgtggtggcacgcgcacttctcctggctgcgcgtgcacctctacggcccgctcgtcatcctccccaagcgcggcgagggctacccgttcccgcgcccctacaaggaggtgcccatcctcttcggcgaatggttcaacgcggacacggaggccgtcatcaaccaggccctgcaaacaggcgccggcccaaacgtctccgatgcctacaccttcaatgggcttccaggcccgacatataactgctcgtctaaagacacgtacaagctgaaggtgaagcccgggaggacgtacatgctccggctcatcaactccgccctcaacgacgagctcttcttcggcatcgccaaccacacgctcaccgtcgtcgaggcggacgccagctacgtcaagccattcaccgtcagcacgctcgtcatttcaccggggcagaccatgaacgtgctcctcacgacggcccccagccccgcctccccggcctacgccatggcgatcgcgccctacaccaacacgcagggcacgttcgacaacaccaccgccgcggccgtcctcgagtacgccccgacgacgaccaggaacaacaccctgcctcccctaccggccctgccgctgtacaacgacaccggcgcggtgtccaacttctcgcgcaatttccgcagcytgaacagcgcgcgctacccggcgcgcgtgccggtggcggtggaccggcacctgctgttcaccgtggggctcggcacggacccgtgcccgtacaccaaccagacgtgccagggccccaacggcaccaagttcgcggcgtccgtcaacaacaactccttcttccgcccccggaccgcgctcctcgaggcgcactaccggcgccgctacgccggcgtgctcctggccgacttccccacggccccgccgcacccgttcaactacacgggcaccccgcccaacaacacgttcgtgcagcacggcacgcgggtggtgccgctccgcttcaacgcctccgtggagctggtgctgcagggcaccagcatccagggcgccgagagccacccgctgcacctgcacggctacaacttcttcgtggtcggccaagggttcggcaacttcgacccggtgaacgacccgcccgggtacaacctcgccgaccccgtagagcgcaacaccatcagcgtgcccaccgccggctgggtcgccgtccggttcctcgccgacaacccgggcgtgtggctgatgcattgccacttcgacgtgcacttgagctggggcctgtccatggcgtggcttgtcaacgacggcccgctgccgaacgagaagatgttgcccccgccatccgacctcccaaaatgctgatgacgactggtcgtttatcacccgatcgaggggtagatgggcatttaggaaggttctcctgcttcctgcacgtctgcctacttcctttccttacgatgtttggaactatttggtttggactatttaattaccgtgtgccgatttttggcgagtgcttggatttcgcgatcctcgctgaatccccttttgaaacatgttaatctgtatctatgtaacgacaacgtttgttctgcggttacttgttctttttttaccccctttctgaacattcagcacgcattggtgtattcacatggtcaaatacaatgtaacaatgatgtctgtaacaaaaaaaaaaaaaaaa

SEQ ID NO: 1788 - DNA, 2044 bp, Zea mays
cttgcttcaaagcgcaaacacacaagaagggcggagctgttgtcatcctgacaatgggcgcgcgtcgtggtctccggcgaggccaagccgccgccgccgccttctccgcatgtcccttcctcgccctcgccgtcgtcctcctcgccttgccggagctcgcagccggcgacacccactactacacgttcaacgtgcaaatgaccaacgtgacacggctgtgcgtgactaagagcatcccgacggtgaacggggagttcccggggccgaagctggtcgtgcgggaaggcgaccgcctcgtggtcaaggttcacaaccacatcaactacaatgtctcgttccactggcacggcgtccggcagctgcgcaacgggtgggcggacgggccgtcgtacatcacgcagtgcccgatccagggcgggcagagctacgtgtacgacttcaccgtcacggggcagcgcggcacgctgtggtggcacgcgcacttctcctggctgcgcgtgcacctctacggcccgctcgtcatcctccccaagcgcggcgagggctacccgttcccgcgcccctacaaggaggtgcccatcctcttcggcgaatggttcaacgcggacacggaggccgtcatcaaccaggccctgcaaacaggcgccggcccaaacgtctccgatgcctacaccttcaatgggcttccaggcccgacatataactgctcgtctaaagacacgtacaagctgaaggtgaaagcccgggaaggacgtacatgctcccggcttcatcaactccgccctcaaacgaacgagctcttcttcggcatcgccaaccacacgctcaccgtcgtcgaggcggacgccagctacgtcaagccattcaccgtcagcacgctcgtcatttcaccggggcagaccatgaacgtgctcctcacgacggcccccagccccgcctccccggcctacgccatggcgatcgcgccctacaccaacacgcagggcacgttcgacaacaccaccgccgcggccgtcctcgagtacgccccgacgccgccgcccgtcgccaccaggaacaacaccctgccccccctaccggccctgccgctgtacaacgacaccggcgcggtgtccaacttctcgcgcaacttccgcagcctgaacagcgcgcggtacccggcgcgcgtgccggcggcggtggaccggcacctgctgttcaccgtggggctcggcacggacccgtgcccgtacaccaaccagacgtgccagggccccaacggcaccaagttcgcggcgtccgtcaacaacaactccttcttccgcccccggaccgcgctcctcgaggcgcactaccggcgccgctacgccggcgtgctcctgggcgacttccccacggccccgccgcacccgttcaactacacgggcaccccgcccaacaacacgttcgtgcagcacggcacgcgggtggtgccgctccgcttcaacgcctccgtggagctggtgctgcagggcaccagcatccagggcgccgagagccacccgctgcacctgcacggctacaacttcttcgtggtcggccaagggttcggcaacttcgacccggtgaacgacccgcccgggtacaacctcgccgaccccgtagagcgcaacaccatcagcgtgcccaccgccggctgggtcgccgtccggttcctcgccgacaacccgggcgtgtggctgatgcattgccacttcgacgtgcacttgagctggggcctgtccatggcgtggcttgtcaacgacggcccgctgccgaacgagaagatgttgcccccgccatccgacctcccaaaatgctgatgacgactggtcgtttatcacccgatcgaggggtagatgggcatttaggaaggttctcctgcttcctgcacgtctgcctacttcctttccttacgatgtttggaactatttggtttggactatttaattaccgtgtgccgatttttggcgagtgcttggatttcgcgatcctcgctgaatccccttttgaaacatgttaatctgtatctatgtaaaaaaaaaaa

SEQ ID NO: 1789 - DNA, 2567 bp, Zea mays; identical to SEQ ID NO: 1716

SEQ ID NO: 1790 - DNA, 2808 bp, Sorghum bicolor; identical to SEQ ID NO: 1714

SEQ ID NO: 1791 - DNA, 2558 bp, Zea mays; identical to SEQ ID NO: 1715

SEQ ID NO: 1792 - DNA, 2818 bp, Oryza sativa Japonica Group; identical to SEQ ID NO: 1717

SEQ ID NO: 1793 - DNA, 2581 bp, Hordeum vulgare subsp. vulgare; identical to SEQ ID NO: 1718

SEQ ID NO: 1794 - DNA, 2520 bp, Vitis vinifera; identical to SEQ ID NO: 1720

SEQ ID NO: 1795 - DNA, 4136 bp, Oryza officinalis; identical to SEQ ID NO: 1719

SEQ ID NO: 1796 - DNA, 2417 bp, Populus trichocarpa; identical to SEQ ID NO: 1721

SEQ ID NO: 1797 - DNA, 2257 bp, Arabidopsis lyrata subsp. lyrata; identical to SEQ ID NO: 1722

SEQ ID NO: 1798 - DNA, 2616 bp, Populus trichocarpa; identical to SEQ ID NO: 1723

SEQ ID NO: 1799 - DNA, 1644 bp, Sorghum bicolor
atggcgacgtgccagtgcccggagctggcgcaatgccaccacagggcgctcctcccgacggccaagagctaccctaagctgcacgaccgcccgaggccggcgcccggcaccggcaccggcaccggcagcgtgctcgctgaggtggccgccatcctctgcctcaccgggccaatggtcggcgcggggatcctgttctacatgcgctccctggtgtccatggtgttcctcggccgcctcggccagctgcccctcgccggcggctccctcgcgctcggcttcgccaacatcaccggctactccgtcctctccggcctcgccggcgggatggaccccgtctgcggccaggccttcggcgcggggcggacggacctcctccgcaccgcgctccggcgcaccgtcctgctgctcctggccgcgtgcgtgcccatcgccatgctctgggtggccatgcaccgggtcctcgtctccacggggcaggaccctgacatcgcggccacggcgtacgcctacatcctgtggtgcctccccgacctcgtgctgcagtgcttcctccacccgatccgcatctacctccgcgcgcagtccgtcacgctgccgctcacctacggcgccgccgcggcgctgctcctccacgtgcccatcaacttcctcctcgtcagcgtcctcggcctcggcatccgtggcgtcgcgctcggcggggtctggaccaacctcaacttcctgctgttcctcgtggcgtacgtctacctccgcggaatgtacggcgcccatgacgatgacggcagcgccaagaagggcggcgcgtccgtggcggcgccgccgccagccgaggaggaggtgggcgccaactccaaggagtggtggagcctggtgaggctgtgcgtgcacagctgcatgtccgtctgcctggagtggtggtggtacgagatcatggtgctcctctgtggcgtgctcatcgaccccaaggcggcggtggcggccatgggcgtgctcatacagaccacgtcgctgatctacatcttcccgcattcgctcggctgcgccgtgtccacgcgcgtcgggcacgagctgggcgcccggaggccggagcgcgcgcgcctcgtcgcgcgcgtcgggctcggcctgggcgccgcgctgggcctcgtggcctgcgcattcgccgtgtccgtgaggggcgtctgggcgcggatgttcaccgcggacgaggccatcctgaagctggcggcggcggcgctcccgctgctgggcatggccgagctggggaactgcccgcagacggccggctgcggcgtgctgcgcggcagcgcgcggcccgagaaggcggcgaggatcaacgtctcggcgttctacggcgtgggcatgcccgtggcgctggcgctggcgttctggcccgccgggctggacttccgcgggatgtggggcggcatgctggccgcgcagctcgtgtgcgccgcgctcatgctgcgcgccgtgctgggcaccgactgggcggagcagacggagcgcgcccgccagctcaccggtggcgggcgcggagacggctttgacgtcgtcggcattgtcgacgaggacaaaacaagccatgcagaagcggccaaagcagaggtcgggaacgcattgttcatggtggcggattgcgtctag

SEQ ID NO: 1800 - DNA, 1965 bp, Zea mays
gtcatgcgctgcacctgcaagcatctatataaacagtgccagtacgagtgccagctctcgtccctgccaccgcaacagcacacagacgtggcccctctgcggcaaacaaaccagaggccgcggcaggcacggggacacttcacgcaggccgcgcagcagcgccatggcgacgtgccagtgcccggagccggcgcaatgccaccacaggccgctcctctcgtcgacggccgacacctaccctgagctgcacgaccgcccgaggcctgcgcccggcagcgtcctcgccgaggtggccgccatcctctgcctcacggggccaatggtcggcgcgggcatcctgttctacatgcgctcgctggtgtccatggtgttcctcggccgcctcggccagctgcccctcgccgggggctccctcgcgctcggcttcgcaaacatcaccggctactccgtcctctcagggctcgccggcgggatggaccccgtctgcggccaggcgttcggcgcggggcggacggacctcctccgcgccgcgctccggcgcaccgttctgctgctcctggccgcgtccgtgcccatcggcctgctctgggcggccatgcaccgggtcctcgtctccacggggcaggaccccgacatcgcggccaccgcgtacgcctacatcctctgctgcctccccgacctcgtgctgcagtgcttcctccacccgatccgcatctacctccgcgcgcagtccgtcacgctgccgctcacctacggcgccgccgccgcgctgctcctccacgtgcccatcaacttcctcctcgtgagcggcctcggcctcggcgtccgtggcgtcgcgctcggaggggtctggaccaacctcaacttcttgcttttcctcgtggcgtacgtctacttccgcggaatgtacggcgcccatgacgacggcggcgccaagaagggcgcgtccgtggcgccgccgacaccagccgagggggagtggtggagccttgtgaggctgtgcgtgcacagctgcatgtcggtctgcctggagtggtggtggtacgagatcatggtgctcctctgtggcgtgctcatcgaccccaaggcggcggtggcggccatgggcgtgctcatacagaccacctcgctgatatacatcttcccgcattcgctcggctgcgccgtttccacgcgtgtcgggcacgagctgggcgcccggaggccggagcgcgcgcgcctcgtcgcgcgcgtcgggctcggcctgggcgccgcgctgggcctggtggcctgcgcattcgccgtgtccgtgaggggcatctgggcgcggatgttcaccgcggacgaggccatcctgaggctggcggcggcggcgctgccgctgctcggcacggccgagctggggaactgcccgcagacggccggctgcggcgtgctgcgcggcagcgcgcggcccgagaaggcggcgaggatcaacgtgtccgcgttctacggcgtgggcatgcccgtggcgctggcgctggcgttctggcccgcccgtctggacttccgcgggatgtggggcggcatgctggccgcgcagctcgtctgcgccgcgctgatgctgcgcgccgtgctcggcaccgactgggcggagcagacggagcgcgcccgccagctcaccggcgggcgcggcggcggctttgacgtcgtcggcattgtcgacgaggacaaaacaagccatgcagaagcggccaaagcagaggtcgggaacacactgttcgtggtggcggattgcgtctagcgacgacggaagcaggacctgattcatggatgatttgcatcctcgattcattagccataggttttcttttttgctttattagttcttttttgtgattttacccgacctttttggggggatttgtagcaatacaaagcttcaacctccctctgttgttagcttatttttccctcttcgaaacgagaaagagagagtttacagtt

SEQ ID NO: 1801 - DNA, 2009 bp, Oryza sativa Japonica Group
atgaacacaaagccggcctctctcctctgcagcaacaaaccggagggtcggctcacacaaagctacactccaaacgtgcagcgcagcagcagcagcaatggcgagtcgccacagcgatgaggcgacgcaatgccaccaacaattgcttgtcatgccggcggcgacggcgagctatcccaagctgcatgatcgcccgaggctggccggcgccgccgccggcgttcttggcgaggtggcgtccatcctctgcctcgccgggccgatggtcggcgccgggatcctgctgtacctgcgctccctggtgtccatggtcttcctcggccgcctcggccagctcccgctcgccggcggctcgctcgcgctcggcttcgccaacatcaccggctactccgtcctctccggcctcgccggcgggatggaccctgtttgcggccaggcgttcggcgcggggcggactgacctgctccgcgccgcgctccggcgcaccgtcgtgctgctcctggcggcgtccgtgcccatcagcgcgctctgggtggccatgcaccgcgtcctcgtcgccaccggccaggacccggacatcgccgccacggcgtacgcctacatcctctgctccctccccgacctcgccgtgcagtgcttcctccaccccatccgcatctacctccgcgcgcagtccgtcacgctcccgctcacctacgccgccgccgccgcgctgctgctccacgtgcccatcaacgtcgtcctcgtcgaccgcctcggcctcggcatccgcggcgtcgcgctcggcgcggtctgcaccaacctcaactgcctcctgttcctcgcggcgtacgtgtgcctctcgggaatgtacggcggcagggcgaaggcgtgcgcctccgccgccgcgccggccgccggcgaggaggacgacgacggcggcgtcagggagtggtggagcctggtgaggctgtccgtgcacagctgcatgtcggtctgcttggaatggtggtggtacgagatcatggtgctcctctgcggcgtgctcgccgaccccaaggcggcggtggcggccatgggggtgctgatacagaccacctcgctgatatacatcttcccgcactcgctcggctgcgccgtgtccacccgcgtcggccacgagctcggcgccgggaggccggagcgggcgcgcctcgtggcgcgcgtcggcgtcggcctcggcgcggcgctcgggatcgtggcgttcgggttcgcggtgtccgtgagggcggcgtgggcgcggatgttcacggcggaggacgccatcctgaggctggcggcggcggcgctgccgctgctgggcgccgccgagctggggaactgcccgcagacggccgggtgtggcgtgctgcgcggcagcgcgcggccggagagggcggcgaggatcaacgtggcggcgttctacggcgtcgggatgccggtggcgctggcgctggcgttctggcccgcggggctggacttccgggggatgtggggcggcatgctcgccgcgcagctcgtctgcgcgtggctgatgctgcgcgccgtgctgggcaccgactgggcggagcaggcggagcgcgcgcgcgagctcaccggcggcggcgacggctacgccgccgtggccgccgtcattgtcgacgacgacaaagccaagcagcatgcagaaatggacaaaccgcaacaggttgacaacacattgctcatggcgatcgattgtgtctagcaaaaccaagcagcagcagcaacaccaattcttggatgattgcatccatgattctttagttataggtttttttttgccttagtatttttgtaattttaccggatttttttttcagggaattcaagcaatcaaaagctgaacattccctactttttagcatttttttcctctttgaaatgagggaacctaagagataagaaatttacagtgaaaacagagagtggccagtgtacaaaagtagccactattgccatcagatttcataacaatgccaaacttttttttc

SEQ ID NO: 1802 - DNA, 1604 bp, Oryza brachyantha
atggcgatttgtgacaaggaggaggcggcgcaatgcctccaccagctgctcatcgtgccggagagctatcccaagctgcatgatcgcccgaggctggcggccgccggcgccggcgttcttggcgaggtggcgtccatcttccgcctcaccgggccaatggttggcgcggggatactcctgtacctgcgctccctggtatccatgatcttcctcggccgcctcggccagctcccgctcgccggcggctcgctcgcgctgggcttcgccaacatcaccggctactctgttctgtctggcctcgccggcgggatggaccccgtctgcggccaggcgttcggcgcggggcggacggacctgctccgggccgcccttcggcgcaccgtcgtgctgctcctggccgcgtcggtccccatcagcgcgctctgggtggccatgcaccgcgtcctcgtggccaccggccaggacccggacatcgccgccacggcgtacgcctacatcctctgctccctccccgacctcgccgtgcagtgcttcctccacccgatccgcatctacctccgcgcgcagtccgtcacgctcccgctcacctacgccgccgccgccgcgctgctcttccacgtgcccatcaacttcgtcctcgtagacaggcttggcctcggcatccgcggcgtcgcgctcggcgcggtctgcaccaacctcaactgcctgctcttcctcgcggcgtacgtctgcctctccggaatgtacggtcgcgacggcgacggcggcatggcgacggcgaaagggtgcgaggaggacggcggcgtcgtcagggagtggtggagcctggtccggctgtccgtgcacagctgcatgtcggtctgcctggaatggtggtggtacgagatcatggtgctcctctgcggcgtgctcgccgaccccaaggcggcggtggcggccatgggggtgctgatacagaccacgtcgctgatatacatcttcccgcactctctgggctgcgccgtgtccacgcgggtcggccacgagctcggcgccgggaggccggaccgcgcgcgcctcgtggcgcgcgtcggcctcggcctcggcgcggcgctcgggctggtggcgttcgcgttcgcggtgtcggtgagggcggcgtgggggcggatgttcacgacggaggacgccatcctgaagctggcggccgcggcgctgccgctgctcggcgccgccgagctgggcaactgcccgcagaccgccggctgcggcgtcctgcgcggcagcgcgcggccggagaaggcggcgaggatcaacgtctcggcgttctacggcgccggcatgccggtggcgctggcgctggcgttctggcccgtcgggctcgacttccgtggcatgtggggcggcatgctcgccgcgcagctcgtctgcgcgtggctcatgctgcgcgccgtgctcggcaccgactgggcagagcagacggagcgcgcccgcgtgctcaccggcggccgcgacgacggctacgccgtggtcgtcgtcgtccacgacgacacagcaaagccgcatgcagaaatggccaaatcagaggctgacaccaacacattgctcatggcgatcgatcgtgtcta

SEQ ID NO: 1803 - DNA, 1599 bp, Sorghum bicolor
atgtgccactgccactgctccgagccgacacaatgccaccaccaggtcctgctcccgccaaccaaggcctgccccgcgctgggtgaccgcccgaggccggcgcggcgcggcgacggcggcgcgcccaccgaggtcatcgcgtccatcctgcgcctcgccgtgcccatggtcggcgccggcctgctcatgtacatgcgctccctcgtgtccatgctcttcctcggcacgctcggccgcctgcccctcgccggaggctccctcgcgctcggcttcgccaacatcaccggctactccgtgctctccggcctcgccgccgggatggaccccgtgtgcggccaggcgttcggcgccggccgcacctccgtcctcaccgccgcgctccgccgcaccgtcgtcctgctcctggccgcgtccgtgcccatcaccctgctctggctcgccatgcaccgcgcgctcgtcgccacgggccaggaccccgacattgccgccgccgcgtacgacttcatcctgtgctcgctgcccgacctcgtcgtgcagtccttcctccacccgctgcgcgtgtacctccgcgcgcagtccgtcacgctcccgctcacgtacgccgccgccgccgcgctactgctccacgtccccgtcaactgcctcctcgtgcacagcctccggctagggatacgcggcgtcgcgctcggcgccgtttgcaccaacctcaacttcctgctgttcctcgtggcctacgtctaccttaccggactaatgcggcacggcgatgacggcggtaatggcaaggccgacgcgctgatgtgcgcgacgccgccgccggccgaggacgtcgagtgggggtgcctgctgaggctgtcgctgcacagctgcatgtcggtgtgcctggagtggtggtggtacgagatcatggtgctgctctgcggcgtgctggccgaccccaaggcggcggtggccgccatggggatactgatacagaccacgtcgctgctctacatcttcccgcactccctcagctgcgccgtgtccacgcgcgtcgggcacgagctcggcgcggggcggccggagcgcgcgcgcctcgtggcacgcgtcgggctctgctgcggcgcggcgctggggctcctggcgtgcgccttcgcggcgtccgtgagaggggtgtgggcgcggatgttcaccaccgacgccgccatcctgcggctagcgtccgcggcgctgcccatactcggcgcagccgagctgggaaactgcccgcagacggccggatgcggcgtgctgcgcggcagcgcgcggccggggaaggcggcgaggatcaacgtctccgccttctacggcgtcggcatgccggcggcgctcgcgctggcgttctggcccgcgcggctcgacttcgccggcatgtgggccggcatgctcgccgcgcagctcgtgtgcgcggcgctgatgctgcacgcggtgctgcgcacggactgggacgagcaggccgtccgcgcgagcgtgctaaccggcggcggcatagtcgtcgtcgccgatgtcaaaagcggccatgcagacgctgccaaagtaaaggcgaacaacggcatgctcgtcgtgaccgtgctaacttga

SEQ ID NO: 1804 - DNA, 1652 bp, Oryza sativa Japonica Group
agaaaagcatcactccataacatccttaaccatttgcacccaagaaacgccattgatgatagggtaagctgctgagctaagagtaagagctctcacattagctagctgtaccacacactacactagcagctggagcagcacacacatcacactacaatgtgccactgctcgtccaaggtcgtagccgtagcacaatgccaccagcctctgctcccgccaccggaggcatgccccgccctgcatgaccgccccaggtcggcgcgcggcggcggcggcgcgatcgccgaggtggcatccatcgtgcggctcgccatgccgatggttggagctgggctgctgatgtacatgcgctcgctggtatccatgctctttcttggccggcttggccgtctcccgctcgccggcggctccctcgcgctcggcttcgccaacatcaccgggtactcggtgctgtccgggctcgccgccgggatggaccccgtgtgcggccaggcgttcggcgccggccgcacgtccgtgctcgccgccgcgctccggcgaacggtcgtgctgctcctcgccgcgtccgtgcccatcgccgcgctctggctcgccatgcaccgggtcctcgtcgccgccggccaggaccccgacattgccgcctgcgcctacgagttcatcctctgctcgctcccggacctcgccgtgcagtccttcctccacccgctccgcgtgtacctccgcgcgcagtccatcacgctcccgctcacgtacgccgccgccgccgcgctcgcgctccacgtccccgtcaacgtcctcctcgtgcacggcctcggcctcgggatccgcggcgtcgcgctcgccgccgtctggaccaacctcaacttcttgctgttcctcgtggcgtacgcctacttctcaggtctgattcgtggcgacgacgacgacgacggcggcaatggcaaagccggcgaggagggcgcgacgacgacgacgacgacgatggagtgggggtggttggtgaagctgtccgtgcacagctgcatgtcggtgtgcttggagtggtggtggtacgagatcatggtgctgctctgcggcgtgctcgccgacccgaaggcggcggtggcggcgatggggatactgatccagaccacgtcgctgctgtacatcttcccgcactccctcagctgcgccgtgtcgacgcgcgtcgggcacgagctcggcgcggggcggccggagcgcgcgcgcctcgccgcccgcgtcgggctcgcctgcggcgccgcgctcggcgtcgtggcgtgcgcgttcgcggcgtccctgagaggggtgtgggcgcggatgttcaccgccgacgccaccatcctgcggctggcgtcgtcggcgctgcccatcctcggcgccgccgagctggggaactgcccgcagacggtcggctgcggtgtgctgcgcggcagcgcgcggccggggagggcggcgaggatcaacgtctcggcgttctacggcgtcggcatgcccgccgccctggcgctggcgttctggccggcgcgcctcgacttccgcggcatgtgggccggcatgctcgccgcgcagctggtgtgcgcggcgctgatgctgctcgccgtgcggcgcaccgactgggacgagcaggccgcccgcgcgcgcgagatcaccgg

SEQ ID NO: 1805 - DNA, 2096 bp, Zea mays; identical to SEQ ID NO: 1735

SEQ ID NO: 1806 - DNA, 2192 bp, Zea mays; identical to SEQ ID NO: 1730

SEQ ID NO: 1807 - DNA, 2006 bp, Zea mays; identical to SEQ ID NO: 1731

SEQ ID NO: 1808 - DNA, 2167 bp, Sorghum bicolor; identical to SEQ ID NO: 1732

SEQ ID NO: 1809 - DNA, 2064 bp, Oryza sativa Japonica Group; identical to SEQ ID NO: 1737

SEQ ID NO: 1810 - DNA, 2078 bp, Hordeum vulgare subsp. vulgare; identical to SEQ ID NO: 1738

SEQ ID NO: 1811 - DNA, 1874 bp, Oryza sativa Japonica Group; identical to SEQ ID NO: 1740

SEQ ID NO: 1812 - DNA, 2265 bp, Sorghum bicolor; identical to SEQ ID NO: 1724

SEQ ID NO: 1813 - DNA, 2127 bp, Zea mays; identical to SEQ ID NO: 1745

SEQ ID NO: 1814 - DNA, 2040 bp, Zea mays; identical to SEQ ID NO: 1742

SEQ ID NO: 1815 - DNA, 2004 bp, Sorghum bicolor; identical to SEQ ID NO: 1741

SEQ ID NO: 1816 - DNA, 2148 bp, Zea mays; identical to SEQ ID NO: 1743

SEQ ID NO: 1817 - DNA, 2022 bp, Oryza sativa Japonica Group; identical to SEQ ID NO: 1744

SEQ ID NO: 1818 - DNA, 1607 bp, Zea mays
gagcgagagagagacagaaagagacacagtcacacagcgtagggcgctgcggcctgcggggaggaagggcaccagcttggtctttctcatccattcgcaaatcgcaacaaatcttgcatcttatcttaccctagaaaaacaaatcttgcatcttcagctgtctgtacgtgtgtgtgtgagagagagacactgcgtgccgcagcagcagctctggacaggcttacaggcaagtcagagagcgagggaggagccgggaagaggaggccggagggaacaaaaggggaagtttggttctttcctctaccacctggagcgtctccttgccagccagcgcccggtccggtgagctccataccatccaagtagtgtgaggaaccgtcgtcgttgctggcgatccaagagaccaggagatgggcagcggcaggaacggcgctgtggtgaggcggtacgtccggtccaaggagcccaggatgaggtggagcgccgacctccaccgcagcttcgtgcaggctatcgactcccttggcggccaacacaaggctacgccgaagctcattctccagttcatgggcgccagggggcttaccatatctcatgtcaagagccacctccagatgtacagagctgcaagccttggcgcagaaagaggaggagggacgccagcccagctgctgcaaaggaggtactcatgcagcggtgatgagcgaggaggccccaaggaggagttcctgtgctgcccaccaccaccacctctgaaaagggcccggatgggatacgagagcatgcagggaagccatggagtcagtgatgcgaggactactgctgggggagggggactgtactgcatcgatgattacatgcaagccatggccgtgggctggagaataaaggaggagggcctcatcagatggcagaggagagatgcggctgctgctacgccttccaatctccaagccatgggatgtttggtgcaagaatctggcccctttaagcaggtacgccgaccagaagcacaccgtcttggttctgcgctgaagcagcaggacggcgacgactccagcaaagaggacggaaacgacggacggccccagtccagcaatgcagcgacgaaggaggacgaggcatctgagcagtgctcgctctcgctgtccctcggtaatctggacgcaaaatgcgggcgtggcatggcggcagcggcctcctcgcgaagcggcgagagcagctgcatcctcacggcctcgccggcgaggaggagctccagcgactgctccggccactcaggctgcttcgtcgtcgggccgggtggtgttgttagcctggagctttccctgtccatctgtggatcttagctagaccactccggccacttctggacgacgattctgtacatcagtggcggcgttggtgatcgccgcgtttgtttttttggtgttcgtgggcacatcatgaccgtgttagaaagtttagtaaccttagaaccatagcatgttagttctagctaagctagtatgatgtttgttacctctacctgtagccctagctggtatgtgtaaggctggctccaacaaggtcccctaaagggttctctaccctaaatatagaggatc

SEQ ID NO: 1819 - DNA, 939 bp, Sorghum bicolor
atgggcagcggcggcggcggcaggaatggtgctgtagcgaggcggtacatccggtccaaggagccccggatgaggtggagcgccgacctccaccgtagcttcctgcaggccatagactgcctcggcggccaacacaaggctacgcccaagctcattctccagttcatgggcgtcaaggagcttaccatatctcatgtcaagagccatctccagatgcacagagctgcgaggcttggcgcaggaagaggaggcccagggatgcaaaggaggcactcatgcaccggtgatgagcaaggtcccaaggaggaggagttcctgtgcccaccaccacctttgaaaagggtccggatggggtacgacgagagcatgcagggaagccatggagtcagtgatgcgaggactactgcagctgctgctgggggcctgtactgcatcgatgattacatgcaagccatggcctccatgggcaggagaataaaggaggagggcctcatcagatggcagaggagggacgctgctgctgatgctcctgcgaccattgctgctgctacgccttccaacctccaagccatgggatgtttggtgcaagaatctgacccctttaagatacgccgaccagaagcacgccatcttggttctgcgctgattcagcaggatgcctccaacaaagaggacggaagcggatgccccctcttcagtagcttcagcattgcagccaaggacgagccatccgagcagtgctcactctcgctgtcccttggtctggacccaagatgcgcccgtgccatgacagcagcctcctcgccaagcggcgagagcagctgcatcctcatggcctcgccggagaggaggagctccagcgactgctccggccattcaggctgctttgtcggaccgggtgttagcctggagctttcgctgtccatctgtggatcctag

SEQ ID NO: 1820 - DNA, 1618 bp, Sorghum bicolor
gtcacgcagattgtctacttccacgagcgtccatggacgggagcagcagcaaggtggttgagctcaagccgcacggcgacgtcgcggaggaggaccccgcccgtcgcggcggtccggggacggatgaagccgatgacaacgagaaggcgcctcgccggagcaggcgggttgcttccctcgacgtcttccgcggcctcaccgtcgcgctgatgatactggtggacggagccggcggcgagtggccggtcatcgggcacgcgccgtggaatggctgcaacctcgccgacttcgtcatgcccttcttcctcttcatcgtcggcatggccattcccctctccctcaagaggatcccagaccgtggccgagccgtgagaagagtagtcataagaacactgaagctgctcttctggggcatcctgttgcaaggccgttactcccatgctccggacgaactgacttatggagtcgacatgaagcacgtaagatggggtggaatcctccagaggatcgctcttgcgtatttggtggttgcagttctagagattgtcacaaaagatgcaaagattcaggatcagtcaagttcaggtttctctatattcagaatgtatctttctcaatggattgttgcatgctgcatcctagtgatctacctggcccttgtctatgggatttacgttcctgattgggagttcagagtgcgcaatgttgacagcccaaactacgggaaagtgttgacggtgacgtgtggtacaagggggatattagaccctccttgcaacgctgtaggttacattgaccgcaaagtcctcggcatcaatcacatgtaccagaaaccagcatggagaaggcacagggcctgcactgatgattccccacacgagggtcatttcagaaacgatgccccggcatggtgtgttgcgccattcgaacctgaagggatactaagctcactctctgcggtgttgagtacgataatcggtgttcactatgggcatgtgcttgtccacatgaagagtcatacagacaggctgaggcagtgggtaaccatgggaatatgtcttcttgttctcggaatcattctacacttttcacatgcaattccactaaacaagcagctctacacattcagttatatctgcgtcactgctggggctgccggagtcgtcttctccgtactctacttcttggttgacatcgtgagcctgcgctacgtcttcgcgccgctgcagtggatcggcatgaacgcgatgctggtgtacgtgatggccgctgaaggcatcttcgaggggttcctcaacgggtggtactacgagggcaccaacaacactctggtttactgggtgaggaagcacgtgttcgtgaaggtgtggcactccaccagggtgggcatcctcctctacgtcctcttcgcgcagatcctcttctggtcgctcgtctccggcgtcctccaccgcgctggtctctactggaagctctagcgaggatcatacacatagtcacatacacagacagtagcattagcatgttcttgtttgaatcgtattggaactgcacatgatacctcaaactcaaaatcagatgtatatttacaagcgaagtcagtgtctcggttgtcggt

SEQ ID NO: 1821 - DNA, 1621 bp, Zea mays
caacttgcacgtacgagagcgtccatggacgacggcagcagcaacaaggtggttgaggacgtcgcggaggaggaccccggccgccgcggcggtccatggaggacggatgaggccgacgccaacgagaaggcgcctcgcccgagcaggcgggtcgcttccctcgacgtcttccgcggcctcaccgtcgcgctgatgatactggtggacggcgccggcggcgagtggccggtcatcgggcacgcgccgtggaacggctgcaacctagcggacttcgtgatgcccttcttcctcttcatcgtcggcatggccgttcccctggccctcaagaggatcccggaccgtggccgagccgtgaggagagtggtcgtaaggacgctgaagctgctcttctggggcatcctgttgcaaggcggttactcccacgctccggacgaactggcgtatggagtcgacatgaggcacgtgaggtggggcggaatcctccagaggatcgctcttgcgtacctggtggttgcggttctagagatggtgacgaaagacggcgccaaggttcatcaggaccagccgccaggttcttcaggccgcttctcccgtgtattcagaatgtatctctcccagtggatcgtcgcgtgctgcattctggtggtctacctgtcccttgcctacggggtctacgttcctgactgggagttcagagtgcgaaacgctgacagcccagactacggcaaagttctaacggtgaggtgtggtacgaggggggcgttggaccctccctgcaacgccgtaggctacatcgaccgcagagtcctgggcatcaaccacatgtaccagaagccggcatggagaaggcacagggcctgcactgatgactccccacacgaggggcctttcagagaggatgccccagcgtggtgtgtcgcgccattcgagcctgaagggatactgagctcactgtctgctgtgctgagtacggtcgtcggtgttcactacgggcatgtgcttgtccacatgaagagccatacggacaggcttaggcagtgggttaccatgggcgtagctcttctcgttctcggaatcattctgcacttctcgcatgcgatcccgctcaacaagcagctctacacgttcagctacatctgcgtcactgccggcgccgctggggtcgtcttctcagcgctctacttcttggtcgacgtcgtgagcctgcgctacgccttcgcgccgctgcggtgggtcggcatgaacgcgatgctggtgtacgtgatggccgcggaaggcgtcttcgagggcttcctcaacgggtggtactacgagagcaccaacaacactctggtttactgggtgaggaagcacgtgttcgtcaaggtgtggcactccaccagggtgggcatcctcctctacgtcctcttcgcgcagatcctcttctgggcgctcgtctccggcgtcctccaccgcgctcgcctctactggaagctctagcgagcgaacggtggcatagcatgcttttgtcttttgaactgcacatgatacacacgacacctcaaactcgaaccccaagttagtttgaagaactcaaatcacgggcaaaatggaattcggcgagcggatcggattcattatt

SEQ ID NO: 1822 - DNA, 1963 bp, Hordeum vulgare subsp. vulgare
ggaagaaaatcattcccccatcttcttcttcttcctcctcctcttatctcctgtccccgtccgcattcactcacggcggtggcgacgcacgttcgttcttgttcctttcttgatggacggggggcagaacgtcgccaagcggcacgcccccggcgccgaggaggaccctgaccggcaccgcacccatgaggcggcggatgatcttgacgacgacggcgaaaagaaggcgtctcgcccgagcagcagcagcagcaggcgggtcgcctccctcgacgtcttccgcggcctcaccgtcgctctgatgatactggtggacggcgccggcggcgagtggccggtcatcggccacgcgccgtggcacggctgcaacctcgccgacttcgtcatgcccttcttcctcttcatcgtcggcatggccatccccctctccctcaagagaattccagaccgcggctgggccgtcaggagggtggtcataagaacgctgaagctgctcttctgggggatcttgctgcaaggcggttactcccatgctccagatgaactcacctatggggttgacatgaagcacataagatggtgtggtatcctccagaggattgcccttgcatacttggttgtcgcagtcatagagatcgccacgaaagacgcgagggttcaggatcagtcaagctcgggcttcttctcagttttcaggctgtacctgtcccaatggattgtcgcatgttgcattcttttgatctacttgtcccttgtttacggggtttacgttcctgactgggagttcacggtgcgaaatgtggatagcccgaactacggcaaagttttaacggtgacatgtggcacaaggggaaatctgagccctccttgcaatgctgtaggttacatcgaccgtaaagttctcggcatcaatcacctgtaccagaaacctgcatggaggaggcacagggactgtactgatgattccccacatgaggggcctttcaaaagggacgccccggcatggtgtgcctcgccatttgaacctgaaggtttactaagctcattttcagcggtgttaagtacgatcatcggcgtacactacgggcacgtgcttgttcatatgaagagtcatatggacaggctaaagcagtgggtcaccatgggcgtagctctcctcctccttggaatcattctgcacttctctcatgcgattcctctgaacaaacagctgtacacgctcagctacatctgcgtgaccgccggcgccgctggcatcatcttctccatgctttacttccttgtcgacgtcgtgcacctgcgctatgtcttcgcgccgctgcggtgggtcggcatgaatgcgatgctggtgtacgtgatggccgcggcgggcatctttgagggcttcctcaacggctggtactacgacgggcccaacaacacactggtttactgggtgaggaagcacgtgttcgtccgggtatggcactcagccagggtgggcatcctcctctacgtccttgtcgcgcagatcctgctctgggcgctcattgccggcctcctccaccgggccggggtttactggaagctctagccacccaggagggtattggtgtcatcatttgcttgtgtgttggaattgtgcagaatgtgtgtaagaagacaaggaaggtgcaaaagcatttcaacatgatcccaagcagaagcatgactaagcttcaaaaagctacaagggctgcacctagtgagatgagatctatggttcagaggtgaagcagaagcagtatagcctatgggactgtggggggaaaattcatacataagtaattagcaatctagaatgtcacatttgttaacttatgattagcacattgttagcttctgatcatccacagtctgatccaactgtccagaaatataaacttgtatccagtctgatgcatgtagtaagccatctttgattttctgaaactgttcgcaaggc

SEQ ID NO: 1823 - DNA, 1945 bp, Oryza sativa Japonica Group
gtattagagctattgattgattgattgctgatcgcttccagttccagcaatccgtcggaatatctctccccgatctcctcttcttcttatccacgcgcggcacgacacgagcagctttttgcctgcggccgctgctgcttctgtgtgagattgttcgctggggatggacggcggtggccagggcgtcgcgcggcggcacggcgcggtggcggaggaggatcccgaccgccgccgcggcgaccgctcggggaaagaaggtgacgacgacggcgtcgacgtcgacgagaaggcgcctccgcctcgccggaccagcaggcgggtcgcgtcgctcgacgtcttccgtggcctcaccgtcgctctgatgatactggtggacggcgccggcggcgagtggccggtgataggccacgcgccgtggaacggatgcaacctcgccgacttcgtcatgcccttcttcctcttcatcgttggcatggctattcccctctccctcaagaggattccagaccgcggtcgagctgtgaggagagtagtgctcaggacactgaagctgcttttttggggaattctgttgcaaggcggttactcccatgcccctgatgatttgtcttatggagttgacatgaagcacgtgagatggtgtggtattctccaaaggattgctcttgcatacttggtggttgcagttctagagatcgtaacgaagaatgcaaaggttcaggaccagtcaagttcgggcttctcgattttcaggatgtacttctcccagtggattgttgcatgttgcatccttgtgatctacctgtcccttgtatatgggatttatgttcctgactgggatttcagagtgtcagatgttaaaaatccaaacttcggcaaaatcttgacggtgacatgtggtacacggggaaaattaagtcctccttgcaatgctgtaggttatattgaccgtaaagttcttggtatcaatcatatgtaccacaggccagcatggaggaggcacaaggactgtactgatgattccccacatgagggaccttttaaaactgattccccggcgtggtgttatgcaccatttgaacctgaagggttactaagctcactgtccgcggtgttgagtacgatcatcggggtgcattatgggcatgtgcttgttcatatgaagagccacacggacagactaaagcagtggtctatcatgggcataactctcctcattcttgggcttactctgcacttttcacatgcaattcctttgaacaagcaactgtacaccttcagttatatctgtgttactgccggtgcggctggaatcgtgttctgcatgttctacttcctggttgacatcctgaatctgcactacccattcgcacccctgaaatggaccggcatgaacgcgatgctggtgtacgtgatggcggcggcaggcatcttcgaagggttcttgaacgggtggtactacgagggcaccaacaacacactggtttactgggtgaggaagcatgtgttcgtgaaggtgtggcattccacccgtgtgggcatcctcctctacgtcctcttcgcgcagatcttgttctgggcccttgtcgccggcctcctccaccgtgctcgcctctactggaagctctagcactgcactggtacactacactacactacagcgtttacacaggggctgttcggattgatgtcattttcaaccgaactattttttttaaaattaccaaaaagaagtgttgcatttagtttgttgccaaactttgataaatacataagaaatcctaccaaaattttgataacattgttaacttgtcaaaatttggtaaggtttattttcgctacaatctgaatagcctagtcttcagatttctcgttgatggaattgtgcatttagccgtgattaaaatttgaaaccacaagtgcaattgggatcttgtgcagtctc

SEQ ID NO: 1824 - DNA, 3158 bp, Oryza sativa Japonica Group
actacgggcaggtgcccccgccccagccgtactacgccgcgccaccgccgcaggcgatgcccgcccccgcggccgcggacgaggtgaagacgctctggatcggcgacctgcagccctggatggacgagagctacatctacaactgcttcgcggccaccggggaggtacgggtcctgatctgctgtgagatttggttgcccgtaattttttgtttgtgtggcttgttgctgatggagttgtactgtggtgtattgcgactaatttagttcctgatgctgtatgttgtgacttgcgactgacttagttctgacttctcaaaagctctaggctatgagttgtgggtctacaataaaaacaaaatttcatgcttcggctgatttatcagtgattgttgaatgtatctttttggtttattgagattttatgaacatgctactttctttagtgaatcgatttcggaaggttttgtttggttttttacttactgttttcacatggatgctaagtttgcagactatataacatttgcgtacattctaaatgctatttatgtgattcggttttgctatcaatatacataagccattgctcagatgataatggatgaaatgcaacatctaatatacccagattgtgtccgcccattcatgatttacctaccgtatctaacgttttgcatttacttgcaggttcaatctgtgaagcttatccgggacaaacaaagtggacagcttcagggttatggctttgttgagtttacaagtcgtgcagctgctgatcgaattcttcagacttataatggacagatgatgccgaatgttgagatggtcttccgattgaattgggccagtgctggcgagaagcgtgatgatacccctgactacaccatttttgtcggggatttggctgcagatgttacagactacctactacaagagacattcagggtccattacccttcggttaagggtgcaaaagttgtaactgacaaaatgacaatgcgttcaaagggttatgggtttgtgaaatttggtgatcctacagagcaagctcgtgcaatgactgaaatgaatggaatgctttgctcttccagaccgatgcgtattggtccagcggcaaataagaaaacaacaggggttcaggagagaggtaaatgctgctgatcgtatttcccattgacaccttttacttattagctattattatgggcagttatctttatttctatctatatgtatggctggctactctgcttgatgataccttttccttttgatgttccgcttttaccttttccggttttacttacttttacggaataaaccaaagcttgtgtgaccctttttcttcaagaagtcattattccttagtacaacattccctgtgaatttggatcatttcatgcactagaactagaaaaatagtagacttatgaaactcgtgttatctggaagcaggaggtcaacaggctctctccgtattggagttttggaactgatttgagctgtgatgcatttcttgtgtaatgcatggcctcatttaggtcagtgtaaaacatttatgttctaaatttgaagtctgtttctttcgatttctgccctccgaatacttcagtcatttattcttcttgctatttcagattctacttcatttgtgcacgcatacgtttactatacattttctttgtttaaaaagttttatgactcatgcttgatgtgatatgcacatagttaaattagcatgttggctcgagcttgcttttatttgctaggcttgactattgagggtcatatccgtgcttcatgtattgaggcttgatatttttaacattttctatttccttctttttgaaaaatagatttttgaatgacaaaatgttagtaccttctgtgaataaattcttgtctttttcatgccttctagtttttgtttttgtgatattttacacttcgagttgccacactgtttatctgttcttttaaacatctggagaatattctgcttcttttctcaacatacattatgataggcttgcaatgaatctctcattttatctgcctctaacttgacatggaatcgattgttggggctgtatttcattctgtattgtgttgtgtattcagcttgtttgagattctatgtatacaatacttaaaaaacagtgttctgcttgcccttttccttgattgggtagtcttattagcatttttggccacttaactccattataagtctgttaagtgaaatcttgtctacatgtgtactattagcttggtggtttcgcctccataatcttatcaaactttagcatggttctgatgaacatgttcctgaattgctgagctatcctagttactctattctaaattgtcttcagtgatgcttgatattctgcttaatgcatatggcttgacatggctggatctatatgaatatcactgcttatgcttgtaataatctatttactactataagaacatcagtgaacgagacatttgcatgataagcattcatgtttaccagcatttgacaaatcttacattgtattttcttcacttttttgctttcatttacagtaccaaatgctcaaggagctcagtctgagaatgatcctaacaataccaccgtgcgttcttagttctatttttcctgtacaacagtaatttcttttcagttcatttagtgactatgtttgttgttgagctcagatattcgttggtggtcttgaccccaacgtcactgaagatgtcttgaaacaagttttcgctccttatggagaagttgtccatgttaagattcctgttgggaaaagatgtggttttgttcaatatgttaacaggttgactctttgttcgtttgttctatttccacagatgtcttactgccttgtattttttttttttgatgaggtacttgcaaattactcttgtcattgcatattcaggccttctgctgagcaagcactggcagtgctacaagggaccttgattggtgggcagaatgttagactttcgtggggtcgaagcctttcaaacaaacaggtccagatcaaactcaacatagtaattttcttatctataaagctgtataatggagctaaagttgataacattgtggtttttgaatgtcttcagcctcagcacgactcgaatcagtgg

SEQ ID NO: 1825 - DNA, 1597 bp, Oryza sativa Japonica Group
agtctctctctctctctctctcccgttcgtgcgtgctagctagggcatctcgtcgcattgatgcagcagccgccgtcgcagccgcagcccggcatgggcggcccgcctccgccgccacagggcgcggcggggcagccgccgcagtggggcgcgatcccgccgccgatgccgccgcaccagtacggcgcgccgccgccccagcagccgccggcgatgtggggccagcccccgccgcaggcgcactacgggcaggtgcccccgccccagccgtactacgccgcgccaccgccgcaggcgatgcccgcccccgcggccgcggacgaggtgaagacgctctggatcggcgacctgcagccctggatggacgagagctacatctacaactgcttcgcggccaccggggaggttcaatctgtgaagcttatccgggacaaacaaagtggacagcttcagggttatggctttgttgagtttacaagtcgtgcagctgctgatcgaattcttcagacttataatggacagatgatgccgaatgttgagatggtcttccgattgaattgggccagtgctggcgagaagcgtgatgatacccctgactacaccatttttgtcggggatttggctgcagatgttacagactacctactacaagagacattcagggtccattacccttcggttaagggtgcaaaagttgtaactgacaaaatgacaatgcgttcaaagggttatgggtttgtgaaatttggtgatcctacagagcaagctcgtgcaatgactgaaatgaatggaatgctttgctcttccagaccgatgcgtattggtccagcggcaaataagaaaacaacaggggttcaggagagagtaccaaatgctcaaggagctcagtctgagaatgatcctaacaataccaccatattcgttggtggtcttgaccccaacgtcactgaagatgtcttgaaacaagttttcgctccttatggagaagttgtccatgttaagattcctgttgggaaaagatgtggttttgttcaatatgttaacaggccttctgctgagcaagcactggcagtgctacaagggaccttgattggtgggcagaatgttagactttcgtggggtcgaagcctttcaaacaaacagcctcagcacgactcgaatcagtggggtgctggtgctggtgctggtggttactatggtggctatggacaaggttatgaggcttatggtgggtatgcacaacctcaggatcctaacatgtatggttatggagcctatgctggttatcccaattaccaacagcaacaagtagcacagcagcagccgccgcagcagtgagccctgtttgatcgatcgcgtctttgggctgtgaggcacacaacccatttcaagctacagctttagctatgttattgctattctcaatagagagacggtttctgaagactccagatttcgattgaggttttaatgtatgaactgtattatgattatgaacaacggatgctgccatatcgtggttcctatattgagtcatgtattttgaaaacatatcctctgtttccatctcacccttatcatcgattattattattgc

SEQ ID NO: 1826 - DNA, 1492 bp, Zea mays
tgctagggttaggtcgtctcggcaagtcgccatgatgcagcagcccccgcagccgcagccgggtatggcgctacctcctccccctcagaccggtggcgggcagccaccgcagtggggcgcgatcccgccgccgatgacgcagcagtacggcgcaccacctccgcagcagcctccagcgatgtggggccagcctccgtcgcaggcgcactacgggcaggcgccgccccctcagccgtattatgccgcgccgccggtgccggccgcccccgctgcggcggacgaggtcaggacgctctggatcggggacctgcagtactggatggacgataactatgtcttcgggtgcttttcgaacaccggcgaggttcaaaatgtgaagctcatccgcgacaagaattcaggacagcttcagggctatggttttgttgaatttacaagccgtgcagctgcagagcgagttcttcagacatataatggacaaatgatgccaaatgttgacttgacatttcggctgaactgggccagtgctggtgaaaagcgtgatgatactcctgactatactattttcgttggtgatttggctgcagatgttacagattacttgttacaagagacattcagggttcattatccctcggtgaagggtgcaaaagttgtgactgataaattgacaatgcgtaccaagggttatggatttgtgaaatttggcgatcctacagagcaagctcgtgcaatgactgaaatgaatggaatgccttgttcttccaggcctatgcgtattggtcctgcagcaagtagaaaaaatgcaggtggtgttgttcaagagagagtaccaaattctcaaggagctcagtctgagaatgatcctaacaataccactatatttgttggtgggcttgaccccaatgtcactgaagatgtcctaaaacaagcattttctccttatggcgaagtcatccatgttaagatccctgttgggaagagatgtggttttgttcagtttgttaccagaccttctgctgagcaggcgctgctaatgttgcaaggggccttgattggtgcacagaatgttcggctttcgtggggtagaagcctgtcgaacaagcagactcagcctcagcaggaatccatgcaatggggtgcgggtgcgcctgctggtgttggtgattactatggtggctatggacaaggttatgaggcttatggcagtgggtatgcacaaccccaggaccctaacatgtatggttatggcgcttatgttggttatcccaattaccaacagcaaccagctgcacagcagccacagcaacaacaggtgaagctcctagctaattgatgccctttggagtttaattggtgaaaaaaatatctctactaataacaaattgaggcctctttgctcgggtaggtcattgggttgtctgagatgggatcaattagtattatttctaggcattcatatattgatttcttgaaaatagaggtggtttcg

SEQ ID NO: 1827 - DNA, 2019 bp, Hordeum vulgare subsp. vulgare
gattcggcggcgcatcttctgcttcccccaaaccccccaagccctcgtctgagaaaaaaacccagctttgggctctccgtgcccacggtggttggaggcggcggcaatgcgccagagcccgtcgccggcggcaatggacaccccagactttagagtcaagctaggcttcgagagatcccttcgacgcgaccgtccatacggcgggtacccacgcctcccaagcgaggactcgccgcagatggccttcttcgacgcggccttcgagggcaaccttccccgcctcagagagctggcgagcggcagggacgcgaaggggatggcctggtccaccgtgatggccgatttggccctcgagggccaaatcggccatcacgacggacgaatctcagccctgaaatccccatcccctcccccgcacccgtccgtctccctcccctctctccctagggttcgggcctctcctcccctctcctctcgccatgatgcagccaccgccgccgtcgcagccgcagccgggcatgggcgcccccatgccgccgcagggcgcgggagggcagccgccgcactggggcgcgatcccgccgccgatgccgcactacgcgcagccgcccccgcagcagcagccgccgccccaggccatgtggggccagccgccgccccaggccgcgccctacggccaggtgcccgccccgcagcagtactacgccgcgccgcaggcccccgccgcccccgccgcctcggacgaggtcaggacgctctggatcggggacctccagtactggatggacgagaactacatctacagctgcttcgccaacaccggggagttccaatctgtgaagcttatccgcgacaagcagactgggcagcttcagggttatggctttgtcgagtttgcaagccatgcagctgctgagcgagttcttcagacattcaatggacaaatgatgccaaatgttgagttggcatacagactgaactgggccagtgctggcgaaaagcgtgatgataccccagactatacaatttttgttggggacttggcagctgatgttacagactacatgttacaggagacattcagggtccattacccttcagtgaagggcgcaaaagttgtgactgacaagatgacaatgcgttcaaagggttatgggtttgtcaagtttggtgatcccacagagcaagctcgtgccatgactgagatgaatggaatgccctgttcttccagacctatgcgcattggtccagcagcaaataggaagacaacaggggttcaggagagagtaccaattccaaatacaaatactcaaggagctcagtctgacaatgatcctaacaataccaccatatttgttggcggccttgaccccaatgtcactgaagatgccttgaaacaagtgtttgctccatatggggaagtcgtccatgtcaagatccctgttgggaagagatgtggctttgttcagtatgctaacaggccttctgctgagcaagctctgcaattgctgcaagggaccttggttggtggtcagaacgtgaggctttcatggggacgaagcccttcgaacaaacaaactcagcctcaggaagccacccagtggggtgcaggtgctgctgccggtgctgctggtggttactatgctggatatggacaagggtacgaggcttatggacaagggtatgcacagccccaagaccctaacatgtatggttatggagcctatgctggttatccaaactaccaacaaccagcagctgcacctcagccgccaccgccacaacagtgagccctccccattgggtcttccagacatgagatgagaacccctgtttgaaggcgctgtcgaggctaatgttgtagcacctgtcgatagagagagagagggttcctggactcctgattttgatcgcctcatggcaaggtctatttggtctattatgcactatgttatgagcagctgttgtcccattgtgatccttcaaatgtgtactggaaactatgttttgttttgccgc

SEQ ID NO: 1828 - DNA, 1416 bp, Sorghum bicolor
aacaccgaaatttccttcttcccccatctcctcctcgccgtccctcctttcctcccgtcgcggctagggttagggtcgtctcgccaagtcgccatgatgcagcagcccccgccgccgcagccgcagccgggcatggcgccgcctcctcctactcaggccggtggagggcagccaccgcagtggggcgggatcccgccgccgatgacgcagcagtacggcgcaccgcctccgcagcagcctccggcgatgtggggccagcctccgccgcaggcgcactacgggcaggcgccacctcctcagccgtactacgccgcgcctcctgcgcccgcgccggcgccggccgcccccgctgcggcggacgaggtcaggacgctctggatcggggacctgcagtactggatggacgagagctacgtcttgggatgcttcttgagcaccggggaggttcaaaatgtgaagctcatccgtgacaagaattcaggacagcttcagggctatggttttgttgaatttacaagccgtgcagctgcagagcgagttcttcagacatacaatggacagatgatgccaaatgttgagttgacatttcggctgaactgggccagtgctggtgaaaagcgtgatgatactcctgactataccattttcgttggggatttggctgcagatgttacagattacttgttacaagagacattcagggttcattatccctcggtgaagggtgcaaaagttgtgactgataaattgacaatgcgcacaaagggatatgggtttgtgaaatttggtgatcctacagagcaagctcgtgcaatgactgaaatgaatggaatgccttgttcttccaggcctatgcgtattggtcctgcagcaagtaggaaaaatacaggaggtgttgttcaagagagagtaccaaattctcaaggagctcagtctgagaatgatcctaacaataccaccatatttgttggtggtcttgaccccaatgtcactgaagataccctaaaacaagttttttctccttatggcgaagtcgtccatgttaagatacctgttgggaagagatgtggttttgttcagttcgttaccagaccttctgctgagcaagcgctgctaatgctgcaaggggccttgattggtgcacagaatgttcggctttcatggggtagaagcctgtcgaacaagcaggctcagcctcagcaggaatccaaccaatggggtgcagcagcggctgctggcgctggtggttactatggtggctatggacaaggttatgaggcttatggcagtgggtatgcacaacctcaggatcctaacatgtatggttatggtgcttatgctggttatcccaattaccaacagcaacaagctgcacagcagccacagcaacaacaggtgaagctcctagctaattaa

SEQ ID NO: 1829 - DNA, 1663 bp, Zea mays
ctcccatctcggctagggttaggtcgtctcgccaagtcgccatgatgcagcagcccccgccgcagcagccgcagccgggcatggcgccgcctccgcctccgcaggctgctggcgggcagccaccgcagtggggtgggatcccgccgccgatggcgcagcagtacggcgcaccgcctccgcagcagcctccggcgatgtggggccagcctccgccgcaggcgcactacgggcaggcaccaacccctcagcagtactacgccgcgccgccggtgccggtgcaggcgccagccgcccccgctgcggcggacgaggtcaggacgctctggatcggggacctgcaatactggatggacgagaactacgtcttcgggtgcttttcgaacactggggaggttcaaaatgtgaagctcatccgtgacaagaattcagggcagcttcagggttatggttttgttgagtttacaagccgtgcagctgcagaacgagttcttcagacatacaatggacaaatgatgccaaatgttgacttgacatttcggctgaattgggccagtgctggtgaaaagcgcgatgatactcctgaatatactatttttgttggggatttggctgcagatgttacagattacttgttacaagagacattcagggttcattatccctctgtcaagggtgcaaaagttgtgactgataaattgacaatgcgcacaaagggttatggatttgtgaaatttggtgatcctacagagcaagctcgtgcaatgactgaaatgaatggaatgccttgttcttccaggcctatgcgtattggtcctgcagcaagtaggaaaaatacaggaggtgttgttcaagagagagtaccaaattctcaaggagctcagtctgagaatgatcctaacaataccactatatttgttggtgggcttgaccccaatgtcactgaagataccctaaaacaagttttttctccttacggtgaagtcgtccatgttaagatccctgttgggaagagatgtggttttgttcagttcgttaccagaccttctgctgaacaagcgctgctaatgctgcaaggggccttgattggtgcacagaatgttcgactttcatggggtagaagcctgtcgaacaagcaggctcagcctcagcaggaatccaatcaatggggtgcggctgctggtgctggtggctactatgggggctatggacaaggttatgaggcttatggcagtgggtatgcacaaccccaggatcctaacatgtatggttatggcgcttatggcggttatcccaattaccaacagcaaccagctgcacagcagcaacagcaacaacagtgatgcctgtttgctcgggtaggtcattgggttgtcgcgacggaattaattaaatattatttcaggacactctcatattgcattcttgtcaattgaggtggttttgaaaggctcctgattttgatggccccatggcacggtttcatctatttattagtatatgacatatatgcgctgtgaacaagtggcgctctactgtgattgctgtgttgagacatgctttcttagtttctttccatgtttctcggatctgttgtgttacctttattactgtgtatttgcatatctactgtgatgctatatatgcactgtgccgtttgtttcct

SEQ ID NO: 1830 - DNA, 1693 bp, Zea mays
cgctccccgccgccgccgccatgatgccgcagcagcagcagcccggcatggcccctcctcctccacaggccgcccccggagcgccgccacactggggcggcatcccgccgcctatggcccctcagcatcagtacgcgccaccaccgacccatcaggccccgcccccgccgcagatgtggggccaggcgcccccgcccccgcccccgcctcaggccgcgtacggtcaggcgcccccgccgccccaggccgcgtatggccaggcgctcccaccaccccaggccgcgtacggccaggcgcctcccccgccacaggccgcctactacggggcggtacccgcgcccgcggcggtggccgcggcacctgtcgggcccagcgaggtcaggacgctctggatcggggatctgcagtactggatggacgataactacatctacgggtgcttcgcatccacgggggaggtgcaaaatgtgaagctaattcgtgacaagcatactggacaacttcagggctatggttttattgaattcataagccgcgctgctgctgaaagagttcttcagacttacaacgggacaatgatgccaaatgttgagttgccattccggttgaattgggctagtgctggtgaaaaacgtgatgacacccccgactatacaatatttgttggtgatttggctgctgatgttacagactatgtattacaagagacatttagggcacattacccttctgtgaagggtgcaaaagttgtaacagacaagctgacaatgcgcacaaagggttatggttttgtgaagtttggtgatcctaatgagcaagctcgtgcaatgactgagatgaatggcatgctatgttcttctaggcctatgcgtattgggcctgctgcaaacaagaaagctactgttgttcaggagaaagtaccaagtgctcagggagttcagtctgacaatgatcctaacaatacaaccatttttgttggtggtcttgaccccaatgtcactgaagatatgttgaaacaagttttcaccccttatggggacgtagtccatgttaagattcctgttggcaaaagatgtggttttgttcaatatgctaacagatcttcggcagaggaggcattggtaattctgcaaggcaccttggttggagggcagaatgtgaggctttcatggggtcgcagcccttcaaacaaacaagttcagcctcaacaggactccaaccagtgggccggggctaatgctggatattatggctacggtcaaggctatgaggcctatgggtacccccagtctcaggaccctaatatgtataattatggagctggagcttatgctggctatccaaattaccaacaacaaccagtagcacagcaaccgccgcagcaacagtgagaggtccagtgacgctactgtcatttgggtgattgacgtggaaatatttatgagttgtaagatgagcttcggatgcaagctggattaggtatacagacatgattttcgtagtactcagattctgagttgccctcgtatcagagcttgtggtcccaatagcctgcagctgcagctaaaacgatctattttggtagcggaatgttttatctgcttattttgtaccgtgtcttccgctactgcggcggagccttgataacttgctatgttggatttttcccgagtgttatcgcatgaatgttgtc

SEQ ID NO: 1831 - DNA, 1764 bp, Zea mays
gagaaatctcaatccaaagagagccttctccaccgctcttgctcgtccaaccttctccatcgtctcaccttaggtttcgctccccgccgccgccgccatgatgccgcagcagcagcagcccggcatggcccctcctcctccacaggccgcccccggagcgccgccacactggggcggcatcccgccgcctatggcccctcagcatcagtacgcgccaccaccgacccatcaggccccgcccccgccgcagatgtggggccaggcgcccccgcccccgcccccgcctcaggccgcgtacggtcaggcgcccccgccgccccaggccgcgtatggccaggcgctcccaccaccccaggccgcgtacggccaggcgcctcccccgccacaggccgcctactacggggcggtacccgcgcccgcggcggtggccgcggcacctgtcgggcccagcgaggtcaggacgctctggatcggggatctgcagtactggatggacgataactacatctacgggtgcttcgcatccacgggggaggtgcaaaatgtgaagctaattcgtgacaagcatactggacaacttcagggctatggttttattgaattcataagccgcgctgctgctgaaagagttcttcagacttacaacgggacaatgatgccaaatgttgagttgccattccggttgaattgggctagtgctggtgaaaaacgtgatgacacccccgactatacaatatttgttggtgatttggctgctgatgttacagactatgtattacaagagacatttagggcacattacccttctgtgaagggtgcaaaagttgtaacagacaagctgacaatgcgcacaaagggttatggttttgtgaagtttggtgatcctaatgagcaagctcgtgcaatgactgagatgaatggcatgctatgttcttctaggcctatgcgtattgggcctgctgcaaacaagaaagctactgttgttcaggagaaagtaccaagtgctcagggagttcagtctgacaatgatcctaacaatacaaccatttttgttggtggtcttgaccccaatgtcactgaagatatgttgaaacaagttttcaccccttatggggacgtagtccatgttaagattcctgttggcaaaagatgtggttttgttcaatatgctaacagatcttcggcagaggaggcattggtaattctgcaaggcaccttggttggagggcagaatgtgaggctttcatggggtcgcagcccttcaaacaaacaagttcaggactccaaccagtgggccggggctaatgctggatattatggctacggtcaaggctatgaggcctatgggtacccccagtctcaggaccctaatatgtataattatggagctggagcttatgctggctatccaaattaccaacaacaaccagtagcacagcaaccgccgcagcaacagtgagaggtccagtgacgctactgtcatttgggtgattgacgtggaaatatttatgagttgtaagatgagcttcggatgcaagctggattaggtatacagacatgattttcgtagtactcagattctgagttgccctcgtatcagagcttgtggtcccaatagcctgcagctgcagctaaaacgatctattttggtagcggaatgttttatctgcttattttgtaccgtgtcttccgctactgcggcggagccttgataacttgctatgttggatttttcccgagtgttatcgcatgaatgttgtcatt

SEQ ID NO: 1832 - DNA, 2572 bp, Sorghum bicolor
cccccccctgctcctcctcgcagtcctagtctagatctccaccgcgcgcgcgcagatccgccacacctccatggcggatctcgccgccgccgcggcggcccctccgccggccacggacctcttcggtgagccgatcgaggcgcaccctccctggttcaagcccgacgccttcctccgcgccggcttcgacccggacgcctacgtcgccgagctccgctcctacgtcccgctcgagagcctcgccgccgagctccgcgcccacctcgccgcgctccgcgccgagctcgtcggcctcatcaaccgcgactacgccgactttgtcggactcagcgcccgcctcaagggcgtcgacgccgccgccgcaaggatgcgcgccccgctcgccgacctcagggacaaggtcgccgccttccgcgccggggcatccgccgcgctcgccgcgctacgggcggggctcgagcagcgggccgccgcaaccgccgcgcgcgagctgctcgagctcctgctcgacacctcccacgtcgtctccaaggttgagaaattgatcaaggaactaccaactgcaccatcagattcatcgaatgccgaagttcctaacaatgacactggaatgccaaatggggaggctgggacaggtgtcagagaaacacaaagcattctcttagaaagaattgccagtgagatgaaccggcttaaattctacatcagtcatgcacagaacatcccttttattgagaacatagagaagagggtccaaggtgctacaaaactgcttgatggtagcttggagcgctgctttgtggatggtctggaacaccgtgatgctaaagttatatacaactgtttgcgtgcttatgctgcaattgacaatacatcatcagccgaagagcttttccgtacaacagtggtgtctccattgattcagaaaatagtccctcaaaattatgcgagggctgttgctggggcatcatctgatgaactggaagatgattatcaacagataaaagaatgtgttaaaaaagattgcaaattcatattggaaatatcttcatcagaaaactctggattgcatgtttttgattttctgggcaattcaatactcaaagaagtcctttctgcaatccagaaaggcaagcctggggccttttctcctggaaagcctaaagaattcttgaggaactacaaagcaagcttaggatttcttgattttcttgaaggttactgcctctccaagtctgctgtaacgaagttccgcgctgagcctgcttacacagatttcatgcgacaatggaatgttggtgtctacttttcgttgcgatttcaggaaattgcgggtggccttgattctactcttacaaacacctttagtcctactggatcgaatgaggctcaagggaagcaattgctcttgaagcaaagtattaagctcttagaaagtttggagtcatgttggagtgacgaggttcttttattctctcactgtgataagttcctccgtttgtccttgcagcttatttcaaggtatacaacatggctttcatctggtttatctgcacgtaaagcttctgatgggagcccaaattcacctgcagatgctgaatgggcactgtctacacctattgaagatttcatatatataatgcatgatgtgcatgctgtaattggtgagctttcagaatcaggcagctttattggacatgtgaatcagttactaggatcatgccccattgaagtacttaaccttgtcaaacaaagtatactgcaagctgtcgaacctttaaaggaggtgttgcctgcaataatgaatgtcatgattggaatcatagttaagaagtctaatgaggacctgaagcacctgaaaggaataacagcgacatataggatgacgaataagcttccagtgaggcattctccatatgtatcaggaattttacatccactgaaggtgtttcttgaaggggagcgtatacactatctatcagaagatgataaaactaggttgtgtcgagggtctacagataagattactgcaatttactatgacttggtctctgaagttgtcactgtggcaaggaaaaccgagtcttcattgcaaagactgcgccaaggtgcacaaaggcgagtaggggctagtacagatgcctcagataacatcatatctgatacagacaagatctgtatgcagctatttcttgatattcaggagtatgcacgaaaccttcgtgcgataggaatagatgcgagagaaattgattcctacagagctctatggcagtgtgttgccccaaaagacaaacaagagaacattcagttttgatgtaaagaatgctgtcagtatatataaaattgtcacccgtagatctctcagcatgtaggtgtatctgatgttgttcttttggtttgaagtacttatgatgcatacatagatagagaactgaattttgatatcgttgccgtaccattttattattaggatggtcacctccatatataatccagaattggagaatgtgtatcaatacatgatttcacgtgaaatacaaggatactgttgcaaactgcttgcaattat

SEQ ID NO: 1833 - DNA, 2595 bp, Hordeum vulgare subsp. vulgare
ggtccagtccaaacccaccgcactcccctccctcctgcccctcagatccacccgacaccatggcggatctcgccgcgcccccgcgcccggccgccgcgccgcagccaccggcggcggcggcggcggcggcgaaggacctcttcggggagacgatcgaggcgcacccgccgtggttcaggccggaggccttcctgcgcgcgggcttcgacccggacgcctacgtcgccgagctgcgctcctacgtgcccctcgagagcctcgccgccgagctgcgctcccacctcgccgccctccgcgccgagctcgtcggcctcatcaaccgcgactacgccgacttcgtcggcctcagcgcccgcctcaagggcgtcgacgccgccgccgcacgcatgcgcgccccgctcgccgacctcagggacaaggtcgccgccttccgcgccgccgcgtccgcggccctcgccgccctccgcgccgggctcgagcagcgcgccgcggccacgcaggcgcgcgagctcctcgagctgctgctcgacacctcccacgtcgtctccaaggttgagaaactgatcaaggaattaccaacagcaccatctgattcatcagatgttgaggttcgttcagttgataagggatactccggcaatgatactacgccatcaaatgtggaggcagggacagatgtcagagaaacacagagcattctcttagaaagaatcgcaagcgagatgaaccgactcaaattttacatcagccacgcacagaaccttccttttattgagaacatggagaagagggtccaaggtgctacaaaactacttgatggtagcttggagcgttgcttcgtggttggtctagaacatcgtgacgcaaaagtaatatacaactgcttgcgcgcttatgctgccattgacaacacatcttcagctgaagagcttttccgtacaacagtggtctccccattgattcagaaaattgtccctcaaaactatgcaaaagctgtttctggggtatcttctgatgacctggaggatgactatgagcagataatgcaatgtgtagaaaaagattgcaaatttattttggaaatatcttcatcagcaaactctggacttcatatttttgattttctggccaattcaatactcaaggaagtccattctgcaatcatgaagggaaagcctggggcctgttctcctggaaaacctaaagacttcctgagaaactacaaagcaagcttaaagtttcttgattttcttgaaggctactgtccttccaagtctgctgtagcaaagttccgctctgaacctgcttacacagatttcatgcgactgtggcatgttagtgtctacttttcactgagattccaggaaattgctggtggtcttgatggtgctcttacagccacaattagccctgtcggagtgaatgagaaccaaatgaagcagaagacattattgttgaaacaaagtattaagctattagaaagtttgcagtcctgctggagtgatgatgttcttattttctctcagtctgataaattcctccgattgtccttgcagcttatttcaaggtatacaacatggctttcttctggtctggctgcacgtaatgcttctgatgggagctcgagttctcctgcagattctgagtgggcactctctgtacctgtggaggatttcatatatgtaatgcatgatgtaaatgctgtaattggcgagctttcagaatcaggcaactttgtgggacgtgtgaatcaattgctagcatcatgccccattgaagtacttacccttgtgaaacaaagtatattgcaagctgttgagccgttgaaggagttgttgcctagcataatggatgccatgattggggtcatagttaaaaggtctaatgaggatctgaaacacctgaagggaataacagccacgtacaggatgaccaataaacttcctgtgaggcattctccatatgtatctgggattttgcatccacttaaggtgtttcttgaaggagatcgtgtgcactatttatcagaagatgataaaactaagctgcgccgtggatcgacagacaagatcacggcaacttattatgacatggtatccgaagtagtcaatgtggcaaggaaaactgaatcttcgttgcaaagactgcgccaaggacaacaaaaacgaataggaggtagtactgatgcctcagataacatcatatctgacaccgacaagatctgcatgcagctattccttgatattcaggaatatgcacggaaccttcgcaccctgggaatagatgcgaaagaaattgaatcctacagatctctgtggcagtgtgtcgcccctaaagacaagcaagatatcatccaattttgatgtaaaacacattgtcagtacatagaaaatgttgcctataggtccttggaattgcgtagatatgtctggtgttgttcattaggttggagattcgtgcgatacgtagagctctggaccttgattgttgtcattgtttgaatttactagactgtcacctccagattttacaatgatatattcaaaatgtgtatcacaacttctctctctgaataactacatgaacttcactgcc

SEQ ID NO: 1834 - DNA, 2585 bp, Oryza sativa Japonica Group
agaggaggaagcgccagatctccacacccacccgcgccgcagatccagccagagccatggcggatctcgccgtggcggcgccgccgccgacggacctcttcggcgagcccatcgaggcgcacccgccgtggttcaagcccgactccttcctccgccccgacttcgacccggacgcctacgtcgccgacctccgctcctacgtgcccctcgacagcctcgccgccgagctccgctcccacctcgcctccctccgcgccgagctcgtcggcctcatcaaccgcgactacgccgacttcgtcggcctcagcgcccgcctcaagggcgtcgatgccgccgccgcgcgcatgcggcccccgctcgccgagctcagggacaaggtcgcctccttccgcgccgcagcagccgccgggctcgccgcactccgctccggactcgagcagcgcgcggctgccacggctgcacgggagcttctcgagctgctgctcgacacctcccacgtcgtctctaaggttgagaaactgatcaaggaactaccatccgccccatctgattcatcaaatgttgaggctgtttctggtgataagggctactcaggcaacgttgccacaccaccaaacatggatgatgggacagatgttagggagacacaaagcattctcttagaaagaatcgccagtgagatgaaccggctcaaattctacatcagtcatgcacagaacctcccttttattgaaaacatggagaagagggcccaaggtgctacaaaactacttgatggtagcttggagcgttgctttgtggatggtctagaacatcgtgatgacaaagtaatatacaactgtttgcgtgcttatgctgctattgacaacacatcttcagctgaagagatattccgtacaacagtggtgtcgccgttgatccagaagattgttcctcaaaactatgcaaaagtggttgctggggtatcttctgatgacctagaagatgattatgagcagataatgcaatgcgtagaaaaagattgcaaatttattttggagatatcctcgttggcaaactctgggcttcatgtttttgattttctggccaattcaatactcaaagaagtccatttggcaatccagaagggaaagcccggggcgacctctcctggaaaacctaaacagttcctcaaaaactacaaagcaagcttaagattccttgattttctggaaggttactgttcatctaagcctgctgtaacaaagttccgctccgagcctgcttatgccgatttcatgcgacagtggcatgttgctgtctacttcacattgaaatttcaggacattgctggtggtcttgattctgtgcttacagccacaattactcctgctggaatgcatgacaatcaagcgaagccgcagacactgttgttgaaacaaagcgttaagctcttagaaagtttgcaggcctgctggagtgacgatgttcttgttttctcccactctgataagttcctccgcttgtctttgcagcttatttcaaggtatacaacatggctttcttctggtttggctgcacggaaagcttctgatgggggctcaagttctcctgcggatgctgaatgggcactatctgtacctgtggaggatttcatttatgtaatgcatgatgtaaatgctgtaataagcgagcttttggaatcaggccaatttgtggaacatgtaaaccaattgctagcatcatgcccaaccgaagtacttgctctcgtgaaacacagtatactgcaagctgttgagcctttaaaggagttgttgcctgctataatgaatgtcatgattatggtgatagttaaaaggtctaatgaggacttgaagcacctaaagggaataacagcaacatatagaatgaccaataagcttccagtaaggcattctccatatgtatctgggattttgcatccacttaaggtttttcttgaaggtgaccgtattcactatttatcagaagatgataaagcaaagctgcgccgtggatcgacagataagatcacttcaatttattatgacatggtgtctgaagtagtcactgtggcaaggaaaactgaatcatcattgcaaagactacgtcaaggtgcacaaagacgagtaggagctaataccgatacctcggataacatcatttctgatactgacaagatctgcatgcagctatttcttgacattcaggaatatgcacggaatcttcgtgcaataggaatagatgcaagggaaatcgaaacattcagagctttatggcagtgtgttgctcctagagacaaacaggataacatccagttttgatgtaaagatcaatttgagtacatagaagaaaattgccttaggtccctcaatatccgtagatacgtctcgtgttgttcgtttaggatggatgttggaatgatttttatacatagagctctggattttgattgtttcattttggacggtctcctccggattatacaagggtcaagggtacatccaaaatttgagaagtgtatcaaacctcatgttgttggaaacacaccgattctgttgaaagattgttttagtgtcttggtatct

SEQ ID NO: 1835 - DNA, 1026 bp, Zea mays
ctttctgccaatcgcccatagcacccagccgcttggcctccctggtactcgctctccctcagtgctctggctcctgcttccctcgccagcgcgctccaatcccctgcacgcggagcttctcctctgccagtgctcctccatgtgtgcacggtccatcgctctcgcgtcgctcggtctgcgcgtccctgcgtccggatcctctccctccagctcggcgcccatccatgctgcgtcgccctctctctcatctccaagccgagaccctcgccgtgaagcttccatgtggccgcgcgtactccctctgcttctccctcgtggcgctcaaccttgccgagcttccttgccatggctcttccacagcccggctctgccccatcgtcgatcgcccatctccatggtcgcgcgccctccagttctatggccgtgccgcgcgtcctggagctcaccgcgcccggccaagctcccctgtgcacgcccagccactcctctctcccttgcagcgcgcgtccctctgcttgccaaagcaccagctcggtcgctccgttcgtgcttccgcggaggccgcagctcttcctctggtgcgcgcgccccatctccctggtgctcggccagctcacccatggcgcgccgtgctcctctgctctccccgccggcccgagctccctatggcgtgcatctccctggcaaaagctctctcttccctctcccatggcgcgtctcgagctccacctcgggtcgtcgtctccgagctcgaccccaaactgttgtgcgtcctatcctatctccgagtcgaggttcctgaaagtcgcctatagagggtgaatagggtgaatctgaaatttacaaacttaagcacaaactacaagccaggttagcgttagaaatagaaacgagtccgatagagagggcgcaaaacaaatcgtgagcgaataaagagcgagacacgatgatttgttttaccgaggttcgatttttgtaaacctaatccccgttgaggtggtcacaaaaactggatctctttcaacc

SEQ ID NO: 1836 - DNA, 3805 bp, Oryza sativa Japonica Group
aacgaggtcaggacgctctggatcggggatctccagtactggatggatgagaactacatctccgcctgctttgcgcccaccggcgaggtatatgcttctctccgtttgtttgtctccgaatttgtgccataaaaatagttttttttgtctctcatctgttgatgtggagtacgttcatgctatttgctatagctgtgtatttggcctaatggttgatgggtaataagggtatgatacagttttaaggcggcacatgctgtttgtatgtttgtgtaggagtgtaaatgtgaagacttgggatgatttaggtctctcatatgatgaggactggtttttttagacttaattctgttgattggcgtggcgcgatgggatggtggcaatgtttttcctcaatgttttgggtatgcttgagtgtttttatgttaccaatgctttaagatatgttagggggaaaagctagattgtttctgctgttccaaataggcttatttggatgttgtaatgcttgttttttttgtaagtttgccaaaaaaaaaaaaccagacaaatctttacgagtttaggaggtatttctgtggtaggtagctggtgtgttggtttatttatgacttgtatgttttcatcattgcacagtttctcctcaagatctgttgcttttctgtgatcatgtttagctaatcttttattttgtgtccatcatttggcagctacaatctgtgaagctaattcgtgacaagcagactggacaacttcagggttatggctttattgaattcacatcccatgctggtgctgaaagagttcttcaaacatacaatggggcaatgatgccaaatgttgagcagacataccggttgaattgggcctctgctggtgaaaaacgtgatgatacccctgattacacaatttttgttggtgatttggctgctgatgttacagactacatattgcaagagacgttcagggtacattacccatctgtgaagggtgcaaaggttgtgacagataaaatgacaatgcgttcaaagggctatggcttcgtcaaatttggtgatccttccgagcaagcccgtgcaatgacagaaatgaatgggatggtttgttcttcaagacctatgcgtatcggcccagctgcaaataagaaagcaactggagttcaagagaaaggtaatcactaactgaatgctggttgagttcatctagttttatctgtttttggcttgtagctggattccatcattgttacttacatgttgtgcagttaacaacaacttgttatattatttttcttttttttttcccgttggttggcttgttccatacttccatatgtattgaagattggctgaaatccttctacaataacttagtagctccacgcatttccttcgtgaatttggataatttaatacactaggattctgaaatactcataaagctcctgttgtctggaagcaggataccaacaggctctcttcatataggagccttggaattgacttgagctgcaatgcatgtcttgtaattcgtggcctctgttaggtcagtgttaattgtttatgtcctaaatttgaagtcagttctttcggtaccaagtacttaattttgttaaattttttccttcctgccacataataatccttttgttcttctggtatctttcgttaaagctttacttgaaattaagatcttcctcaactcaataggtttcatgtagaatggacattagcttgtttataagcttcctatccttataagtagcccatacttctgcccttgttattcctttgttactttcttttagaaggatgctatgatggaaatatcgtatgctctcagtaccaattccatttgctattcctttatcttctgtttgttgtaacatccacttctatgctggaagtattgtatgatcttagtgccaagcctaacctgttgatcaattccatttctattcctttatcttctctctgttgtaacttccacttctatgatctttcaataatagtaacaaaaaaaaaaaaagctactggctcctttgtagctctgtaagctgttatgtttttaatacctaataattatgacttgtaccattagacttgcttcagaagcataccattaccacctgctgtgatctatgcgttcacaattctttgtgaaagtattcctgttaaggataaacttctttcttgagggatttgatgtgttctgccaaagcccaaagataggttaggaacagcaagaatctagttgcatttgttgactagtgtttcttggcttcttatatggtcttggtacctgttagctcattgacactgcatgaagattatatttgacaagcaaatgctgcagggcgtacttgttccttgtttgctttgagtttattgagatactttaagatagcatgttttagctgtttgcatataattgagttgacaaccaggaatactagaatactaaactactgggcactatttgaatttgaagtgcaacaagttcaacatacgggatgcctttttctgcccttgatttctgactagatttgtgttattctacttacaacctccgtgtctttatgtgatctgtctagttgaccctattaattttcactagcaaactataattatttactcaaaatctccttttcaaggttcttcatattaagttgcatcattagatattaacatgttgggtctaatcgtttacacaatctcttacatggagctacagaatcagtttcaataatgaccagaagaaaatacttgttatttgcaagaattaaaattaatttattaaagcttcatcatggacatgttctcggttgttgtcattagcaccagaaattttgcaagcaaagactgatatatgatatggatgatttcaatttcgtaagactgttttggttgctgcatttgtttcgtgtatcagatttcaatgatatcttatgcttgttgctgaggaggtttgtatctcttgagccatgaagcatgctgtttgcttgcaacatctttttaactatacagtctcttgcgactaagtgaagatcatgatttgcatgatatgcatctggatttaacaagtcttacattatatttttcttcatttgtgttttatttacagtaccgagtgctcaaggagttcagtctgacagtgatcctagcaataccactgtgcgttctttgttctactttcttggtaaacgtagtttcacatatcaattttactgatgaccatctttgttgttgagcacagatatttgttggtggccttgatcccagtgtcactgacgatatgttgaaacaagttttcactccctatggagatgtggtccatgttaagatcccagttggaaaaagatgtggttttgttcaatttgctaacaggttggctaattttgcaccctagatatcccttgtttgtgtgtatgatgtatgcactccatatatacttttatcttaaccatatgttcgatgcattcagagcttctgcagatgaagctttggtacttctacaaggtaccttgattggaggacagaatgtgaggctttcatggggccgcagcccttcaaatagacaagctcaggtgatatactgatcaatcttttacatgaactgaatttctttgcccagtcaaccaaaactaacatatacatttccagcctcaacaggattccaaccagtggggtggtgctaatgctggatactacggttatgggcaaggatatgagggttatgggtatgctcaacctcaggaccctaatatgtacgggtatggagcttatgctggttatcccaactacca

SEQ ID NO: 1837 - DNA, 1693 bp, Zea mays; identical to SEQ ID NO: 1830

SEQ ID NO: 1838 - DNA, 1764 bp, Zea mays; identical to SEQ ID NO: 1831

SEQ ID NO: 1839 - DNA, 3129 bp, Zea mays subsp. mays
atagctatgttcccactactagtgacacactagacgttggtctgtgctgtacggagaacgaaggtataaacaaatgcgttgcaaaagtgcagttcgacgacgatagatgtatatgtatactccacaaaagcccgagctgtcttttgtttttggagaaaaaataaataacgtgtggttcaggaacaaaagctagcggggttgctactaattgctactgttgttgataaacacgtcctgatcagacgccacttgcttggatctgtattattattattattattattattattattattattattattattattattattattattatttcctttgctttctttttttgaactgattttttgtgtgttgcaataataatgttaaaagacaaaagtaacggcagggagttgcagatagacctaatatcaaaggctgtcagggcccttttggaacgcagggattttcacttcacaggtgcttttttttatgaaaatgaaccggttcttatgatttctttttttctatgtttcatcatacgagtggaactcgaacatccatcccaaatattagaagacaaaagtaacagtaggagagctgagaagcctgagatagacccaatatcaattaattaaagacttttatagcaaatccaaaaggatgcaaaaacacccccgtcaaaaaaataattattagggacaggttacatttttttggaggcaaatatggtgcatacttcaacagttttattcaaaacaaaggctaaaagaccgtaaaccgagcctatatttttttaaaaaaaaactagatccatctgccccattccgcaaacgattggggagacactacgtcgctcaaatatgtgtgggggggggggggggggagaacataggttgaaagcgggttaccgtatttttccaacaatgatgtgatccgtcgggcatatttggtgacaaggagatcccagaaggattggaggggattgagggggaaatgaactaatttccccctccattatcttgggagcccgggtcaccaaatcaactctaaatctgtctttcgggttgttttaagtgtttttggagttactcttatacgaatatgagtcatttttaaaaaaaaaagataaatcaaaatatacattagtctgtacatagagtgactgctctgaaaaaaataaaaaaactgtagagacaccttagccccaataattgtagcacaggcaacaggtgcacagcacaacatagccccttgcatgcatggctgcagtgtgacacatggcggtggggccctgcccactgttcctccttcagggacggaaaggttggttgcggccccaccatggcgccaagtaatatcgccgctgctctctctctcttttcatgcacacgctcctctctccctccctcccaccattgctacagtcgcagctgtctgtgtctgcaaagtactgactgctcccactccactccacccccagttccgggccactcgggcatcgtttctgttgctgcaaatctttgttggctgctggctgctgctgccttgctatctatctatacaccgcccgcaccttccattcctcctcctccgaagcagcaggcagcagctgcatcgcacctcacacctctcgtgtccatcgatccagccgccgccgcagctgcagctctcacttcactgttgctgtgccacctcctcgtcgcctgtagtgtctgtcgacagagaaacgcccgcggaatgagagggaaggagcggaagctgcagcgggcgcgcgcgtgcaagggctaggattaggagtagcggttgcaacgtcggcgcgcacggcgtacgtcgggcatggattgggatctcaaggcggcgggcgcgtgggacctcgcggagctggagcaggaccacgcggccgcggcgccgtcgtcggggggccacgccgccaatgctgccgcggcgggcacggggacggagagccgcccgccggcgcccggggcagcaggggcacccgccgagtgctccgtggacctgaagctgggcgggatgggcgagtgcgagcccggcgcggcccgcagggagagggaggccgcggcgggggcggcgaagcggccgcgccccgccgggcccggcgggcagcagcagcagcagtgcccgtcgtgcgcggtggacgggtgcagggcggacctgggcaagtgccgcgactaccaccggcggcacaaggtgtgcgaggcgcactccaagacccccgtcgtcgtcgtcgccggccgcgagatgcgcttctgccagcagtgcagcaggttccatctacttgcagagttcgacgccgacaagcgcagctgcagaaagcgtctggacgggcacaatcgccgccgcaggaagccacagccagacaccatggcttctgctagctttatcgcaagccagcaaggcacgcgattctcaccatttgcgcatccaagactggaggcgagctggccgccgggggtgatgaaaaacgaggagagtccatatcacatcactcaccaaatccctctgggatccagcagcagcggcaacaggcagcagcatttcgtggctctgggagccgccacgcctgcctacgccaaggaaggccggcgcttccctttcctgcaggagggcgagataagcttcgccaccggcgtggtgctggagccgcccgcgtcggctccagcgtgccagccgctcctcaggacgggagcaccatccgagagcagcggcgcaggcggcagtaagatgttctccgatcaggggctggctcgcgtgctcgactcggactgtgctctctctcttctgtcagcgccggccaactcctccggcatcgacgtcagcaggatggtccgcccgactgaacacgtccccatggcccagcagcccgtggttccgggcctgcagttcggcagcgcgtcgtggttcccgcgcccccaggcttccacgggcggctccttcgtcccctcctgccccgccgcggtggagggcgagcagcagctgaacgccgtgctgggccccaacgacagcgaggtgagcatgaactacggcgggatgttccacgtcggcggcggcagcggcggcggcgagggctcctcggacggcggcacctcgtcgtcgatgcccttctcgtggcagtag

SEQ ID NO: 1840 - DNA, 4086 bp, Zea mays subsp. mays
ggattgggatctcaacgcggcgggcgcgtgggacctcgcggagctggagcgggaccacgcggccgcggcgccgtcgtcggggggccacgccgccaatgctgccgcggcgggcacggggacggagagccgcccgccggcgcccggggcagcaggggcacccgccgagtgctccgtggacctgaagctgggcgggatgggcgagtgcgagcccggcgcggcccgcagggagagggaggccgcggcgggggcggcgaagcggccgcgccccgccgggcccggcgggcagcagcagcagcagcagtgcccgtcgtgcgcggtggacgggtgcagggcggacctgggcaagtgccgcgactaccaccggcggcacaaggtgtgcgaggcgcactccaagacccccgtcgtcgtcgtcgccggccgcgagatgcgcttctgccagcagtgcagcaggtagtatccccgccttcttttcccatggggggctggtgtagtgtagtgtagctcgtccctgtctcgtttcaaggatgcacaactttaccttttccggcttgcctttttttttttcgttatcttttttctctctctctttttcctgaaaaccaaagagatgaaaaaccttcatctcgttcgttcgtttcctcctgtagctacggtacctgaattattggcacgcctttttcctttctcccggcctcctcctgcgctcgctgctgctgctgcacactgctctcaggcaggcctagcgttcgtttccttcactttctctgacgccctgatgcgaattaacatctgctgctccccaatcgtctgctcaagattcagcccgctgccacggacacgtgagctcctgcgcttgcttttccgagcggtttcttgctttcacgccctttggcggcgacgggacgggatgcccccccccccccccccccggtactctgccattggctcctcctctagtcggcgctgcttgcttcccggcgacagttcgccaccgccgcagatgaagcgccgccacggtttggcgtgccgcgttgagcgagacaggggtgtactcccagctttggctaccatcaatcatttgatgtttaggtgccgcgttgtgagctgtactgctacagtatctctgcagaatgtattctgtagtagtatgaaaaggtaaaggcggcgtactgctatagtatctctgcagaatgttcggaggagtacaccaactgaaagaggtttaggaaaattgcatcgtggatctagaattctagatgcagtagtgtagcctacagtagccctgtacacacataaaggcatttttcttataaaattgtctcgcaaaatgggatttttttgtgctaattatagggtgctttagcgccacctgggccgtataggatgctttagcgcaacatttctgaacaaccctatgcagcttccatagaccaccacaggcattcccgcatgcagtttgctctaaatgcctccttttcatttttactatccctgaacgacgacccatccatttctttttccgtctcagggaagtagccattaaatgctagcagtctttttttaaagtatcgcttggtttgagatgttattaggcccggtttggttggaaaaaccgctccattttaatctcctttagtttgtaaattacagtactaaactgttttagtctttagtatctcgaggagtgactaaaagagactaaaccatataaatttcaccttttatctcccatttatttcagttacactaatgacgggagaatgctaaagtgtattttagtcatcttataattgatttagtgtgttttaaatacttccttagtctataaaattaaacaggatataggctaaactttagttggactaaaccatataaatttcgtctggtgaagtttacggcagtacagcgctgtgttggcgcccagttttgtcttgctcatatggacagcagagacaggtcccgctctcctgtggtggacctaaacctaaacagcgtaggttcagatcgttcctggagcgatcgacgctgtggcaagcgatcctaatgcgatgctctggtgacatgtcctgtttctgtttacgccggaacatcttgctcggtggggacaattctcaatcattgatcactttgtcttctgctttaaattgcagactttgtaggttaatagtaagttgtcagccagtgagccaacagattctcagctttctgtttaccgtctgtgtggtccaggcttgacaggtcttatagtattttcctgtctctaataagcatggacaaggaacattggtccctggtgtgatgtgtattaactataacaagcatgtatgtgcgccacagtacattaactattctgacaataattacgttgctgtttcttcagtgaggaccatcttagcataccgttggatcatgtgcccaccctactacctaggaccatctattcttctaaaaaaaactgagtatcttatacttgtttagaattatcctaattcaaagaatcctgtggtcctaatcgattatgccatcattcattggtcagcatattacactgcaactttctcgtttgcccgtactcgaattcagttgtctgatcaagagttttttttttgttttttgtttatgtaggttccatctacttgcggagttcgacgccgacaagcgcagctgcagaaagcgtctggacgggcacaatcgccgccgcaggaagccacagccagacaccatggcttctgctagctttatcgcaagccagcaaggtcattttcgtactcaccaattttgctttggttttttttctccccaagtctgtacttggttcgaatacatctacattgtttccatcttgctggtgctggacaaagaaaaggtaaaacgtcagaacagatctgtgcacacataaaccatgagaagtaaaagactgctctgttaaacttgtagagcttgcgtagcatttcagcatgtttcagaactagaattcggttcataagataagatgctactctagcatccctgcatacattagttgcgacaagacgaagattacattgttgacgcatcaagttattatgaacctcttctgtttctgtcaattgtgtcctcatatttagtgcaaggtcttgctaatgcctttaagttaaaaaagattagtatactgtatgtttctttgcctttcagatgtgttctagtacaaactacttgtatgcttcaccacttgtagattggcatgtatatgagtctcaaacttccaacacaattgccagcagattggcatatagaactgcaataaaaattctgattcacattgtatgaaacggcgcacagaatcaatttatcagttatgtcacctgatcgacatttcttcccaattgatcaggcacgcgattctcaccatttgcgcatccaagactggaggcgagctggccgccgggggtgatgaaaaccgaggagagtccatatcacatcactcaccaaatccctctgggctccagcagcagcagcaggcagcagcatttcgtggctctgggagccgccacgcctgcctacgccaaggaaggccggcgcttccctttcctgcaggagggcgagataagcttcgccaccggcgtggtgctggagccgccggcggcggctccagcgtgccagccgctcctcaggacgggagcaccatccgagagcagcggcgccggcggcagtaagatgttctccgatcaggggctggctcgcgtgctcgactcggactgtgctctctctcttctgtcagcgccggccaactcctccggcatcgacgtcagcaggatggtccgcccgactgaacacgtccccatggcccagcagcccgtggtcccgggcctgcagttcggcagcgcgtcgtggttcccgcgcccccaggcttccacgggcggctccttcgtcccctcctgccccgccgcggtggagggcgagcagcagctgaacgccgtgctgggccccaacgacagcgaggtgagcatgaactacggcgggatgttccacgtcggcggcggcagcggcggcggcgagggctcctcggacggcggcacctcgtcgtcgatgcccttctcgtggcag

SEQ ID NO: 1841 - DNA, 1469 bp, Zea mays subsp. mays
ctaggactagcggttgcaacgtcggcgcgcgcggcgtacgtcgggcatggattgggatctcaacgcggcgggcgcgtgggacctcgcggagctggagcaggaccacgcggccgcggcgccgtcgtcggggggccacgccgccaatgctgccgcggcgggcacggggacggagagccgcccgccggcgcccggggcagcaggggcacccgccgagtgctccgtggacctgaagctgggcgggatgggcgagtgcgagcccggcgcggcccgcagggagagggaggccgcggcgggggcggcgaagcggccgcgccccgccgggcccggcgggcagcagcagcagcagtgcccgtcgtgcgcggtggacgggtgcagggcggacctgggcaagtgccgcgactaccaccggcggcacaaggtgtgcgaggcgcactccaagacccccgtcgtcgtcgtcgccggccgcgagatgcgcttctgccagcagtgcagcaggttccatctacttgcagagttcgacgccgacaagcgcagctgcagaaagcgtctggacgggcacaatcgccgccgcaggaagccacagccagacaccatggcttctgctagctttatcgcaagccagcaaggcacgcgattctcaccatttgcgcatccaagactggaggcgagctggccgccgggggtgatgaaaaccgaggagagtccatatcacatcactcaccaaatccctctgggctccagcagcagcagcaggcagcagcatttcgtggctctgggagccgccacgcctgcctacgccaaggaaggccggcgcttccctttcctgcaggagggcgagataagcttcgccaccggcgtggtgctggagccgccggcggcggctccagcgtgccagccgctcctcaggacgggagcaccatccgagagcagcggcgccggcggcagtaagatgttctccgatcaggggctggctcgcgtgctcgactcggactgtgctctctctcttctgtcagcgccggccaactcctccggcatcgacgtcagcaggatggtccgcccgactgaacacgtccccatggcccagcagcccgtggtcccgggcctgcagttcggcagcgcgtcgtggttcccgcgcccccaggcttccacgggcggctccttcgtccccttctgccccgccgcggtggagggcgagcagcagctgaacgccgtgctgggccccaacgacagcgaggtgagcatgaactacggcgggatgttccacgtcggcggcggcagcggcggcggcgagggctcctcggacggcggcacctcgtcgtcgatgcccttctcgtggcagtagtcgtcgtcacttgtcagcagccgctgcgttctctcatctttcgcgcttcagacgatctggtagggagatactggctttagtgatcactgatcagcattgatttctgttctttttcctgcattccctt

SEQ ID NO: 1842 - DNA, 1602 bp, Sorghum bicolor
atggactgggatctcaaggcgccgggcgcgtgggacctggcggagctggagcacgaacaacacgcggctgctacagcggcggcggcggggccgtcgggtggccacgccaatgctggcgtggcgggcacggggacggggtgccgcccgccgccgggggcagggggagcacccgccgagtgctccgtggacctgaagctgggcgggctgggcgagcctggcgcggcgccgccggcgcgcagggagagggaggccgcggcggcggcggctgctgctgcggagcatcagcaggggcaggggcagcatcagcagcagcagtgcccgtcgtgcgcggtggaagggtgcaaggcggacctgagcaagtgccgcgactaccaccggcggcacaaggtgtgcgaggcgcactccaagacccccgtcgtcgtcgtcgccggccgcgagatgcgcttctgccagcagtgcagcaggtttcacttacttgcggagtttgacgccgacaagcgcagctgtagaaagcgactagatgggcataatcgccgccgcaggaagccacaaccagacaccatggcttctgctagctttatcacaagccaacaaggcacacgattctcaccatttgcacctccaagactggaggcaagctggccgggggtgatcaaaaccgaggagagtccatattacactcaccaaatccctctgggatccagcagcaacaggcagcagcatttcgtgggatccaccacgcctgcttacgccaaagaaggccgtcgcttccctttcctgcaggagggcgagataagctttgccaccggcgtggtgctggagccgccggcgtgccagccgctcctcaagacggtagcagtagcaccacccgagagcagcagcagcagcagcgccggcgggggcaacaagatgttctccgacgggctgactcgcgtgctcgactcggaatgtgctctctctcttctgtcagcgccagccaactcctccggcatcgacgtcagcaggatggtccggccgactgaacacgtccccatggctcagcccgtcgtctcgggcctgcagttcggcagctcgtcgtggttctcgccgcgcccccaggcttccacgggcgtgacggcaggtagcgggttcccctcctgccccgccgtggtggagggcgagcagcagcagctcaacaccgtgctgagcccccacgacaacgaggtgaactacggcgggatgttccacgtcggcggcggcagcggtggtggcggcgagggctcctcggacggcggcacctcttcgtcgatgcccttctcgtggcagtaggagttgacgagttgtcagcactcagcagcagctgcgttcttggatcttcgcgcttccgacgatctggtagagagctattggtttttagtgaatcactgatcagcattgatttctgtcttttctgcattcgttttcttgaatcggttagcattcgtgtggacattttttgagcataattctgtgctcgttttcctaaaattatctttgctaccgtggcacctgccgactgctgattgtagcatgttgcttctctttgacttgtccttgagacgagggcaacacctgtgatggaat

SEQ ID NO: 1843 - DNA, 1197 bp, Zea mays
atggaaggaaacggtggcgcgggcggcggtagcggaagcgcggcaccgccctgggatctcgccatgcactgggcacccgccgtagtgtcgtcctacccgccgcagcccttggagctgcagcagcaggagcttacctgcctcaagctggggaagcggcccgcctgctgctgggcaggggcgccgggcaaccaagcggcgcaggtccacggcaatggcggcgctggtggcgcagctgctgagggtaagaggaaggacaaggcgcctgccgcggcggccgtgacgaggtgccaggtggaggggtgccacctgtcgctggcggacgccaaggagtaccaccggcggcacaaggtgtgcgaggcgcactccaagtcgccccgggtcgtcgtcctcggcgccgagcagcgcttctgccagcagtgcagccggttccacgcgatctcggagttcgacgacgcgaagcggagctgccgacggcgtctggccgggcacaacgagcggcggcggaagagcaacgccagcgaggccatggcaagaggcgtcgcgcacccacacggagtgacggctttcggccacggcggcttcctgccctcgcgcggcctcgtccccgcagggtcgtccccggcggcggctggtgctctctctcttctgtcatcggccagaggcagcgtggcgggcgccagcgggccctggctggtcacggcggcgcgggaggacatcccggcgcgctccagcgcggcgctcgacgaccttatcgccgagaaccgcgccgccgcgctcctcgcgcggcagtacttcgtctccgaccgctcgccggcgcccagacgggatttcgtcgcctcttcgacggcgggttgctccctccagcagcagcagcacccgcccgaccacgaccacacagccggctggcacccgcacccccacccctacagtggcggtggcggtggcagctgtggtggtcggtaccagtaccaccacgtggcgccgccgagcgcgtggcacgcgacgacgctggaccttatgcagccgacagcaagcaccaccgccgctcccgccaccgccggcgcagcgttgtggccagcagtgccggagagggcgggcgcgaggtcgtctcgctctcgcagcgagaccaaggatggcgacgcgtcgggatgtagcggcttggacgcgtgggcgcccactggtggagctcgtgtgctg

SEQ ID NO: 1844 - DNA, 1257 bp, Sorghum bicolor
atggaaggaaacggtggcgctggcggcggcagcggaagcgcggcaccgccctgggatctcgccatgcactgggctccctccgccggctcgtcctacccgcagcaacccttggcgctgcgtcctggcggcgtgcccagcagccagctccagctgctgcaccagcagcagcagcagcagcagcaggagctgacctgcctgaagctggggaagcggcccgcctgctgctgggccggggcggcgttgggcagccaagtggtggcggcgcaggctggcgcgggcctgccgcatcatctccacggcaatggcggcggcgccgccgctggttgtggtggtggtgcgagtgggaaagctgctgagggtaagaggaaggagaagcaggcggcggcggcggcgccgggcgcggcggccgtgccgaggtgccaggtggaggggtgccacgtggcgctggcggacgccaaggactaccaccggcggcacaaggtgtgcgaggcgcactccaaagcgccccgggtcgtcgtgctcggcgccgagcagcgcttctgccagcagtgcagccggttccacgcgatctcggagttcgacgaagcgaagcggagctgccgccggcggctggccgggcacaacgagcggcggcggaagagcaacgccagcgaggccatggctagaggcgctgcgcacccacacggagtgacggctttcggccacggcttcctgccaccgtgcggcggcctctcggggtcctcggctggtgctctctctcttctgtcatcagccagaagcggcgcgacgagcgccgccccctggcaggtcacgacgtcggacatctctgcgcgctccagtgcggcgctcgacgaccttatcgccgagaaccgcgccgcactcctcgcgtggcagtacttctcggaccgctcgtcgtcggcgcccggccgccattttgcctcttcgtcgtcgacggcgacgggttgcgccctcccgccggccgacgatcagcacgcagcagccagctggcgcccgcacccccacagcggcgttggcggtggccggcaccacatggcgccgcccggtgtgtggcacacgacgctggaccttatgcagacagcaagctccgcagctccggccacctccaccggcgcaccgttccggccagtgccggagagggcgggcgccaggcctcgcggtaagagcaaggacggcgacgacgcctcaggatgtagcttggacgcgtgggcacccgcgggtggagctcgtgtgctgtga

SEQ ID NO: 1845 - DNA, 1283 bp, Zea mays
ttcttgcgtggatgctcccctcttggctatttgtttgtttcttgcagaggaattttttcctgaacttgtcctcgccgtcttgaaggtttcttgtttgggagcaggcggaggcgtttctttccttcttcgccggcggcggcatggactgggcagcggcgtccgggtctccgtcgtggggcgcggcggcgacggaccccggtccgaccatgctgtccttcgcaggcccgtcctcctccgccgccgacgccgaggtgcggctccaggatttcgccgcgggtcttgcccagagctcgcggccgactggggcggcgccgggagccgggaggaggtcccgcgcggccgtgggaggtgccggcgcggaggcgtgctccgtcgacggctgccgctctgatctcagccggtgccgcgagtaccaccggcggcataaggtctgtgaggcacactccaaggcgccggtggtggtcgtcggcggacaggagcggcgcttctgccagcaatgcagccggtttcacatgctgtccgagtttgacgaggaaaaaagaagttgccggaagcgtctggatggccataataggcgtcgaagaaagccacagcatgatctgacaaatctagggggtttctttccataccaccaagtgaatcagtttgagttctacccacaaacaattccaacagttggccagaattcggacgccgtgcacttggtgggccgtcagcagcctttctccatatcgttctcaagaacaccagacgagttccctttcccacagggtggcggtagcagtgtgctgcaccacctccatgcagcccgccctggccatcacgctgaaggcagcagccacactggaagcagcacacgcgacaacgctctctccggcacactgggccccgagtgtgctctctctcttctgtcatcgtcgctgcgtcgcccctcaactgctggcgtccccgccgttggccaaccccaggttactgcctcttcgaccactgccgtgtcgcaggctgcaacggcagctgtggccactgctgcattcgcggccagtgctggccaccatgtgtttgttcctgatgctatgtttgaggatccatcacaggcactgccattctcttggcagtaggattgttttgttgtcctgtttttatgtgctcctgttgtgttctcgatcgatactctagtgtctgatggctgggaattcggggtacctgtgcacttgcagactcaggttgtggtccgtcagagatgtatacaagtgacacgacgactagtgctggcatctgaaagg

SEQ ID NO: 1846 - DNA, 1413 bp, Zea mays
atatcttctcttgcggtggctttattgcacatcctgcggaccttcttgcgtggatgcttctctcttggctagttgtttgtttcttgcagaggaattttttcctgaacttgtccccgccgtcttgaaggtttcttgtttgggagcaggcggaggcgtttctttccttcttcgccggcggcggcatggactgggcagcggcttccgggtctccgtcgtggggcgcggcggcgacggaccccggtccgaccatgctgtccttcgcaggcccgtcctccgccgccgccgacgccgaggtgcggctccaggatttcgccgcgggtctcgcccagagctcgcggccgacgggggcggcgccgggagccgggaggaggtcccgcgcggccgggggaggtgccggcgcggaggcgtgctccgtcgacgtctgccgctctgatctcagccggtgccgcgagtaccaccggcggcataaggtctgtgaggcacactccaaggcgccggtggtggtcgtcggcggacaggagcggcgcttctgccagcaatgcagccggtttcacatgctgtccgagtttgacgaggaaaaaagaagttgccggaagcgtctggatggccataataggcgtcgaagaaagccacagcatgatctgacaaatctagggggtttctttccgtaccaccaagtgaatcagtttgagttctacccacaaacaattccaacagttggccagaattcggacgccgtgcacttggtgggccgtcagcagcctttctccatatcgttctcaagaacaccaccagacgagttccctttcccacagggacagggtggcggtagcagtgtgctccaccacctccatgcagcccgccctggccatcacgctgaaggcagcagcagccacactggaagcagcacacgcgacaacgctctctccgtctccggcacactgggccccgagtgtgctctctctcttctgtcatcgtcgctgcgtcgcccctccactgctggcgtccccgccgttggccaaccccaggttactgcctcttcgaccactgccgtgtcgcaggctgcaacggcagctgtggccactgctgcattcgcggccagtgctggccaccgtgtgtttgttcctgatgctatgtttgaggatccatcacaggcactgccattctcttggcagtaggattgttttgtcctgtttttatgtgctcctgttgtgttctcgatcgatactctagtgtctgatggctgggaattaggggtacctgtgcacttgcagactcaggttgtggtccgtcagagatgtacacaagtgacacgacgactagtgctggcatctgaaaggaagtggtagccgctgtgcagagtgtttagccgttaaatttaaatgcgtcccgtccaaaaaaaaaaaaaaaaaa

SEQ ID NO: 1847 - DNA, 978 bp, Sorghum bicolor
atggactgggcagcggcttccggggctccgtcgtggggcgcggcggcgacggaccccggcccgaccatgctgtccttcgcgggcccgtcctcctccaccacacccgccgccgacgccgaggcgcggctccaggatttcgccgcgggtctcgcccagagcgcgcggccggcgggggcggcgggagccgggaggaggtcccgcgcggccgggggaggtgctggcgtggaggcgtgctccgtcgacgggtgccgctctgatctcagccggtgccgcgagtaccaccggcggcataaggtctgtgaggcgcactctaagacgccggtggtggtcgtcgccggccaggagcagcgcttctgccagcaatgcagccggtttcacatgctgtccgagtttgatgagggaaaaagaagttgccggaagcgtttggatggtcataataggcgtcgaagaaagccacagcatgatctgacgaatctagggggtttctttccataccaccaagtgaatcaatttgaggtctatccacgaacaattccaacagtcggccagaattctgatgccatgcacttggtcggtcgtcagcagcccttctccatatcattctcaagaacaccaaatcagttcccttttccacagggtggcggtagcacgctccatgcagcccgccctggtcatcttctggctgaaggtagcagccacactggaagcagcacatgcagcaaccctctctccggcacgctgggccccgagtgtgctctctctcttctgtcatcgtcgctgcatcacccctccgctgctggcatccccaccgctggccagccccaggttgcctcttcactctctcggatcgctgctgtgtcgcaggctgcaacaacagctatggccactgcattcgcggccggtgttggccaccatgtgtttgttcctgatgctatgtttgaggatccttcacaggcactgccattctcttggcagtag

SEQ ID NO: 1848 - DNA, 1169 bp, Zea mays
gtggtagtccgggctcctcctgagagaataatagttctgttttgaatttgaaatttgtttgatcaggtttcacttgctcgcggagtttgacgaggccaagcgcagctgtagaaagaggctcgatgggcacaaccggcgtcgcaggaagccgcagccagataccatgagctctgggagctttatgacgagtcaacaagggacgaggttctcgtcgttcccggttccaaggccggagccgagctggcccggagtcatcaaatccgaggacagcggctcatactacgcgcaccagcgccacccggtcctaagcagcaggccgcacttcgccggcgggggctccacgccgccggcctactcgtccaaggaaggccggcgcttcccgttcctccaggacggctgcgaccagcagcaggtcggcggcttcagcgcgggcgcgggggcgcagcagctcgaggtctcttccacgtccacggtgtgccagcccctcctcaaggccgccgccgccgccgccccaccgccgccgccagagagcagcagcagcaacaagatgttctccgacgggctcgcccccgccgtgctcgactcggattgtgctctctctcttctgtcatcccccgccaactcctccagcgtcgacgtgggccggatggtcgtccaccagcccgcggagcacatccccatggcgcagcccctcgtccccggcggcctccagcagcagcagcagcaccacccgttcggcggctcccccgcctggttcgcctgctcccaggccggctccagcgccgtctccgccggcggtttcgcctgccccccgggcgtggagagcgagcagctcaacaccgtgctggtgccgagctccgacggtggcggccacgacatgaacatgaactaccacggcatattccacgtcggcggcgacggctcctccgacgggacgtccccttcgctcccgttctcgtggcagtagctagctttccaattcaagcgtccagcagtctatcgtttcagctgtactagtggtcgttttatttatttattcgctgctccctcgctccgttttaacttgtcctgtcgtttgctcgtttcttcgttttgcatgcctgatgcatatgcggcctggaaaaaaactcgcataaaattactgagaccgtccgtgtgtctggttctgg

SEQ ID NO: 1849 - DNA, 1273 bp, Sorghum bicolor
cgtagcgtaacacccgcggccgcaccttgacgagacaagatccggtcctcctccgatcctccgtcttcctcccagctagcgcgcgcgcggccccggccccggcccctcgatccatccatcgtctcggatccctgcctgcctgccagtgcatgccgcaccctggaactggaacggagggcatggcagcgtcgccgtcgccggaccacctcttcggcctgcgcaacagcttctacatcggcgcgtaccacgccgccatcaccagcagccagtccctccccgcgcacgcgctctcccccgacgacctcgtcgagcgcgacgccctcctctaccgctcctacatcgccatcggctcccaccagttggtgatcggcgagatcgggcccagcgcagccacgccgctccaggccgtcaagctgctcgccgtgtacctctccggcgacgccgggaacagggaatcggtggtctcgaggcttcgggagctcctgtcagatgcggctgttgggaccaatccgatcctacggttgatggccggcaccgtcttcatgcacgaacgcgattacgccgaggcactgaagcacaccagctccggtggcagcatggaactgcatgcgttgaatgttcagatataccttcaaatgaataggacagaccatgcagagaagcaactcagggtgatgcaacagctggacgaagaccacacgctgacgcagctcgccaatgcatggatcgaccttgtcatgggtggctccaagatccaagaagcgcacctcatcttccaggacttgtccgagaagtacccggcgacctgcacgattcttaacgggaaagccctgtgttcgatgcacatgggcaacttcgaggacgccgagggcttgctgctggagtcactgaacaaggacgccaaggatgctgaaactcttgcgaacctcacggtgtgcagcctcaacttgggaaaacctgcaacgcgctacctcaaccagttgaagctagcacagccagaccacgcgctggtgaagcgaatgtcctccgctgcagacagcttcgacagagcctgccaagcaatggcatgaaatttcatttgctccattatgtttattttccctaggatgaatcggaataagatcgtgatcttctgtctctgatgagaagcaaagcagctagagcttggttaactttactgctcgcccatgacctgtctgtcaataaatttgtcatggtaggatcttgagttctcgactatatatgacagttaagaaaggctatatatcttctg

SEQ ID NO: 1850 - DNA, 1404 bp, Zea mays
ggcctgacgagacgagatccggacctccgtcctcccaactagggcgcgcgcgcgacctcggcaccggcggcctcgatccatcgttctctcggatccccgccagtgcatgccctggaacggacggacggaatggcagcgtcgccggaccacctcttcggcctgcgcaacagcttctacgtcggcgcataccacgccgtcatcaccagcagccagtccctccccgcgcacgcgctctcccccgacgacctcgtcgagcgcgacgccctcatgtaccgctcctacatcgccatcggctcctaccagctggtgatcggcgagatcgggcccagcgcggccacgccgctccaggccgtcaagctgctcgccgtgtacctctccggcgacggcgggaacagggaatcggtggtctcgaggcttcgtgagctcctgtcagacgcggcggtcgggagcaatccgattctccgggtgatggccggcaccgtcttcatgcacgaacgcgattacgccgaggctctcaagcacaccaactccggtggcagcatggagctgcttgcgctgaatgttcagatataccttcaaatgaacaggacggaccacgcagagaagcagctcagggtgatgcagcagctggacgaagaccacacgctgacgcagctcgccaacgcatgggtcgaccttgtgctgggtggttccaagatccaagaagcgcgcctcatcttccaggacctgtccgagaagtacccgacgacctgcacgattcttaacgggaaagccctgtgctcgatgcacatgggcaacttcgaggacgcggaggggttgctgctcgagtcactgaacaaggacgccaaggatactgagactctcgccaacctcacggtgtgcagcctgaacctggggaaacccgcaacgcgctacctcaaccagctgaagctcgcacacccggaccacgcgctggtgaagcgaatgtcctccgctgcagagagcttcgacagagcctgccaagcaatggcgtgaacctcgtttgcgaaaattacatttgttttccctaggatgagtcggaataacatcgtgatctactctgaagcaaagcagctagtgcatggctttctcatgggcagcttggactccaccgtcggcatgcttttccactggtctcggatagtacattcggcctcgctggtgcgctggaaaggcccaggtgtttcctttaccttttgggctatgctctctctctctctgacgccttgttgcgatgggagtgactgaggggaagcaatccttgaaatcctaaacaggagatagcatgaaacagtatttggttcaggtactgcaatgctgggggtcatatctcatatgcctgttccgatctgcatataataatagggtgtttggttcaatgagact

SEQ ID NO: 1851 - DNA, 894 bp, Oryza sativa Japonica Group
atggcgggtgcggcgtcgccggaccacctgttcggccttcgcaacagcttctacgtcggcgcgtaccaggccgtcatcaccggcgtccaggccatccccgcgcgcgctgccctctcccccgacgccctcgccgagcgcgactccctcctctaccgctcctacatcgccatcggctcccaccagctggtgatcgacgagatcgggccgggcgcggccacgccgctccaggccgtcaggttgctcacggtgtatctctccggcggcgccggcggcaaggaatccgcgatcaggaagctgaacgagctcctggcagatgatgcggtggggagcaacccgattctccggctggttgcagggacggttctcatgcacgagcgggactatgccggagcactgaagcacacaaattctggtgggactatggaattgcttgcgatgaatgttcagatatgcctccagatgcacaggtctgatcacgcagagaaacagctgaggataatgcagcaattggacgaagaccacacactgacgcagctcgcaaacgcatgggtagaccttgtcatgggcgggtccaagatccaagaagcgcacctcatcttccaggacttgtcagagaagtacccagcaacttgcttaattcttaatggtaaagcactgtgcctgatgcacatgggtaactttgaagatgcagagggattgctgctggaatcactgaacaaggatgccaaggatgcagaaactctagccaacctcgttgtgtgcagtctgaacctaggaaagtctgcatcccgctacctgaaccaactgaagctggcacacccagaccatatgctggttaagcgaatgtcctctgctgaagacagtttcgacagagcctgccaagcgatatcatga

SEQ ID NO: 1852 - DNA, 1744 bp, Zea mays
ccttccctcgctgaagccctctcgcgcctcctcccactcccactggacagagaggaggttagtggaaggcgggctaggaggctacgccgccacagacgcgaagcgatagcgtcggggggaagcaaggaagcgggtggcaatggcgaccggcggcggcggtgggagcgacgacttccacgggctcacgttcggccagaagatctacttcgagcaggacgcgggcgccgccggggggagcgcgacgggcggcaggaaggggaagggcgccgcggcgtccgcgagcgccgcccagccgccgcggtgccgggtggacgggtgcggcgtggatctgagcgccgtcaagcagtactactgccggcacaaggtgtgctacatgcactccaaggagccgcgcgtcttcgtcgccggcatcgagcagcgcttctgccagcagtgcagcaggttccaccagttacctgaatttgaccaagggaaacgaagctgccgccgccgcctcattggtcacaacgagcgccggaggaagccaccacctggaccactcacctcacgatacggcccgcttgctgcatcactagttcaaggtatcaagtgccacatcatcttgttatgtagctacaggtgtagacacgcgttacatactttactcgttattttcagatgcatatgccaatccgctgtttcccgaatctactgttttttttttggtcagagcctggtaggttcaggagcttcctgctcgacttctcgtacccgagggttccaagcagcgtgagagatgatgcgtggcaatggcaagggatgcagcatggcggcgacaggatgctgctgggtaccgccagcgccatccagtggcatgggaaccaagaacctcacccaccacatcgcagcgcagctgcgggctatggcaaccatgcgtacaacaactgccatggtggcggcggcttggtagcagcagcagcgggggcgtcaatgctctcctctgccttcgagcccccgcctggcggtggcggatgtgtcgcaggagctaccgcggccgactccagctgtgctctctctcttctgtcaactcagccatgggatacgcccacccaaagtggcagcagccaccacaaccggtccccagcgatgtccgcggctgcaggcgccttcgaagtggcgccgtcgtccgtcgtggcgagcagctacacggcgtcgagctcctggtctggctcacgggaccctgccgacggcgccaggaaaaacgcgcagcgtcacgatgatggcctgcacctggtccatccaccaggccccgtccaccacggccacttctccggcgagctcgagctcgccctgcagggaagcggcccgccgcatgtcgaccatggcggcggcacctgcttcagccattctgacaccaacgcgatgaattggtccctgtagggacaacaacttttgccgccactgccttgatccggtcggcacgccacgagacatggagcacttgggattgggacaccctggttttgtgcccctgaccttgccgttctggtttttcagggtggaactaactgggattccctaggcgtagatcatgaatcccctttccccgtgtaacccattgcgtccatgaagtcggcccaacaccggatcatatataattctacaactcccataacctaaatcattcttcagttgtgaagatatatgcttgtcaagtgacctggttttattttatctgccatcaattcatcatcatcacttcttt

SEQ ID NO: 1853 - DNA, 2270 bp, Zea mays
gactgcccagcgccccagttcctggctggccggctggctgtggcctgtggctgtgcctggtctcctcttcctcggtggtggcggtggcggtggacggtggtgctgctggtggtgttgcgctgcttgttcggttgttcctcactttcacttcctttttcctccacggctcccgtcacctaagcagcagctgcagcagcatatcccccgcacaccactcgcttcttcgccatcacccggtggctagctcttgcagcagctcatctcatctctacctctggctggcagtttatttctctcctccctatcagcataagctcagctcagctcagctcagcccagctccctgctgatctgcggcatttgacctgcctcccgtgcttgaagcttgatttgttcgtttctgtgcgcggtggtgcccgggcaataactccccttggtgcctggttggctcgttgccaccctccccgcggcagagcggcctataggatgagagggacgggggaggaacccaacaaaccggccgcgacactgtcctgaccgtggaagacacgcacacagagctccagctctgcactgcactggccgacggggaaacggtggagctcgcgcggtgttccattcatggattgggatctcaagatgccggtctcctgggacctgcccgacctggagcacgacgccatgccgccgccgccgcccgtctccgcggcttccaccgcggcggcgtcgggcattgccgccgcagctgccgcgccttcctccgcgacggcgccgagccgggcggagtgctccgtcgacctcaagctcggcgggctaggcgagttcggggcggcggacggcacggccacgaaggagccggcggctgcaaccgcagctccgtccgccagcccgatgaagcgcccgcgcttggggcccggcggcgccggcggggcgcagtgcccgtcgtgcgcggtggacggctgcaaggccgacctgagcaagtgccgcgactaccaccgccgccacaaggtctgcgaggcgcactccaagacgcccgtcgtcgtcgtcgccggccgcgagatgcgcttctgccagcagtgcagcaggtttcacttgctcctagagtttgatgaggccaagcgcagttgtagaaagaggcttgacgggcacaaccggcgccgcaggaagccgcagccagataccatgaactctgggagctttatgacaagtcaacaaggcttgttttcgagtgcagggacaaggttctcgtcgttcccggctccaaggccggagccaagctggtctggagtcatcaaatccgaggacagctcatactacacacaccacccggtgctcagcaacaggccgcacgtcgccggcacctccacgtcgccggcctactccaaggaaggccggcgcttcccgttcctccaggacggcgaccaagtcagcttcagcgcatcaggcgccgggacgctcgaggtctccacggtgtgccagcccctcctcaagacgaccgccgccgtggccccgccgccgcccgagagcagcaagatgctcgcccccgtgctggactcggattgtgctctctctcttctgtcatcccccgccaactcttccagcgtcgacgtgagccggatggtccagcccgcggagcgcatccccatggcgcagcccctcgtccccggcctccagcaccaccagttcggcggctccccggtgccggactggttcgccggctccggcgccgtccctgccgcgggcaccggcgggttcgcctgcccccacagcgtggagagcgagcagttcaacacagtcctagtgccgagctccgacggcggccacgagatgaactaccacggcatattccacgtcggcggcgagggctcctccgacgggacgcccccttcgctcccgttctcgtggcagtagcttaccgttgaagcgggcagtgttatgatcggtcagctgtatagcggtggtcatcacaccagttccctcttctttccgtgtttatttattctctgctccctcacgcactcccccgtgtcacttgctagtttcttagttttgcatgcctgatgcatgtagcctgaaaaaactctatcaaattagtgccagatttcctagttcccgtttgtttcattttattttgagaattggaatcttactaatgatttcctagttcccgtttgtttcattttattttgagaattggaatcttattaatgtaataggctattttttagaatgtgacattccaccactttacaaagttattgtataagcct

SEQ ID NO: 1854 - DNA, 1732 bp, Sorghum bicolor
cactactgtcctgaccgtgaaagacacgcacacccacacctccacctccacctccagcacgggcacggggcactgcactcgccgacggggaacggtggtggagcagagcttgcgctcgcgcggcgttccattcatggattgggatctcaagatgccggtgtcctgggacctgcccgacctggagcacgacgccgccatgccacagccgccgcccatcgccgccacagcagccgcggcttcccccgcggcggcgtcgggcattgccgccgcagcaactgccgcgcctccccacgcggcggccacgcgcggggcgccgagccgggcggagtgctccgtcgacctcaagctcggcgggctcggcgagttcggggcggtggccgacgggacgaaggagcctgcggcggctgcaactgcaacggctgcgccatccgcgccgtccgcgagcccgatgaagcgcccgcgctctggtcccggtggcgccgccggggcgcagtgcccgtcgtgcgcggtggatggctgcaaggccgacctcagcaagtgccgcgactaccaccgccgccacaaggtctgcgaggcgcactccaagacgcccgtcgtcgtcgtcgccggccgcgagatgcgcttctgccagcagtgcagcaggtttcacttgcttgcggagtttgatgaggccaagcgtagttgtagaaagaggcttgatgggcacaatcggcgtcgcaggaagccacagccagatgccatgaactctgggagctttatgacaagtcaacaaggcttgttttcgagtgcagggacaaggttctcgtcgttcccggctccaagaccggagccaagctggtctggggtcatcaaatccgaggacagctcatactacacaccccacccgcacccggtgctcagcaacaggccgcacttcgccggcggctccacgtcatcggcctactccaaggaaggccggcgcttcccgttcctccaggacggcgaccaggtcagcttcagcgcaggcgccgggacgctggaggtctccacagtgtgccagcccctcctcaagaccgccgccgccgcggccccgccgcccgagagcagcagcagcaacaagatgttctccgacgggctcacccccgtgctcgactcagattgtgctctctctcttctgtcatcccccgccaactcctccagcgtcgacgtgagccggatggtcgtccagcccgcggcggagcacatccccatggcgcagcccctcgtccccagcagcagcctccagcaccaccaccagcaccaccagttcggcagctccccgggcggctggttcgcctgctcccaggccggctccagcgccgtctccggcgcgggcaccggcaccggcggcttcgcctgccccgccagcgtggagagcgagcagctcaacaccgtcctggtgcccagcaacgacgccggccacgagatgaactaccacggcatcttccacgtcggcggcgagggatcctccgacgggacgtccccttcgctcccgttctcgtggcagtagcttcttccgtccggttcaagcgaccagtagtgatcggtgttcagctgtagtgatcctgttctttctgtgtttatttattattattattctccctgtcatttgctcgtttcttcgttttgcatgcctgatgcatgcagcctgaaaaaactcgcataaaattagtgccgaatttctcctgaaaccgttctgatatcttactgattc

SEQ ID NO: 1855 - DNA, 1419 bp, Oryza sativa Japonica Group
atggattgggatctcaagatgcctgtttcttgggacctggccgagctggagcacaacgccgtgccgaacatggcggcggcggcgagcgcggcggagccgggcattgccgcggtggcggcgtcgcgcggggcgccgggccggccggagtgctctgtcgacctcaagctcggcgggctcggcgagttcggcgccgcggacgcgctcaaggagcccgccgccgcggcgaaggcgccggtgtcgagcgccgccgccgccgcctcggtggcgaaggtgccgccgtccacgagcacgctgaagcggccgcgcggcgggggcggcggcggcggcgggcagtgcccgtcgtgcgccgtggacggctgcaaggccgacctgagcaagcaccgcgactaccaccggcggcacaaggtgtgcgagccgcactccaagactcccgtcgtcgtcgtctccggccgcgagatgcgcttctgccagcagtgcagcaggtttcacttgcttggggagtttgatgaggctaagcgtagttgtagaaaacgcttggatgggcacaatcgacgccgcaggaagccacaggcagatagcatgagttctggcagctttatgacaagtcaacaagggacaaggttcgcgtccttcactcctccaagaccagagccaagctggcctgggatcatcaaatccgaggagaccccatattacagccatcatcaccaccctcatccggtgatgaccagccggcagccgcatttcgtcggctcgccgtcgtcggcgacgacggcggcgttctcccccaaggaaggccggcggttcccgttcctccatgagggcgatcagataagcttcggcggcggcggtggcgcggcggcggcggcgacgctggagatctcggtgtgccagaccaccgtcgtcgcgccgccgccaccggagagcagcagcagcaacaagatgttctcctccgacgggctgacgacggcgacgacgacgacgaccaccgcccaccaccaccaccaccaccaccaagtgctcgactccgattgtgctctctctcttctgtcatccccggccaactcctccagcgtcgacgtcagccggatggtccagccgtcaccggcggcggcggcgggagccgagcaccaccaccaccaccaaatccccatggcgcagccgttggtccccaacctgcagcagcagttcggcggcagctcgccgtggttcgccagctcgcccgccgccgcggccgtcgccggcggcgggttcgcctgcccgagcatggacagcgagcagcagcagcagcagcagctgaacgccgtgctggtgccgggctccaacgagaacgagatgaactaccacggcatgtttcacgtcggcggcgagggctcctccgacggcacgtcgccgtcgctcccattctcgtggcagtag

SEQ ID NO: 1856 - DNA, 1590 bp, Zea mays
cactgccgcctaccctcgttgaagcgcgctctctcgctctcgctctcctcgcgcttcctcccactcccactggacagagaggagggttagtggagggcggggtaggaagctaccgccgccacagtaacagcgttagctaggggggaagcacggaagcgggaagcaatggcgaccggcggcggcagcagcaggagcgacgacgtgcgcgggctcaagtttggcaagaagatctacttcgagcaggacggcgggagcgggagcggggcgggggcggtgggcggcaggaaggggaagggcgtggccaccggtggcgcgaggccggcgtccgccgcctccgcagcccagccgccgaggtgccaggtggacgggtgcggcgtggatctgagcgccgtcaagcagtactactgccggcacaaggtgtgcaacatgcactccaaggagccgcgcgtcttcgtcgccggcatcgagcagcgcttctgccaacagtgcagcaggttccaccagctacatgaatttgaccaagggaaacgtagctgccgccgccgcctcatcggtcacaacgagcgccggaggaagccaccacctggacctctcacttcacgatatggccggctcgctgcatcacttcaagagcctggcaggttcagaagcttcctgctcgacttctcgtacccaagggttccaagcagcgtgagggatgcgtggccaggaatccagcacggtggcgacaggatgctgggcaccgtccagtggcatgggcaccaagaacctcctcacccacaccgcagtgcagctgctggctatggcaaccatgctgcatacaactgccatggcggcttggtagcaggcggggccccaatgctctcctctgccgcctttgagctcccgcctggcggatgtgtcgcgggagttgccgccgactccagctgtgctctctctcttctgtcaactcagccatgggacacgacctcccacgaccaccggtccccagcaatgcccgcggccggcgccttcgacggcaccccggtggcgccgtccgtcatggcgagcagctacgcggcgtcgagcgcctggacgggctcgcgggaccccgctgccgacggcgccaggaacgcgcagcgtctcgacgatgctctgcacctggtccacccaggctccgcggcggtccacttctccggcgagctcgagctcgccctgcagggaagcggcgggccgccacacctgccgcgcgtcgaccatggcggctccggcggcggcaccttcaaccattccaccaccagcgcgatgaactggtccctgtagcagcactgcctgccttcatccggtcgccacgccacgagatgtggagggagcacttttgcattggacaccaccctggttttgtgcgccttaccttgccgttctcgttttttcagggtggagaaactgggattcctaaccatagtagatctaccgtgaattcccttcccgtgtagtagcgcattgcgtccatgaactcatttgatcgatcgtcgtgtcaccgtgtgcgtaactgcgtatctgtttggcgtaactgcgtatctgtttgttgaatctttccgaacattgcgg

SEQ ID NO: 1857 - DNA, 1511 bp, Zea mays
gcttcaccctccctgctcactgccgcctaccctcgttgaagcgcgctctctcgctctcgctctcctcgcgcttcctcccactcccactggacagagaggagggttagtggagggaacagcgttagctaggggggaagcacggaagcgggaagcaatggcgaccggcggcggcagcagcaggagcgacgacgtgcgcgggctcaagtttggcaagaagatctacttcgagcaggacggcgggagcgggagcggggcgggggcggtgggcggcaggaaggggaagggcgtggccaccggtggcgcgaggccggcgtccgccgcctccgcagcccagccgccgaggtgccaggttgacgggtgcggcgtggatctgagcgccgtcaagcagtactactgccggcacaaggtgtgcaacatgcactccaaggagccgcgcgtcttcgtcgccggcatcgagcagcgcttctgccaacagtgcagcaggttccaccagctacatgaatttgaccaagggaaacgtagctgccgccgccgcctcatcggtcacaacgagcgccggaggaagccaccacctggacctctcacttcacgatatggccggctcgytgcatcacttcaagagcctggcaggttcagaagcttcctgctcgacttctcgtacccaagggttccaagcagcgtgagggatgcgtggccaggaatccagcacggtggcgacaggatgctgggcaccgtccagtggcatgggcaccaagaacctcctcacccacaccgcagtgcagctgctggctatggcaaccatgctgcatacaactgccatggcggcttggtagcaggcggggccccaatgctctcctctgccgcctttgagctcccgcctggcggatgtgtcgcgggagttgccgccgactccagctgtgctctctctcttctgtcaactcagccatgggacacgacctcccacgaccaccggtccccagcaatgcccgcggccggcgccttcgacggcaccccggtggcgccgtccgtcatggcgagcagctacgcggcgtcgagcgcctggacgggctcgcgggaccccgctgccgacggcgccaggaacgcgcagcgtctcgacgatgctctgcacctggtccacccaggctccgcggcggtccacttctccggcgagctcgagctcgccctgcagggaagcggcgggccgccacacctgccgcgcgtcgaccatggcggctccggcggcggcaccttcaaccattccaccaccagcgcgatgaactggtccctgtagcagcactgcctgccttcatccggtcgccacgccacgagatgtggagggagcacttttgcattggacaccaccctggttttgtgcgccttaccttgccgttctcgttttttcagggtggagaaactgggattcctaaccatagtagatctaccgtgaattcccttcccgtgtagtagcgcattgcgtccatgaactcatttgaccaaaaaaaaaaaaaaaa

SEQ ID NO: 1858 - DNA, 1167 bp, Sorghum bicolor
atggcgaccggcggcagcgggagcgacgatgtccacgggctcacgtttggcaagaagatctacttcgagcaggacgcggccgtcgccgccgcaggcggaagcgggagcgggagcgcgactgcggcggcgggcggcaggaaggggaagggcgtggccaccggtggcggcaggccggcgtccgccagcgccgcctctgccacccagccgccgaggtgccaggtggatgggtgcggcgtggatctgagcgccgtcaagcagtactactgccgccacaaggtgtgctacatgcactccaaggagccgcgcgtcgtcgtcgccggcatcgagcagcgcttctgccaacagtgcagcaggttccaccagttacctgaatttgaccaagggaaacgtagctgccgccgacgcctcattggtcacaatgagcgccggaggaagccaccacctggacctctcacttcacgatatggccggcttgctgcatcatttcaagagcctggtaggttcagaagcttcctgcttgacttctcgtacccaagggttccaagcagcgtgagagatgcgtggcaaggagttcagcccggcggcgacaggatgctgggtaccatccagtggcatgggaaccaagaacctcacccacaccgcagtgcagctgcgggctatggcaaccatgcatacaactgccatggtggcttggtggcaggggcttccatgctcccctctgcctttgagctcccgcccggcggatgtgttgcaggagttaccaccgactccagctgtgctctctctcttctgtcaactcagccatgggatacaaccccccaaagtggcagccacaaccggtccccagcaatgtccgccgcggccagcgccttcgaaggcaccccggtggcgccgtccgtcatggcgagcagctacacggcgtcaagcacctggacggcctcacgggaccctgccgacggtgccaggaacgcgcagcagcatcacgatgatgctctgcacctggtccatccaggcccggtccaccacggccacttctccggcgagctcgagctcgccctgcagggaagcgggccaccgccgccgccaaacatgccgcacgtcgaccatggcagctccagcggcaccttcagccattccaccaccaacgcaatgaactggtccctgtag

SEQ ID NO: 1859 - DNA, 1616 bp, Zea mays
ctgcctcctcctacccttccctcgctgaagccctctcgcgcctcctcccactcccactggacagagaggaggttagtggaaggcgggctaggaggctacgccgccacagacgcgaagcgatagcgtcggggggaagcaaggaagcgggtggcaatggcgaccggcggcggcggtgggagcgacgacttccacgggctcacgttcggccagaagatctacttcgagcaggacgcgggcgccgccggggggagcgcgacgggcggcaggaaggggaagggcgccgcggcgtccgcgagcgccgcccagccgccgcggtgccgggtggacgggtgcggcgtggatctgagcgccgtcaagcagtactactgccggcacaaggtgtgctacatgcactccaaggagccgcgcgtcttcgtcgccggcatcgagcagcgcttctgccagcagtgcagcaggttccaccagttacctgaatttgaccaagggaaacgaagctgccgccgccgcctcattggtcacaacgagcgccggaggaagccaccacctggaccactcacctcacgatacggcccgcttgctgcatcactagttcaagagcctggtaggttcaggagcttcctgctcgacttctcgtacccgagggttccaagcagcgtgagagatgatgcgtggcaatggcaagggatgcagcatggcggcgacaggatgctgctgggtaccgccagcgccatccagtggcatgggaaccaagaacctcacccaccacatcgcagcgcagctgcgggctatggcaaccatgcgtacaacaactgccatggtggcggcggcttggtagcagcagcagcgggggcgtcaatgctctcctctgccttcgagcccccgcctggcggtggcggatgtgtcgcaggagctaccgcggccgactccagctgtgctctctctcttctgtcaactcagccatgggatacgcccacccaaagtggcagcagccaccacaaccggtccccagcgatgtccgcggctgcaggcgccttcgaagtggcgccgtcgtccgtcgtggcgagcagctacacggcgtcgagctcctggtctggctcacgggaccctgccgacggcgccaggaaaaacgcgcagcgtcacgatgatggcctgcacctggtccatccaccaggccccgtccaccacggccacttctccggcgagctcgagctcgccctgcagggaagcggcccgccgcatgtcgaccatggcggcggcacctgcttcagccattctgacaccaacgcgatgaattggtccctgtagggacaacaacttttgccgccactgccttgatccggtcggcacgccacgagacatggagcacttgggattgggacaccctggttttgtgcccctgaccttgccgttctggtttttcagggtggaactaactgggattccctaggcgtagatcatgaatcccctttccccgtgtaacccattgcgtccatgaagtcggcccaacaccggatcatatataattctacaactcccataacctaaatcattcttcagttgtgaagatatatgcttgtcaagtgacctggttttattttatctgccatcaattcatc

SEQ ID NO: 1860 - DNA, 1711 bp, Zea mays
ggcaacagcgagccctgctgtccctctgcttcgccacctcctccctccctctctttccttcctcttggaggagagagaagagggggagagccagtcagccagccagcccaagaacagcgtacgtacgttgtcaagtcccgtcgccgccgcagcagcttcgctcctcccgccccgcccaccgtcgcgcgcggcggcggggagcgagcaatggaggccggcggcgccagcggcggcgacgacggggacggccagctgcacggcctcaagttcggcaagaagatctacttcgaggacgccggcggctccagtagcagcggcggcagtggcagtgccagcgcgaccgcgcctccagcgacgcagcagccgtcgccgccggccgcttcgcctagggccgcgcccggtggcggcaggaggggcagggccgcggctggcggcgcgggcccctccttgccgcccgcgcccccgcgctgcctggtcgacggctgcaacgccgacctcaccgacgccaagacctactactgccgccacaaggtgtgcgaaatgcactccaaggagccccgcgtcgtcgtcaacggtctcgagctacgcttctgccagcagtgcagcaggttccacaacctggccgaatttgaccagcaaaagaaaagctgtcgcaagcgtctagcaggccacaacgaacgccggagacggccacctcctggaccccttgcgtcacgatatggccgtctcgctgcaccgctcggtgaagagcccggcggcagattcagaagcttcatgctggatttctcatacccaagggttccaagcgccatgagggatgggtttccagcggttcgacctggtggtgaaagggtgcctggcagcaatatccagtggcaagcagcgagcctagatcctcctccccctcaccatcagagcgcggcagcaggatacggtgcccactcgtacgggagcccgggtagctcgtcgtcgtcgaggccaccggtgttccctgctggcccggagctccccccaggcggtggatgtctcgcaggagtccccacggactctagctgtgctctctctcttctgtcaactcagccatgggacgctgctggccacagcgccggccacggccacggccacgccgcgtcactgcccgcaacagcaggcttcgacggcaaccccgtggccatggcgagtagctacatcgcgccgccaagcccctggaccgactcccgggcccacgaaggcgggcggcggaacgtgcctcaactgccacccgacgtccccctcggcgacgtgcactctggcccaggcacccatcacggccagttctcaggtgagctcgagcttgccctgcagggaaacaggccagccccggcgccgcgcaatggccagggctccgcgggcgcgttcgaccaggccggcagcacgacggagtggtcgctctaggaggccaaataaaagcgcggcacatcgtcgtagccgcacagcgagatggagcttgaagcctggctccgctagctacctgcatgcgctgtttgcttgcctagaggctagagcatccagtatgataataagcgaggaactagtgcagtgccggccaggagactgatttcttttgcgcttgtccatgaactcgtctgttgcgtctatgtacacctccatggtttgaactcgtcggggacttcgctcgatgtgttattaatctcatgctcatccttccgct

SEQ ID NO: 1861 - DNA, 1534 bp, Sorghum bicolor
ggaggagagagaagagggggataccccagccacagccagcacaagaccacccagcccctctcgctgacgtcgccgccgcaatggagtccggtggcgccagtggcggcggcggcggcggcggcggggacgaccagctgcacggcctcaagttcggcaagaagatctacttcgaggacgccgccgcggccggctccagcagcggtggcggtggcggtggcagtggcaatgctagcgcgaccaccgcggctccagcgacgcagcagccgtccccgccgcaggccgcttcgcccagggcagccagcggcggcggcggcaggaggggcagggccgcgggcggcccctccccggcgcccgcgcccgcgcgctgccaggtcgacggctgcaacgtggacctcaccgacgtcaagccctactactgccgccacaaggtctgcaaaatgcactccaaggagccccgcgtcgtcgtcaacggcctcgagcagcgcttctgccagcagtgcagcaggttccaccagctgcctgaatttgaccaactaaaaaaaagctgccgcagacgtctcgcaggccacaatgaacgccggaggaggccacctcctggacctcttgcaacacgatatggtcgccttgctgcatcattcggtgaagagcccggcaggttccgaagctttatgttggatttctcatacccaagggttccaaccgccatgagggatgggtttccagcagttcgacctggtgaaagggcgcctggtagtatccagtggcaagcgagcttagatcctcatcatcatcaaagtgcggtcgcaggatacagtgctcactcatatgggagccagggtagctcgtcgtcaaggccaccggtgttccctggtccggagatccccccaggtggatgtcttgcaggagtcccctcggactctagctgtgctctctctcttctgtcaactcagccatgggatactacccacagctctggccacagccatgctgcatcaatgcctgcaacagcaggttttgacggcaaccctgtggcaccctccctcatggcgagtagctacattgcgccaagcccctggactgactcccggggccatgaaggcgggcggaacgtgcctcagttgccacctgacgtccccctcagcgaggtgcactctggctcaagcagccatcacggccagttctcaggtgagctcgagcttgccctgcagggaaacaggccagcaccagggtcagcgccagcgccgcgcaatgatcagggctccacaggcgcattcgaccagtccggcaacacaatggactggtcactctaggaggccaaataaagtgcagcagatcatagccgcacagagagatggaactgaaagcctgacgctgcacgctgtttgctagcttagagcatccagtatgataaggaactaatgcaatgtcaggagactaatttcttatgtggttgtccgtgaactcatctgttgcgtctatgtagacctccatgatttgaagttatcatcagcatgcttctcggggactttgctcg

SEQ ID NO: 1862 - DNA, 1950 bp, Sorghum bicolor
gagccgctgaggataggggaggcatgcatgatagagacctcaaaggccaggtgagagctcagtcgacggtaatgctgtcgcagctcctttagttgccagacgattggcatgccacgattcctggtttcatctcgctgagttagtttgacttcaaggcttgtgcggtgttgctgattggcaacaagaggttcaggaataggcggaggatttggttgtgttctttctgtttcgtcagggaaagggatttgagttctgccagctttcacatacacaggttgggggagcagttgagattttctaattcttcttcttggcaggattgagatcttcagttctggtaatgggttctttcgggatgaactggaatcagaagaactccatggtgtgggattgggaacatctagtgccatctgtctcgaatgcagttacaaggcatggatctgctaattcatctggtggtactcttacttctagctcagagctagggcatggttcatccaagagctctatttcagcatccattgattcaccatctggagtagggaacagcttagagttcaattttgccgctgttcaaaggcatgttaagaacacgggcaccaatggcagagtcgatgactcagggaattctccatcgtcaatgatagccttcagccaaggagagccactgatcagcctcaagcttggaaaaagggcttacttcgaaaatgtctgtggaggacaggaggccaaggtttctgcaccttcagatgttacttctgcagtcaccgtggtcaagaagactaaggtgtctcagcagaatgcaaagaactggtactgtcaggttgaaggttgcaaagttgacctgtcttctgctaaagattacaaccgcaagcacaaagtctgtgtagctcattctaaagctcccaaggtggttgttgctggtctagagcgccggttttgccaacagtgtagccggtttcatggtttggcggagtttgatcagaacaaacgaagctgtcgtaggcgtcttactcatcataatgcacgaaggaggaagccacaggcagatgcaatttcattcaattcatcacggctctcgtcaatgttttatgatacaagccaccggacaaatcttttctttagtcaacctctctatggccaagtgagaagcaatgcagtatctccgtgggataactcgggaggcttcaaatttatggaaacaaaacatctgtcagtgcagccaacaaaaacagtaggcctggatgagctgcatttctcaaccccccagatatcaactagtgttgtggcgcacactggacatcatcataacttcgataggttcatgccattcaagggaactaacacaaaggttcttaaccaagtttcaggtgtggaagcttcggcgaccgcttccaactctaataacggagccccagaacctgggcgtgctctctctcttctgtcagacggttcttggggctcaaattcagccgtcatccagcagcctccttctcacgcagatgctggtgcattgccgcccctcgccaccgttgctgtctccaacaccgccgccaggcatcctcttgacccgtccctgggaaggttctggcaagacgatcatcccccactcgacggacctgcacctcagattcaggaactggcgcacctccgaacatggtgaaagtgaaagataaatgtatctgatgccatctcgaggacctggttgggaacttctggctaggcattttgatggcaatctgtggctctggtttgaatttgccggtgacagtctttggacaatgtttaatttagctgttttgatcagaacgggcacagacatgtttgcacaatgtgagttcctctatcattggggatgagtgaggtgaagatgcaggaacaataggagacaaaatcttaatttttttgctcgttttcccaccagtatttgaattattaattactaggacc

SEQ ID NO: 1863 - DNA, 1827 bp, Zea mays
gaggatagggaaggcatgcatgatagggacttcaaagacccaggtgagagctcagtcgacggtaatgccgccgcagctcctttagtcgccaggcgattggcatgccacggttcctggttcatctcgcagagttagtttgagttcgaggcttgtgtggtgttgctgattgcgcacaagaggtccaggaacatataggcggcggatctggctgcgttctttctgtttcgtcagagaaggggtttcagcgctgccagctttcacataaacaagttggggaagcagttgaggttttctaattcttcttggaaggattgagatctccagttctgataatgggttcttttgggatgaactggaatcagaaggaccccatggtgtgggattgggaacatctagtaccgtctgtctcaaatgcagttacaaggcacggatctgctaattcatctggtggtactcttacttctaactcagagctagggcatggttcatccaagagctctatttcagcgtccattgattcaccctctggagtagggaacagcttagagttcaacttcgccgctgttgagaggcatgttaagaacacgggcacgaacggcagagtcgatgactcggggaattctccatcgtcaatgatagctttcaaccaaggagagccattaatcagcctgaaacttgggaagagggcttacttcgaaaacgcctgcggaggacaggatgccaaggtttctgcagcttcagacgttacttctgcagccagcgtggtcaagaagactaaggtgtctcagcagaatgcaaagaactggtactgtcaggttgaagggtgcaaagttgacctgtcttctgctaaagattacaatcgcaagcacaaggtctgtgtagtccattctaaagctaccaaggtggttgttgctggtctagagcgtcggttttgtcaacagtgtagccgttttcatggtttagcggagtttgatcagaacaaacgaagctgtcgtaggcgtctgatgcatcataatgcacggaggaggaaacctcaggcagacacaatttcattcaattcatcgacaatgttttatgatacaaggcagcggacaaatcttttctttagtcaaccactttatggccaagtgaggagcaatgcagggtcttcatgggataacttgggaggcttaaaattcatggagacgaaacatccgccagtgcatccaacaaaaacagcatcccctgatgaactgcatttctcagccctccagataactagtgctgcggctcacaccggacatcatcatgatctcgatgggttcatggcgttcaagggaaccagcacaaaggtccttaaccaaggcgtggaggcttgggcggccgcttccagctcgaacaacggaggcccagaaggtgggcgtgctctctctcttctgtcagacggctcgtggggctcgagttcagccgtcatccagcagcccacatctcacgcggacgccggtgcattgctgccgcccctcgccaccgttgccgtctccaacgccgccgccgccgccgggcatcctctggacccgtccccgggaaggttctggccgcaagacgatcatcccccgctcgtcgacggacccgccacgcagattccggagctggcgcacctccggatatggtgaaaggaaacgcatgtgatgcggtgactggtgacatgccagttcgagggcctggctgggaacacatctggttggttagcctgccgctctggcttgaatttgccggcgacgacagtctttgtttgtatcttttgatcagaacggacacagacatgtttgcgcaaaaaaaaaaaaaaaa

SEQ ID NO: 1864 - DNA, 2768 bp, Sorghum bicolor
cttctctctctcccacctcccttcttacatccatcctctcatcaccaccccaccctctcctcctcctccctgtctttctccctctccctctccctctccctcttgacaaattttcctccacccattccattcctcctcctcttctccacccactccaccgatccccctctttctctctgatgaattctctctctaggcttctccaccgttccatctgtctgccgcctctctcttgcaagcaatcaatcggttcttgtttcctccgtctgctgggttgattctctgtctcttcctctccgtggagagaggatcgagaaaccggagacaggaaaggagaggactcagaacgagcctgttcttcttcctggattgcggttcttgcgagttgttcagaaactctgggccactttctggtccttcaaactactggaaagaggaatcatcagagatgctaaggcaacagaccaattgatatctcggtgccctagtttggatcatcacaatgcaagggcagaggaattctatggagcattatgctgatgtttttggattcgacattgcatctagttcaggcaaccctgtgatggaccagcagtcatattggaataatgttcttggatcagtagaatcacagaatcctcaaggttatcagatgaatcacagtgatgccgccatgccatatggaaatgaggcacagcaagatggtacatttcttggtttctgggaatcaggcgaagcaagttcaagtggcagcgcactaaactatggcagctccaacaatgtcaaaacagagcatcttaacattggcggtggactgaggattggtgaaaggcaactggtagctgacaatggcatttctctggatgtggatatcaaccttaacgccaacgttaacgatctatgtggccaaagttcaaatgttaactgtacctctcaaggtcctgagcagtatggtggcagtgatcgtaatggtataaattctcagccaactgacctgagattacacccatataggacattcctgctaggtgcagagcaagcagactcttttactttgaatcctagtgaaaatcctttgagtgatttttcactaatgcaagaaagcattgatcaaagagcaggtagttccctggatggtcgccggctagcgtgcaagagaaaaaatattgaaggagccaatggccagagttcagcaggtgctagcacaagtttttccctcaggaacgataatgctttctataacattgcttcttcaagttacaatcctgcacctatcagaaattcatcctctcccaattgcttgccagttccaagttctattgaggatcaactcccacaatatggaactaatgcagggctctcagccggtacctatgaccttaatggaggggtccacaatgctgggaattcgcagagaagtttccgggcaagaactaccacgtctcaacagattgctccctgtagtgtatggccctcttcaaatgctatcaggctttctaattcatggaatcaccagccacctcattttcaaaatgcatttgatggtccccaggaagttattcctgtggtcagcagcctcaacttgcaataccagcatccagtgaatgtttctggtgtgccacaggctgcaaaccgtttcactggccatggggcttcatcatcgagagctacgagtttggagaacagaaatcttggtagtgaagaggttactaggaggaatgtggtgcctaccaactacactgatttagttcccccgtctgcagtagacctgagacgtttggtgccagaaccatctaactggagttctgatgtccgaggcactgcaatatcaggaagtattcctcctgtatcaagagctaataacagttcagcagctaatccaccagcaggattcaatcaccaaaacctcacccgtcgccatcctcgaaatttgtcagaggagattggtcgtctatccggagcacttcgcggccatcaacccccacgcttaaggtcagggtttctgttggagcgccagggcgatggtgtttggggtgttcctttatcaacaaggggtagggaaggaagaaggctaatggagattcggaatgcacttgaaatgattcatagaggggagaatgtaaggcttgagtctatcttctatggtggcgttgaaattcatgacagacacagggacatgcgccttgacattgacaatatgtcctatgaggaactattagcacttgaggaaagaataggagatgttagcactggcctcagcgaggaagctgtgataaagttgctcaaacaaaggaaattttcatcatggagactgaaagcatctttggaccctgaaccgtgttgtatctgccaggaggagtacgttgatggagacgatcttgggaggctggactgcgggcacgacttccacgcttgctgcatcaagcaatggctggtggtgaagaacgtgtgccccatctgcaaaaacaccgcattgaagacctgaaactgaaaaggctcgtcagagacacccatgttccatgttcattccatcgatcgcaagatcatttaccgattcatattactatgcttttttggttgggaaaattttgccattcacctgcaattgggaaaggaaaaaaaaaaagaggatgtgcggaccctgtaaactgctgcagcagtaaataatccctggaatatgtctccctgcatttaaccaaatatttatggctgttataatggatggacgtatcgtaggattaaaacctgaaagagtgcctgttgccgcc

SEQ ID NO: 1865 - DNA, 2579 bp, Zea mays
gtctgctgcctctctctctcgcaatcagtcactcggctcttgtttcttccgtctgctgggttgattctttctcttcctctccgtggagaaacaggaggagagaggaaagaagagaaatcggaaccagcctgttctttttgcctggattgcggttcttgcgagttgttcagaaactctgggccagtttctggtcctttaaactactggaaagaggaaccatcagagatgccaaggcagccaacaaattgatatctaattgccctactttggatcatcataatgcaaggacagaggaattctatggagcattttgctgatgtctttggattcgacgttgcatcgagttcaggcaaccctgtgatggatcagcagtcatattggaataatgttcttggatcagtagaatcacataatcttcaaggttatcagatggctcacagtgatgccgccatgccatatggaaatgaaccacagcaagatggtacatttcttggtttctgggaatcaggcgaagcaagttcaagtgccagtgcactaaactatggcagctctaataatgtcaaaacagagcatcttaacattggtggtggaggtggactgaggattggtgaaagccgactggtagctgacaatggcatttctctggatgtggatatcaaccttaacgccaacgttaacgatctttgtggtcaaagttcaaatgttaactgtgcctctcaaggtcctgagcagtattgtggcagtgatcgtaatgctataaattctcagccgactgacctgggattacacccattcaggacattcctactagatgcacagcaagcagaatcttttactttgaatcctagtgaaaaccctttgggtgatttttcatcaatgcaagaaagcattgaacaaagaccaggtggttccctggatggtcgccggctagcgtgcaagagaaaaaatattgaaggagccaatggccagagttcagcaggtgctagtacaagttttccccacaggaacgataatgcattccataacattgcttcttcaagttacaatcctgcacctatcagaaattcatcctctcccaagtgtttgccagttccaagttctattgaagatcaactcccacggtatggaactaatgtagggctctcagccggtacttatgaccttcatggaggggtcaacaatgctgtgaattcacagagaagtttccgagcaagaactaccacatctcaacaggttgctccctgtagtgtatggccctcttcaaatgctatcagactttctaattcatggaatcaccagccacctcatttccaaagtgcatttgatgatccccaggaggttattcctgtggtcagcagcctcaacttgcaataccaacatccaatgaatgttcctggtgtgccacaggctgctaaccgtttcactgaccatggagcttcatcatcgagagctgggagtttggagaacagaattattggtagtgaagaggttcctaggaggtatgccgcgcctaccaactactctgatttagttcccccacctgcagtagacctgagacgtttggtgccagaaccatttaattggagttctgatgtccgaggcactgcaatatcaggaagtattattcctcctgtatcaagaactaataacagttcaacagttaatccaccagcaggattcaatcaccaaaacctcaccagacgccatcctcgaaatttatcagaggagattggtcgtctatctggagcactccgcggccatcaacccccacgcttaaggtcagggtttctgttggagcgtcagggcgatggtgtttggggcgttcctttatcaacaaggggtagagaaggaagaaggttaatggagattcggaatgcacttgaaatgattcaaaggggggaaaatgtaaggctcgagtctatcttctatggcggcctcgacattcatgacagacacagggacatgcgccttgacattgacaatatgtcctatgaggaactattagcacttgaggaaaggatcggaaatgttagcactggcctcagcgaggaagctgtgataaagttgctcaaacaaaggaaattttcatcgtggagactaaaagcatctttggacccagaaccatgctgtatttgccaggaggagtacgttgatggagacgatctcgggaggctggactgcgggcacgacttccatgctggctgcatcaagcaatggctggtggtgaagaacgtgtgccccatctgcaagaacaccgcattgaaggcctgaaaccgaacaaaggcccgtcagagacacacccatgttccgtgtccattcgatcggtcgcaagatcatttacccgattggtttttactatgcgttttttggttgggaaaattttgccatttcacctgggaaagtggtgggggggtgttggaggtggaagagaagatggcggtccctgtaaactgctgctgctgctgctgcagtaaataatccctggaatttgtctccctgcatttaaacaaaatatttatggctgttataatggacgccgtcgtagggttataacttgaaagatagcattgtgtgccacc

SEQ ID NO: 1866 - DNA, 2695 bp, Zea mays
aacctcctgtcatcaccaccacacccctcctcctcccctgtctttctccctctccctcttgacaaaatttcctccacccattctcttcctcctcttcttccccaccgatccacctctttctatctgaatttcctctcgtcttgcccaccgctccatctgtctgttgcctctctctctcgcaaccaatcggttcttgtttcctccgtctgctgggttgattctctctctcttcctctccgtggagaggagaggatcgagaaacaggagacaggaaagaagagaaatcagaacggagcctgttcttttgcctggattgcggttctcgcgagttgttcacaaactctgggccagtttctggtcctttaaaatactggaaagaggaaccatcagagatgctaaggcaacagaccaattgatgttatctcgctaccctagtttggatcatcacaatgcaagggcagaggaattctgtggagcattttgctgatgtttttggattcgacattgcatctagttcaggcaaccctgtgatggatcagcagtcatattggaacaatgttcttggatcagtagaatctcagaatcttcaaggttatcagatgaatcacagtgatgctgccatgccatatgggaatgaggcagagcaagatggtacatttcttggtttctgggaatcaggcgaagcaagtgcaagtggcagctctaacaatgccaaaacagagcatcttagtattggcggtggtctgaggattggtgaaaggcgactggtagctgacaatggcatttctctggatgtggatatcaaccttaacgccaacgttaacgatctatgtggtcaaagttcaaatgttaactgtacatctcagggccctgagcactatggtggcggtgatcgtagtgttgtaaattctcagccaactgacctgagattacacccatacaggactttcctactagatgcagagcaagcagactcttttactttgaatcctagtgaaaaccctttgtgtgatttttcattgatgcaagaaagcattgaccaaagacccggtagttccctggatggacgccggctagcctgcaagagaaaaaatgttgaaggacccaatggccagagttcagcaggtgctagcactagtttttcccacaggaacgacaatgctttccataacattgcttcttcaagttacaatcctgcacctatcagaaatccgtcctcacccaattgcttgccggttccaagttctatcgatgatcaactcccacgatatggaactaatgcagggctctcagccggtacctatgaccttaatggaggggtcaacaatgctgggaattcgcagagaagtttccgggcaagaattactacgtctcaacagattgctccctgtagtgtatggccctcttcaaatgctatcagacttcctaattcatggaatcatcagccacctcattttcaaagtgcatttgatgatacccaggaggttattcctgtggtcagcagcctcaacttgcaataccagcatccagtgaatgtttctagtgtgccaccggctgcaaaccgtttcactggccatggagcttcatcatcgagagctggcagtttggagaacagaattcttggtagtcaagaggctcctacaaggaatgtggtgcctgccaactactctgatttagttcccccgtctgtagtagacccgagacgtttgctgccagaaccatctaattggagttctgatgtccgaggcactgcaatatcaggaagtattcctcctgtatcaagagctaataacagtgcaactgttaatccgccagcaggattcagtcaccaaaacctcacccggcgccatcctcgaaatttatcagaggagattggtcggctatctggagcacttcgcggccatcaacccccacgcttaaggccggggtttctgttggagcgccagggcgatggtgtttggggtgttcctttatcaacaaggggtagagaaggaagaaggttaatggagattcggaatgcacttgaaatgatccatagaggggagaatgtaaggcttgagtctatcttctatggcggtgttgacattcacgatagacacagggacatgcgccttgacattgacaatatgtcctatgaggagctattagcactcgaggaaagaataggaaatgtcggcactggcctcagcgaggaagctgtgataaggttgctcaaacaaaggaaattttcatcttggacactaaaagcatctttggaccctgaaccatgttgtatctgccaggaggagtacgctgatggagacgacctcgggaggctggactgcgggcacgacttccacgctggctgcatcacgcaatggctggtggtgaagaacgtgtgccccatctgcaagagcaccgcattgaagaagacctgaaacccgaacaaaggctcgtgtcagagacacccccccatgttttctatgttcactcgatggttcgcgagatcatttgccgattcgtattgctacgcttttttttttggtcgggaaaattttgccagccacctgcaattgggaaaggaaaagagagagaaagagggtgcggttgctgtcctctgtaaactgctgctgcagtaaataatccctggaatatgtcttccctgcattcaaccaaatatttagtagctgttatagtggaaaaaaaaaaaaaaaaa

SEQ ID NO: 1867 - DNA, 3690 bp, Oryza sativa Japonica Group
aaggacagaagaactctgttgagcagcttgctgatgtgtttggatttgaccatgcatccagttcaggaaaccctgtcatggatcaacaaggatattggaacaacattcttggttcagtggagtcacataaccttcaaggttatcaggtgaaccgtagtgatggaactattccctatggaaacggtgtgcatcaaaatggcacttttttaggtttttgggaatcaggcgaagcaagtgcaagtggcagttcactacattttgggggctctaatgagatcaaagctgagcaacgtaatatcggtggtggcctaaggattggtgaaaggcgcttggtagctgagcgcaacctttctttggataatgttgatataggccttaacatcaatggtaatgatctatctggtgaaaattcaaatgtgaatggtgcttcacaaggctctgaactacatggtggctgctctcatactggttcaaatggtcaagcctctgagctgagattacatccatacaggacattcatattaggtgcagatcaacctgagccttttaattctttgaatggcagtgaaaatcctttaggtgatttttccttgatgccagaaggcattgatcagcgaccaggcagttccctggatggccgccggctggcatgcaagaggaaaaatatagaaggagttaatgggcagtgctcggcaggtgctagcactagtttttcccacaggaacgatagtattttccataacattgcttcttcgagtcataatccctctcctagtacaaatttaccctctcctaattgtctgttggttccaagcactcttgatgaacaactcccgcgttatggagctactacagctggattgtcatctagtagctatgatcctagtggaggcaataacaattcaggaggctcacaaagaagttttcggccaagaactagcctggctcaacatattggcccctatggtgtgtggccatcttcaagtactatcagacattccaattcatggaatcatcagccacctccctttcagagttcatttgatgaaccaccggaggtaattccagtggtcagtagcctgaactttcaataccagcatccaatgaatgtcgttcctggcattccacagatgtcacaccggttcactggtccaggggcctcatcatcaagaacaggcaatttggagaacagaattattggtagtgaggaatttagcgcgaggaatgtagtggctaccagcttccctgatgcagttcctccggccgcactagacatgaggcatttgataccagaaccatctagttggaatgtagatggcagagctactaccattccaggaaatgttccttcttcatcgagagctaataccaattcgatggttaatccaccagcaggctctccatttattgcccatcaaaacttgcatagacgtaatcctcgtaatttgtcagaggtagcttttcgcctgctcagttcaatatgttccattttcaaatcgatttatcttttagtaatcttcttgcgtttttttcttttataggagataagtcgtttatctggagctcttcgtggccatcagcacccacgcctaaggtccggttttctgttagaacgacaaggtgatggtgtttggggtgttccgttgtcaactaggagcagggaaggaagaagattaattgaggtatcaattctgctctctttttttcccttctcttgcctgccttgtttctgaactaggtcagaaatcagaataatgttatgtttacatccgtttagtggacatacagaagcatcattaggaataatattctgacgatcttctaaatctcatttcccctttgatctcacatgcttcttcgcatgtctgcagccatccacctaattctgcggtggaaagataaactttagtttctcaccaatctgaaaatgttacggcagttgctaaattcccccccccccttacgcaccatcatcttgtacctagtagtgacacttaattttattaactcaacagagagagagagagagagagagagagagagcacatatcttgttttggttttaaatgacacagtggattaatagttataaaattcaatggaccgtttaccttatgcatgctacgttttgtttctagccgcatgttattctctagaactatgtggcttggacaggcaataactagtgagccatccatgttggatgcgtcgttcatttatttacttgtgtaaccatgaagtctatgcaagacaatatgtttcttacctttttgcttgtcaccagatccggaacgcgcttgaaatgattcacagaggggaaaatgtaagatttgaggtcagtaacaactgtggtttcggagttacctacagttgcctatttttatctgcacggacttgtagagattgatgaaactatattatgtcctaaaaactcacagcaagactggctgactaatactagttgatgctaggattacataaggtttgctctgtccattcagtttggatgtagaggctggattctaatccattttataaaagagagatcgcataaggtgttgttttgtttctgaaaacagaagtttcttgtaatatggaaatagtatatagtgaatgcatgaaagaccatagtatatctataattcagaaaaatatagtcatcatttcaacagagagaaacaaataggcaacaacttgcactgaacccttttttgttttctaaaatctttgcttatttcttgaggtatttactcttgcttccacgtatatctgttcttgctacagtccattttctatggtggagtcgacattcatgacagacacagggatatgcgccttgacatagacaacatgtcttatgaggttggttttccttagcacaatattatctggatctttctccagcaaaactctgataattgctgttgtcttccaggagctattggcactggaagaaagaataggcaatgttagcactggcctcagtgaggaagaagtgacaaagctcctaaagcaaaggaaattctcatcatggaggttggaagcatctgtggaagaagagccatgctgtatctgccaggtataactcaggcctatcagaagcttgtgacatagtttcctttgtttagttaacttgaaatctagcaggttcagtgctttgtgcatttagctttgttaattgtacgccatacctaataggtgacataagcctgtgagtatgtccattttaacttgaaaaacactcatctatcaataatgtagctgtaattatcaattaagtcggtcaggcctgtgaaccactaccagttggacaacaatgctcaacttttaaaacttgtagctgaaagttgaatatgattttgttcaagattcctagtgctgcatatactgacctacccaagcaaatatcttaccttgggatacacttgaggaattgtctttgctcaatatcttcctttttcttcattgtcttcttaaatcaatgaaaagttttggcaattctgcaaactaataattcatattgatgtcttctaactatgttcgttctcgctgtttatccaggaagagtatgttgatggggatgatctcgggacactggactgtggacatgacttccatgttggatgcgtcaggcaatggctggttgtgaagaacacctgtcccatatgcaaaaatactgctctgaagtct

SEQ ID NO: 1868 - DNA, 1616 bp, Zea mays; identical to SEQ ID NO: 1859

SEQ ID NO: 1869 - DNA, 1167 bp, Sorghum bicolor; identical to SEQ ID NO: 1858

SEQ ID NO: 1870 - DNA, 1590 bp, Zea mays; identical to SEQ ID NO: 1856

SEQ ID NO: 1871 - DNA, 1511 bp, Zea mays; identical to SEQ ID NO: 1857

SEQ ID NO: 1872 - DNA, 1304 bp, Zea mays
gcccctcgacggcgcccgcgcccgcccgctgccaggtcgacggctgcaacgttgacctcaccgacgtcaagcccgcctactactgccgccacaaggtgtgcaaaatgcactccaaggagccccgcgtcctcgtcaacggcctcgagcagcgcttctgccagcagtgcagcaggttccaccagctgcctgaattcgaccagctaaagaagagctgccgcaaacgcctcgcaggccacaacgagcgccggaggaggccgccgcctggaccccttgcgtcacgatacggccgtcacgctgcgtcgctcggcgagcccggcaggctcagaagcttcatgctggatttctcgtacccgagggtctcaagcgccatgaggggtgggtttccggcggtgaggcccggtggtgaaagggtgcctggcggtatccagtggcaagcgggcttggatcctcgtcaccaccaaggcgcggtcgcgggatacggcgcccactatgggagcgagggtggtagctcgtcgtcggcgaggccgccggtgttccctggcccggagctgcccccaggtggatgccttgcaggagtccccgcggactccagctgtgctctctctcttctgtcaactcagccatgggatgctgcccacagccacagccacagccacgctgcgccaacagcgggtttcgacggcggcagccctgtggcgccctccctcatggcggcgagtagctacatcgcgccgagcccctggaccgagaccgactcctggggccacgaaggcgggcggagcgtgcctcagctgccacctgacgacgtccccctcggcgaggtgcactccggctcgagcagccaccacggccagttctcaggtgagctcgagctcgccctgcagggaaacaggccagcgccagggtcggcggcaccgccagcgccgcgcaataatcagggctccgcgggcacgttcgaccaggctggcaacacgatggactggtcgctctaggccgggggccgaaataaagcgcagcagatcctagccgcgcagggagatggaggaggctgaaagtctgatgctgcacgctgcttgcttagcttagagcatccagcatgataagagtgatgaactgatgcggtgtcaggagactagtttattctgtgcttcaccatgaactcgtctgtcgcggcgtctatgtagacagacgtcacggcagacgtccgtggtttgaagttaccagtatgcttgtcgtggactttgctcgcgatgcattaatctcattgttcaccatccagaaaaaaaaaaaaaaaaaaaaaaaaa

SEQ ID NO: 1873 - DNA, 1534 bp, Sorghum bicolor; identical to SEQ ID NO: 1861

SEQ ID NO: 1874 - DNA, 1711 bp, Zea mays; identical to SEQ ID NO: 1860

SEQ ID NO: 1875 - DNA, 1132 bp, Zea mays
gccccactaactattgactgtcggattccctacccgtcggcgacaatccgctgcccccaatctgcctggtaggtctcgcacctccggtcatggctgccgaagctggcccaatctccaaggtcctcatcgtcatagcaatgcagaaggaggcgacgccgctcgtccacaagttcaatctcgtcgaggcgcccgcccaccaatccacttttcctaaaggtgccccatgggtttggtaccatggcagctacaaaggcctccacattgaccttgtattgcctggaatggatgctgttcttggagtcgacagtgttggtacagtaccagtagctgttgtgactagtttctccattcaaacattgaagccagaccttatcattaatgcgggcactgctggtggcttcaaggccaaaggagcaagcattactgatgtattccttgcatcagatgttgcattccatgacaggaggataccaatacctatttttgacatgtatggaactggagcacgcaaaacttttgcagctcctaatatcttgaaggagctcaatttgaaggttggcaagttgtcgactggggattctctggatatgtgtccccaggataaggagttgatactgcgcaatgatgctacaataaaggacatggagggagctgctgtagcatatgtcgctgacatgttctcgacaccagcgatctttgtgaaagctgtgactgatatcgtggatggggtgaagccaacgtatgaggagtttctgcagaacctgattgccgtgacgacggcactggagctggcagtcaccaaagtggtggatttcatcagcgggaaacgcatctccgatctttgaaagctcgtggtcacgaaatccaacatccccctgctctgatgcacgatgctaggctaggatacaatacaacgttgggtcaatgattttttttggaggtgttctatacgtgaggttttaccccttttgcaatggctcttgatctattcctgaataccgaccagagcagttgtctcttgctaaacagaaggaatgtaaagtgagcaaacatgccattgatcgttgcgaccaaactaacaatgtctgtgcgctgctaaggcacgcatcggcgactattctagagacgattc

SEQ ID NO: 1876 - DNA, 1211 bp, Zea mays
gtgagccggcaccaatcatgccgcttgcattgctggtaccgacccgtccccaccagtccagtctataagagcgacgggatcacggaaacctgttcaccgctgcgccgcctcactattgactgtcggattccccactcgccggcgacaaccgccgcgcccgatccgtctgctaggtcttgcacctccgggctctggccatggctgccgaagctggcccaatctccaaggtcctcatcgtcgtagcgatgcagacggaggcgatgccgctcgtccacaagttcaagctcgtcgaggcgcccgcccacgaatccacatttcctaaaggtgccccatgggttaggtaccatggcaactacaaaggcctccacattgaccttgtattgcctggaaaggatgctgttttaggagtcgacagtgttggtacggtatcggcagctcttttgactagtttttccattcaaacattgaagccagaccttatcattaatgctggcactgctggtggcttcaaggccaaaggggcaagcattggagatgtattcctggcatcagatgtttcattccatgacaggaggataccaatacctgtttttgacatgtatggaattggagcacggaaaacttctgcagttcctaatatcttgaaggaactcaatttgaagattggcaaattgtcgactggggattctctggatatgtctccccaggatgagaaggtgatactgagcaatgatgctacagtaaaggatatggagggagctgctgtggcatatgtcgccgacatgttttcaacgccagcgatctttgtgaaagccgtgactgatatcgtggatggggagaagccaacatctgaggagtttctgcagaacctgattgccgtgacggcggcactggacctggcagtcaccaaagtggtggatttcatcagcgggaaacgcatctctgatctttgaaggctgtcatgaaatccgacacccccactgctctgatgcacgatgctaggctacgaacaatacaacattgggtcaacgattttttgtgaggtgttttctatgtgaggttaaaccttcttaaccctgtgtacaaaattcctgccaattgctatgggccggccatagcgtggaattttgtagaataatttgcaaaatgtattttgtggtgcaaatatcgatatataataatatgctgggggacgggatccccgtgggatt

SEQ ID NO: 1877 - DNA, 1204 bp, Zea mays
attgctggtaccgacccgtccccaccagtccagtctataagagcgacgggatcacggaaacctgttcaccgctgcgccgcctcactattgactgtcggattccccactcgccggcgacaaccgccgcgcccgatccgtctgctaggtcttgcacctccgggctctggccatggctgccgaagctggcccaatctccaaggtcctcatcgtcgtagcgatgcagacggaggcgatgccgctcgtccacaagttcaagctcgtcgaggcgcccgcccacgaatccacatttcctaaaggtgccccatgggttaggtaccatggcaactacaaaggcctccacattgaccttgtattgcctggaaaggatgctgttttaggagtcgacagtgttggtacggtatcggcagctcttttgactagtttttccattcaaacattgaagccagaccttatcattaatgctggcactgctggtggcttcaaggccaaaggggcaagcattggagatgtattcctggcatcagatgtttcattccatgacaggaggataccaatacctgtttttgacatgtatggaattggagcacggaaaacttctgcagttcctaatatcttgaaggaactcaatttgaagattggcaaattgtcgactggggattctctggatatgtctccccaggatgagaaggtgatactgagcaatgatgctacagtaaaggatatggagggagctgctgtggcatatgtcgccgacatgttttcaacgccagcgatctttgtgaaagctgtgactgatatcgtggatggggataagccaacatctgaggagtttctgcagaacctgattgccgtgacggcggcactggacctggcagtcaccaaagtggtggatttcatcagcgggaaacgcatctctgatctttgaaggctgtcatgaaatacgacacccccactgctctgatgcacgatgctaggctacgaacaatacaacattgggtcaacgattttttgtgaggtgttttctatgtgaggttaaaccttcttaaccctgtgtacaaaattcctgccaattgctatgggccggccatagcgtggaattttatacgaataatttgcaaaatgtattttgtggtgcaaatatcgatatataataatatgctgggggacgggatccccgtgggattagatgaaaaaaaaaaaaaaa

SEQ ID NO: 1878 - DNA, 1439 bp, Sorghum bicolor
ctctctctctctctgtctctcatctcacggtcaatcgcccggtcgtggcccgcccccttctaggctctagctgacagcgtaaccctaacgtcgaatcgtcggagctcggacgacggacggcgccgaacaggtgggcttcgctgcgccttggacccttggccgttggcagcgcaagacacgagtcgcggcggcggcaccagtcatgccgcccgccctgttggtcccaacccggccccaccagtccagtctctagtactcctataagagaaacggaacggaatcacggaaacctgttctgttcaccgcagcgccgtctccctcgctattgactatcggattccatccctctccccccgtcggcgacaatccgccgcccccaatccgcctgctaggtccttgcacctccggccatggctgccgaagctggcccaatctccaaggtcctcgtcgtcgtagcgatgcagacggaggcgatgccgctcgtcaacaagttcaagctcgtcgaggcgcccgcccacgaatccacttttcctaaaggtgccccatgggttaggtaccatggcaactacaaagacctccacattgaccttgtattgcctggaaaggatgctgcttttggagtcgacagtgttggtacagtatcggtagctcttgtgactagtttttccattcaaacattgaagccagaccttatcattaatgctggcactgctggtggcttcaaggccaaaggagcaagcattggagatgtattcctagcatcagatgttgcattccatgacaggaggataccaatacctgtctttgacatgtatggaattggagcacggaaaacttttgcagctcctaatatcttgaaggaacttaatttgaaggttggcaaattgtcgactggggattctctggatatgtctccccatgatgaggaggtgatactgagcaatgatgctacagtaaaggatatggagggagctgctgtagcatatgtcgctgacatgttctcaacaccagcaatctttctgaaagctgtgactgatatcgtggatggggagaagccaacgactgaggagtttctgcagaacctgattgctgtgacagcggcactggatctggcagtcaccaaagtggtggatttcatcagcgggaaacgcatctctgatctttgaaagctcatggtcatgaaatccaacaccccaccccccctgctctgatgcccgattctagactaggatacaatacaacatggggtcaatgattttttcgatgtgttccatatgtgaggtttcaccttcttaaccctgtgtacaaaattcctggcaattgccatgggccagccactgtggaattttggagaataatttgcaaaaaaaatgtactttgcggtgcaaatattgatatataatatgctggggggatgggatctcccgtgggattagatg

SEQ ID NO: 1879 - DNA, 998 bp, Zea mays
cgccccactaactattgactgtcggattccctacccgtcggcgacaatccgctgcccccaatctgcctggtaggtctcgcacctccggtcatggctgccgaagctggcccaatctccaaggtcctcatcgtcatagcaatgcagaaggaggcgacgccgctcgtccacaagttcaatctcgtcgaggcgcccgcccaccaatccacttttcctaaaggtgccccatgggtttggtaccatggcagctacaaaggcctccacattgaccttgtattgcctggaatggatgctgttcttggagtcgacagtgttggtacagtaccagtagctgttgtgactagtttctccattcaaacattgaagccagaccttatcattaatgcgggcactgctggtggcttcaaggccaaaggagcaagcattactgatgtattccttgcatcagatgttgcattccatgacaggaggataccaatacctgttggcaagttgtcgactggggattctctggatatgtgtccccaggataaggagttgatactgcgcaatgatgctacaataaaggacatggagggagctgctgtagcatatgtcgctgacatgttctcgacaccagcgatctttgtgaaagctgtgactgatatcgtggatggggtgaagccaacgtatgaggagtttctgcagaacctgattgccgtgacgacggcactggagctggcagtcaccaaagtggtggatttcatcagcgggaaacgcatctccgatctttgaaagctcgtggtcacgaaatccaacatccccctgctctgatgcacgatgctaggctaggatacaatacaacgttgggtcaatgattttttttggaggtgttctatacgtgaggttttaccccttttgcaatggctcttgatctattcctgaataccgaccagagcagttgtctcttgctaaacagaaggaatgtaaagtgagcaaacatgccattgatcgttgcgacc

SEQ ID NO: 1880 - DNA, 1211 bp, Oryza sativa Japonica Group
accacgcggcggcggcagcagcagcagctagggtttagagagcagcccccaatcccatggccccgccctccgactccgacgactcggccccgatccccgccggcgccatctccaagctcctcatcgtcatagcgatgcagacggaggcgctcccgctcgtcaacaagttccacctcgtcgaggcggaggaatccatatttcctaaaggtgccccatggattagataccatggcaactacaaaggccttcacgttgaccttgtatggcctggaaaagatcctgttctcggagttgactgtgttggcacggtatcagcagcacttgtgacttatgcttctattcagtcattgaagccagatctgatcatcaatgctggcactgctggtgggtttaaggccaaaggagcagacattggagatgtctacttagcatccgatgttgcattccacgataggagaatacctatccctgtcttcgacatgtatggaattggaacacgaaaaacatttgctacccctaatatattgaaggaactcaatttgaaggttgggaagctctcaactggcgattctctagatatgtctccccatgacgagtcagcaatattgaacaatgatgctacagtcaaggatatggagggagccgcggtggcatatgttgctgacatgttttcaacaccggcaatctttgtgaaagctgtgactgatattgttgatggggagaaaccaacagccgaggagtttctgcagaacctggttgctgtgacagcagctctggacaaggcagttacagaagtggttgatttcatcagtgggaaatgcatatcggatctttgaatgatgaagcttagaaacctgttcatcaaatccaagctctgctgcttcaatgcactatactatactacatcactgctgtatgatttttcatggggatgcgtatacaatttttaggttcccctgaggccctgatcccccgtatgtacaaaattcttggcaattacttggatcaatagcgtggaattttgtagaatattctgcaaaatgtgcagtgtaatgaaactaaataaggtgatattctgtcaaactaagataagtggtgggcggtggagttattttcttaatagagcattgagaccatcttcattgtttgctctacgattggtaaactgtgaaaaaaaaaacccgaagaagcaataaacatagtttacgtgt

SEQ ID NO: 1881 - DNA, 1227 bp, Oryza sativa
accacgcggcggcggcagcagcagcagctagggtttagagagcagcccccaatcccatggcgccgccctccgactccgacgactcggccccgatccccgccggcgccatctccaagctcctcatcgtcatagcgatgcagacggaggcgctcccgctcgtcaacgagttccacctcgtcgaggcggaggaatccatatttcctaaaggtgccccatggattagataccatggcaactacaaaggccttcacgttgaccttgtatggcctggaaaagatcctgttctcggagttgactgtgttggcacggtatcagcagcacttgtgacttatgcttctattcagtcattgaagccagatctgatcatcaatgctggcactgctggtgggtttaaggccaaaggagcagacattggagatgtctacttagcatccgatgttgcattccacgataggagaatacctatccctgtcttcgacatgtatggaattggaacacgaaaaacatttgctacccctaatatattgaaggaactcaatttgaaggttgggaagctctcaactggcgattctctagatatgtctccccatgacgagtcagcaatattgaacaatgatgctacagtcaaggatatggagggagccgcggtggcatatgttgctgacatgttttcaacaccggcaatctttgtgaaagctgtgactgatattgttgatggggagaaaccaacagccgaggagtttctgcagaacctggttgctgtgacagcagctctggacaaggcagttacagaagtggttgatttcatcagtgggaaatgcatatcggatctttgaatgatgaagcttagaaacctgttcatcaaatccaagctctgctgcttcaatgcactatactatactacatcactgctgtatgatttttcatggggatgcgtatacaatttttaggttcccctgaggccctgatcccccgtatgtacaaaattcttggcaattacttggatcaatagcgtggaattttgtagaatattctgcaaaatgtgcagtgtaatgaaactaaataaggtgatattctgtcaaactaagataagtggtgggcggtggagttattttcttaatagagcattgagaccatcttcattgtttgctctacgattggtaaactgtgaaaaaaaaaacccgaagaagcaataaacatagtttacgtgtaaaaaaaaaaaaaaaa

SEQ ID NO: 1882 - DNA, 877 bp, Oryza sativa Indica Group
cgccctccgactccgacgactcggccccgatccccgccggcgccatctccaagctcctcatcgtcatagcgatgcagacggaggcgctcccgctcgtcaacaagttccacctcgtcgaggcggaggaatccatatttcctacaggtgccccatggattagataccatggcaactacaaaggccttcacgttgaccttgtatggcctggaaaagatcctgttctcggagttgactgtgttggcacggtatcagcagcacttgtgacttatgcttctattcagtcattgaagccagatctgatcatcaatgctggcactgctggtgggtttaaggccaaaggagcagacattggagatgtctacttagcatccgatgttgcattccacgataggagaatacctatccctgtcttcgacatgtatggaattggaacacgaaaaacatttgctacccctaatatattgaaggaactcaatttgaaggttgggaagctctcaactggcgattctctagatatgtctccccatgacgagtcagcaatattgaacaatgatgctacagtcaaggatatggagggagccgcggtggcatatgttgctgacatgttttcaacaccggcaatctttgtgaaagctgtgactgatattgttgatggggagaaaccaacagccgaggagtttctgcagaacctggttgctgtgacagcagctctggacaaggcagttacagaagtggttgatttcatcagtgggaaatgcatatcggatctttgaatgatgaagcttagaaacctgttcatcaaatccaagctctgctgcttcaatgcactatactatactacatcactgctgtatgatttttcatggggatgcgtata

SEQ ID NO: 1883 - DNA, 1196 bp, Hordeum vulgare subsp. vulgare
gataaggaagcgaaccgcgggtttggcacctcctcgcccgccgccgccgccgtcgccgtcgccgtcgccgaccagatcccgcgccgccgcagccccgctcctccggccatggcgccaccctcctccgaagagccggccgccgcctccgccgaggcctccgcagccggcgccatctccaaggtcctcgtcgtcatagcgatgcagacggaggcgctcccgctcgtcacccggttccagctcgtcgaggcggccgccgacgagtccatatttcctaaaggtgccccatggactcggtaccatggcgaatacaaaggcctccacattgaccttgtatggcctggaaaagatcctctgctcggagtggacagtgtgggtacagtatcggcagctctggttacttatgcttctatacagttgttgaagccagaccttatcatcaacgctggtactgctggcggtttcaaggccaaaggagcaggtattggggatgtcttcttggcttcagatgttgcattccatgacaggagaatacccattcctgtttttgacagttatggaattggagcgagaaaaacatttgaaaccccaaatatagtgaaagaactcaatttgaaggttgggaagctgtcaactggtgattctctagatatgtctcctcatgatgagtcagcaatactgagcaatgaagctacagtcaaggatatggagggagcagcggtggcttatgttgctgacttgttctcaacacccgctatctttgtcaaagctgtgaccgacattgttgatggggagaagccaacagccgaggagtttctgcaaaacctgatctcggtgacgatggcgcttgaccaggcagtcttgcaggtggtagacttcatcagtggcaaatgtatctctgatctctgaacgcccaaccttccgctatgctgttctgggttccacaaatcgagggagcctgaatatatattgttggatgtataatgtttccctggggattccacccaggttttacattcccgtgacccccttgtaaaaaattcttggcgattactccgagccattttatgggattttgtacaattttacaaactatgcagcttagtgaggctcggctcaataaggtggtgtattgttgtactggaataaatgatgggcactggaactcccatggattcagcacaatggttgatggatgc

SEQ ID NO: 1884 - DNA, 4086 bp, Zea mays subsp. mays; identical to SEQ ID NO: 1840

SEQ ID NO: 1885 - DNA, 3129 bp, Zea mays subsp. mays; identical to SEQ ID NO: 1839

SEQ ID NO: 1886 - DNA, 1469 bp, Zea mays subsp. mays; identical to SEQ ID NO: 1841

SEQ ID NO: 1887 - DNA, 1602 bp, Sorghum bicolor; identical to SEQ ID NO: 1842

SEQ ID NO: 1888 - DNA, 1288 bp, Hordeum vulgare subsp. vulgare
gatggactgggatctcaagatgccgcccggcgcatgggacctcgccgacctggagagcgacgccgcgccggcgccggccggtggcattgctaatgcggagtgctccgtggacctgaagctcggcgggctcggcgagtgcggcgctgccccggacacccgcggcctcggcaaagcgccggccgaggcggcggcgtcgcccagcgcggccaagcgcccgcgcgcgtcgtcgggaggcggcgcggggcagcaccagcagtgcccgtcgtgcgcggtggacgggtgcagggccgacctgagcaggtgccgcgactaccatcgccgccacaaggtgtgcgaggcgcactccaagacccccgtcgtcaccgtcgccggccgcgagatgcgcttctgccaacagtgcagcaggtttcacctgcttacggagtttgatgaggccaaacgcagctgtagaaagcgtcttgatgggcacaaccgtcgccgcaggaaaccgcagccggatccgatgaattctgcaagttttatgacgagtcaacaaggaacaaggtttccatcatttccaactccaagaccggagcaaaactggccagggatcattaaaactgaggagaacccctattacacacatcagctccctctaggcatcagtaacaggcatcattttggtggctctacatctactttcgcgaaagaaggacggagatttcctttcctacaggagggcgaaataaactttgccaccggtgtggcacttgagcctgcagtgtgccagccgctgctcaagacggtagctcctcccgagagcagcagcagcagcagcaagatgttctccgatggtctgactccggtgctcgactcggactgtgctctctctcttctgtcagctccggcaaattcctccggtatcgatgttggccagatggtccaacagactgaacacatccccattgcccaacctctgttctccaacctgcagcaattcagcagctcgtcctggttctcgcgcacccaggcttccaccggcaccgtctcagcgaccggattttcctgccccgtggtggaaaatgagcagctgaacaatgtcctaacctcggacaacaatgacttgaactacaatgggatttttcatgtcggaggcgaaggctcctcagacggcgctccgccatctctgcccttcccgtggcagtagttttcagtggctgttcatgtgttgcttacagtagagcgcatcttttctccctagtgatcaacatttgcttctgttcaatctgaatcattcctttcacttgtg

SEQ ID NO: 1889 - DNA, 1869 bp, Sorghum bicolor
gcagaggtggacgaggcgcgccaccggccgagccgaatcgagcagcagcagcagcagcagcgccctcccaccttgccatggcgacgcaggctgctttcctcgcggggttatcgcagctcgccgcacagccgggccgggaccgcgccgtggcgccggcgcgggtggccgtggcggcggtgggtgtgggtagcgccaaggtgggtgtgcgggtgggcgtgaaggcggggaccgccgaggccaaagcggtggcgcagcgccgcggggtgcggtgccgggccagcctgatcgagcccgacggcgggcggctggtggacctggtggcgcccgaggagggcgggcggcgcgcggcgctgcggcgggaggcggccgagctgccgcaccgcctgcgcctcagccgcgtcgacaaggaatgggtccacgtcctcagcgaagggtgggcgagcccgctgcaagggttcatgcgcgagcatgagttcctccaagcacttcatttcaatgccatccgcggcgcggatggcaggatggtcaacatgtccgtccccatcgtgctctcccttggggacgcacagcggagggccatccaggccgacggcgccacgcgcgtcgcgctcgtcgaccaacgcgaccgccccatcgccgtcctcagcgacatcgagatctataagcataataaggaagaaagaatagcaaggacatgggggacaactgcacctggattaccttatgtcgaggaggcaattaccaatgctggtgactggttgattggtggggacttggaggttatagaaccaatcaagtacaatgatggtctagatcagtatcgcctgtctccagcacagctgcgtgaagagtttgccaggcgcaatgctgatgcggtatttgcctttcagcttcgcaatcctgtacacaatgggcatgctctgcttatgaccgacacacgtaaacgcctccttgagatgggttataaaaatcctgttcttctgctccatccactgggaggattcacaaaagcagatgatgtgcctcttagttggagaatgaagcaacatgagaaggttcttgaggaaggtgtcctcaacccagaatcaactgttgttgcgatctttccctctccaatgcattatgctgggccaaccgaggttcagtggcatgctaaggctcgtattaatgctggcgcaaatttctatattgttggaagggatcctgctggtatgagccatcccacagagaaaagggacctctatgatgcggatcatggaaagaaggttttgagcatggctcctggtcttgagaggctcaacatccttccattcaaggtggctgcatatgacacaaagcaaaagaaaatggatttctttgatccatcaaggaaagatgatttcctcttcatctctggcacaaagatgcgcactcttgccaagaaccgcgagaatcccccagatggttttatgtgcccgggtggctggaaagtactcgttgaatactatgacagcttggtgccatctgagggcagcagcaagctgcgagaaccagttgcagcctaaaatctgggaagtgcttcagataaggaatcctattatatcagcgcaagcggttctttgcgacatagaaccgatgttatatgattgtataccggctgtaagacttaaaaacactgggcttggttcggacgttaatgtgtgcttttgtgactggtgtgccctatctgctggcagtgctgcacatgcagtagagcacatcaaatgtttggtgttaataaggacaggctatgtatcgtctgccagattgtacatatacattgtggtgatataattaaaaccctgtcttctgccgttcaggctccgtaatgatgaccctgttttatcacta

SEQ ID NO: 1890 - DNA, 1824 bp, Zea mays
gctaagccgaatcgagcagcagtagccaccttgccatggcgatgcaggctgctttcctcgcggggttctcgcagctcgccgcgcagccgagccgcgactgcgccgtggcagtggcgccgacgcgggtggccgttgctgcggtgggtagcgccaaggtgggcgcgcgggtaggcttgaaggcggggatcgccgcgcccgcgcccgcggcgggccgcggggtgcggtgccgcgcaagcctgatcgagcccgacggcgggcagctggtggacctagtggcgcccgaggagggcgggcggcgcgcggcgctccggcgggaggcggcggaactgccgcaccggctgcgcctcggccgcgtcgacaaggaatgggtccacgtcctcagcgaagggtgggcgagtccgctgcaagggttcatgcgcgagcatgagttcctccaaacacttcattttaatgccatccgcggccaggatggcaggatggtcaacatgtccgtccccatcgtgctctccgtaggggacgcacagcgaagggccatccaggccgacggcgccacgcgcgtcgcgctcgtcgacgaacgcgaccgccccatcgccgtcctcagcgacattgagatctataagcataataaggaagaaagaatagcacggacatgggggacaactgcacctggattaccttatgttgaggaggcaattaccaatgctggtgactggttgattggtggggacttggagattatagaaccaatcaagtacaatgatggtctagatcagtatcgcctgtctccagcacagctgcgtgaagagtttgccaggcgcaatgctgatgcagtatttgcctttcagcttcgcaatccagtacacaatgggcatgctctacttatgaccgacacacgcaaacgcctccttgagatgggttataaaaaccctgttcttctgctccatccactgggaggattcacaaaagcagatgatgtgcctcttagttggagaatgaagcaacatgagaaggttcttgaggaaggtgtcctcaacccagaatcaactgttgttgcgatcttcccctctcctatgcattatgctgggccaactgaggttcaatggcatgctaaggctcgtattaatgctggtgcaaacttctatatcgttggaagggatcctgctggtatgagccaccccacagagaaaagggacctctatgatgctgatcacggaaagaaggttttgagcatggctcctggccttgagaggctcaacatccttcctttcaaggtggctgcgtatgacacaaagcaaaagaaaatggatttctttgatccatcaaggaaagatgatttcctgttcatctctggcacaaagatgcgcactcttgccaagaaccgagagagtcccccagatggttttatgtgcccgggtggctggaaggtactcgttgaatactatgacagcttggtgccatctgagggcagcagcaagctgcgtgaaccaattgcagcctaaaatctggaaaatccttcatataaggaatgctactatatcttagcaagcggttctttgcgacatagaaccgatgctatatgattgtatactggctgtaagactgtaaaacactaggcttgattcggatgttaatgtgtgctttgtacccggtgtaccttctctgctggcagtgttgcacatgcactggagcacatcaaacgtttggtgttaataaggacaggctatgtatcctctgccagattgtacatatatacattgtggtgatatataattataaagctgacctctgccgtccgggctcgtagtgatgaacagttttatcact

SEQ ID NO: 1891 - DNA, 1878 bp, Zea mays
ccgcctttcacaaaaccaaacaaaacgcacccgcaatataaagaggagaccaaggcgtgaagtggaggaggcagaggtggacgaggcgcgccaccgcccgagccgaatcgagctgcagaaaccaccttggcatggcgacacaggccgctttcctcgcagggttctcgcagctcgccgcgcagccgggccgcgaccgcgccgtggcggtggcggtggcgccggcgccgggcccggcccgggtggccgttgcggcggtgggtagcgccaagttgggcgtgaaggcggggacgtccaggaccgcggcggtggcgcgcctcggggtgcggtgccgggccagcctgatcgagcccgacggcgggcggctggtggacctggtggcgcccgaggagggcgggcggcgcgcggcgctgcggcgggaggcggcggagctgccgcaccggctgcgcttgggccgcgtcgacaaggaatgggtccacgtcctcagcgaagggtgggcgagcccgctgcaagggttcatgcgcgagcatgagttcctccaagcacttcatttcaatgccatccgcggccaggatggcaggatggtcaacatgtccgtccccatcgtgctctctgtcggggacgcacagcgaagggccatccaggccgacggcgccacgcgcgtcgcgctcgttgacgagcgcgaccgccccatcgccgtcctcagcgacattgagatctataagcataataaggaagaaagggtagcacggacatgggggacaactgcacctggattaccttatgtcgaggaggcaattaccaatgctggtgactggttggttggtggggacttggaggttatagaaccaatcaagtacaacgatggtctagatcagtatcgcctgtctccagcacagctgcgtgaagagtttgccaggcgcaatgctgatgcagtatttgcctttcagcttcgcaatcctgtacacaatgggcatgctcttcttatgaccgacacacgcaaacgtctccttgagatgggttataaaaaccctgttcttctgctccatccactgggaggattcacaaaagcagatgatgtgcctcttagttggagaatgaagcaacatgagaaggttcttgaggaaggtgtcctcaacccagaatcaactgttgttgcgatctttccctctccaatgcattatgctgggccaactgaggtgcagtggcatgctaaggctcgtattaatgctggtgcaaatttctatattgttggaagggatcctgctggtatgagccatcccacggagaaaagggacctctatgatgctgaccacgggaagaaggttttgagcatggctcctggcctcgagaggctcaacatccttcctttcaaggtggctgcatatgacacaaagcaaaagaaaatggatttcttcgatccatcaaggaaagatgatttcctcttcatctctggcacaaagatgcgcactcttgccaagaaccgcgagagtcccccggatggttttatgtgcccgggtggctggaaagtgctcgttgaatactatgacagcttggtgccatccgagggcagcagcaagctgcgcgagccagttgcagcctgaaatatgggaagcgcttcagataaggaaccgtactatgtcagcacaagcggttctttgcgacatagaaccgttgttgtatgattgtatactggcttgtaagacttaaaaacactgggcttgatttggacgttaatgtgtgcattgtaactggtgtgccctatctgctgacagtgttgcacatcacatgtttggtgttaataaggacagactatgtatcatctgccagattgttgtacatatacattgtggtgatataaacatgaagctgtcttctgct

SEQ ID NO: 1892 - DNA, 1795 bp, Zea mays
gaatcgagcagcagtagccaccttgccatggcgatgcaggctgctttcctcgcggggttctcgcagctcgccgcgcagccgagccgcgactgcgccgtggcagtggcgccgacgcgggtggccgttgctgcggtgggtagcgccaaggtgggcgcgcgggtaggcttgaaggcggggatcgccgcgcccgcgcccgcggcgggccgcggggtgcggttccgcgcaagcctgatcgagcccgacggcgggcagctggtggacctagtggcgcccgaggagggcgggcggcgcgcggcgctccggcgggaggcggcggaactgccgcaccggctgcgcctcggccgcgtcgacaaggaatgggtccacgtcctcagcgaagggtgggcgagtccgctgcaagggttcatgcgcgagcatgagttcctccaaacacttcattttaatgccatccgcggccaggatggcaggatggtcaacatgtccgtccccatcgtgctctccgtaggggacgcacagcgaagggccatcctggccgacggcgccacgcgcgtcgcgctcgtcgacgaacgcgaccgccccatcgccgtcctcagcgacattgagatctataagcataataaggaagaaagaatagcacggacatgggggacaactgcacctggattaccttatgttgaggaggcaattaccaatgctggtgactggttgattggtggggacttggagattatagaaccaatcaagtacaatgatggtctagatcagtatcgcctgtctccagcacagctgcgtgaagagtttgccaggcgcaatgctgatgcagtatttgcctttcagcttcgcaatccagtacacaatgggcatgctctacttatgaccgacacacgcaaacgcctccttgagatgggttataaaaaccctgttcttctgctccatccactgggaggattcacaaaagcagatgatgtgcctcttagttggagaatgaagcaacatgagaaggttcttgaggaaggtgtcctcaacccagaatcaactgttgttgcgatcttcccctctcctatgcattatgctgggccaactgaggttcaatggcatgctaaggctcgtattaatgctggtgcaaacttctatatcgttggaagggatcctgctggtatgagccaccccacagagaaaagggacctctatgatgctgatcacggaaagaaggttttgagcatggctcctggccttgagaggctcaacatccttcctttcaaggtggctgcgtatgacacaaagcaaaagaaaatggatttctttgatccatcaaggaaagatgatttcctgttcatctctggcacaaagatgcgcactcttgccaagaaccgagagagtcccccagatggttttatgtgcccgggtggctggaaggtactcgttgaatactatgacagcttggtgccatctgagggcagcagcaagctgcgtgaaccaattgcagcctaaaatctggaaaatccttcatataaggaatgctactatatcttagcaagcggttctttgcgacatagaaccgatgctatatgattgtatactggctgtaagactgtaaaacactaggcttgattcggatgttaatgtgtgctttgtacccggtgtaccttctctgctggcagtgttgcacatgcactggagcacatcaaacgtttggtgttaataaggacaggctatgtatcctctgccagattgtacatatatacattgtggtgatatataattataaagctgacctccaaaaaaaaaaaaaaaa

SEQ ID NO: 1893 - DNA, 1790 bp, Zea mays
ggggtggacgaggcgcgccaccggccgagccgaatcgagctgcagaaaccaccttggcatggcgacacaggccgctttcctcgcggggttctcgcagctcgccgcgcagccgggccgtgaccgcgccgtggcggtggcggtggcgccggcgccgggcccggcccgggtggccgttgcggcggtgggtagcgccaagttgggcgtgaaggcggggacgtccaggaccgcggcggtggcgcgcctcggggtgcggtgccgggccagcctgatcgagcccgacggcgggcggctggtggacctggtggcgcccgaggagggcgggcggcgcgcggcgcttcggcgggaggcggcggagctgccgcaccggctgcgcctcggccgcgtcgacaaggaatgggtccacgtcctcagcgaagggtgggcgagtccgctgcaagggttcatgcgcgacgatgagttcctccaaacacttcactttaatgccatccgcggccaggatggcaggatggtcaacatgtccgtccccatcgtgctctccgtaggggacgcacagcgaagggccatccaggccgacggcgccacgcgcgtcgccgtcgtcgacgaacgcgaccgccccatcgccgtcctcagcgacattgagatctataagcataataaggaagaaagaatagcacggacatgggggacaactgcacctggattaccttatgttgaggaggcaattaccaatgctggtgactggttgattggtggggacttggaggttatagaaccaatcaagtacaatgatggtctagatcagtatcgcctgtctccagcacagctgcgtgaagagtttgccaggcgcaatgctgatgcagtatttgcctttcagcttcgcaatccagtacacaatgggcatgctcttcttatgaccgacacacgcaaacgtctccttgagatgggttacaaaaaccctgttcttctgccccatccactgggaggattcacaaaagcagatgatgtgcctcttagttggagaatgaagcaacatgagaaggttcttgaggaaggtgtcctcaacccagaatcaactgttgttgcgatctttccctctccaatgcattatgctgggccaactgaggtgcagtggcatgctaaggctcgtattaatgctggtgcaaatttctatattgttggaagggatcctgctggtatgagccatcccacggagaaaagggacctctatgatgctgaccacgggaagaaggttttgagcatggctcctggcctcgagaggctcaacatccttcctttcaaggtggctgcatatgacacaaagcaaaagaaaatggatttctttgatccatcaaggaaagatgatttcctcttcatctctggcacaaagatgcgcactcttgccaagaaccgagagagtcccccagatggttttatgtgcccgggtggctggaaggtactcgttgaatactatgacagcttggtgccatctgagggcagcagcaagctgcgtgaaccaattgcagcctaaatctggaaaatccttcatataaggaatgctactatatcttagcaagcggttctttgcgacatagaaccgatgctatgtgattgtatactggctgtaagactttaaaacactaggcttgattcggatgttaatgtgtgctttgtacccggtgtaccttctctgctggcagtgttgcacatgcactggagcacatcaaacgtttggtgttaataaggacaggctatgtatcctctgccagatgtacatatatacattgtggtgt

SEQ ID NO: 1894 - DNA, 1590 bp, Oryza sativa Japonica Group
gagagcaaatcgaggtagccatggcgatgcaggccgccttcgccgcctcgatgttcccgcagctggcgcagcggaggggaagcgatcgcgcggtggtggtggcgccgccggcgccggcgccggtgagggtggcgatgaggagcggtggggcggcggcggcggcggcgagaggggtgaggtgcagggcgagcctgatcgagcccgacggggggaggctggtggagctggtggtgccggaggagggagggcggcgggaggcggcgcggcgggaggcggcggcgctggcgcaccgggtgaggctggggcgggtggagacggagtggctgcacgtgctgagcgaagggtgggcgagcccgctgcgagggttcatgcgcgaggccgagttcctccaagcacttcatttcaacgccatccgcggcggagacggggccatggtcaacatgtccgtgcccatcgtcctccccctcggtgacgcccagcgccgcgccatcgaggcgtccggcgcccgccgcgtcgcgctcgtcgacgccgccgaccgccccctcgccgtcctcagcgacattgagatctacaagcataacaaagaagaaaggattgcacggacatggggaacaactgcacctgggctgccttatgttgatgaggcgattacaaatgctggtgattggttaattggtggtgacttggaggttatagaaccaatcaagtacaatgatggtcttgatcagtatcgcttgtctccagcccagctgcgtgaagagtttgccagacgcaatgctgatgcggtattcgcgtttcagcttcgcaatcctgtacacaatggacatgctttgctcatgactgatacacgcaaacgccttcttgagatgggttacaaaaatcctgttcttctgcttcatccattgggaggattcacaaaagcagatgatgtgcctcttagttggagaatgaagcagcatgaaaaggttcttgaggaaggtgtcctcaacccagaatcaactgtcgttgcaatcttcccctctccaatgcattatgcagggccaactgaagtgcaatggcatgctaaggctcgtataaatgctggtgcaaacttctacatagttggaagagatcctgctggtatgggccacccaactgaaaagagggacctgtatgatgctgatcatgggaaaaaggtgttgagcatggctcctgggcttgagaagctcaatatccttcctttcaaggtggctgcatatgacacaaagcaaaagaaaatggactttttcgatccatcaaggaaagatgatttcctgttcatctctggcacaaagatgcgtactcttgccaagaactgccagagcccccctgacggattcatgtgcccgggtggctggaaggtccttgttgaatactacgacagcttgacgccatcagcggacagcagcaaactgcgcgaggcggttgcggcctagaaagctgaaactacctcaaataagcaagaacattgcatcttgcaactgtaaaatggttctttcagagagagaaccaatggtatatgtgtatactactggtcgcaaggcctaaacatttgggtttgattggaagcgc

SEQ ID NO: 1895 - DNA, 1721 bp, Hordeum vulgare subsp. vulgare
gagatcgtcagcaagaagcatcagcactaccagccatggcgacgcaggccgccttcgcggtgaggttcccgcagctggcgcggcccagcagggggcagggacagccggcgccggcgccggcgcgggtcgcggtgaggggcgttggcagggccgcggcggcggcggcgcgcggggtgcggtgccgggccggcggcctgatcgagccggacgggggcaggctggtggagctggtggcgcccgaggagggcgggcggcgggcggcgctgcggcgggaggcggcggcgctgccgcaccgggtgcgcctgggccgcgtggacaccgagtggctgcacgtgctcagcgagggctgggccagcccgctgcgcggcttcatgcgcgagaccgagttcctccaagcacttcatttcaacgccgtccgcggcgccgatggcagcctcgtcaacatgtccgtgcccatcgtcctcgccctcgacgacgcccagcgccgcgccatccaggcctccgccgccaccagcgtcgcgctcgtcgacgcccacgaccgccccgtcgccgtcctccgcgatattgagatctacaagcataacaaggaagaaagaattgcacggacttggggaacaactgcacgtggactgccgtacgtagaggaggcgattacaaacgctggtgattggttgattggtggagacctggaggttatagaaccaatcaagtataatgatggcctggatcagtatcgtttgtctccagcacagctgcgtgaagaatttgccaggcgcaatgcagatgcagtgtttgcttttcaacttcgtaaccctgtgcacaatgggcatgcgttgctcatgactgatacacggaggcgtcttcttgagatgggctacaaaaaccctgttcttcttctccatccactgggaggattcacaaaagcagatgacgtgcctcttagtgtgagaatgaagcagcatgagaaggttcttgaggaaggtgtcctaaacccagaatcaactgtggttgcaatcttcccctctccaatgcactatgctgggccaactgaggtgcagtggcatgctaaggctcgtataaatgctggtgcaaacttctatattgtcggaagagaccctgctggtatgggccacccgaccgaaaagagggacctttatgatgctgatcatgggaaaaaagtactgagcatggctcctgggcttgagaggctcaatatccttcctttcaaggtggccgcatacgacacaaagcataacaagatgaatttcttcgacccatcaaggaaagaggacttcctgttcatctctggcacaaagatgcgcagccttgccaagaatcgcgagagcccacccgacggttttatgtgcccgggtggctggaaggtcctcgtcgagtactacgacagcttggcgcctccagaaggcagcagcaaactgcgagaggcggttgcggcttagaagctgaaagacgcctcggataagtagtaccgatgtatctcgtgtcatgaaccaatgatatatgattgtatattggtggtaagaatcgacatttgggcatgaaccccagcactccccgtgtggtttgtactgcatattagtatctgctagcagtgttaccccctggagcccatcatgtgcttgtggtgccaataaggatgggttttgtatcctctttgccagatctgtacataactacatatacaatattgtggtaatttatct

SEQ ID NO: 1896 - DNA, 4479 bp, Oryza sativa Indica Group
tccgtggctctctctctctccccgcaggaagcaaccaatgcttcttcttcaaatccctcgaaatccattcaaaatccgatattcttactccgattttaagcccttttgagtaggagcccatcccataggtatatttccttttttaggttttttctcgtgtttgcatttagttatttccatccttctaaattgcagtgaaaacatgtaacaaggaatcgaatatacttgaaccattcatatcttcaacacataaatcaagtccatcaaaaccattctaaaatggattcatccaaaccattcattactatgtagttttctaataataccatagatattttatctgatctttatccgtttagtaccaattttctaaatacaaacttgttatattcatcataaaccacaatagtcatgaaattaataaaacaataatcctaacacatggaaattttcttatcgaacacttgaaattatttgttaaaaggcatgaaataaatagggctagctgcattgtcaagccaataagccggacatttcagttggcacgccatggaccctgacgtggcaataagttatacgttggcgctgctagactttgtccacgccaactactgccatggggcacctttgccacgttaagaccgatggcatgatagagtaatttggccatgcaggttataatggtgtgaaagaaaaggtttatttttaaagattagttcatatgaagtctattattaaaattatttattaaaaagtagaaggggacacatacacacgccctagctcattccagatgatccgaaatagtactccacccaaacaaaccaaaaaaaaaactcaagttcgcaggagatccaaaccttaaacatgacacacaagttaatacgcctgcttggcagtagaccagtccaaatccaaccctgtcccccaaattaacaaaccccagaaatgcccccaaaagacaacaaagcattcaccaacccccccaaccttaatcagcatttgattttgatccatcttcatcaacccccactattaatcctcttccccttccccccgcttttccgtccatgttcaccccgcccccatgccccgcaatcccatccaggttcatccgcctccccgtcttcttttttttttcattcatccgcaacccactgcgaacttgcgaaggccgcgggtacaagaaaagaagagaaaaataaaaaggagccgcattataagtaggtagtggtggtggtggaggaggaggagagcaaatcgaggtagccatggcgatgcaggccgccttcgccgcctcgatgttcccgcagctggcgcagcggaggggaagcgatcgcgcggtggtggtggcgccgccggcgccggcgccggtgagggtggcgatgaggagcggtggggcggcggcggcggcggcgagaggggtgaggtgcagggcgagcctgatcgagcccgacggggggaggctggtggagctggtggtgccggaggagggagggcggcgggaggcggcgcggcgggaggcggcggcgctggcgcaccgggtgaggctggggcgggtggagacggagtggctgcacgtgctgagcgaagggtgggcgagcccgctgagagggttcatgcgcgaggccgagttcctccaagcacttcatttcaacgccatccgcggcggagacggggccatggtcaacatgtccgtgcccatcgtcctccctctcggtgacgcccagcgccgcgccatcgaggcgtccggcgcccgccgcgtcgcgctcgtcgacgccgccgaccgccccctcgccgtcctcagcgagtgagacacccccctaccccacctcttcttgtttcccttgtttagttagttgcatttccctgttcagacgcttaattgcaattatttggttactaggagtgcttgctagaagagtaaaattactaattacatgagtggatggaatgtagatatattgattgttcgtgttggttggttgattctcacagttgtgggatgcctttggacctccaaaagccgtaatttttgtgcttgggttggaaattggaattgtgggggttgtagcctgaagtgttcagagaagttcataggtggtttcttcaattggaaacataatatgcagaaatacagattatgagtgtttctgtgcagttcccacatttcgtgagcttatccctcacaaacttgtgctctggttatatttagccttatgctagtaacattgttcacagcaacctggtcaatgatatatcattcatggcggaggttttatcttgggcgttaaactaattttaaggttgtggcattcctcttttgtcgattagactacaatatcatcatgcggataacctttgtcatgctatatcaggaactcaggacatctttatacatctcggtcgttttcaggtcatatttttttgagtcgtatatatataatacgatgatcggtaatgtcattggtagtccttataaatacatgttccgtagttcttttgccgtgttctctaggtattttagttttatctatattaaactgacaagtgatattatatttgtttcgttgttttttcgccgcgttctatgggtattttagtttaagcaactgacacatgatataatttacatcagaaagattattttttattcaccatttgtttataaggttttgtacacatccagctattgtaagatgttgttatagaagtgacgtaacaacgtcaacgtttacatctgtgtctaagaactcctcaagtcatgtgtgttcaaaacaatccgacttgatttagcatggttttagttctttttaattagttataccatggcattccctgacatttttttcttctttgttgtcagcattgagatctacaagcataacaaagaagaaaggattgcacggacatggggaacaactgcacctgggctgccttatgttgatgaggcgattacaaatgctggtgattggttaattggtggtgacttggaggttatagaaccaatcaagtacaatgatggtcttgatcagtatcgcttgtctccagcccagctgcgtgaagagtttgccagacgcaatgctgatgcggtattcgcgtttcagcttcgcaatcctgtacacaatggacatgctttgctcatgactgatacacgcaaacgccttctcgagatgggttacaaaaatcctgttcttctgcttcatccattgggaggattcacaaaagcagatgatgtgcctcttagttggagaatgaagcagcatgaaaaggtacgctttaagagtagcaatcgtactgtcaaatctttttagcaaatgcatgttggtgccttgttgttgatgaaaccatttgatttaattacactactgtaaggcccaattcatgcacaattttgacgcgtgtttattttggtaggttcttgaggaaggtgtcctcaacccagaatcaactgtcgttgcaatcttcccctctccaatgcattatgcagggccaactgaagtgcaatggcatgctaaggctcgtataaatgctggtgcaaacttctacatagttggaagagatcctgctggtatgggccacccaactgaaaagagggacctgtatgatgctgatcatgggaaaaaggtgttgagcatggctcctgggcttgagaagctcaatatccttcctttcaaggtatgtcattctaccagaccagatatcacattttttggatgcactagattgtgtagttcgctagcttactgtccatcttgcacatttgaatttggatgtcaagcaacatattttagttttcagataaaccttgttgtattctttttcttggcatgaccctgatttgttttatcaggtggctgcatatgacacaaagcaaaagaaaatggactttttcgatccatcaaggaaagatgatttcctgttcatctctggcacaaaggtaacatccatttcaatcctgttttggtacaccagttaattttgagcaccaatgtttttttccagcccagtcctaacaacattgcctgtgttatatagatgcgtactcttgccaagaaccgccagagcccccctgacggattcatgtgcccgggtggctggaaggtccttgttgaatactacgacagcttgacgccatcagcggacagcagcaaactgcgcgaggcggttgcggcctagaaagctgaaactacctcaaataagcaagaacattgcatcttgcaactgtaaaatggttctttcagagagagaaccaatggtatatgtgtatactactggtcgcaaggcctaaacatttgggtttgattggaagcgcattctggtgttgatttgtatgttgccctatcatctggtaatgctacattggaagctcatcatgctgttggtgttaataaggatgacctttgtgttgctctgctagatatgttcatatacaatgttggtggtatttatatagtgcttggtgtgtttgctattata

SEQ ID NO: 1897 - DNA, 1954 bp, Sorghum bicolor
atgtccctcgcgagtgcgggtgcggccgcggcgcgcaagcccgccgcggcgtggcggcgcccgggcggtgtcggcggcgggcgcggcgtgggagtggcgcggaggcgcgccgtggccgccgccgcggcgctgctcctcgcgctcgtctacgccgcggggctgctcgtgttcctcctcggcgggaggctctccggcggcggagcgacggcgggaggcccgggccccgcggcggtgacggtggcgtcctccctccgccgccgcacccgccccgtggatggggagccacctcatgctcaactccggttaatgacatcacattaccagaattctggggacccatggatgccttgtgtcaacagtaggctgactcgatcagagttgccaccctcaaatggctatctcatgatagaagcaaatggtggtctaaatcaacaacggctttctatctgcgatgctgttgctgtggccagcttgcttaatgcaactcttgtgatcccaacatttcatctgaatagcgtctggcgtgatcctagcaaatttggtgatatatttgatgaagatcatttcattgagacactcaaagaacatgtaagagttgtgaagaaacttcctgaagatgttttgctgcgcttcaatcataatatcagcagcataccaaatatgagaactaaagcctattcatctccaaaccactatgtgcaaaatgttcttccaaaactgctggagttaggggttgtgcgcatagccccattctcaaacagattagccctgtcagttccattgaacatccaggccttgaggtgtttggtaaactaccatgcgttaagatttgctgaaccaataagaattctctcagatgacttggttggtcgaatgacaaaaaagagtttgttgactggtgggaagtatgtctcagtgcatcttcgctttgaagaggatatggtagccttttcatgttgtacatatgatggtggctggagggagaaaactgaaatggacaatgctcgcgaaaggagctggagagggaagtttcgtcggcatggtcgagtgataaaccctgaggcaaacagaagggatggaaagtgtcctcttactcctttagaggttggcatgatgctacggggcatgggatttgacaatacaacctccctatatgttgcttcgggtaaaatatacaactctgaaaaatatatggctcctcttcgccagatgttccctcttttaacgacgaaggattctcttgctttgcctgaagaacttgctcagttcaaggggcactcatctcagctagcagcgttagattacactgtctgcgttcagagcgaagtgtttgtgacaactcaaggggggaacttccctcactttctgatggggcacagacgctacctgtttggggggaatgcgaagacaataaaaccagacaaacggaagctggtcttatcttttgatgatcccaatatcagatgggatcagttcaagcagaacatgcaggaaatactgcatcacagcgacatgaagagcattgcattcaggaaaccaaacgattcggtgtacacgttcccaatgcctgaatgcatgtgtcagcaagatgggatgatataggcctgacagaataaacatgaggcaaatccttttgtgttttggttttgagactgataccacacagataggtaggtgtaggcaggtaacttgtacattcataataacctgtaggtagtgtcaccatatgcttgaaagactgaccagggattcgctgattcatgttggttccactattctagggtggtctatggaggacatacagttgggggttgggttgggctgggccgtggatgttgacatcaatcacaacacttggacttgagagagggcttctgacaaaatgagaccctaccttcttgattgtatatgtaaaggggatgcctaactacaaaggggaaaaagactttctgat

SEQ ID NO: 1898 - DNA, 1921 bp, Oryza sativa Japonica Group
cggtggcgctgtacgcgcgtgggggtggctgcggcgcgaaggcggccgcagcgcggcgctcggggcgcggcggtggtgggcggaggcgcgccgcggtcgtgctgctgctcgcgctggcgtacgtggcggggctgctcgtgttcgtgcttgcgggaggcggtggtgttggagttggagggcgcgtggaggtggggcgagaggtgggggtgatgacggtggcctcgctccggaggcggcgcgccgcggcggcggcggcgccgcagcccgggtcggtgtaccgcagccacctcgtgttcgagcggctctggccggacatccgcgacgacgccagctccgcctccgccgccgcctcgtcgctctcctccacttcttggcgtcgcagcatgttgatgacatcgcactatcagaatcctggggagctatggatgccttgtgtcaacaggaagctgattcgaccagagttgccaccttcaaatggttatctcatgatcgaagcgaatggtggtctgaatcaacagcgtctttcgatctgtgatgcagttgctgtggccagtttgcttaatgcaactcttgtgatcccagcatttcattttaatagtgtttggcgtgatcatagcaaatttggtgacatctttgacgaagaccattttattgagacactcaaagaacatgttagagttgtgaaggaattacctgtagatgttttgacgcgcttcgatcataatatcagcagcataccaaatatgagaactaaggcctattcatctccaaatcactatatgcagaaggtgcttccgaaattgctggagttaggggctgtgcgaattgccccattctcaaatagactggcacaatcagttccatcaaatctccaggccttgagatgttttgttaactaccaagcgttgagatttgctgagccaataagagttctcgcagaggatatggttgaaaggatggtaaaacggagtactttgactggtgggaagtttgtatcagtacatcttcgcttcgaagaggatatggtagctttttcatgctgtacatatgatggtggcttgaaggagaaaactgaaatggaaaatgctcgtgaaagaagctggagaggaaagtttcatcggcatggtcgagtgatcaatcctgaggcaaacagaagagatggaaaatgtcctcttactcctctagaggttggtatgatgctgcggggcatgggatttgacaataccacctccctctatgttgcttctggtaaaatatacaatgctgaaaaatacatggcaccgcttcgacagatgttccctcttttggcaacaaaggatactcttgctttgcctgaagagcttgctgagtttgaggggcactcatctcgattagcggcattagattactcggtctgtcttccgagtgaggtctttgtgacaactcaaggtgggaacttccctcactttctgatggggcacaggcgctacctgtttggcgggaatgcaaggacaataaagccagacaaacggaagctggttttatctttcgatgatccgaatatcagatggaatcggttcaagcgccacatgcaggatatactacaccatagtgacatgaggggcactgcattgaggaaacccaatgattccatatacaccttcccaatgcctgaatgtatgtgccagcaagatgggatgatgtaggccttgtatgattcatgcacatacgtcgaggaggaggaaatatgcaattttgtacactctgtaatgatctgtaggtagccaccaccaccgtacagaagcaatctttggccgggaatttgttgatttctgtctgtagattgtagagagaggagaggtgaaaattggttctggttgtagatatgatgaaacacatgctgttgacaagggacagcctgccctgtaaatgtatatgcagt

SEQ ID NO: 1899 - DNA, 1878 bp, Zea mays; identical to SEQ ID NO: 1891

SEQ ID NO: 1900 - DNA, 1790 bp, Zea mays; identical to SEQ ID NO: 1893

SEQ ID NO: 1901 - DNA, 1824 bp, Zea mays; identical to SEQ ID NO: 1890

SEQ ID NO: 1902 - DNA, 1795 bp, Zea mays; identical to SEQ ID NO: 1892

SEQ ID NO: 1903 - DNA, 1869 bp, Sorghum bicolor; identical to SEQ ID NO: 1889

SEQ ID NO: 1904 - DNA, 1721 bp, Hordeum vulgare subsp. vulgare; identical to SEQ ID NO: 1895

SEQ ID NO: 1905 - DNA, 1590 bp, Oryza sativa Japonica Group; identical to SEQ ID NO: 1894

SEQ ID NO: 1906 - DNA, 4479 bp, Oryza sativa Indica Group; identical to SEQ ID NO: 1896

SEQ ID NO: 1907 - DNA, 1931 bp, Zea mays
cgactacctctcttttttttctctccctggtggtggtgaaaagacacgagcgtcgtgccaccgctgatctacgctgtgatggggacatcgagggagatcgccatcgggccagtcgccgtcgtctcgctgctgctgtcctcgatgatccagaaggtcgtcgacccggccgccgacccggcgacctacaggtcgctcgtcttcacggtgactttcctcgccggggtcttccaggtctccttcggcctcttcaggctggggtttctcgtggatttcctgtcgcacgctgccatcgtggggttcatgggcggggcggccatcgtgatcgggatgcagcagctcaaggggctgcttggcctcgcccatttcaccaacagcaccgatgttgtttctgtcctcaaggctgtctgctctgcgctacgacatgacccgtggcacccgggcaacttcctcatcggatgctccttcctcatattcatcctcaccacacggttcatcgggaggaggtacaagaagctgttctggctgtcagcgatctcgcctctgctgtcggtcatcctgtccaccgctgcggtctacgcgacaagggctgacaggcacggcgtcaagatcatccagaaggtgcacgcgggcctaaacccaagctccgtgaagcagatacacctcaacgggccgcacacaacggagtgcgccaagatcgccgtcatctgcgcagtcatcgccctcacggaagctatcgccgttggccgatctttcgcctccgtaagagggtacagactcgacggcaacaaggagatgctggccatggggttctccaacgttgctggttctctgtcctcgtgctatgtggcaacaggttcgttctcccgaacggcagtgaacttcagcgcgggggccaggtcgaccgtttcaaacatcgtcatgtccatcaccgtgttcgtcaccctggagctgttcatgaagctcctctactacacgcccatggcggtgctcgcctccatcatcctgtcggctcttccgggactgatcgacatcaaggaggcctgcagcatatggaagatcgacaagatggatttcctcacctgcctcggtgcgtttgttggcgtcctgtttgggtcggtggagattgggcttgcagttgcacttggcatttccttcgcaaagatcatcatacagtcgcttcggcctcaggtggagatccttggcaggctacaagggacagatatcttctgcagcgtcaggcagtaccctgtagcctgcctaactccgactgtactgcctatacgcgtcgacacatccttcctctgcttcatcaacgccacttccgtcaaagaaaggatcacagagtgggtttgggaaggagtggagacctcaaatggaaaagcgagggagaggatacaagcagttgtccttgatatgtcaagtgtggtaaacatcgacacttcaggactcactgcactggaagaaatacacaaggagttggtgtctcttggcttacagatggctatagccagtccgggatggaaggcagttcagaagatgaaagtgtcacaggtggtggacagggtaggacaggactggatcttcatgacagtaggtgaagcggtggaggcctgtctagctgctcataagggcacagctctcgcatgttgagtatgcgttaattactactattagtactcctaaggataatcccataagcgatgcggttatttgcatcctatgaaggtgttactggaaatgcttacgaaacagaaatgcatggtttgcacatgatggaggcaaaatacctatggtatgacttgactggagtggtcgtggcgagaaacaaacctgctctgggaaggacattccttgagctccacaaaaacatgtatggtgatatcttgatgatgtgtaactgtacttagtaagtaaacaagtctttttgtttt

SEQ ID NO: 1908 - DNA, 2609 bp, Sorghum bicolor
aagtgagcatttcctctccctctccggggcggggctcatccatgcacgggggcgggatgggtgtcttcttcctctaaccggccggcctcttgccaagagaatcatatcgccgtccatgcatatatgtgatatccgtctcccagggccggtgatgtttacacgagaggaggaattctagcctgcctcttcctctgatcgttgtcagcaagattctccgtccaaccgccagaaccaaaatcccttttaaagcaagggagctcccagctcccgagtttccccaaacacttcatttcagccttcagctatggaggcatcatcggcatcagcggtcgagtcgaccgccaccgtgtccgtcttcgatgtatcatccaacaagcagcgcccagacacggcgaagctcgtgctgaacagccccagcccgccgagcctgcgcgaggagctcgtcggcgtggtcggcaaggcgttccggccacggccccccggcggcggtggccgggcgccgcgctgcccgtggatcctcacggcgctgcagtgcgtgttcccggtcctgcagtgggggaggacctacaccctcaagtccttcaggagtgacgtcatggccggcctcactcttgccagccttggcatccctcagagcattggatatgccaacctagccaaactggaccctcagtacggtctttacacaagtgtcgtgccaccgctgatctacgctgtcatggggacatcgagggagatcgccatcggcccagtcgccgtcgtctcgctgctgctgtcgtcgatgatccagaaggtcgtcgacccggccgccgacccggcaacctacaggtcgctcgtcttcacggtgactttcctcgccggcgtcttccaggtctccttcggcctcttcaggctggggtttctcgtggatttcctgtcgcacgctgccatcgtggggttcatgggcggggcggccatcgtgatcggactgcagcagctcaagggcctgcttgggctcagccatttcaccaacagcaccgatgttgtttctgtcgtcaaggccgtctgctctgcgctacatgacccgtggcacccgggcaacttcctcatcggatgctccttccttatattcatcctcaccacacgcttcatcgggaggaggtacaagaagctgttctggctgtcagcgatttcacctctgctatcggtcatcctgtccaccgctgcagtctacgcaacaagggccgacaagcacggcgtcaagatcatccagaaggtgcacgcaggcttaaacccaagttcagccaagcagatacacctgaacgggccgcacgccacggaatgtgccaagatcgccgtcatctgcgcagtcatcgccctcacggaagctatcgccgttgggcgatctttcgcctcggtaagagggtacaaacttgacggcaacaaggagatgctggcgatggggttctccaacgttgctggatctctgtcctcgtgttatgtggcaacaggttcattctccagaacggcagtgaacttcagcgcgggcgccaggtcgactgtttcgaacatcgtcatgtccatcaccgtgttcgttgccttggagttgttcatgaagctcctctactacacacccatggcggtgctcgcctccatcattctatcagctcttccggggctgatcgacatcaaagaagcttgcaacatatggaaaatagacaagatggatttcctcatctgccttggtgcatttgttggtgtcctgtttgggtcggtggagattgggcttgcagttgcacttgccatttccttcgcaaagatcatcatacagtcaattcgacctcaggtagaggttcttggcaggctacaagggacaaacatcttctgcagcgtcagacaataccctgtagcttgccaaactccgactgtgctaccgatacgcatggacacatccttcctctgtttcatcaatgccactttcatcaaagaaaggatcatagagtgggttcgggaagaagtggagaacccaaatggaaaagcgagagagaggatacaagcagttgtccttgatatgtcaagtgtggtaaacatcgacacttcaggactcactgctctggaagaaatacacaaggagttggtgtctcttggcatacagatggctatagccagtccaggatggaaggcagttcagaagatgaaagtgtcgcgggtggtcgacagagtaggagaagattggatcttcatgacagtaggtgaagcagtggaggcctgtctagctgctcataagggcacagctctcgaatgttgagcatgcgcttaattagcactccactattagtactgctaaggataatcccataagcgatgcggctttgcatcctatgaaggtgttactgcaaatgcttacaaacagaaatgcatgtttgcacatgatggtgacgaagtacctatgagatatgactgaagtggtcgtggtgggaaacaatcctgctgtgggaagaacaatccttgagcttcacaagacatgttttggtgctatcttcatgatctgtacttgtacttagtttttcttttactgtttcttcctaaacaaagatgaaatcttgacctaataagaactaagtgagatt

SEQ ID NO: 1909 - DNA, 2564 bp, Hordeum vulgare subsp. vulgare
ggcacggccgcacacacgcatccccccgcctcctcctcctcctcctcccccgagagagagagagagagagcgaattttctctggaggccaggggctcatatgcgcgtgggtgtcgtctacctcctcccaagaatcacatcgctatccatgaggaccgtgactcgtcgccggtgatgtttacgccagaggaaaatctaaatctactaccagctgcgatcgtcggccgcgtcacctcaccctcgagagattctcccctccatctatccagcagctaggagccccctttaagtttaagaccgaggaaggaaggaggagttcccccaaacacttcagttaccgaccgaccgtccgccatggagtcgtcgtccgcgccagcagccctcgagacggccgtcacggtgccgtcgtcggcattcgacgtgtccaggcggcccgacacggccggcctcgtcctcaacagccccaggccgccgagcctccgcgaggagctcgtcggcgtggtcggcaaggccttccgcccgcgcggggccgggaccggcggtgccggtggtgaccgccggccgccgcggttcgcgtgggtcctgacggcgctgcaggccgtgttcccggtgctgcagtggggcaggacctacacgctcaagtccttccggagcgacgtcatggccggcctcacgctcgccagcctcgggatcccacagagcattggatacgccaatctagcgaagctggacccgcagtatgggctctacacgagcgtcgtcccgcccctgatctacgcggtgatggggacgtcgagggagatcgccatcgggcccgtggcggtggtgtcgctgctgctgtcgtccatggtgcagaaggtggtcgacccggccgtcgacccggtcacctaccgcacgctcgtcttcaccgtcaccttcctcgccggcgtcttccaggtctccttcggcctcttcaggctggggttcctggtggatttcctgtcgcacgcggccatcgtggggttcatgggcggcgccgccatagtcatcgggctgcagcagctcaagggcctgctcggcctctcccggttcaccaacagcaccgacgtggtcgccgtcgccaaggccgtcttctccgcgctccacgacccctggcacccgggcaacttcttcatcggatgctccttcctcatattcatcctcgccacgcgattcatcgggaggaagtacaagaagctcttctggctgtcggcgatctcgccgctgctctcggtcatcctgtccacggccgcggtctacgccaccaaggccgacaagcacggcgtcaagatcatccgcgaggtgcacgccggcctcaacccgagctccgtcaagctgatccagctcaacggcccctacaccaccgagtgcgccaagatcgccatcatctgcgccgtcatcgcgctcacggaagccattgccgtcgggcgatctttcgccacgatcagagggtacaagctcgacgggaacaaggagatgatcgccatggggttctccaacgtcgccggatctttatcctcgtgctacgtcgcaacaggttccttctcccggaccgcggtgaacttcagcgccggcgccaggtcaacggtctccaacatcgtcatggccgccacggtgttcatcgccttggagttcttcatgaagctcctctactacacgcccatggcggtgctggcttccatcatcctgtcggcgctccctggactgatcgacatcagagaggcctgcaacatatggagggtcgacaagatggacttcctcatatgcctcggcgcgttcctcggcgtgctctttgggtccgtggagatcggcctcggagtcgcgcttgccatatcgtttgcaaagatcatcatccagtcactccggcctcaggtggaggttctaggcaggctacaaggaacaaacatcttctgcagcgtcaggcagtaccctgtggcgtgccggacaccggccgtacaagtcatacgcatcgatacgtccttcctctgcttcaccaatgcaactttcatcaaagaaaggatcatggaatgggtaagggcagaagtggacacatccaatgagaaagtcagggaaagggtgcaatcagttgtccttgacatgtcaaacgtggtgaacattgacacttcaggacttgtggggttggaggaaatccacaaggagcttgcgtctctgggcatacagatggctattgctagtccaggatggcaggcaattcagaagatgaagctggcacacgttgttgacagaataggagaagactggattttcctgacagtaggcgaagcagtggaagggtgtctaactgcacacaagggcagtgctatggagtgttgagtgtatgctagtagaaataacaccatcgtgctgtggatttgtacccagtgaatatgatttacacagctcagcaagtgcttacaaacagctacctactcagcaatgacagaacatgtatgtttccgtagaaatcgtacgcattaactgaagtggtatacagtcgtctttttgtgactatactcactcaaaatctatttctatttctattccacc

SEQ ID NO: 1910 - DNA, 2421 bp, Oryza sativa Japonica Group
aatcaaattcacctgaagcacctaaggttcacatggacttgccatcctcacagctcaccaatcttggaggcaccgatacattgtgatggaatttcagccatttcctcagggagttcacccaaacacttcagaaccagccatggagcccatggcaagtgagtcatctgtgcccatagggacagcttttgcagacttgctgctgcaagggccagagcacccaagcctgtggaatgatctcaccggcatgttcaggaaggcattccgttggcaaggtgcagacaagcgcttcacactgtctgtgtatgtgatgtctgttctacagggtctgtttccaatacttgactggtggaaaacctacaatctgaaattctttcgaagtgacctcatggctggcctaactcttgcaagccttagcattccacagagcattggatatgcaactctggcaaaactggatcctcagtatggtctttatacaagtgttgtgccacctcttgtatatgctgtgacggggtcctctagggagatagccattggaccagttgccattgtgtcattattgctttcatcaatgattcagaagatagttgacccatctgttgatccagcgttctaccgaaaaatggtctttaccgtgacattccttactggtgtctttcagtttgcatttggtctgttcagactgggatttcttgtggattttctatcacatgctgctatcgtcgggttcatgggaggagctgctattgtgattggattacagcagctgaaggggctgcttggacttagtcattttacaaatagaactgatgtcgtctctgtcaccaaggcagtctgggtttcagttcacgaaacatggcatccggagaacgtcttcattggatgttcctttttcatgttcattcttgccatgagattcattggaaggaagtacaagaaactcttttgggtctctgccattgcacctgtactatcagttgcactatctactctgtttgtctatgcgacaagagcggataagcacggcgtgaagattatacaaaaagtgaattcaggtattaatgcaagttctgtcgagcagatagatctcaaaggaggctatgctgccgaatgtgcaaagattgctcttgtttgtgctgtgattgctctgacggaagctgttgctgttggccgctctttttcagcgatcaatggatatcggttggacggaaataaggaaatggtagcaatgggcttcatgaatatagcaggatccttatcatcatgctatgtagcaacaggttcattctcgcgcacagctgtgaacttcgctgctggttgcaagacaaccgtttcaaacattatcatggctgccactgtgatggttgccttggagcttctcacaaagctcctgtactacacacctgtgtccatccttgcatcaatcattctgtcagctcttccaggattgatcaatgtgcaggaagtctgcttcctgtggaaagtcgacaagatggacttcctcacatgcatgggatcattccttggtgttctattcggatcagtggagattggtctttcagttgcacttcttgtttcctttgcaaagatcattatacagtcgatttggcctcaagtagagattcttgggaggcttcagggcacagaaatcttctgtaacgtcaagcagtatccagtggttcacgaaacaccgactgtactgaccgtacgcattgaaacatcattcctttgcttcgtcaactccagttccatcaaagaaaagatcatgggatgggtaaccgatgagcgcgaggcattttgctcggtcgttcttgacatgtcaaatgtggtaaacatggatacttcaggtcttgtggcgctggaagaactgcacaaggagctggcgtgtctcggcatccagatggctatagccaagcctggatggcaggtgatccacaagatgaaactggcacggctcgtcgacggaatcggagaaggatggttcttcctcacggtgggcgaagccgtggaagcttgcctggcaaacaaggcgggaaacgccctggaatgctgctgaatcgaatccaccgtgtgcatggtctctccggtggttgaataaagagagacactagtgcttcgtggtacgctacaaaaggattgtgttgtgtgctagtgctgcacgatgatgcagcttcagctgtagtgtggtgcttcatggattgtgcgacgtgcaactgttgggggaagacgaactgtgtctgtctgaacttagtatgccgagttcgtctaaattccccactatagctgtaggtttgtgatgtatcggatgcatttgtgaagagcaaatgccaggttttaagtgttggaactgatgattgtgtaatattattatattaatcgagtttgtataattaatttgtactcgagtttgtgcgttttggc

SEQ ID NO: 1911 - DNA, 1433 bp, Zea mays
agtttctctttcttcgtcccgtcaggaatgccctccttcctctgagatctcggagtcgccctcctcttgcccaagcccagaccgatcgaggaccagccctgcatccagatctatgttttttgtgcccctccacgtgatccctgctggcggaggtagcactgtgtgggagaatgacgcccccccacttcggcaatatggtcagcacggtcgcacccgtggtggcctggccacatctacaaagtcaggctcaccgtctcatcgatgacgatgaggtacaccgcggctaccgcgacgggttcatcctggtcgtcttcttcggcgacaagagcacgggtggttcgagcccggcgagctcgtccccttcgaggaccgcttcaccgagaaggcagcccacgccgaggccgtcgacaagcgacgtcattttcttccttgtcaatctcccggcattcgacaccaacgttgactaccaccgccaccagacccaggccgcgcggcaacgatttgtgcgcagaaggagctcgactaagtgcttaacgctgccatggctgatggctcaacgggacgcggcggaaaaggctgcacacaccgtgccagggatggagatgaccacgttgttctcagcgtaccgtcgcgcagtgttttcgcccatagaccacctacgcccaagcgttgggacttcggggtggatcccgagcttccgcttgctacggactagagagccacggcggcagagcgagctcaacaagaaccactttggggccaacagtgtcgtaacaagagggcccctatcgtgcccacctttgggcgtttcccggcgctcgtgggctaacacaagcgagccccttcactcgctctcaaaacccgggctgtgagaggaggggaaatctcacttataagctcaccacggccccctccggctagcgaggtggtactaaagccgggcgctaacggctaggctcctgacatcccatcccccttttcgggcggtatggcgactgtctgcctctgataccaattgtcagcgaccttcccggcctagcccactcaacgctacacctttgggcgtttcccggcgctcgtgggctaacacaagcgagccccttcactcgctctcaaaacccgggctgtgagaggagggaaaatctcacttataagctcaccacggccccctccggctagcgaggtggtactaaagccgggcgctcctccatattatgctgctaatataacatctagatatttttttactgtaagaaccctcagtgtaggctccaagcggtaagcaccactgcagtctgcagttaaaatgcgtgtttccctctacattgattatgcatctatttaaatttggcagtgttctgctcaacaaatctgcttaacatatcagcaacaataccgtctggaagacaatttctgcaaaaaaaaaaaaaaaa

SEQ ID NO: 1912 - DNA, 1420 bp, Zea mays
cgtcaggaatgccctccttcctctgagatctcggagtcgccctcctcttgcccaagcccagaccgatcgaggaccagccctgcatccagatctatgttttttgtgcccctccacgtgatccctgctggcggaggtagcaccgtgtgggagaatgacgcccccccacttcggcaatatggtcgcacggtcgcacccgtggtggcctggccacatctacaaagtcaggctcaccgtctcatcgatgacgatgaggtacaccgcggctaccgcgacgggttcatcctggtcgtcttcttcggcgacaagagcacgggtggttcgagcccggcgagctcgtccccttcgaggaccgcttcaccgagaaggcagcccacgccgaggccgtcgacaagcgacgtcattttcttccttgtcaatctcccggcattcgacaccaacgttgactaccaccgccaccagacccaggccgcgcggcaacgatttgtgcgcagaaggagctcgactaagtgcttaacgctgccatggctgatggctcaacgggacgcggcggaaaaggctgcacacaccgtgccagggatggagatgaccacgttgttctcagcgtaccgtcgcgcagtgttttcgcccatagaccacctacgcccaagcgttgggacttcggggtggatcccgagcttccgcttgctacggactagagagccacggcggcagagcgagctcaacaagaaccactttggggccaacagtgtcgtaacaagagggcccctatcgtgcccacctttgggcgtttcccggcgctcgtgggctaacacaagcgagccccttcactcgctctcaaaacccgggctgtgagaggaggggaaatctcacttataagctcaccacggccccctccggctagcgaggtggtactaaagccgggcgctaacggctaggctcctgacatcccatcccccttttcgggcggtatggcgactgtctgcctctgataccaattgtcagcgaccttcccggcctagcccactcaacgctacacctttgggcgtttcccggcgctcgtgggctaacacaagcgagccccttcactcgctctcaaaacccgggctgtgagaggagggaaaatctcacttataagctcaccacggccccctccggctagcgaggtggtactaaagccgggcgctcctccatattatgctgctaatataacatctagatatttttttactgtaagaaccctcagtgtaggctccaagcggtaagcaccactgcagtctgcagttaaaatgcgtgtttccctctacattgattatgcatctatttaaatttggcagtgttctgctcaacaaatctgcttaacatatcagcaacaataccgtctggaagacaatttctgctaatgccaactttttgatcctcc

SEQ ID NO: 1913 - DNA, 1420 bp, Zea mays; identical to SEQ ID NO: 1912

SEQ ID NO: 1914 - DNA, 1433 bp, Zea mays; identical to SEQ ID NO: 1911

SEQ ID NO: 1915 - DNA, 1622 bp, Sorghum bicolor
agatgccccccccttttttttttcctggtttctttccccttcgccaagcccgaacccggaaccctcgtctttaaatacgccctcggcccatcctccgcatcccccgtctccgtctgccaaaccattcctcccaacaacacccgccgcctcctgcaatcctcgtagcctccgtcgagcatcgatcatgtcggcctactgcggaaagtacaaggatgagctcatcaagaatgctgcctacattggcacccctggcaagggtatccttgctgctgatgagtccactggcaccattggcaagcgtctttccagcatcaatgtcgagaacgtggaggagaaccgccgtgccctccgtgagctccttttctgctgccctggtgccctccagtacatcagcggtgtgatcctcttcgaggagaccctctaccagaagaccaaggatggcaagccttttgtcgatgtcctcaaggagggaggcgtcctccctggcatcaaggtcgacaagggcaccattgaggttgctggcacggacaaggagaccaccacccagggccatgatgaccttggcaagcgctgcgccaagtactacgaggccggtgcccgctttgctaagtggcgtgctgttctcaagatcggccccaatgagccatcacagcttgccattgacctgaatgctcagggcctggctcgctatgccatcatctgccaggagaacggtctggtgccgattgttgagcctgagatccttgttgatggccctcatgacattgatcgctgcgcttatgtcactgaggtcgtccttgctgcctgctacaaggctctcaacgagcaccatgtcctcctggagggtaccctcctgaagcccaacatggtgaccccaggctctgactctaagaaggtgacccctgagttgattgctgagtacaccgtccgcaccctccagaggaccgtccctgctgctgtgcctgctgttgtcttcctctccggtggacagagcgaggaggaggccaccctcaacctcaatgccatgaacaagctcaacaccaagaaaccgtggtccctgtccttctccttcggccgtgccctccaggcgagcacactcaaggcctgggctggcaaggtggagaacatcgagaaggctagggcggccttcctcgccaggtgcaaggccaactctgaggctaccctcggcacctacaagggtgatgctgctgctgacaccgagagcctccacgtcaaggactacaagtactgagttgcttctctttgcgtgcccgttttggaactcctgcctacgagtaggttgctgagtgtggtttgctcgtttgagcttatattcggacaacaaaaaaaaacatgcttcctatgtggatgatggttatctttatattcgtatattaactagtctctttggtgttaaatttcgtgtaatatggtcctgccgatggagcatcgagcagcctcttttttttgttctatctactaatgctgtaatgctggttatgtatcggcaaaaaccattctatatgctgagttggagacagcaacctatgtggatcatattttgttgagacgaactcatgagagattttagacataataatagagtattggaagttatttcc

SEQ ID NO: 1916 - DNA, 1336 bp, Zea mays
cacctcgcctgcgatcttcgtagcctccgtcgcgtcgagcatcgatcatgtcggcctactgcggaaagtacaaggatgagctcatcaagaatgctgcctacattggcacccccggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggttgacaagggcaccattgaggttgttggcactgataaggagaccaccacccaaggccatgacgaccttggcaagcgttgcgccaagtactacgaggcaggtgcccgctttgccaagtggcgcgctgttctcaagattggccctaatgagccatcacagcttgccatcgacctgaacgctcagggtctggctcgctatgccatcatctgccaggagaatggtctggtgccaattgttgagcctgagatccttgttgatggccctcatgacattgatcgctgcgcttacgtcactgagaccgtccttgctgcctgctacaaggcgctcaacgagcaccatgtcctcctggagggtaccctcctgaagcccaacatggtgactccaggctccgactccaagaaggtgacccctgaggtgattgctgagtacaccgtccgtaccctccagaggaccgtccctgctgctgtgcctgctgttgtcttcctctctggtggacagagcgaggaggaggccacccgcaacctcaatgccatgaacaagctcagcaccaagaagccgtggtccctgtctttctccttcggccgtgccctccaggcgagcaccctcaaggcctgggctggcaaggtggagaacctggagaaggctagagctgccttcctcgccaggtgcaaggccaactctgaggctaccctcggcacctacaagggtgatgctgccgccgacaccgagagcctccacgtcaaggactacaagtactgagttgcttctctttgcgtgcccgttttggaactcctgcctacgagctaggttgcggagtgtggtttgctcgttagagcttattttcggacatccaaaaaacatgcttcctatgtgggatgatggttatctttatatttgtatgttaattagtctctttgctgttaaatttcgtgtaagttggtcctgccgatggagaatcgagcagctccctttttttgttc

SEQ ID NO: 1917 - DNA, 1388 bp, Zea mays
ccgtcgcgtcgagcatcgatcatgtcggcctactgcggaaagtacaaggatgagctcatcaagaatgctgcctacattggcacccctggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggttgacaagggcaccattgaggttgttggcactgataaggagaccaccacccaaggccatgacgaccttggcaagcgctgcgccaagtactacgaggccggtgcccgctttgccaagtggcgcgctgttctcaagattggccccaatgagccatcacagcttgccatcgacctgaacgctcagggtctggctcgctatgccatcatctgccaggagaatggtctggtgccaattgttgagcctgagatccttgttgatggccctcatgacattgatcgctgcgcttacgtcactgagaccgtccttgctgcctgctacaaggcgctcaacgagcaccatgtcctcctggagggtaccctcctgaagcccaacatggtgactccaggctccgactccaagaaggtgactcctgaggtgattgctgagtacaccgtccgtaccctccagaggaccgtccctgctgctgtgcctgctgttctcttcctctctggtggacagagcgaggaggaggccacccgcaacctcaatgccatgaacaagctcagcaccaagaagccgtggtccctgtctttctccttcggccgtgccctccaggcgagcaccctcaaggcctgggctggcaaggtggagaacttggagaaggctagagctgccttcctcgccaggtgcaaggccaactctgaggctaccctcggcacctacaagggtgatgctgccgccgacaccgagagcctccacgtcaaggactacaagtactgagttgcttctctttgcgtgcccgttttggaactcctgcctacgagctaggttgcggagtgtggtttgctcgttagagcttattttcggacatccaaaaaacatgcttcctatgtgggatgatggttatctttatatttgtatgttaattagtctctttgctgttaaatttcgtgtaagttggtcctgccgatggagaatcgagcagccccctttttttgttctatcaactatgctgtaatgctggctatgtatcggcaaaaacaattctatatgctgagttggagtcggcaaaaattcat

SEQ ID NO: 1918 - DNA, 1452 bp, Zea mays
aagcccaagcccaaacccgggaaccccgtctttaaaaagtacaccctcgactcgtcctccgcattccccgtttgccttgtttaccattcctccccaaaacacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatcaatgtcgagaacgtggaggagaaccggcgggctctccgtgagctcctgttctgctgccctggtgccctccagtacatcagcggtgtgatcctcttcgaggagaccctctaccagaagaccaaggatggcaagccttttgtcgatgtcctcaaggagggaggcgtcctccctggcatcaaggtcgacaagggcaccattgaggttgttggcaccgacaaggagaccaccacccagggccacgatgacctcggcaagcgctgcgctaagtactacgaggccggtgcccgctttgccaagtggcgtgctgttctcaagattggccccaacgagccgtcacagcttgccattgacctgaatgctcagggtctggctcgctacgccatcatctgccaggagaacggtctggtgccaattgttgagcctgagatccttgttgatggccctcatgacattgatcgctgcgcttacgtcactgagacagtccttgctgcctgctacaaggctctcaacgagcaccatgtcctcctggagggtaccctccttaagcccaacatggtgactcctggctccgactctaagaaggtgacacctgaggtgatcgcccagtacaccgtccgtaccctccagaggaccgtccctgctgctgtgcctgctgttgtcttcctctccggtggacagagcgaggaggaggccaccctgaatctcaatgccatgaacaagctcagcaccaagaagccatgggccctgtccttctccttcggccgtgccctccaggcgagcaccctcaaggcctgggctggcaaggtggagaacgtggagaaggctagagcggccttcctcgccaggtgcaaggccaactccgaggctaccctcggcacctacaagggtgatgctgccgccgacaccgagagccttcacgtcaaggactacaagtactgagttgcttctctttgcgatcccgttgttttggaactcctgcctgcgagtaggttsctgagtgttgyytgcttgttagagcttttatattcggacatgaaaaaaacatgcttcctatgtggatgatggttatctttatattcgtatattaactactagtctctgttgttaatttccgtgtaatttgctcctcccagatgggagaatcgaacgccgcttttttgttctatccaaaaaaaaaaaaaaaa

SEQ ID NO: 1919 - DNA, 1612 bp, Sorghum bicolor
tccgcacatggttggatctctgcatccggcaccgcctaccgccctcgccctgctgcgcccgcaccgcaggccgcgcttgcctggtggcgcacccagatcggatccacgtttctttcccctcgcacaagcctgagcctcccttgaaatactccccatctccatcgccccgcctaccccgctcagccattcgaccccaatttcgcttgcagttccagtagcctccctcccctcccgcgcgcatcgatcatgtcggcctactgcggaaagtacaaggatgagctcatcaagaacgccgcatatattggcacccctggaaagggtatccttgctgctgatgagtccacaggcaccattggcaagcgactttcaagcatcaatgtcgagaacattgaggagaaccgccgtgcccttcgtgagctcctcttctgtgcccctggtgccctccagtacctcagcggtgtgatcctctttgaggagaccctctaccagaaaaccaaggatggcaagccctttgttgatgtcctcaatgagggaggtgtgctccccggcatcaaggttgacaagggcaccattgaggttgctggcaccaacaaggagaccaccacacaaggccatgatgaccttggcaagcgctgcgccaagtactatgaggctggtgcccgctttgccaagtggcgtgccgtcctcaacatcggccctaacgagccatcacagcttgccattgacttgaacgctcagggtcttgctcgctacgccatcatctgccaggagaatggtctggtgccaattgttgagcctgagatcctcgtcgatgggccacatgacattgagcgttgtgcctatgttacggagatggtccttgctgcctgctacaaggctctcaatgagcaccatgtcctccttgagggtaccctcctgaagcccaacatggttacccctggctctgactccaagaaggtggctcctgaggtgatcgctgagtacactgtgcgtgccctccagaggactgtccctgctgctgtgcccgccatcgtcttcctctctggtggacagagtgaggaggaggccacactaaacctgaatgccatgaacaagctcaacaccaagaagccgtggtccctatccttctcattcggccgtgcccttcaggcgagcaccctcaaggcctgggctggcaaggaggagaacgtggagaaggccagggctgccttcctcaccaggtgcaaggccaactcggaggccaccctcggcacatacaagggtgacgctgctgccggcgagggtgtctcggagagcctccacgtgaaggactacaagtactgagctgcctcacattctggacccctgagtctgcttgcgtttaggttgagtgtttgtcagtcagagcccaaattttggacatcggaacttggttttaataatcctgaacttatggatgatggttgcttactttttatactcatgtattaattagtattttttggtgttcatcttgtgtaatctggtcgtaccgatggtaaatcgaggggccacattttgttctgtccgttgctgtaatatgctggttatgttattggtatagtatatgtcaaaccaaatgcttagttggccg

SEQ ID NO: 1920 - DNA, 1494 bp, Phyllostachys edulis
ctcatccctttctccacagccgccacctgccaaaccaacctcccccagtctcccttccggactctcgaatcttccccaagcatcgaccatgtcggcctactgcggcaagtacaaggatgagctcatcaagaacgctgctcacattggcacccctggcaagggtatccttgctgctgacgaatccactggcaccattggcaagcgctttgccagcatcaatgttgagaacgttgaggagaaccgccgttccctccgtgagctcctcttctgcacccctggtgccctccagcacctcagcggtgtgatcctctttgaggagaccctgtaccagaagaccaaggatggcaagcccttcgtcgatgtcctcaatgagggtggtgttctccccggaatcaaggtggacaagggcaccatcgaggttgctggcaccaacaaggagaccaccacccagggccatgatgatctcggcaagcgctgtgccaagtactatgaggctggtgcccgctttgccaagtggcgtgctgtcctcaagattggcccaaatgagccatctcagcttgccattgatctgaatgctcagggtctggctcgctatgccatcatctgtcaggagaacggcctggtgccaattgttgagcctgagatccttgttgatgggccacatgacattgaccgctgtgcttatgtcacggagaccgtccttgctgcctgctacaaggccctcaacgagcaccacgttcttcttgagggtagcctcctgaagcccaacatggtcaccccgggctctgactccaagaaggttgccccagaggtcattgctgagtacactgtccgcacactgcagaggaccgtccctgctgctgtgcccgccattgtcttcctctctggtggacagagcgaggaggaggctactctgaacctgaacgccatgaacaagctgagcaccaagaagccgtggtctctgtccttctccttcggccgtgccctccagcagagcacgctcaaggcctgggctggcaaggtggagaacgtggagaaggccaggaaggccttccttaccaggtgcaaggccaactctgaggctactctcggtacatacaagggtgatgccctcctcggcgagggtgcctctgagagccttcacgtgaaggactacaagtactgatctgcctctcgtgctggctccctatccgattggacgtgcgtatgaatattcacattgctgagtgtggtttggttttcagagtccagtcttcggatgtcagaaactttgttttaataatctggaactcatgccatgccttttataatacctttcgtactagtctttttttggttttaaatctcctgtaattccggtgctgcgtgtggtaaattgtagcagctgcgtttgttatgtttgctgttgcattggcatgtatgaatgttcatggcaacctgcaatccgccagttttttttcctaaaaaaaaaaaaaaaaaaaaaaaaaaaaaaaa

SEQ ID NO: 1921 - DNA, 1305 bp, Oryza sativa Japonica Group
gatctccctattcgtcgtagcctcctccctcgttcgctccgcccgcaaccatgtcggcctactgcggcaagtacaaggacgagctcatcaagaacgctgcctacattggcactcctggcaagggtatccttgctgcggatgagtccactggcaccattggcaagcgcttcgccagcatcaacgtcgagaacgttgaggagaaccgccgctccctccgcgagctcctcttctgcacccctggcgccctccagtacctcagcggcgtgatcctcttcgaggagaccctgtaccagaagaccaaggatggcaagcccttcgtcgatgtcctcaaggagggtggtgtcctcccgggcatcaaggtggacaagggcacaatcgaggttgccggcaccgagaaggagaccaccacccagggccatgatgaccttggcaagagatgcgccaagtactacgaggctggtgcccgcttcgccaagtggcgcgccgtcctcaagatcggccccaacgagccgtcgcagctcgccattcatctgaatgcgcagggcctcgctcgctacgccatcatctgccaggagaacgggctggtgccgatcgtcgagcccgagatccttgttgatggccctcacgacatcgacccgtgcgcctacgtctcggaggtggtcctcgctgcgtgctacaaggccctcaacgagcaccatgtcctcctcgagggtaccctcctcaagcccaacatggtcaccccaggctctgacgccaagaaggtgtctcccgaggtcatcgctgagtacaccgtccgcaccctccagaggaccgtccccgctgccgtgcccgccatcgtcttcctgtccggtgggcagagcaaggaggaggcgacccgtaacctcaacgccatgaacaagctcagcaccaagaagccgtggtcgctgtccttctccttcggccgtgccctccagcagagcacgctcaaggcctggtccggcaaggcggcgaacattgagaaggccagggcggccttccttaccaggtgcaaggccaactccgaggctaccctcggtacatacaagggtgacgctgtcctcggcgagggcgcctccgagagccttcacgtcaaggactacaagtactgatttgccttgggaggtgctggctaccattggaacattctgcggctgttgcttaatgtggttttgatatctagagggcaatctatggttatctaaaatgtcttgtcgtaataattctggaacctttttgtgtaacacattaccaaatatcaattgcctggattgaaatatcgtttttatc

SEQ ID NO: 1922 - DNA, 1048 bp, Oryza sativa Japonica Group
gatgagctcataaagaatgctgcctacattggcaccccgggcaagggtatcctcgctgcggacgagtccactggcaccatcggcaagcgcttcgccagcatcaatgttgagaacgtcgaggataaccgccgtgccttccgcgagctcctcttctgcacccctggcgccctccagtacatcagcggcgtgatcctcttcgacgagaccctctaccagaagaccaaggatggcaagcccttcgtcgatgtcctcaaggaggccggtgccctccccggcatcaaggtggacaagggcaccatcgaggtcgccggcaccgacaaggagaccaccacccagggccacgatgacctcggcaagcaatgcgccaagtactacgaggccggtgcccgcttcgccaagtggcgtgccgtcctcaagatcggacccaaccagccctcccagcttgccattgatctgaacgcccagggccttgcttgctacgccatcatctgccaggagaacgggctggtgccgatcgtcgagccggagatcctcgtcgatggccctcacgacatcgatcgatgcgcgtacgtctccgaggtggtcctcgccgcgtgctacaaggcgctgaacgagcaccatgtcctcctcgagggcaccctcctgaagcccaacatggtcaccccgggttccgacgccaagaaggtggcgccggaggtcatcgcggagtacaccgtccgcaccctccagaggaccgtccctcctgctgtgccggccatcgtcttcctctccggtggacagagcgaggaggaggcgacgctgaacctgaacgccatgaacaagctcagcgccaagaagccgtggtcgctgtccttctcctttggccgtgccctgcagcagagcacgctcaaggcctgggctggcaagacggagaacgtagagaaggccagggcggccttcctcgtcaggtgcaaggccaactccgaggctaccctgggtacttacaagggtgatgctgtcctcggcgagggcgctgctgaaagcctgcacgtcaaggactacaagtact

SEQ ID NO: 1923 - DNA, 2027 bp, Zea mays
gtgaaattgaggaactgaaccccggcggccggagttcctcatttgatttcgctcagaaaagtagaaaacgccagccgaacacaccggtccgccgcccacgccagcgctgagctcaccaggaaaccgtcttcttccactggcgcgggctaggagcgtcgccgccgcgtcgcggttatgggtacggcggctgtcgtggaggacacgatacgcgtcgtcctcacctgcctccctgatccgcccttccgcaccaccggttcctcccgtccctaccagagtcccagcggcggcggcggcggcggggaccgcatcagccgcctctcagacgcggtgctctctaacatcgtggcgcgtctccccgccaaggacgcagcgcgcactaccgcgctctccaggcgctggcgccgcgtctgggcctccactccactcgtcctcgacgactccgacctcctcgtcttccacgacgacggcggctgctctacgcccaactggttagccgtcacagacaccgtgtcccacgtcctctcctcccacagggggcccatccgctttgtgcgcctcacctgctgctacatggcgctggcctcgcacaacggcgcgctccagtactggctccgggtcctcgctgcggggggagtcgaggatctcgtcctcgtcaaccgcccattacccacctccgtgggcctccccatcgacgtcctccacctcgcctccctccgcaccctctacctcggtttctggtgcttcccggacaccgccaccctcccgcgaggccgcgccaccgtgttcccctgcctccaggagattggactctgcgctaccgtcatccacgccagggacatcgaccacctgctcgcctgcagccccgtgctcgagaagttcgccagcatcaccagcatctacttcacagaccctgtccggatccgcagctgcagcctccggtgccttgtcttctgggagtccctggccaatgagctcgacttggtcgtcgccccgcgcctccagcgcctaatcctgtggcagtcgcgccaatggatgatcggctccgtccatttccgcagcaggatcaggattggctccgccaccgaactcaaggtgctcggctacctggagccaagcatccaccagctcgagattggcggcaccataattgatagtggaacaaagatgaccccatctaacatggttccaagtgtcaagatcttggccttgaagatgcagttcagaatccgcaaggaagtcaagatgctgcccaccttcctgagatgctttcccaatgtggagacattgcatgttctgtcacatgaaactgatgagcaaaatggcaagttcaatttgaagttctgggaggaggttggctccatcagctgcctagagacacgcatcaccaaggtggtgtttgacagattcagaggagagcgttgtgagctcgcgttcctcaagttcgtcctagagagggcagaatcgctgctgaagcttgtggttgtattggccaatggagatcaagcctcagtggatgagatgcttgctaagttgaagtctctgaccacggtgaaacgagccagcgatttccctactctgttggcagttgcccgtgagggtgacagcgcctggtactttgagagagcatccgatctttctgttactgaccccttcgatttgtgaagctcaaggcgatgacatattccatgaccaattctattgttctcctgagccaatcagttgttctttgtcattcagggtatacttgctaggcattccctagaatcttgtctcgtcttgtgttgactgtaaatgtgagtacagttctgagtgaatcaggagaggtatatagtttatggaaagcgctgcttgacatttcgctattgaaaatataggttctgcatagctgctcttgagttgactacctccaaatgctgtcactggctagtttctcagttgtgatgtactgcatactgggcatagttggaactggaaaatatcgtattggtaaccccagattctgtgtatcgttgatatgattctggttt

SEQ ID NO: 1924 - DNA, 1933 bp, Zea mays
gtcttcttccactggcgcgggctaggagcgtcgccgccgcgtcgcggttatgggtacggcggctgtcgtggaggacacgatacgcgtcgtcctcacctgcctccctgatccgcccttccgcaccaccggttcctcccgtccctaccagagtcccagcggcggcggcggcggcggggaccgcatcagccgcctctcagacgcggtgctctctaacatcgtggcgcgtctccccgccaaggacgcagcgcgcactaccgcgctctccaggcgctggcgccgcgtctgggcctccactccactcgtcctcgacgactccgacctcctcgtcttccacgacgacggcggctgctctacgcccaactggttagccgtcacagacaccgtgtcccacgtcctctcctcccacagggggcccatccgctttgtgcgcctcacctgctgctacatggcgctggcctcgcacaacggcgcgctccagtactggctccgggtcctcgctgcggggggagtcgaggatctcgtcctcgtcaaccgcccattacccacctccgtgggcctccccatcgacgtcctccacctcgcctccctccgcaccctctacctcggtttctggtgcttcccggacaccgccaccctcccgcgaggccgcgccaccgtgttcccctgcctccaggagattggactctgcgctaccgtcatccacgccagggacatcgaccacctgctcgcctgcagccccgtgctcgagaagttcgccagcatcaccagcatctacttcacagaccctgtccggatccgcagctgcagcctccggtgccttgtcttctgggagtccctggccaatgagctcgacttggtcgtcgccccgcgcctccagcgcctaatcctgtggcagtcgcgccaatggatgatcggctccgtccatttccgcagcaggatcaggattggctccgccaccgaactcaaggtgctcggctacctggagccaagcatccaccagctcgagattggcggcaccataattgatagtggaacaaagatgaccccatctaacatggttccaagtgtcaagatcttggccttgaagatgcagttcagaatccgcaaggaagtcaagatgctgcccaccttcctgagatgctttcccaatgtggagacattgcatgttctgtcacatgaaactgatgagcaaaatggcaagttcaatttgaagttctgggaggaggttggctccatcagctgcctagagacacgcatcaccaaggtggtgtttgacaaattcagaggagagcgttgtgagctcgcgttcctcaagttcgtcctagagagggcagaatcgctgctgaagcttgtggttgtattggccaatggagatcaagcctcagtggatgagatgcttgctaagttgaagtctctgaccacggtgaaacgagccagcgatttccctactctgttggcagttgcccgtgagggtgacagcgcctggtactttgagagagcatccgatctttctgttactgaccccttcgatttgtgaagctcaaggcgatgacatattccatgaccaattctattgttctcctgagccaatcagttgttctttgtcattcagggtatacttgctaggcattccctagaatcttgtctcgtcttgtgttgactgtaaatgtgagtacagttctgagtgaatcaggagaggtatatagtttatggaaagcgctgcttgacatttcgctattgaaaatataggttctgcatagctgctcttgagttgactacctccaaatgctgtcactggctagtttctcagttgtgatgtactgcatactgggcatagttggaactggaaaatatcgtattggtaaccccagattctgtgtatcgttgatatgattctggtttatgtaatttcttgagcctgacgtttgattct

SEQ ID NO: 1925 - DNA, 1973 bp, Zea mays
atttgatttcgctcagaaaagtagaaaacgccagccgaacacaccggtccgccgcccacgccagcgctgagctcaccaggaaaccgtcttcttccactggcgcgggctaggagcgtcgccgccgcgtcgcggttatgggtacggcggctgtcgtggaggacacgatacgcgtcgtcctcacctgcctccctgctccgcccttccgcaccaccggttcctcccgtccctaccagagtcccagcggcggcggcggcggcggggaccgcatcagccgcctctcagacgcggtgctctctaacatcgtggcgcgtctccccgccaaggacgcagcgcgcactaccgcgctctccaggcgctggcgccgcgtctgggcctccactccactcgtcctcgacgactccgacctcctcgtcttccacgacgacggcggctgctctacgcccaactggttagccgtcacagacaccgtgtcccacgtcctctcctcccacagggggcccatccgctttgtgcgcctcacctgctgctacatggcgctggcctcgcacaacggcgcgctccagtactggctccgggtcctcgctgcggggggagtcgaggatctcgtcctcgtcaaccgcccattacccacctccgtgggcctccccatcgacgtcctccacctcgcctccctccgcaccctctacctcggtttctggtgcttcccggacaccgccgccctcccgcgaggccgcgccaccgtgttcccctgcctccaggagattggactctgcgctaccgtcatccacgccagggacatcgactacctgctcgcctgcagccccgtgctcgagaagttcgccagcatcaccagcatctacttcacagaccctgtccggatccgcagctgcagcctccggtgccttgtcttctgggagtccctggccaatgagctcgacctggtcgtcgccccgcgcctccagcgcctaatcctgtggcagtcgcgccaatggatgatcggctccgtccatttccgcagcaggatcaggattggctccgccaccgaactcaaggtgctcggctacctggagccaagcatccaccagctcgagattggcggcaccataattgatagtggaacaaagatgaccccatctaacatggttccaagtgtcaagatcttggccttgaagatgcagttcagaatccgcaaggaagtcaagatgctgcccaccttcctgagatgctttcccaatgtggagacattgcatgttctgtcacatgaaactgatgagcaaaatggcaagttcaatttgaagttctgggaggaggttggctccatcagctgcctagagacacgcatcaccaaggtggtgtttgacaaattcagaggagagcgttgtgagctcgcgttcctcaagttcgtcctagagagggcagaatcgctgctgaagcttgtggttgtattggccaatggagatcaagcctcagtggatgagatgcttgccaagttgaagtctctgaccacggtgaaacgagccagcgatttccctactctgttggcagttgcccgtgagggtgacagcgcctggtactttgagagagcatccgatctttctgttactgaccccttcaatttgtgaagctcaaggcgatgacatattccatgaccaattctattgttctcctgagccaatcagttgttctttgtcattcagggtatacttgctaggcattccctagaatcttgtctcgtcttgtgttgactgtaaatgtgagtacagttctgagtgaatcaggagaggtatatagtttatggaaagcgctgcttgacatttcactattgaaaatataggttctgcatagctgctcttgagttgactacttccaaatgttgtcactggctagtttctcagttgtgatgtactgcatactgggcatagttggaactggaaaatatcatattggtaaccccgaaaaaaaaaaaaaaaaaa

SEQ ID NO: 1926 - DNA, 1506 bp, Sorghum bicolor
atggctcaggagcaaatcgtggggatggaggacatgctacgcgtcgtcctcccctgcctccccgccccgcccttccgcaccaccggtgccttccgtcgctcccacagcccccgcagcggcggcggcggcgaggaccgcatcagccgcctcccgggcacggtgctctccaacatcgtggcgcgcctccccgccaaggacgcagcgcgcaccaccgcgctctccaggcgctggcgccgcgtctgggtctccacgccgctcgtcctcgacgactccgacctcctcatcttccgcgacggcggcggcggcggccgctccgcgcccgtcaactggccagccgtcaccgacgccgtctcccgcgtcttcgacggccgcaggggcggccccatccgcttcgtgcgcctcacctgctgcttcatgaagctggccatgcgcttccgcattctcgagtactggctccgggtcgtcgccgcggggggagtcgaggaccttgtcctcgtcaaccgccccttccccagctccctgcccctccccctcgacgtcctccacatcgcctccctgcgcaccctctacctcggcttctggcaattcccggacaccgccgccctcccgcgaggccgcgccaccgtgttcccccgcctccaggagattggactctgcgctaccaagatccaagccagggacatcgaccacctgctcgcctgcagccccgtgctcgagaaattcgccatcatcgctggcctttacttcccccgctatgtccggatccgcagctgcagcctccagtgccttgtcttctggaagtccctggcggatgagctcgacgtggtcgtcgccccgcgcctccagcgcttaatcctgtggcaggcgtgccaatgcatcatcggctccctccccttccgcaccagtgtcaggattggccacgccaccgagctcaaggtgctcggctacctggagccaagcatccaccagctccagattggcagcaccataattgagagtggaacaaacatgatcccatctagcatggttccaagtgtcaagatcttggccttgaaggtgcagttcagaatccgcaaggaagccaagatgctgcccaccttcctgagatgctttcccaatgtggagacattgcatgttctgtctcatgaagctgaggagccagatggcaagctcaattcgaagttctgggaggaggttggctccatcgactgcctagagacacacatcaccaaggtggtgtttgacaaattcagaggagagcgctgcgagctcgcgttcctcaagttcatcctcgagagggcacaatcgctgctgaagcttgtgattgtattggcaaatggagatcaagcctcagtggatgagatgcttgccaagttgaagtctctgaccacggcgaaacgagccagcgaatgccctactctgttggcagtcgtccgtgagggagacagcgcctggtactttcagagagcatccgatctttctgtcagtgacccctttgattggtga

SEQ ID NO: 1927 - DNA, 1302 bp, Zea mays
cccgcacctacctctctgcctgctgccccggcccctgatcctgatttccccaatcgagagtccgagacccgagaggaggcacaggcacctgcgctagctgcagctgcaaatcgtcttccccagatccggcgccgcctagttcgctcctgctcgcgacagcgcccagagccgtccgcgtgcgcccgcagagatcgtttcggggacagccgagcagagcagagcagagcagagctgactctgccgcttgttgcccgttcttggctgctgttgctggcgagagcgcgcaggaggagcggctgatttttgattctctctgtccctccctccctcgcttcgctcgcgcggggtgcgtgcacgtaccatgagaagatgatgcgcgccaggcccaaaggtacattcgccgacgcgatgagggagagctcccctcctcctcctccccctccggctccggcttcggcagcggtgaaagaggacgagtgggaggtgcggcccggcgggatgctggtgcagaagcggagccccgacgccgacgcccccgccggggcgcccgtccccaccatccgcgtcaaggtcaagttcaacggcgtgtaccacgagatctacatcaactcccaggcctccttcggtgagctgaagaagatgctgtcggcgcggaccgggctgcaccccgaggaccagaagctggtgtacaaggacaaggagcgggactccaaggcgttcctggacatggccggcgtcaaggaccgctccaagatggtgctgctcgaggaccccgccgcgcaggccaagcgcctcctcgagcagcgccgcaccgacaaggcggagcgcgccgccaagtccatctcccgcatcggcctcgacgtcgacaagctcgccaccaaggtgtcggcgctggaggccatcgtcagcaagggcggcaaggtggtggacgctgacgtggtcgccctcaccgaggcgctcatgaacgagctggtcaagctggactccatcgccgccgacggcgaagtcaaggtgcagcgacgaatgcaggagaagcgggtgcagaagtacgtggagacgctggacgctatccgcgccaagaacgcggcggcgcccaaggccaaggccaaggccaacggcgacatgaatgggcacgccaaggcccgcgcgccgcaactcccgccgcgcccgccgcccgtgtcgcagaggcggaacttccagcagccctccccggcgccagcgccgcccacgcagggctgggagtcgttcgacctgctgtcgtcggtgccgtccacgtcctcggccaccgtgaccaccaccatg

SEQ ID NO: 1928 - DNA, 1315 bp, Zea mays
cagctcagctcctaaacccgcacctacctctctgcctgctgccccggcccctgatcctgatttccccaatcgagagtccgagacccgagaggaggcacaggcacctgcgctagctgcagctgcaaatcgtcttccccagatccggcgccgcctagttcgctcctgctcgcgacagcgcccagagccgtccgcgtgcgcccgcagagatcgtttcggggacagccgagcagagcagagcagagcagagctgactctgccgcttgttgcccgttcttggctgctgttgctggcgagagcgcgcaggaggagcggctgatttttgattctctctgtccctccctccctcgcttcgctcgcgcggggtgcgtgcacgtaccatgagaagatgatgcgcgccaggcccaaaggtacattcgccgacgcgatgagggagagctcccctcctcctcctccccctccggctccggcttcggcagcggtgaaagaggacgagtgggaggtgcggcccggcgggatgctggtgcagaagcggagccccgacgccgacgcccccgccggggcgcccgtccccaccatccgcgtcaaggtcaagttcaacggcgtgtaccacgagatctacatcaactcccaggcctccttcggtgagctgaagaagatgctgtcggcgcggaccgggctgcaccccgaggaccagaagctggtgtacaaggacaaggagcgggactccaaggcgttcctggacatggccggcgtcaaggaccgctccaagatggtgctgctcgaggaccccgccgcgcaggccaagcgcctcctcgagcagcgccgcaccgacaaggcggagcgcgccgccaagtccatctcccgcatcggcctcgacgtcgacaagctcgccaccaaggtgtcggcgctggaggccatcgtcagcaagggcggcaaggtggtggacgctgacgtggtcgccctcaccgaggcgctcatgaacgagctggtcaagctggactccatcgccgccgacggcgaagtcaaggtgcagcgacgaatgcaggagaagcgggtgcagaagtacgtggagacgctggacgctatccgcgccaagaacgcggcggcgcccaaggccaaggccaaggccaacggcgacatgaatgggcacgccaaggcccgcgcgccgcaactcccgccgcgcccgccgcccgtgtcgcagaggcggaacttccagcagccctccccggcgccagcgccgcccacgcagggctgggagtcgttcgacctgctgtcgtcggtgccgtccacgtcctcggccaccgtgaccaccacc

SEQ ID NO: 1929 - DNA, 746 bp, Sorghum bicolor
atctcgcccgccgttctcgcccttctcgatctcacctcgcgcccggccgcccgcacctctccccttcgcttcaccaagggtttaggaccggcggcgatggcggcgaagctggcccagctgcgcgcgcaggcggcgcgtgcggcggagttcgcctcgaagcacggcggcgcctactacaaggaggtcatggagaagaacaagcagtacgtcgttcagccccctaccgtcgagaagtgccaggagctctccaagcagctcttctacacccgcctcgcaagcctaccaggtcgctatgaggcattctggaaggagcttgatagtgtcaagcaggtatggaagaacaggaaagacctcaaggttgaggaccttgggattgcgactttatttggagttgagctttatgcatggttctgcgtaggagagattgttggcagaggtttcaccttaaccggctataaggtctagatgatttccactggttaagacctgcttcataatcgatacttttagctgatgcttgtcgaatcgacgatgatacctgccttccttcacaattttgtttcttgtaagagtttatgtagtgctgaatgccagcaaagacgggcacatcattgcaacactgcctcaataatttgctcgctcaattgttgattttggtgcatgtaattctttgttggttgcatctgccacagtccccttttcccctgtgcgcggactgatttgtgtctttctttctgccctcaaaa

SEQ ID NO: 1930 - DNA, 1008 bp, Zea mays
atcacacacacaccatcgtcctctcctttgccagcgccgccgaacccgccaccagccttctcccatccttgaagcacggaaggctcccagaaggagctctcacctcgcagccatctctggcacgtccgtccttcttctccctcggtccctccccttctccacagctatcggattggcgttggagtggagatcgacccgggctcggaattcccttcgttggtaaggaaccctaatttggtcagatgggatttccaacttcgacaaagcccgcgaggtcgatcgatctcagttgacgcgagggattggaaaactaagttgcgggtgtagttaattttctaggaagattggggtttcagctcaaactcccatgctcgacgctgaggacgaccctggcgggagatgacgaggatcttcgtgcagcgcgggaccgccggctcctcgtccttatcgatctcctcgcacctcgtggcggcacctctccccttcgatccccaagggtttaggatcggcggcgatggcggcgaggctggcacagctgcgcgctcaggcggtgcaggcggcggagttcgcctcgaagcacggcggctcctactacaaggagctcatggagaagaacaagcagtacgtcgtgcagccccccaccatcgagaaatgccaggagctctccaagcagctcttctacacccgcctcgcaagcctaccaggtcggtatgagtcattctggaaggagcttgatggtgtcaagcaggtatggaagaacaggaaggacctcaaggttgaggaccttgggattgcgactttatttggagttgagctttatgcatggttctgcgtaggcgagattgttggcagaggtttcaccttaaccggctataaggtctagttgatttccagtgatttaagacctgctttataaatcgacactttagctgatgcttgtcgaaacgacgatgatacctgccttccttcacaattttgtttcttgtaaggaaaaaaaaaaaaaaaaaa

SEQ ID NO: 1931 - DNA, 827 bp, Zea mays
accctcgaccctcgaggtctcgagtcttgaccaacccatacgcacccaccctccgccgccgtttttctctccccatctcgcccgccgttttcgtccttatcgatctcctcgcacctcgtggcggcacctctccccttcgatccaccaagggtttaggatcggcggcgatggcggcgaggctggcacagctgcgcgctcaggcggtgcaggcggcggagttcgcctcgaagcacggcggctcctactacaaggagctcatggagaagaacaagcagtacgtcgtgcagccccccaccatcgagaaatgccaggagctctccaagcagctcttctacacccgcctcgcaagcctaccaggtcggtatgagtcattctggaaggagcttgatggtgtcaagcaggtatggaagaacaggaaggacctcaaggttgaggaccttgggattgcgactttatttggagttgagctttatgcatggttctgcgtaggcgagattgttggcagaggtttcaccttaaccgtctataaggtctagttgatttccagtgatttaagacctgctttataaatcgacactttagctgatgcttgtcgaaacgacgatgatacctgccttccttcacaattttgtttcttgtaagagtctacctagtgctgaatgccagcaaagacgggcacatggttgcaacattgcctcaataatttgcccgcgcaattcttgattttgatgcatgtaattctttgtcagttgcatgtgctgcagtccctgcgtgcagactcatttcgtgtctttcgttctgcccacaaaataaattctttctgcgtt

SEQ ID NO: 1932 - DNA, 837 bp, Zea mays
actcgagaaacggatccctaatcgctgaaccaaaactacaaaacgaagtgacgatactgccctcgacctctcgaggtatcgagtctcgaccaacccatacgcacctaccctccgccaccgttcccccctccccatctcgcccgccgttctcgtccttgtagatctcctcgcacctcgcccattcgcttcaccaagggtttaagaccggcggcgatggcggcgaagctggcgcagctgcgcacacaggtaacgcgtgcggcggagttcgcctcgaagcacggctgctcctactacaaggaggtaatggagaagaacaagcagtacgtcgttcagccccccaccgtcgagaagtgccaggagctctccaagcagctcttttacacccgcctcgcaagcctaccaggtcgctatgagtcattctggaaggagcttgattgtgtcaagcaggtatggaagaacaggaaggacctcacggtcgaggaccttggcattgcgagtttatttggagttgagctctatgcatggttctgcgtaggcgagattgtcggcagaggtttcaccttgaccggctataaggtctagatgatttccactggtcaagacctgctttataattgatactcttagctgatgcttgtcgaaacgacgacgatggtacctgccttggttcacaattttgtttctttgtaagagtttacctagtgctgaatgccagcaaagacgggcacatcgttgcaacattgcctcaataatttgctcgctcaattgttgattttggtgcatgtaattctttgttggttgcaatcccccgcgtgcggactaaaaaaaaaaaaaaaa

SEQ ID NO: 1933 - DNA, 634 bp, Hordeum vulgare subsp. vulgare
ggccgtcctcctctccctccccccctccccctctctcgatctcctcccacctcacctcctcctcgcctcttgccgacgtttcgtcaaggttccggcggcgatggcggcgaggctcgcgcagctgcggaccaaggcggcgcaggcggcggaattcgcctcgaagcacggcggcgcctactacaaggaggcgatggagaagaacaagcagtacgtcgtgcagcccccctccgtggagaagtgccaggagctctccaagcagctcttctacacgcgcctcgcgagtctaccaggccgctatgaagcattgtggaaggaggttgatggtgtgaagcagctttggaagaacaggaaggagctcagggtggaggaccttggaattgcaacattgtttggggttgagctctacgcatggttctgcctaggtgagattgctggcagaggtttcaccttaaccggctataaggtctgaattagtttgtggaggcccggcttataatatactgttagctgatgcttgtcgaaattacctgtcttgtttcacaattttgtttctgaaaagtttgtagtgctgaatgccagcaagacgagcacacaattgcaacagtgcctcaataatttgctcgctcaattgtcc

SEQ ID NO: 1934 - DNA, 703 bp, Oryza sativa Japonica Group
atccacctcgcgacctctcctctcccctccccggcgcttcacccacggcgatggcgtcgaggctggcgcagctacggtccaaggcggcgcaggcgtcggagctcgtgtcgaagcacgggtgcgcctactacaaggaggtgatggagaagaacaagcagcacgtggtgcagccacccaccgtggagaagtgccaggagctctccaagcagctcttctacacccgcctcgccagtttgccaggccgctatgaggcattttggaaggaatttgatggtgtcaagcaggtatggaagaatagaaaggagctcaaggtagaggaccttggaattgtgacattatttggagttgagctttatgcgtggttctgcgtaggcgagattgttggcagaggattcaccataaccggctataaggtctagaagagttctgattaagacctggtttataaaatacactgttagctgatgcttgtcgaaatgacaaagatacctcctgccttttcacaattttgtttatggaaagtctttctagtgctggatgtcagccaagacgagcacatcgttgcaacactgcttcaataatttgctcgatctctcgattgccattttggtgtcctgtaatgtgaaatactgaaattccatcttgccccacccgtcaaattgtcatttatttgttctcttgaatccatctcaaactgcaagac

SEQ ID NO: 1935 - DNA, 1829 bp, Musa balbisiana
atggcatcgaaactgcatcagcttcgatctaaggctgtccaagcctcggagtttgtggttaagcacgggtgcgcatactataaggagcttttggagaagaacaagcagcatattgttcaaccaccaaccgtcgagaagtgccaagagctctcaaaacagctcttttacacacggcttgcaaggtttggtttaacatccaccctatgttgtttttgctgcgtttttaagtcatcctaggcaaaatgacaagtttggggataatttctatcttattttcggataaatgtactgtaaggttggtgttggccgtaactattcttaaacaagatggatgtaggttattccaggagctgaagtgtaagaatgtaagatacttatgtatagtttaaatccatttcaagcataaaacactgaatacccaaagactaacagcgttgacttggtttttctgccgtagtcacttgccttgtcaacagtaagtttctgtttctctgaacatagcatgtggtaggatctttctctggatttagtgctggaattcataattcaggttggtgacttatttccttgatgagatatccaaggagtttccttgttcccctgatgcagcttgttgtgcctgatgtttgttaaaaatcttgtttaccttgtataatctgtatattactctactaattttaggtactataaaactagtaagctaaatgtgttatccttgcttaggtttatgttgtgggttatgaaaattatccaaagtgacatcttttgtgaggaaattacttgcttgtggtttagagttaagggtcacgtggtgattagtggtttaacccgccacaacaatagggttaaggaaggtcaaatttaatcctgtcagcccaaagaacttgggatgaattaagtcttttaagttgtggttattggtttaacctgccaaacacactttttgctgacccagatagtttttgttcagcaaacaggcaaaaaatagggttaaagttagatagcatggtttggatgattcaaccttttagctttagccactaatgaaatgtagtctaaagagttgggaagggtcaaaataatctggtcaaaatgacttttattcaaccaaccaggtttaagaaagcccatttgacagggttatttagaattaatccttactccaggcaactttgtttgattagtaagcaatcgaagaaaaatgaaaagttaaaataagctagccgcaatagaataactacacctggttactgtaaccatgaaccaaacacaaatttttaattgacttcagattcttggcaaattcatattcaagaacaacaagaagcctgccactaataagcaatatgtgtatactgttaccttccagttaggctgccttctccaaagtccaaattagcatgcccaaagacaagtgcttcccccttaattcatgggatggtgtgttccacgggagaggttgcgatcatggtcggttgctctgctgtcattcaaagctataaagtcaaagttgattatgcttgttttgtttgagacagtcctttttcaacaatgcatgccatgtaaaccatctttttagatgttatcctgcgagatggacaaagtgtcaaatatgtgccggtactgacgtctttcaattacagcatccctggtcgttatgaatcattttggaaggagcttgatggtgtgaagcgcaaatggagaaacagagaggatctcaaaattgaggatgctggcattgcagcattatttgggctcgagttgtatgcatggttctgtgttggtgagatagttggaagaggattcactttcactggctactatgtctg

SEQ ID NO: 1936 - DNA, 872 bp, Solanum tuberosum
aaacaaatcctcgcctgtcatctttccttgcacatcaatccgtaggcaaacctaaaggaattttggggaattgatggcgtcaaagattcaacaactgcaatctcaggcatgccaagcttcaaaatttgttgccaagcatggtactgcctactacaaacagttgctagagcagaacaagcagtacattgtggagccacccactgttgaaaagtgcaacgagttgtccaagcagttactctacactcgccttgcaagcattcctggccgttatgaggcattttggaaggaacttgattctgtgaagcaaatgtggaagaatagaaaggagttgaaggttgaagatgctggaattgcagcgttgtttggtttggagtgttttgcatggtattgtgctggtgagataataggaagagggtttacattcactggttactatccttgaaatatcaatccttatgaaaattgaccagttgtaagggctctccgtctttataagggtgatctgagtgacatgaaatccgtacaagattttgtttctgaagctgcaatgtcagtttttacattatgccgcaaataatctgcccactccgtcttccttggcttaacttgaaaactttgtaatagtgaatttaaatttgctcaaagtatactgctacatgtgacggtatttgttcttattaattagttggcttctatttggaaggttgactagctcatgttttgcagaaaaaatttattatgggtgaggcgcgcatagtgtcagttgtgtgaggcgttttttggctgccatttgtatattgtggggcccatattgtacttgtttcatttccttactttttctctttccattttaaaaaaaaaaaaaaaaaaaa

SEQ ID NO: 1937 - DNA, 378 bp, Oryza sativa Japonica Group
atggcggcgctggcgtcgaagctggcacagatgcaggcgaaggcgtgcgacgcggcgaggttcgcggcgaagcacgggtgcgcgtaccacagggcgctcatggagaagaaccagaagtacgtcgccgacccgcccaccatcgagaggtgccaggagctctccaagcagctcttctacacccgcctcgccagccttcctggtcgctatgaggcattctggaaggaagcggatcaagtgaagaacttgtggagaaacagaaaggatctgaacgttgagcatgctggcgttgctgcactttttggcattgagttgtacgcgtggttctgcgttggtgagatcgttggtagaggatttactttcactggctaccatgtctga

SEQ ID NO: 1938 - DNA, 827 bp, Hordeum vulgare subsp. vulgare
ggcgccctcccaaaagccgcccccttcccaaagaaagaaccacacacgcgcaggcacaaccaacccgccgccgccgccgccgcctcctcctcctcctccgatcccccaaggagccgtcgcgtcccggaaggagcagcagatccatccatggcggcgctggggtccaagctggcgcagctgcaggccaaggcctgcgaggcgacgcggttcgcggccaggcacggctgcgcctaccacaagaccctcatggagaagaacaagcagttcgtcgtgcagccgcccaccgtcgagaagtgccaggagctctccaagcagctcttctacacccgcatcgccagcatccctggccgctgcgaagcattctggaaggaggtggaccaagtgaagcagctgtggagaaacaggagcgatctgaacgtggagcacgcgggcatcgctgcgctgttcggcctcgagctctacgggtggttctgcgtcggtgagattgccggcaggggtttcaccttaactggctacagcgtctgagcgccctccttccatgagtacctttccgcggccgtcgattaagagctgaagactctgttagccaatcagtttctcgtgatgcgcgttgcgaagttttggtttttctgaaatactattcttgatgctggtgaaaaggtacacacggctcggtaaattcgactcgtcgatgaggtctaataatttgtcgcacacttagttgaatgaagcctggacagatgagatgtctgcaatgtttgccttgcttgtatcctaaaatcagggcaaattacgcctccagaagaaatgatctccccatttcattg

SEQ ID NO: 1939 - DNA, 1845 bp, Sorghum bicolor
gaaactgcagccacaccaaagccgttagccgtcttctccctcatctcctcttgtccgacgcgggtgggccgcggtcgggtgagtgagtgagcagctttgcttctccatctcccccattcttcccttccccggcccggcggcggtacgtgacctcgtcggaagaacggcaggtgtccgcgcgcgacctgagagcacagcaccggggttcaggcagaaaagatggctggagcagcggtggcggcggccaacggaggggcgtgctgccacgctgccaaggggcccgggtacgccacgccgctggaggccatggagaagggacccagggagaagctcgtctacgtcacctgcgtctacaacggtactggaattaacaagccggattaccttgcgacggtggatttggatcccgactcccccacatactcccaggtgatccacaggctcccggtcacccacatcggcgatgagctgcatcactctggatggaactcctgcagctcctgccacggcgatccatcagccaagcgccgcttcctgatcctaccttcgctgttgtcaggtcgtgtgtatgttgttgacacagcgacagacccgagggcgccatccttgcataaggtggttgagtctgaggacattgctgagaagactgggcttgggtttcctcacacgtcccattgccttgcatctggcgacattatgatttcttgccttggggacaaggaggggaacgcagctggcaatggcttcctgctgttagattcagagtttaatgttaaagggcgttgggaaaagccaggtcacagtcccttgtttggatatgacttctggtaccagcctcgccacaagacgatgatcagttcgtcatggggagcccctgcagcattcaggacaggtttcaaccttcaacatgtccaggatggcctgtacggaaggcatctgcacgtatacgactggcctggtggtgagctcaagcagacacttgatctaggtgacactggacttcttccccttgaggtgaggtttttacatgatccatcaaaggacactggctatgttggctgtgctttgacaagcaacatggtgagatttttcaagaccgcggatggatcatggagccatgaggttgctatctctgtgaaaccattgaaggtccggaactggattctgccagaaatgccaggattgataactgatttcgttctctctcttgacgaccgttatctgtacttggtaaattggcttcatggcgatatcaggcagtacaacattgaggatcctgcaaaacctttcttggctggacaagtatgggttggtggtcttcttcaaaagggcagtgatgtcgtctatgtcactgatgatggtcaagaagaacagtataatgtgcctcaagtcaagggtcatcgacttagaggtggaccgcagatgattcaactgagcttggatggcaagaggatatacgtgaccaactcacttttcagccgttgggatgagcagttctttggggatgattttgtcaagaagggctcccacatgttgcagatcgatgtcgacaccgagaaaggagggctggctatcaaccccaacttcttcgtagattttggcaccgagcctgatggtcctgccctggcccatgagatgagatatcctggtggggactgcacctctgatatatggatctgaggtcaaggatttgggataacaggctgctgtagattcccgctgttgtatgcactgtaattaacatggtattcgtgcagtgtttcatcttgtattgtgactactgccagtgtaataaggcatggtttcatgagaactttagattaataaagaagtctcgattctaaa

SEQ ID NO: 1940 - DNA, 1899 bp, Zea mays
cgcccccacaccaagccgtatcgtcttctccctcttgtccggttcgggtggtccgcggtcggggtgagtgagtgagcagctttgcttctccatctccccgttcccttccctccccagccccccggcccggcggcggtacgtgaccctgacgccgcagcgctagctagctcgccggaacggcaggtggcggcgcgcgacctgagagcacagcagcaccggaccggctcaggcaggcgaccggcagaaaagatggcgggagcagcagctgtggagacggcggcggcggcggcagcggccaacggaaaagcgtgctgccacgccgccaaggggcccgggtacgccacgccgctggaggccatggagaagggccccagggagaagctcgtctacgtcacctgcgtctacaacggcactggaattaacaagccggattaccttgcgacggtggatttggatcccagctctcctacatactcccaggtgatccacaggctcccggtcacccacatcggcgacgagctgcatcactctggctggaactcctgcagctcctgccacggtgacccatcggccaagcgccgcttcctgatcctgccttccttgctgtcaggccgtgtgtatgtcgtcgacacagcgacagacccaagggcgccatccttgcataaggtggttgagtctgaggacattgctgagaatactgggcttgggttccctcacacgtctcattgccttgcgtctggcgacattatgatttcttgccttggggacaaggaggggaatgcagctggcaatggcttcctgctgttggattcagagtttaatgtcaaaggacgttgggaaaagccaggtcacagtcccttgtttggatatgacttctggtaccagcctcgccacaagacgatgatcagttcgtcatggggagcccctgcagcgttcaggacaggtttcgatcttcaacatgtccaggatggcctgtatggaaggcacctgcatgtgtacgactggcctggcggtgagctcaagcagacacttgatctaggtgacactggactccttccccttgaggtgaggtttttacatgatccatcaaaggacactggctatgttggctgtgctttaacaagcaacatggtgagatttttcaagaccgcggatggatcgtggagccatgaggttgctatctctgtgaaaccactgaaggtccgcaactggattctgccggaaatgccaggattgataactgatttcgtcatctctcttgatgaccgttatctctactttgtaaattggcttcatggcgatattaggcagtacaacattgaggatcccgcaaagcctttcttggctggacaagtatgggttggtggtcttcttcagaagggcagtgatgtcgtctatgttactgatgatggtcaggaacagcagtacaatgtgcctcaagtcaagggtcatcgacttagaggtgggccacagatgattcagctgagcttggatggcaagaggatatacgtgacaaactcacttttcagccgatgggatgagcagtttttcggtgatgatcttgtcaagaagggctcccacatgttgcagatcgatgtcgacaccgagaaaggaggcctggctgtcaaccccaacttcttcgtcgattttggcaccgagcctgatggtcctgccctggcccacgagatgagatatcctggtggggactgcacctctgatatatggatctgaggtcaaggattcggcgtaattaacaggctgctggagaatccctgttgttgtatgcactgtaattaacatggtatccgtgcggtgttctgtcttgtactgcgactgttgccagtggaataaggcatggtttcatgagaactctagattaataaaagaagtcctgattct

SEQ ID NO: 1941 - DNA, 1623 bp, Zea mays
cggcagcggccaacggaaaagcgtgctgccacgccgccaaggggcccgggtacgccacgccgctggaggccatggagaagggccccagggagaagctcgtctacgtcacctgcgtctacaacggcactggaattaacaagccggattaccttgcgacggtggatttggatcccagctctcctacatactcccaggtgatccacaggctcccggtcacccacatcggcgacgagctgcatcactctggctggaactcctgcagctcctgccacggtgacccatcggccaagcgccgcttcctgatcctgccttccttgctgtcaggccgtgtgtatgtcgtcgacacagcgacagacccaagggcgccatccttgcataaggtggttgagtctgaggacattgctgagaatactgggcttgggttccctcacacgtctcattgccttgcgtctggcgacattatgatttcttgccttggggacaaggaggggaatgcagctggcaatggcttcctgctgttggattcagagtttaatgtcaaaggacgttgggaaaagccaggtcacagtcccttgtttggatatgacttctggtaccagcctcgccacaagacgatgatcagttcgtcatggggagcccctgcagcgttcaggacaggtttcgatcttcaacatgtccaggatggcctgtatggaaggcacctgcatgtgtacgactggcctggcggtgagctcaagcagacacttgatctaggtgacactggactccttccccttgaggtgaggtttttacatgatccatcaaaggacactggctatgttggctgtgctttaacaagcaacatggtgagatttttcaagaccgcggatggatcgtggagccatgaggttgctatctctgtgaaaccactgaaggtccgcaactggattctgccggaaatgccaggattgataactgatttcgtcatctctcttgatgaccgttatctctactttgtaaattggcttcatggcgatattaggcagtacaacattgaggatcccgcaaagcctttcttggctggacaagtatgggttggtggtcttcttcagaagggcagtgatgtcgtctatgttactgatgatggtcaggaacagcagtacaatgtgcctcaagtcaagggtcatcgacttagaggtgggccacagatgattcagctgagcttggatggcaagaggatatacgtgacaaactcacttttcagccgatgggatgagcagtttttcggtgatgatcttgtcaagaagggctcccacatgttgcagatcgatgtcgacaccgagaaaggaggcctggctgtcaaccccaacttcttcgtcgattttggcaccgagcctgatggtcctgccctggcccacgagatgagatatcctggtggggactgcacctctgatatatggatctgaggtcaaggattcggcgtaattaacaggctgctggagaatccctgttgttgtatgcactgtaattaacatggtatccgtgcggtgttctgtcttgtactgcgactgttgccagtggaataaggcatggtttcatgagaactctagattaataaaagaagtcctgattctaaattttctg

SEQ ID NO: 1942 - DNA, 1955 bp, Zea mays
tcgcagaagccgcagccacgccccacgcccccacaccaagccgtatcgtcttctccctcttgtccggttcgggtggtccgcggtcggggtgagtgagtgagcagctttgcttctccatctccccattcccttccctccccagcccccccggcccggcggcggtacgtgaccctgacgccgcagcgctagctagctcgccggaacggcaggtggcggcgcgcgacctgagagcacagcagcaccggaccggctcaggcaggcgaccggcagaaaagatggcgggagcagcagctgtggagacggcggcggcggcggcggcggcggcggcagctggccaacggaaaagcgtgctgccacgccgccaaggggcccgggtacgccacgccgctggaggccatggagaagggccccagggagaagctcgtctacgtcacctgcgtctacaacggcactggaattaacaagccggattaccttgcgacggtggatttggatcccagctctcctacatactcccaggtgatccacaggctcccggtcacccacatcggcgacgagctgcatcactctggctggaactcctgcagctcctgccacggtgacccatcggccaagcgccgcttcctgatcctgccttccttgctgtcaggccgtgtgtatgtcgtcgacacagcgacagacccaagggcgccatccttgcataaggtggttgagtctgaggacattgctgagaatactgggcttgggttccctcacacgtctcattgccttgcgtctggcgacattatgatttcttgccttggggacaaggaggggaatgcagctggcaatggcttcctgctgttggattcagagtttaatgtcaaaggacgttgggaaaagccaggtcacagtcccttggttggatatgacttctggtaccagcctcgccacaagacgatgatcagttcctcatggggagcccctgcagcctttaggacaggtttcgatcttcaacatgtccaggatggcctgtatggaaggcacctgcatgtgtacgactggcctggcggtgagctcaagcagacacttgatctaggtgacactggactccttccccttgaggtgaggtttttacatgatccatcaaaggacactggctatgttggctgtgctttaacaagcaacatggtgagatttttcaagaccgcggatggatcgtggagccatgaggttgctatctctgtgaaaccactgaaggtccgcaactggattctgccggaaatgccaggattgataactgattttgtcatctctcttgatgaccgttatctctactttgtaaactggcttcatggcgatattaggcagtacaacattgaggatcccgcaaagcctttcttggctggacaagtatgggttggtggtcttcttcagaagggcagtgatgtcgtctatgttactgatgatggtcaggaacagcagtataatgtgcctcaagtcaagggtcatcgacttagaggtgggccacagatgattcagctgagcttggatggcaagaggatatacgtgacaaactcacttttcagccgatgggatgagcagtttttcggtgatgatcttgtcaagaagggctcccacatgttgcagatcgatgtcgacaccgagaaaggaggcctggctgtcaaccccaacttcttcgtcgattttggcaccgagcctgatggtcctgccctggcccacgagatgagatatcctggtggggactgcacctctgatatatggatctgaggtcaaggattcggcgtaattaacaggctgctggagaatccctgttgttgtatgcactgtaattaacatggtatccgtgcggtgttccgtcttgtactgcgactgttgccagtggaataaggcatggtttcatgagaactctagattaataaaagaagtcctgattctgaaaaaaaaaaaaaaaa

SEQ ID NO: 1943 - DNA, 1791 bp, Oryza sativa Japonica Group
gagtgaggcggcgagcggcgagctcctccggtgatccgaggctcgccggccggcgagagcttgcctgtttcgggaggttttcagggtgatctgagagcacagcgagccgatggcggcggcggcgaacggggcggcgtgctgcggtggcgcgacggggccagggtacgcgacgccgctggaggccatggagaagggcccgagggagaagctcctctacgtcacctgcgtctacaacggtactggaattaacaagccggattacctgggtacggtggacgtggaccccaattcccctacatactcccaagtgatccacaggctcccagtcacccatgtcggcgatgagctgcatcactctggatggaacgcttgcagttcttgccatggtgatccatcggctagccgccgtttcttgattctgccttcgttgctgtctggccgtgtgtatgtcgttgacacgctgaaggacccaagggcgcctgccttgcataaggtggtcgaggctgaggacattgctgagaagacagggcttggatttcctcatacatctcattgcctggcatctggggagataatgatttcttgccttggggataaggagggaaatgctgctggcaatggcttcctcctgctggattctgaattcaatgtcaaaggacgttgggaaaagccaggtcacagccccttgtttggctatgattattggtatcaacctcgtcacaagacaatgatcagttcatcatggggagcacctgcagctttcaggactggttttgatcttcagcatgtgcaggatggtctctatggaagacatctgcacgtgtatgactggcctggtggtgagctcaagcagacactagatttaggcagtacaggtcttcttccacttgaggtgaggtttttacatgatccatcaaaggatactgggtatgtgggctgtgctctgacaagcaacatggtcagatttttcaagactgcagatggatcatggagccatgaggttgctatatctataaaaccattgaaagtgcgcaactggattctgcctgaaatgccaggactgataactgattttgttatctctctggatgatcgctatctctacttggtcaactggcttcatggtgatatcaggcagtacaacatcgaggaccctgcgaagcctgtgttggctggacaagtatgggcaggaggccttcttcaaaagggcagtgaggttgtgtatgtaactgaggatgacaaagaagagcagtacagtgtgccccaggtcaagggtcatcgacttagaggtgggccacagatgattcagctgagcctggatgggaagaggatatatgtgaccaactctcttttcagccgatgggacgagcagttctatggccaagatcttgtcaagaagggctcccacatgttgcagatcgacgtcgacactgagaaaggaggactatcgatcaaccctaacttctttgtagattttggtgctgagccagagggtccctccttggcccatgagatgagatatcctggtggagattgcacctctgatatatggatataaagatcttgaaggatttgcatacactcaggtgttgattcatcctgtgtattcactgtaactaagactgtatgcttgctgtggtctatatgtaatttcgatggtaacaagtccccataatacctagaacattcactccatggctcatttggtaacattagcttaataaagagatgtatccaatggtgcactttctgctagtgtttggattttgagctatctgattaaatttctcc

SEQ ID NO: 1944 - DNA, 2033 bp, Hordeum vulgare subsp. vulgare
ggctccctctgcccctctcgcagaacgcaagagaaaaaccaacagctcgctgcctccggtgagtcagcacagcacccagcccggctcccccctgcttctctccggcacggtggctcaccgttttccttcttccagggggttcgttcaggcgtcctgagatcacacatggccgcggcggtggcagaagcggcggtgccggcgccggcgaaggcgaacggcgccggcgccggtgccgggtgctgcgcggcgaagggccccgggtacgccacgccgagggaggccatggagaagggcccgcgcgaggggctcctctacgtcacctgcgtctacaatggcactggaatcgacaagccggattacctggctacggtggacgtcgaccccagttcagcgacgtactcccaggtgatccacaggctcccggccacccacatcggcgacgagctgcatcactccggctggaacgcctgcagctcctgccatggcgatccctccacgagccggcgcttcttgattcttccttcgttgctgtccggtcgcgtgtatgtggtcgacacggcgaaggatccgagggcgcctgccctgcacaaggttgtccaggccgaggacatcgctgagaagaccgggcttgggttccctcacacatcccattgccttgcaaccggtgatataatgatctcttgcctgggagacaaggagggaaatgctgctggcaatggcttcctcctgttggattcagaatttaacgtcaaaggacgttgggagaagccaggtcacagccccctgtttggctatgatttctggtaccagcctcgccacaagacgatgattagttcatcatggggagccccggcagctttcaggacaggttttgatcttcagcatgtccaggatggtctctatggcaggcacctgcatgtgtatgactggcctggtggtgagctcaagcagacacttgatctaggcagcacaggtcttcttccgctggaggtgaggtttttacacgacccatcaaaggacactggctatgttggctgtgctttgacaagcaacatggtgaggttcttcaaaactgcagatggatcatggagccatgaggtggctatatccatagaaccattgaaggtgcgcaactggatgctgccagaaatgccaggattgataactgattttgtcatctctctcgatgaccgctatctctacttggttaattggcttcatggggatatcaggcagtacaacattgaggaccctacaaagccagtgttggctggacaagtgtttgtaggtgggcttcttcaaaagggcggtgatgttgtctatgtgaccgacgatgacaaagaagagcagtatgctgtgccccaagtcaaggggcatcggcttagaggtgggccgcagatgattcagctcagcttggatggcaagagggtgtatgtgaccaactctctcttcagccggtgggacgagcagttctacggccctgaccttctcaagaagggatctcacatgttgcagatcgacgtcgacaccgagaaaggggggctcagtgtcaaccccgacttcttcgtggatttcggcaccgagcctgaaggtccctccttggcccatgagatgagatatcctgggggagactgcacctctgacatatggatctaggacgaagggtgtaacatatgcagctggagatccatggtgttgagctcactgtaattaagatggtttcttccctgcggtgttgtatgtgatgtggtgtcaattggaataagttcctgatagaacctctgacattggcttcatgggagcttgagccctaataagagatgcctctgattctgaaaattctgatgctggtgaaggccttatgtcttctgcttgaaattttctaccgatgaatggcaagtgattgagctggaagcaaagtaacacctgtgatagccatatattccctgtctggaaatacttgtcagacggagggagtattaaccagagatacaatgcaatttcaccaaaatcaagtagtctttcttgcaacc

SEQ ID NO: 1945 - DNA, 1374 bp, Oryza sativa (japonica cultivar-group)
atggagaagggcccgagggagaagctcctctacgtcacctgcgtctacaacggtactggaattaacaagccggattacctgggtacggtggacgtggaccccaattcccctacatactcccaagtgatccacaggctcccagtcacccatgtcggcgatgagctgcatcactctggatggaacgcttgcagttcttgccatggtgatccatcggctagccgccgtttcttgattctgccttcgttgctgtctggccgtgtgtatgtcgttgacacgctgaaggacccaagggcgcctgccttgcataaggtggtcgaggctgaggacattgctgagaagacagggcttggatttcctcatacatctcattgcctggcatctggggagataatgatttcttgccttggggataaggagggaaatgctgctggcaatggcttcctcctgctggattctgaattcaatgtcaaaggacgttgggaaaagccaggtcacagccccttgtttggctatgattattggtatcaacctcgtcacaagacaatgatcagttcatcatggggagcacctgcagctttcaggactggttttgatcttcagcatgtgcaggatggtctctatggaagacatctgcacgtgtatgactggcctggtggtgagctcaagcagacactagatttaggcagtacaggtcttcttccacttgaggtgaggtttttacatgatccatcaaaggatactgggtatgtgggctgtgctctgacaagcaacatggtcagatttttcaagactgcagatggatcatggagccatgaggttgctatatctataaaaccattgaaagtgcgcaactggattctgcctgaaatgccaggactgataactgattttgttatctctctggatgatcgctatctctacttggtcaactggcttcatggtgatatcaggcagtacaacatcgaggaccctgcgaagcctgtgttggctggacaagtatgggcaggaggccttcttcaaaagggcagtgaggttgtgtatgtaactgaggatgacaaagaagagcagtacagtgtgccccaggtcaagggtcatcgacttagaggtgggccacagatgattcagctgagcctggatgggaagaggatatatgtgaccaactctcttttcagccgatgggacgagcagttctatggccaagatcttgtcaagaagggctcccacatgttgcagatcgacgtcgacactgagaaaggaggactatcgatcaaccctaacttctttgtagattttggtgctgagccagagggtccctccttggcccatgagatgagatatcctggtggagattgcacctctgatatatggatataa

SEQ ID NO: 1946 - DNA, 1660 bp, Populus trichocarpa
atggctacaggcaccgaagtggtgagtgataatggacatggatgctgcaagaaaggaccaggttatgcgacaccacttgaagcaatgtctggtccgagggagtcacttctctatgtcacttgtgtttactctggaacgggaatagagaagcctgattatctagccacagtggatgttgatcccaactcacctacttattcaaaagttatccacaggctacctatgccaaacgtaggagatgaactgcatcatacaggatggaattcttgcagctcttgccatggagatccatctgcagcaaggcgttatctggtccttccttccttgatatctggtcgcatatatgcaattgacaccctaaaagatccaagggctccctcattgcataaagttgttgagcctgcagatattgtaaataagacaggattagcatatccacacacatcccattgccttgcttctggagatgtcatggtatcatgccttggagataaagatggaaatgcagagggaaatggatttcttctactcgattcagaattcaatgtaaaggggaggtgggagaaaccagggcacagtccaacgtttggttatgatttctggtaccaacctcgacacaacataatgattagctcatcatggggagctcctgcagccttcactaaaggcttcaatctgcaacatgtggcagatggtctttacgggaggcatttgaatgtctacagttggccccatggtgaactgaagcagacattggatcttggcgatacaggactcttgccattggagataaggtttctgcacgatccttctaaagattcagggtttgttgggtgtgccttaacaagtaacatggttaggtttttcaagacccctgatggatcatggagccatgaggtggcaatatcagtgaaaccattgaaggtgcaaaactggattctcccagaaatgccagggcttgtaactgattttctcatctctcttgacgatcggtttctgtactttgtcaactggctgcatggagatgtccgacagtacagcattgaggaccctgaaaaacctgtcctgaaaggacaagtttgggttggggggctgatccaaaaaggaagctctgtggtggctgagggtgaagatggaaaaacctggcagtatgatgttcctgaaatccagggacatcgattgaggggcgggcctcaaatgattcagctgagtttagacgggaagcgactttatgtcaccaactcacttttcagtacctgggatcgtcagttttatccggaacttatggagaaaggatctcacatgttacagatagatgttgacactgagaagggtggtcttgcaataaatccaaactattttgtggactttgcagctgaacctgatggtccttccctagctcacgagatgagatatccaggtggtgactgcacatcagatatatggatctaagcatcctaaatggttcggcagtgaggggttacgtgagaacagacattagaagttgtagttatgtgactgtaaattgcaatggcatgttgtggcttactgttgatggatgagtaactatgtctcttctaatgctttaatccatccttttaataataataataattgccgttttcataaccaacttgaactcatggctgatctgaccgta

SEQ ID NO: 1947 - DNA, 1644 bp, Populus trichocarpa
agagatggctacagggacagaagtggtgagtgctcatggacatggatgctgcaagaaaggaccaggttatgctagcccacttgaagccatgtctggtccaagagagtcacttatttatgtcacttgtgtttacgctggaacgggaatagagaagcctgattatctagccacagtggatgtagatcccaactcacctaattattcgaaagttatccacaggctacctatgccaaacttaggagatgaactacatcattcagggtggaattcttgtagctcttgtcatggagatccatcagcagccaggcgttatctgatccttccttcattgatatctggtcgcatatatgcaattgacacactaaaagatccaagggctccctcattgcataaagttgttgagcctgcggatattgtaaataagacaggattagcatatccacacacatcccattgccttgcttctggagatgtcatggtatcatgcctaggagataaagatggaaaggcagagggaaacggatttcttctacttgattcagaattcaacgtaaaggggaggtgggagaaaccagggcacagtccgaaatttggttatgatttctggtaccaacctcgacacaacaccatgattagctcctcatggggagctcctgcagccttcactaaaggcttcaatccgcaacatgtttcagatggtctttatgggaggcatttgcatgtctacagttggcctaatggtgaactgaaacagacattggatcttggcagtactggactcttgcccttggagataaggttccttcacaatccttctaaagatacagggtttgttggatgtgccttaacaagtaacatggtacgatttttcaagacccctgatgaatcatggagccatgaggtggcaatatcagtgaaaccattgaaggtgcaaaactggattcttccagaaatgccagggcttataactgattttctcttatctcttgacgatcggtttctatattttgtcaactggctgcatggagatgtcagacagtacaacattgaggaccccaaaaatcctgtcctgaaaggacaagtctgggttggggggctgatccaaaaaggtagcccagtagttgctgagggtgaagatggaaaaacctggcagtatgatgttccagaaatccagggacatcgattgagaggagggcctcaaatgattcagctgagtctagacgggaagcggctttatgtcaccaactcacttttcagtacttgggatcgtcagttttatccagaagtcgtggagaaaggatctcatatgttacagatagatgttgacactgagaaaggtggtcttgcaataaatccaaactattttgtagactttgcatctgaacctgatggaccttccctagcccatgagatgagatacccaggaggtgactgcacatcagatatatggatctaagcatcctggatggtttggcaatgaggggttacctgagaacagaccttaggaagcaataatatcaatgtgtaaattgcaatggcatgttgtcgcacttactctttgatggatgagtaacttcgttccttttaatgctttaatccatcgtttaatatcaaatgataattgcagtttcataatcaacatga

SEQ ID NO: 1948 - DNA, 1428 bp, Ricinus communis
atggtgaaagatagttgctgcatgaacaagggtccaggttatgccaccccacttgaggctatgtctggtccaagggagtctcttatttatgtcacctgtgtctactctggaacaggaatagataagcctgattatctagccacagtggatataaatccaaactcacctacttattcacaagtcatccataggttgcctgtgccatatgtaggagatgaactgcatcattcaggctggaatgcttgcagttcctgccatggtgatccatctgcaaaccggcgttttctaatccttccttcactgatatctggtcgtatctatgtgattgatacccaaaaagatcccaaggctccatccttgcacaaagttgttgagcctgcagatattatacagaagaccggattggcctatccacacacatcccattgtcttggctctggagatataatgatctcctgccttggagataaagatggaaaggcagagggaaatggatttcttcttcttgactccaatttcaatgtgaaaggaaggtgggagaaacctgggcatagtccactgtttggttatgatttctggtaccaaccccgacacaacacaatgattagctcatcatggggagctcctgcagccttctctaaaggatttgatcttcagcatgtgtcagatggtctatatgggaggcatctgcatgtatatagctggccaaatggtgaattgaaacagacattagatcttggcaatacagggctcctgcccttggagataaggttcctgcatgatccttctaaagacacggggtttgttgggtgtgctttgacaagtaacatggttcgatttttcaagaccccagatggatcatggagccatgaggtggcaatatcagtgaaaccattgaaggtcaaaaactggatcctaccagaaatgcctgggcttataactgactttctaatctctcttgatgatcgatttctgtacttcgtcaattggcttcatggtgatattagacagtacaacatcgaggacctcaaaaatcctgtcttgacaggtcaagtttgggttgggggcttgctccagaaaggaagccctataatggtcgagacagaagatagaagtacttggcaggctgatgttccagagatccagggtaatcgattaagaggaggacctcagatgatccagctaagtttagatgggaagcggctctatgtcaccaactcactcttcagtacttgggatcgtcagttctatcctgaactcgtggagaaaggatcccacatgttacagatagatgttgacactgaaaaaggtggtctcaaagtaaacccaaacttttttgtggactttgcagcagaacctgacggtccttcccttgcccatgagatgagatacccaggtggtgactgcacttctgatatatggatttaa

SEQ ID NO: 1949 - DNA, 2265 bp, Sorghum bicolor; identical to SEQ ID NO: 1724

SEQ ID NO: 1950 - DNA, 2213 bp, Zea mays; identical to SEQ ID NO: 1725

SEQ ID NO: 1951 - DNA, 2187 bp, Zea mays; identical to SEQ ID NO: 1726

SEQ ID NO: 1952 - DNA, 2210 bp, Oryza sativa Japonica Group; identical to SEQ ID NO: 1727

SEQ ID NO: 1953 - DNA, 2155 bp, Hordeum vulgare subsp. vulgare; identical to SEQ ID NO: 1728

SEQ ID NO: 1954 - DNA, 2042 bp, Hordeum vulgare subsp. vulgare; identical to SEQ ID NO: 1729

SEQ ID NO: 1955 - DNA, 2192 bp, Zea mays; identical to SEQ ID NO: 1730

SEQ ID NO: 1956 - DNA, 2006 bp, Zea mays; identical to SEQ ID NO: 1731

SEQ ID NO: 1957 - DNA, 2167 bp, Sorghum bicolor; identical to SEQ ID NO: 1732

SEQ ID NO: 1958 - DNA, 1631 bp, Zea mays
ccgtcatcgatctcgtttcaaatccatccatcctcgtttcctccgtcccgcagcatctcaaccccatggccaagatcaagatcgggatcaatgggttcggcaggatcggaaggctggtggccagggtggctctgcagagtgacgatgtcgagctcgtcgccgtgaacgaccccttcatcagcaccgactacatgacctacatgttcaagtacgacactgtacacggacagtggaagcaccatgaagtcaaggtgaaggactccaaaacccttctctttggtgagaaggaggttgctgtgtttggctgcaggaaccctgaggagatcccgtggggttcggttggtgctgaatatgttgttgagtctactggtgttttcactgaccaggagaaggctgcagctcacttgaagggtggtgccaagaaggttgtcatctctgctcctagcaaggatgcccccatgtttgtcgttggtgtcaacgagaaggagtacaagtctgacattaacattgtctccaatgctagctgcacaaccaactgccttactcctcttgctaaggtcatcaatgacaagttcggtatcgttgagggtctgatgaccactgtccatgccatcactgctacccagaagactgttgatgggccctcatctaaggactggaggggtggaagggctgctagtttcaacatcattcccagcagcactggagctgctaaggctgttggcaaagtgcttcctgtccttaacggaaagttgactggaatgtctttccgtgtcccaaccgtcgatgtttctgttgttgatttgactgttaggcttgaaaagtcagcaacctatgatgagatcaaggctgcggtcaaggccgaggcagaaggtagcctcaagggcatcctgggttacgttgaggaggaccttgtttccaccgatttccagggtgacagcaggtctagcatctttgatgctaaggctggcattgccttgaacggcaacttcgtgaagctcgtgtcctggtacgacaacgagtggggatacagcacccgcgtggtcgacctgatccgccacatgaacagcaccaactaagatgaagaactcaagtcaaggtctggtgatacgagcgagttgtcttcttcccccccgggagaaaagtgcttccgagaataaattttttccatcggaatgtctgaaactatgttgggtgtatcctagtggttggttgagcattaatggctcatattttgtcaggtctatgtgtcgccgtgaaacttttaatcaaatcagttcactcttttgcctctgtcattgccgtgccatttgacttcagagttccacgtcgttcactggctattctgctgccgtcgttcacaagcgccctcctgcacacgcggggggcctggcgcagggtttgcgcgggctgcttccggcagcagcaaccacaggcagctaatggctgaagctgcagccgcagccggtgatgatcagtgttttcaagtctgttgtccgaagtcggtttctgtagcccgattagggtttgtttgggtaatcttggattggagtggattaaggtagtataaggtgtattgaagtgtaatatgaactaatttccctttcaatccctaaaatacattttaatct

SEQ ID NO: 1959 - DNA, 1232 bp, Zea mays
ctcaaccccatggccaagatcaagatcgggatcaatgggttcggcaggatcggaaggctggtggccagggtggctctgcagagtgacgatgtcgagctcgtcgccgtgaacgaccccttcatcagcaccgactacatgacctacatgttcaagtacgacactgtacacggacagtggaagcaccatgaagtcaaggtgaaggactccaaaacccttctctttggtgagaaggaggttgctgtgtttggctgcaggaaccctgaggagatcccgtggggttcggttggtgctgaatatgttgttgagtctactggtgttttcactgaccaggagaaggctgcagctcacttgaagggtggtgccaagaaggttgtcatctctgctcctagcaaggatgcccccatgtttgtcgttggtgtcaacgagaaggagtacaagtctgacattaacattgtctccaatgcatgctgcacaaccaactgccttgctcctcttgctaaggtcatcaatgacaagttcggtatcgttgagggtctgatgaccactgtccatgccatcactgctacccagaagactgttgatgggccctcatctaaggactggaggggtggaagggctgctagtttcaacatcattcccagcagcactggagctgctaaggctgttggcaaagtgcttcctgtccttaacggaaagttgactggaatgtctttccgtgtcccaaccgtcgatgtttctgttgttgatttgactgttaggcttgaaaagtcagcaacctatgatgagatcaaggctgcggtcaaggccgaggcagaaggtagcctcaagggcatcctgggttacgttgaggaggaccttgtttccaccgatttccagggtgacagcaggtctagcatctttgatgctaaggctggcattgccttgaacggcaacttcgtgaagctcgtgtcctggtacgacaacgagtggggatacagcacccgcgtggtcgacctgatccgccacatgaacagcaccaactaagatgaagaactcaagtcaaggtctggtgatacgagcgagttgtcttcttcccccccgggagaaaagtgcttccgagaataaattttttccatcggaatgtctgaaactatgttgggtgtatcctagtggttggttgagcattaatggctcatattttgtcaggtctatgtgtcgccgtgaaacttttaatcaaatcagttcactcttta

SEQ ID NO: 1960 - DNA, 1281 bp, Zea mays
tcgagaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttcggttggcgctgaatatgttgttgagtctactggtgttttcactgaccaagagaaggctgcagctcacttgaagggtggtgccaagaaggttgtcatttctgctcctagcaaggatgcccccatgttcgttgttggtgtcaacgagaaggagtacaagtctgacatcaacattgtctctaatgctagctgcacaaccaactgccttgctccgcttgctaaggtcatcaatgacaagttcggtattgttgagggtctgatgaccactgttcatgccatcactgctacccagaagactgttgatgggccctcatctaaggactggaggggtggaagggctgctagtttcaacatcattcccagcagcactggagctgctaaggctgttggcaaagtgcttcctgtcctcaatggaaagttgactggaatgtctttccgtgtcccaactgtcgatgtttctgttgttgatctaactgttaggcttgagaagtctgccacctatgatgagatcaaggctgcggtcaaggccgaggcagagggtagcctcaagggcattctgggttatgtcgaggaggaccttgtttccaccgatttccagggtgacagcaggtctagcatctttgatgcgaaggctggcattgccttgaacggcaactttgtgaagcttgtgtcctggtacgacaacgagtggggatacagcacccgagtggtcgacctgatccgccacatgaacagcaccaagtaaatgaacaaactgatgaaagcatgcaaagagtgatgaaagcatgcaaagagagttgtgtttcttccccggaagtgcttccgagaataaatttttcttatctgattgtctaaaacctataacgggtgtatcgtagtggttgttatcgttaaacttttaacggtcattctatttcaaaagttttgcattttgactca

SEQ ID NO: 1961 - DNA, 1602 bp, Zea mays
gcaacggtccaggtttccaaggtccaacgttccgacccacgggaagcttctagaaaccattagacgcaccggtcgcgttcctcctcatggcccccacttgtcatccgtccatcctcacgtctctgccccaccattttaccggtagccaacaaaactaggttccgtggcgtcgggtgggaccagcaaccagccgccgcagccggcccccaggcgcctctatatacggcactccgactccgatacattggcgacatcacagatcacacacactcgagaactccatttcgatcccatttgaaatcaacccatcctcgtttcctccgtctagcagcctctcaccctcatggccaagatcaagatcgggatcaatgggttcggcaggatcggaaggctggtggccagagtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttactgtgtttggctgcaggaaccctgaggagatcccatggggttcggttggcgctgaatatgttgttgagtctactggtgttttcactgaccaggagaaggctgcagctcacttgaagggtggtgccaagaaggttgtcatttctgctcctagcaaggatgcccccatgttcgttgttggtgtcaacgagaaggagtacaagtctgacatcaacattgtctctaatgctagctgcacaaccaactgtcttgctcctcttgctaaggtcatcaatgacaagttcggtattgttgagggtctgatgaccactgttcatgccatcactgctacccagaagactgttgatgggccctcatctaaggactggaggggtggaagggctgctagtttcaacatcattcccagcagcactggagctgctaaggctgttggcaaagtgcttcctgtcctcaatggaaagctgactggaatgtctttccgtgtcccaactgtcgatgtttctgttgttgatctaactgttaggcttgagaagtctgccacctatgatgagatcaaggctgcggtcaaggccgagtcagagggtagcctcaagggcattctgggttatgtcgaggaggaccttgtttccaccgatttccagggtgacagcaggtctagcatctttgatgcgaaggctggcattgccttgaacggcaactttgtgaagcttgtgtcctggtacgacaacgagtggggatacagcacccgagtggtcgacctgatccgccacatgaacagcaccaagtaaatgaacaaactgatgaaagcatgcaaagagtgatgaaagcatgcaaagagagttgtgtttcttccccggaagtgcttccgagaataaatttttcttatctgattgtctaaaacctataattggtgtaatggtatcgtagtggttggttgagcattgagtgactcatattttgtcaggtctatgtgttatcgttaaacttttaacggtcattctatttcaaaagttttccaaaaaaaaaaaaaaaa

SEQ ID NO: 1962 - DNA, 1237 bp, Zea mays
ctcaaccccatggccaagatcaagatcgggatcaatgggttcggcaggatcggaaggctggtggccagggtggctctgcagagtgacgatgtcgagctcgtcgccgtgaacgaccccttcatcagcaccgactacatgacctacatgttcaagtacgacactgtacacggacagtggaagcaccatgaagtcaaggtgaaggactccaaaacccttctctttggtgagaaggaggttgctgtgtttggctgcaggaaccctgaggagatcccgtggggttcggttggtgctgaatatgttgttgagtctactggtgttttcactgaccaggagaaggctgcagctcacttgaagggtggtgccaagaaggttgtcatctctgctcctagcaaggatgcccccatgtttgtcgttggtgtcaacgagaaggagtacaagtctgacattaacattgtctccaatgcatgctgcacaaccaactgccttgctcctcttgctaaggtcatcaatgacaagttcggtatcgttgagggtctgatgaccactgtccatgccatcactgctacccagaagactgttgatgggccctcatctaaggactggaggggtggaagggctgctagtttcaacatcattcccagcagcactggagctgctaagggagtgccccatctgcttcctgtacttaacggaaagttgactggaatgtctttccgtgtcccaaccgtcgatgtttctgttgttgatttgactgttaggcttgaaaagtcagcaacctatgatgagatcaaggctgcggtcaaggccgaggcagaaggtagcctcaagggcatcctgggttacgttgaggaggaccttgtttccaccgatttccagggtgacagcaggtctagcatctttgatgctaaggctggcattgccttgaacggcaacttcgtgaagctcgtgtcctggtacgacaacgagtggggatacagcacccgcgtggtcgacctgatccgccacatgaacagcaccaactaagatgaagaactcaaggtctggtgatacgagcgagttgtcttcttcccccccggagaaaagtgcttccgagaataaatttttttccatcggaatgtctgaaactatgttgggtgtatcctagtggttggttgagcattaatggctcatattttgtcaggtctatgtgtcgccgtgaaacttttaatcaaatcagttcactcttttgcctcttgcc

SEQ ID NO: 1963 - DNA, 1886 bp, Sorghum bicolor
ccgcatcgcactcgcgaaccaaccccattctcgatcccgtttgaaatccatccgtcctcgtttcctccgtcccgcagcctctcgtccccatggccaagatcaagatcgggatcaatgggttcggcaggatcggaaggctggtggccagggtggccctgcagagcgacgatgtcgagctcgtcgccgtgaacgaccctttcatcaccaccgattacatgacctacatgttcaagtatgacactgtgcacggacagtggaagcaccatgaggtcaaggtcaaggactccaagacccttctctttggtgagaaggaggttgctgtgtttggctccaggaaccctgaggagatcccgtggggctcggttggtgctgattatgttgttgagtctactggtgttttcactgatcaggagaaggctgcagctcacttgaagggtggtgccaagaaggttgtcatttctgctcctagcaaggatgcccccatgttcgttgttggtgtcaacgagaaggagtacaagtctgacattaacattgtctccaatgctagctgcacaaccaactgccttgctcctcttgctaaggtcatcaatgacaagtttggtattgttgagggtctgatgaccactgttcatgccatcactgctacccagaagactgttgatgggccctcggccaaggactggagaggtggaagggctgcaagtttcaacatcattcccagcagcaccggagctgctaaggctgttggcaaagtgcttcctgtccttaatggaaagttgactggaatggctttccgtgttccaaccgtcgatgtttctgttgttgatctcactgttaggcttgagaagtctgctacctatgatgagatcaaggctgcagtcaaggctgaggcagagggtagcctcaagggcattctgggttatgttgacgaggaccttgtttccaccgacttccagggtgacagcaggtcaagcatctttgatgctaaggctggcattgccttgaatggcaacttcgtgaagcttgtgtcctggtacgacaacgagtggggatacagcacccgcgtggttgacctgatccgccacatgagcagcaccaactagatgaacgaactgaaggtctggtgatacaagggagtagggagttgtcttcttccccggagaaagtgcttccgagaataaaatttttctatctatcggattgtctgaaactattatgttgggtgtattgtatcgtagtggttggttgagcattgaatggctcatattttgtcaggtctactatctaccgttgataaacttttaatcaaccgttatatttcagttttgcattttgcacctgtgtcttgccgtaacattttgatttccattcttccttcacttggctatttggttttggttgccggcctcttcatagttccacgtccttcacttgctatttggttgccggcattctcctgccgttgtggagattgcattagtccgtttctcgtacttaaatgttgaagtttatttacccttcggcacaggggcaaaaattttgtagcatctcatactccttttttgaagtagtttttagattagatggttcacaaccttatttcgtgtggtgtagcgcctcacatttcgtggtacattgcatccaatcaggatagcatgacagatcttgtgctgctgccatggctgccccgccgctcttgtagctcagtgttcttcgtccccggcgctgttgaagaggccagcctatgcagcagcaggcactcgacgcaagtgttcatgaagatctttgttgatcgtcacacgattaaggtgaaatagtagatgtaaggatggggttgctgctgttttcatatttgtgcatgagagaaggcaaccactgtgttcgcc

SEQ ID NO: 1964 - DNA, 1325 bp, Oryza sativa Japonica Group
attcctcgcgtcgcatcgcacttgtagctctcgacccccgcatctcatccctcctctcgcttagttcagatcgaaatcgcaaatggcgaagattaagatcgggatcaatgggttcgggaggatcgggaggctcgtggccagggtggccctgcagagcgacgacgtcgagctcgtcgccgtcaacgaccccttcatcaccaccgactacatgacatacatgttcaagtatgacactgtgcacggccagtggaagcatcatgaggttaaggtgaaggactccaagacccttctcttcggtgagaaggaggtcaccgtgttcggctgcaggaaccctgaggagatcccatggggtgagactggcgctgagtttgttgtggagtccactggtgttttcactgacaaggacaaggccgctgctcacctgaagggtggtgctaagaaggtcgtcatctctgctcccagcaaggatgcccccatgtttgttgttggtgtcaatgagaaggagtacaagcctgacatcgacattgtgtccaatgctagctgcaccaccaactgccttgctccacttgccaaggttatcaatgacaggtttggtattgttgagggtttgatgaccactgtccatgcaatcactgcaactcagaagaccgttgatggaccctcgagcaaggactggaggggtggaagggctgccagtttcaacatcatccctagcagcactggagctgcaaaggctgtcggcaaggtgcttcctgctctcaatggaaagttgactggtatggctttccgtgttccaaccgtggatgtctctgtcgttgatttgactgtcaggcttgagaagccagcatcctatgatcagattaaggcagctatcaaggaggagtctgaggggaaactcaagggtattctgggttacgttgaggaggaccttgtttccacagacttccagggtgacaacaggtcaagcatctttgatgcaaaggccggtattgctctcaatgacaactttgttaagcttgtgtcttggtatgacaacgaatggggatacagctctcgcgttgttgacctgatccgtcacatgtacaacacccagtagaagatggtcactctttcggaagaaatggagtagagtgctactgaaaataagtcggaccttttgcgagctactccagtagagcttcattagctgtatgctgccttttgtttttgctggcttttcgcatgatgttttattaaaactcgatgtaatgttaatttgtgtacttcatctccggcactttataaatcgtggtttttgaatttgaaagttcaagtggcattagacg

SEQ ID NO: 1965 - DNA, 1459 bp, Oryza sativa Japonica Group
ggccgtggtgggcccaccgtctagcgaaaaccacccccgccgccgcgcgtgccacgtttactcccgtgggccccgcaacgaggcacaaaccctaggccgcttatataaacccgacccgccccgctccggtgatcggatccccacagctttgcgtttgcactcctctcgatctccattcgtttttgagttcctcgtttgctccgcctctctttcactcatgggcaagattaagatcggaatcaatgggttcggccgcatcggcaggctggtggccagggtggcgctgcagagcgaggatgtcgagctcgttgccgtcaacgatcccttcatcaccaccgagtacatgacatacatgttcaagtatgacaccgtccacggccagtggaagcatcatgaggtcaaggtcaaggactccaagaccctcatctttggcacgaaagaggttgcggtgttcggctgcaggaaccctgaggagatcccatgggctgcggctggtgctgaatacgttgttgagtctactggtgttttcaccgacaaggacaaggcagcagctcacttgaagggtggtgccaagaaggtcgtcatttctgctcccagcaaagacgcccccatgttcgttgttggtgtcaacgagaaggagtacaagtctgacgttaacattgtctccaacgctagttgcaccaccaactgcctggctcctctcgccaaggtcatcaatgacagatttggcatcgttgagggtttgatgaccactgtccatgccatcactgctacccagaagactgttgatgggccctcgatgaaggactggagaggtggaagggctgctagcttcaacatcattcctagcagcactggagctgccaaggctgtcggcaaggtgcttcctgccctcaatggaaagctgactggaatggctttccgtgttcccacagtcgatgtttccgttgttgatctgactgttaggcttgagaagcccgccagctatgaccagatcaaggctgcaatcaaggaggaggctgagggcaagctcaagggcatccttggatacgttgaggaggaccttgtttccactgacttccagggtgacagcaggtccagcatctttgatgccaaggctggcattgctttgagcgacacgttcgtgaagcttgtgtcctggtacgacaacgaatggggatacagcacccgtgtgatcgacctgatccgtcacatgcacagcaccaactagacgagccctcctcatggaggcctgcagatacaggggagttgtgttttgccccagagaagagtagatgaagcctcttccgagaataaattttaaattctgtatggttttatgtccgtcgaaacctaaaactatacttggttgtatcatggtggttggttgggcctggtcatggctcatattttgtgtctaattttcttgcgcttaatctaaatcgaagtgttgcttcgc

SEQ ID NO: 1966 - DNA, 1014 bp, Triticum aestivum
atgggcaagattaagatcggtatcaacggtttcggccggattggcaggcttgtggccagggttgcgctccagagccccgatgtcgagctcgtcgccgtcaacgaccccttcatcaccaccgactacatgacctacatgttcaagtatgacactgtccacggacagtggaagcaccatgaagttaaggtgaaggactccaagacccttctcttcggtgagaaggaggttgctgtgtttggctgcaggaaccctgaggagatcccatgggctgctgctggtgctgagtacgttgttgagtccaccggtgttttcaccgacaaggacaaggctgcagctcacattaagggtggtgccaagaaggtcatcatttctgctcccagcaaggatgctcccatgtttgtctgtggtgtcaatgagaaggaatacaagtctgacatcgacattgtctccaacgctagctgcaccactaactgccttgctcctcttgctaaggttatcaatgacaggtttggcattgttgagggtttgatgaccacagtccatgccatgactgcaacccagaagactgttgatggtccttccagcaaggactggagaggtggaagggctgccagcttcaacatcattccaagcagcactggtgccgcaaaggctgttggcaaggtgctcccagagcttaacggaaagttgactggaatggccttccgtgttcccactgttgatgtttctgttgttgatctgactgttagacttgcgaagccagcaacctatgatcagattaaggctgctatcaaggaggagtctgagggaaacctcaagggcattttgggttacgttgatgaggaccttgtttccactgactttcagggtgacaacaggtccagcatcttcgatgccaaggccgggattgctctgaacgaccactttgtcaagcttgtctcctggtacgacaacgagtggggatacagcacccgcgtggtcgacctcatccgtcacatgcacagcaccaagtaa

SEQ ID NO: 1967 - DNA, 2167 bp, Sorghum bicolor; identical to SEQ ID NO: 1732

SEQ ID NO: 1968 - DNA, 2192 bp, Zea mays; identical to SEQ ID NO: 1730

SEQ ID NO: 1969 - DNA, 2096 bp, Zea mays; identical to SEQ ID NO: 1735

SEQ ID NO: 1970 - DNA, 2006 bp, Zea mays; identical to SEQ ID NO: 1731

SEQ ID NO: 1971 - DNA, 2064 bp, Oryza sativa Japonica Group; identical to SEQ ID NO: 1737

SEQ ID NO: 1972 - DNA, 2078 bp, Hordeum vulgare subsp. vulgare; identical to SEQ ID NO: 1738

SEQ ID NO: 1973 - DNA, 2265 bp, Sorghum bicolor; identical to SEQ ID NO: 1724

SEQ ID NO: 1974 - DNA, 1874 bp, Oryza sativa Japonica Group; identical to SEQ ID NO: 1740

SEQ ID NO: 1975 - DNA, 1869 bp, Sorghum bicolor; identical to SEQ ID NO: 1889

SEQ ID NO: 1976 - DNA, 1824 bp, Zea mays; identical to SEQ ID NO: 1890

SEQ ID NO: 1977 - DNA, 1878 bp, Zea mays; identical to SEQ ID NO: 1891

SEQ ID NO: 1978 - DNA, 1795 bp, Zea mays; identical to SEQ ID NO: 1892

SEQ ID NO: 1979 - DNA, 1790 bp, Zea mays; identical to SEQ ID NO: 1893

SEQ ID NO: 1980 - DNA, 1590 bp, Oryza sativa Japonica Group; identical to SEQ ID NO: 1894

SEQ ID NO: 1981 - DNA, 1721 bp, Hordeum vulgare subsp. vulgare; identical to SEQ ID NO: 1895

SEQ ID NO: 1982 - DNA, 4479 bp, Oryza sativa Indica Group; identical to SEQ ID NO: 1896

SEQ ID NO: 1983 - DNA, 1878 bp, Zea mays; identical to SEQ ID NO: 1891

SEQ ID NO: 1984 - DNA, 1790 bp, Zea mays; identical to SEQ ID NO: 1893

SEQ ID NO: 1985 - DNA, 1824 bp, Zea mays; identical to SEQ ID NO: 1890

SEQ ID NO: 1986 - DNA, 1795 bp, Zea mays; identical to SEQ ID NO: 1892

SEQ ID NO: 1987 - DNA, 1869 bp, Sorghum bicolor; identical to SEQ ID NO: 1889

SEQ ID NO: 1988 - DNA, 1721 bp, Hordeum vulgare subsp. vulgare; identical to SEQ ID NO: 1895

SEQ ID NO: 1989 - DNA, 1590 bp, Oryza sativa Japonica Group; identical to SEQ ID NO: 1894

SEQ ID NO: 1990 - DNA, 4479 bp, Oryza sativa Indica Group; identical to SEQ ID NO: 1896

SEQ ID NO: 1991 - DNA, 1467 bp, Sorghum bicolor
aatcgaggattggccgggacggagagagagagagagagaggaggagggtttgcgccgcgctgctcgactggaaggagcacaagtgtatcgctgcgattgcggcgccggctacaagcagagcacacaggggggtccaggctagcctacacctacagaggagagccagggtgtgccgtactgcccgtgcgcgctgcggagaagagggcaggggaggcaggaagcaggcagcagcagagatggaggtggggttcctgggtctaggcatcatgggcaaggcaatggcggccaacctcctccgccacggcttccgcgtcaccgtctggaaccggaccctcgccaagtgccaagagctcgccgcgctcggcgccaccgtcggggagacgcccgcctccgtcgtctccaagtgcagatacaccatcgccatgctctccgaccctagcgccgcactatcagttgtcttcgacaaggatggcgtgctcgagcagatcggtagcgggaagggctatgtggacatgtccactgttgacgctgcaacttcgaccaagattagcgaggcagttaaacaaaaagggggagctttccttgaagctccagtttcagggagcaagaagccagctgaagatggtcaattggtcattcttgctgcaggggacaagccattgtatgacggtatggttcctgcatttgatgtactggggaagaagtcattctttctgggagagattggaaatggggcaaagatgaagcttgtggtcaacatgatcatgggaagtatgatgaatgctttgtccgagggactttgtttggccgacaaaagtgggttgagcccccaaacacttctcgatgtactggaccttggtgccatcgcaaacccaatgttcaagttgaaggggcctacaatgctgcaaggcagctacaaccctgcgtttcccctgaaacatcagcagaaggacatgaggttagctcttgctctgggagatgagaacgccgtcgctatgcccgtctcagcagctgccaatgaggcgttcaagaaggcgagaagcctggggctgggggaccaggatttttcggcggtctatgaggtagtgaagggcgcgggtggttctgggtctggccaggcgtgatggaatcatgtgtgtgaccttgttagcccgtttccatgccgatttgcaacacagtctcgtctcgccgtcgtagcgacgtacgagtacgtgtatattcaagatctggaaccagaccgtacttcgcaaaagaaataataaatcaaaagctgatgctagcttgcacgataaccacgtgcagacttagagtgtttttggttcatggacgtaactgaaaccttcgcctaagttaatggtcctttgatgcatttaactcaggctaaaatatggctgatcctacaaatcagcaagactattcgggtgtaacttggcacaggtcgtgacttggcaaatatggtcgtcatcc

SEQ ID NO: 1992 - DNA, 1179 bp, Zea mays
agtccgccacaagcacacgcgcacacaggggccaagcgcctacacctacagaggagagacaaggtctgccgtccgcgcgtgcgcggaagaggggacggaggaagaaggctgccagcaatcagagatggaggtggggttcttgggtctgggcatcatgggcaaggcaatggcgaccaacctcctccgccacggcttccgcgtcaccgtctggaacaggaccctcgccaagtgccaagagctcgccgcgctcggcgccaccgtcggggagacgcctgcctccgtcgtctccaagtgcagatacaccatcgccatgctctccgaccccagcgccgccctatcagtcgtcttcgacaaggatggcgtgctcgagcagatcggtagcgggaagggctatgtggacatgtccactgttgacgctgcaacttcgaccaagattagcgaggcagttaaacaaaaagggggagctttccttgaagctccagtttcagggagcaagaagccagctgaagatggccaattggtcattcttgctgcagggaacaagccattgtatgatggtatgattcctgcatttgatgtactggggaagaagtcattctttctgggagagattggaaatggggcaaagatgaagcttgtggtcaacatggtcatgggaagtatgatgaattctttgtccgagggactctgtttggccgacaaaagtgggctgagcccccaaacacttcttgatgtactggaccttggcgccatcgcaaacccaatgttcaagctgaaggggcctacaatgctgcaaggcagctacagccctgcgtttcccctgaagcatcagcagaaggacatgaggttagcgcttgctctgggagatgagaacgccgtcgccatgcccgtctcagcagctgccaatgaggcgttcaagaaggcgaggagcctggggctgggagaccaggatttttcggcggtctatgaggttgtgaagggcgcgggtggttctggatctggccagccgtgatagaaggaccatttgtgagttgtgactttgttagcccatttccatgccgatttgcaacatagcgacgtacgagtacgtgtgtattcgaaatttggaaccagaccatacgttgcaaaagaaataataaatcaaagagatggtgctagctcgaaaaaaaaaaaaaaaaa

SEQ ID NO: 1993 - DNA, 1233 bp, Oryza sativa Japonica Group
gaggaagaacactgggggagaagaacacaagtgtgcagcgtgcgtgtgtggaggcgagaggaggaagacgaaggcgaggagggaggaggtagctgcgcgcgggcgatggaggtggggttcctggggctgggcatcatggggaaggcaatggcggccaacctcctccgccacggcttccgcgtcaccgtctggaaccggactctctccaagtgccaggagctcgtcgcgctgggcgccgccgtgggggagacgccggcggccgtcgtcgccaagtgcagatacaccatcgccatgctctccgaccccagcgccgcgctatctgttgtattcgacaaggacggcgtgctcgagcagattggggaagggaagggttatgtggacatgtccactgttgatgccgccacttcttgcaagataagcgaggctataaaacaaaaaggtggggcttttgttgaagctccagtttcaggaagcaaaaagccagctgaagatggccaattggtcattcttgctgcaggggacaaggtattgtatgatgatatggtccctgcatttgatgtacttgggaaaaagtcgttctttttgggagagattggaaatggagcaaagatgaaactggtggtcaacatgatcatgggaagtatgatgaatgctttgtctgagggactctctctggctgataacagtggtttgagcccccagacacttcttgatgtcctggaccttggcgccatcgcgaatccaatgttcaagctgaaagggccctcgatgctgcaaggcagctacaaccctgcatttcccctgaaacaccagcagaaggatatgaggttggcacttgccctaggagacgagaacgctgtctccatgccagtggcagctgcttccaacgaggcgttcaagaaagcaagaagcttgggactaggggacctggatttctcagcggtttacgaggtactgaagggcgcaggtggctcaggcaaggcgtgaaactctgaacgctagaatccattcttcagaatctgcccattgccgtgcaggtttgctacagtgatcggcatcgaaccacgcagcatatgtcatcgtattgatactactgggtaaccagtgtgaacgatgtagttgcaggttaagtactacagcttgcgtgaacttcatcccaataataaagatatatatagctctgttatgcgatgcaactgtgtagtcacccaggttaagtacgttttttagtgc

SEQ ID NO: 1994 - DNA, 1188 bp, Hordeum vulgare subsp. vulgare
ggggcgtgcagtcaggaagaggggacgagagagaggaggggagaggagccaaccccgccgccacggcttccgcgtgctaggaagacgaagaagagtagcagcagcagggagagggaggccgcgatggaggtcggcttcttggggctgggcatcatgggtaaggcaatggcggccaacctcctccgccacggcttccgcgtcaccgtctggaaccggaccctctccaagtgcgacgagctcgtcgcgatgggcgccgccgtcggggacacgccggcgtccgtcgtggccaagtgcaagtacaccatcgccatgctctccgatcccagcgccgcgctatctgttgttttcgacaaggatggtgtgctcgagcaaatcggggagggcaagggctacgtggacatgtccactgttgatgctgcaacttcttgcaagataagcgaggcggttaaacaaaagggcggagcttttgttgaagctccagtttcagggagcaagaagccagctgaagatggccaattggtcattcttgctgcaggcgacaaggcactatatgatgacatggtccctgcatttgacatacttgggaagaagtcgttctttctgggggagatgggaaatggagcaaagatgaaactggtggtcaacatgatcatgggaagtatgatgaatgctttctccgagggactctgtttggctgacaaaagtgggttgagcccccagacgcttcttgatgtcctggatctcggtgccatcgcaaatccgatgttcaagatgaaagggccttcgatgctacagggcagctacaatccagcatttcccctcaaacatcagcagaaggatatgaggctggctctgtcattgggagatgaaaatgccgtctccatgccagtcgcagctgctgctaatgaggcattcaagaaagcaagaagcttgggacttggcgacctggatttttctgcggtgcacgaggtgctgaaaggcacaggtggttcaggctaaagcgtgaccgggggctgaatgcttaaaatcacgtgccatgggcatgcagatattcttgtagttcctcctacccatgtggcttatcatcgtactattgatgtgtacgtacattcgaattattggcttgggcatgaaggtatctgtgggatttgggtctttcggcgtcctggacaccggagaccgctgccc

SEQ ID NO: 1995 - DNA, 1544 bp, Vitis vinifera
atgatggaagacaggaagcccatggccatatatcattagggtatatacagatatcagtagagcaaagaaaagaaaagggttgagaagatcattacagtcacttgtcgcttgcagtttgaagattggagaatagagagagatcaaaatggaggtggggttcttgggtctgggaataatgggaaaggccatgtccatcaatctcattcggagtggcttcaagctcactgtttggaacagaaccctctccaagtgtgatgaacttgtggagcttggcgcttcaattggagaaactcctgcagcagtagttaagaagtgcaattataccattgcaatgttgtctgatccttctgttgctctttcggtggtttttgacaaagatggtgttcttgaacaaatttgccatggaaaaggttacattgacatgtcaactgttggtgccgacacttcttcaaaaattagtgaggcaattacatcaaagggtggttctttccttgaagctccagtttctggaagtaagaaacctgcagaagatggtcaactggtaattcttgctgctggggagaaggcattgtacgatgaagcgattcctgcttttgatatcatggggaagaagtcttttttcttggggcaggtcggaaatggagctaaaatgaaacttgtggtcaacatgataatgggcagtatgatgaatgcattttctgaagggcttgtattggctgacagaagtggactgaaccctcatactcttcttgatgtattggacctgggtggaattgctaatccaatgtttaggttgaaaggacccacaatgatacaaaacaattactcccctgcatttcctctgaagcatcagcagaaggatatgaggttggctcttgctcttggggatgaaaatgcggtatccatgccagtagcagctgctgccaatgaggctttcaagaaagctaggagcctgggattgggggaccttgacttttctgctgtgtatgagaccgtgaagacccttgaacattcatcctgatacagtgtatctgctcgaggccttgaaccacaatagggcacaatcatccttggtgatttgggaagttaaggacttgtgatgtagttaatgactaaaattatgcatatcaattccctgtttgtaaaaactagttcattgtgaggaacaagaagttctggtgctgccagattgattgtatactcggtccatcaccaaggaaggagctcttttgaaagtaacaacagtgaaaatatcataccagactttgtccttgttttttgttgcacatttctgtaaggaaccatccaacatagcccattatcctgagggccacattattagtggaaccgagtttatcgattggcctaaatatgtctgaccaagattcttcttaagttttgaatgaaaaatctggcttgtatgaagagcccaatgaccataagctgaaagaaacccttatttggtctcttacggaattgtctagacccctcttgggagggaatgtacttcgttgttggattttattgatgatgggttttagtta

SEQ ID NO: 1996 - DNA, 1326 bp, Glycine max
ggatgccgctaaaggaaacgcctttcctgagaagtcggaaggaagagagtgagagtgagagagatggagtttggatttttgggtttggggataatgggtaaggctatggcaatcaatctgctacgccatggcttcaaggtcactatttggaacagaaccctctccaagtgtgatgaactcgtgcaacatggtgcttcagttggagaaaccccagcaactgtagtcaagaaatgcaagtataccattgcaatgttatctgatccttcggctgctttatcggttgtgtttgataaagatggtgttcttgagcatattaatggaaaatgttatattgacatgtcaacagttgatgctgatacatcttccaaaatatctgagactatcaaagcaaaaggtggttacttccttgaagctcctgtttcgggtagcaagaagccagcagaagatggccaactcataatacttgctgctggagataaggcattgtatgatgaagtgcttccagcatttgatgtactggggaagaagtctttctttctgggtgaggttggaaatggtgcaaaaatgaaacttgttgttaacgtgataatgggcagtatgatgaatgctttctctgagggactcacactagctgaaagaagtggtttgaaccctggaactcttctcgatgtgctggatcttggtgccataagtaacggcatgtttaaattgaaaggacctacaatgctccaaaacagttattccccagcttttccactgaaacgccagcagaaggacatgagattagctcttgcccttggagatgaaaatgctgtatcaatgccagtagcagctgctgcaaatgaggctttcaagaaagccagaagcatggggttgggagaccttgatttttcagcagttcatgagactttgaaagctcctgatcattcatcttgaccagatggatctctgaattgattaaaccactgttaggcaacagtgtgatgcgaaccatctatttatgaaacagcaatttgagcataggtcattattgtagaatcttgttgaaatgaatgaaccttgtaaaattttgctactttcactgcaagattaagctataaaatgcaagaacattggtttagttcaactgattgcagacttgtagtggacggcttggccatctgttcacagacgttaattgttttagtttatgtgagtggtttgaataggttgcatgactattttatgaaccttcgtggcattaaatgtttgctttgattaggctctttatgtgtatttatactaataatactaataacttcttagagtaaaaaaaaaaaaaaaaaa

SEQ ID NO: 1997 - DNA, 1387 bp, Vitis vinifera
atggaggtggggttcttgggtctgggaataatgggaaaggccatgtccatcaatctcattcggagtggcttcaagctcactgtttggaacagaaccctctccaagtgtgatgaacttgtggagcttggcgcttcaattggagaaactcctgcagcagtagttaagaagtgcaattataccattgcaatgttgtctgatccttctgttgctctttcggttaatggtgttcttgaacaaatttgccatggaaaaggttacattgacatgtcaactgttggtgccgacacttcttcaaaaattagtgaggcaattacatcaaagggtggttctttccttgaagctccagtttctggaagtaagaaacctgcagaagatggtcaactggtaattcttgctgctggggagaaggcattgtacgatgaagcgattcctgcttttgatatcatggggaagaagtcttttttcttggggcaggtcggaaatggagctaaaatgaaacttgtggtcaacatgataatgggcagtatgatgaatgcattttctgaagggcttgtattggctgacagaagtggactgaaccctcatactcttcttgatgtattggacctgggtggaattgctaatccaatgtttaggttgaaaggacccacaatgatacaaaacaattactcccctgcatttcctctgaagcatcagcagaaggatatgaggttggctcttgctcttggggatgaaaatgcggtatccatgccagtagcagctgctgccaatgaggctttcaagaaagctaggagcctgggattgggggaccttgacttttctgctgtgtatgagaccgtgaagacccttgaacattcatcctgatacagtgtatctgctcgaggccttgaaccacaatagggcacaatcatccttggtgatttgggaagttaaggacttgtgatgtagttaatgactaaaattatgcatatcaattccctgtttgtaaaaactagttcattgtgaggaacaagaagttctggtgctgccagattgattgtatactcggtccatcaccaaggaaggagctcttttgaaagtaacaacagtgaaaatatcataccagactttgtccttgttttttgttgcacatttctgtaaggaaccatccaacatagcccattatcctgagggccacattattagtggaaccgagtttatcgattggcctaaatatgtctgaccaagattcttcttaagttttgaatgaaaaatctggcttgtatgaagagcccaatgaccataagctgaaagaaacccttatttggtctcttacggaattgtctagacccctcttgggagggaatgtacttcgttgttggattttattgatgatgggttttagtta

SEQ ID NO: 1998 - DNA, 1180 bp, Populus trichocarpa
aagagcagagtttcttcttcttcttcttcttcttcttcttcgaaatagagagagaaaaaaatggaggtagggttcttggggttagggataatgggaaaggccatgtccatgaatttacttaaaaatggcttcaaggtcactgtctggaacaggacgctctccaagtgtaatgaactggtggagtttggtgcatcaattggagaaacccctgcacaagtagtcaagaaatgcaggcttactattgctatgttgtcggatcctgccgcggctctttcggtggtttttgataaagatggtgtacttgagcaaattgacagcggaaaaggttatattgacatgtccacggttgatccagaaacatcttccaagatcagccaggcaattacatcaaagggcggtgccttccttgaggctcctgtgtcaggtagcaagcagcctgcagaaactggtcaacttgtaatccttgctgctggggataaggggttgtatgaggaatcaattccagcttttgatgttttggggaagaagtctttcttcttggggcaagtcggaaatggagcaaaaatgaaacttgtggtcaacatgataatgggcagtatgatgaatgcattttcagagggactggtgctgtcagaaaggagtggactcaacccacatgatcttcttgatatcttggatcttggtggaatagctaatccaatgttcaggggaaaaggaccagctatgctcaagagtaatcactcccctgcatttcctctgaaacatcagcaaaaggacatgcggttggctctagctcttggggatgaaaatgctgtgtcaatgccagtagcagcggcagcaaatgagtctttcaagaaggccagaagcatgggattgggggacctagacttttcagctgtgcatgagattctgaagatgaccaaggattaatcactccttgatagttcacatgacattgattcaaaacacaatgcgcagctcggacttggtttgcagccctggaagttgtagcctagttcatcaatcacaagctagatgatgaagctcctttaatgaatgaattgttgacttcaatttttgttctgtttttttttttttcatttctttcaccagaactctttggccgtgaaaataaacataatttgcttggcaggataaacagcaaactttctacttgaac

SEQ ID NO: 1999 - DNA, 1109 bp, Solanum lycopersicum
atcagtgtagaaagaaaaaaagaaaagaatggaggaaatagggtttctagggattggtattatgggaaaagcaatggcggtcaacttgctgcgccatggtttcaaggttactgtttggaatcgcaccctctccaggtgtgatgagctagtgcaacatggagcctctgttggagaaactcctgcagaagtaatcaagaaatgcaagtatacaattgcaatgttgtctgatccagctgcagctctttcagtggtttttgacaaacacggagcacttgagcacatatgtgccggaaagggctatatagacatgtcaaccgttgatgctgatacttcttcacagattagccaggccattacatcaaagggtggttcattccttgaagctccagtttcagggagcaaaaagccagctgaagatggacaactagtaatcctagcagctggtgacaaggatctgtacgatcaagtagtacctgcttttgatgtcctgggaaagaaatcttttttcttgggaaagattgggaatggagcaaaaatgaaacttgttgttaatatgataatgggcagtatgatgaatgcgttttcagaaggaattgtactggctgacaaaagtggattggaccctcatacccttctcgatgtgttggatcttggagccatagctaacccaatgttcaaaatgaaaggacctgccatgataaaaaatagctacccacccgcatttcctctgaaacatcagcagaaggacatgaggctggctcttgcactcggagatgagaatgcagtgccaatgccagttgcagctgctgcaaatgaggcattcaagaaggcaaggagcttgggcttgggagaccttgacttttcagctgtgtttgagactctcagcaaatgagtcaggctggagatcattcccttttgtctctctaaaataattattagcatggaacttctaaaaattgtaatggaaccttccttcctatgtacttgcaaatgtcaaaacaacgtgacaacttgtaagccctcttctgttggctttaaaattagatttgaagtccaaagggaaaagacatcattcgttgagaaaatttaaataaccatttgaatcaaaa

SEQ ID NO: 2000 - DNA, 1312 bp, Picea sitchensis
gattgagtatccaggatagcaggcgtcgaagaaaaaagaacagaggaggacttcctatgagcactctgtaaatctctgtttaaataaaactattcggtcaacgaaacagaagctcagagaaatctttcatccataacaaaagcatggaggtgggtttcttgggcttgggcattatgggcaaggcaatggcagtaaatctactccgaaatgggttcaaagtgaccgtgtggaataggacactgtctaggtgtgaagaacttgttgagcaaggtgcttccatgggaagcactcctgctgaagttgttaaaaagtgcaagtatatcatagccatgttgtctgatcctcctgctgccctctcggtggtttttggcaaggatggtgtcctagagcaaatgtgtacaggaaaaggatacattgacatgtcaacagttgatacggtcacttcaacaaagatcagtgaggcaataattgaaaagggcgggagatttcttgaggctcctgtctcaggcagcaagaaacctgcagaagatggccaactgattattctcgccgctggtgataagtccttgtatgatgaggtcatgccttcttttgatgtaatggggaagaaagccttctttctaggggaggttggaaatggagctaagatgaagcttgttgtcaacatgattatgggcagcatgattactgcattctccgaaggccttgccctagctgataagagtggattaagccagacaacactattagatgtcctggaattaggcgctattgctaatccaatgttcaagttgaaaggtcctgctatgattcaagagaagttccccacagcatttcctttgaagcaccaacaaaaggatatgagattggcacttgctcttggagatgaagttgaagtatctatgcctgtagctgctgctgctaatgaggcattcaagaagggcataagcttggggcttagtgaccaagacttttcagctgtgtatcaggtagtaaaggaatcgagtgcagcaagtaaagtctaatgggcatttgattttgcaagaaaggaatccatgtactggatcattattactctgcaatgcttttgtcttgcttaggccctttgcctcttgagcattttgccttcaggcaaattaaagataatggacatgcaggtggcatggttcttaggattggaaacttcataattcaaaaagttcagttgacattattgagtttcagagaatccgtctaactttcttcaaatgtttgggacaatatgattaatagatctttatattttgtgtgtgtttgaaaaaaaaaaaaaaaa

SEQ ID NO: 2001 - DNA, 1931 bp, Zea mays; identical to SEQ ID NO: 1907

SEQ ID NO: 2002 - DNA, 2609 bp, Sorghum bicolor; identical to SEQ ID NO: 1908

SEQ ID NO: 2003 - DNA, 2564 bp, Hordeum vulgare subsp. vulgare; identical to SEQ ID NO: 1909

SEQ ID NO: 2004 - DNA, 2421 bp, Oryza sativa Japonica Group; identical to SEQ ID NO: 1910

SEQ ID NO: 2005 - DNA, 2547 bp, Zea mays
gtgaccaccgccctctagctcgtcgcctcgtcggcgtgcccagcttctggtccagcgcgtcgcctccgctgctgctgggcccgacgcccaactaccgtgccgaggtcccaggcaggaagcatcttggcgtacgtgccgccggcgacaagcacccaccacaccagtcaaatgaatagttgatttcatttcaagcaattcctgaacaactatattacagtcatgaagtcgttagccaagcaagagacacagccaaaatcgcggctcattgtgcgccttggtgtattccttgcatctcaccacattctgttcagtgttatatgctgctatgcaggcattatcgcgctactactccttccttcacttgcaaaaaacacatacctctcggagaatgctcttatacctggctctgcaaatccattattttctactgaagatgccattgaagcaaacagatttatgaaagcaattgaagctgtggctagagactcaagcagtgtaataggcatggcaaatttcatagcacaacaaatagaagatctaggtgcagaagtgtgttaccaaaagtttctccctcatggcaagaattttcaccctctgaagttcttcacctccatgacaaatgatattgcaattcaacctaatggcactgccaccaattttgggataaatactatcggcattttacgagctcctcgtggcgatggaaaagaagcaatagtgctggttactccttataattctcaaagagttcagtcgaatgaattattatcgctggctcttggtttctctgtcttctctctcttaagtcgagcagcatggctgtccaaggatgttgtgtggttatctgcagactcacagtttggagagtatgctgcagtctctgcatggctaaaccagtatcataatcccgtgtttttgagtcactcagtggtgtcacataccaagatgtacggtgcaaacaatatatatgatggtaattcagaaaaaacagaagccacggctttcaaacgtgctggaacaatggctgctgctctcatatttaaagttggggaaaccagaagatacagtgacagggatagtgttacgatttatgcagaggcatctaatggacaaatgccaaacttggaccttctgaatgtggtgcactatttggctgttcacagacaaggttttcgtgtgaacatcgctgcatttagttctttgttgagctctgcatggctcagggttattgctgaaattttgcatactattggtagtgtgttaagaaaaataaatcctgactggaagcttgatattgcagtccctgattatgtggaagggactgcaaatctagctaactctatgtacaaccaggctcttggagtgcccacagggtcccatggtgctttccgtgattatcaagttgatgcggtttctttagaattttcaccaacatttcatgtcaaaaatgagaatgctaaatctttgtttcttctgaagggtggaaggttaattgaaggagtggcacgttctgtgaacaatctgcttgagaagttccatcagtcctttttcctgtacttccttacaggtccaagcaagttcatttcggttggtgtgtatatgattccgtttgcattgcttttggcacctctcccaatagttgctgctgcccttgctgatggcagtagaagcatggaaaaaacagcggataagttgataggcgacggtaaaacagatggcattgctgatatttcgcagaacaagggtggatcatggaaatggcttcgagctgcaaaagtattgcttgttgtccaattatgggcagtacttgtttcactacttccatattacattactcagatacctgatgccacacctacgcaaagcacactcatttgggttgtgctctccatcgtcgtactgatctccctatctgtcttgtttggctcaccatactcaactggtgttgaatggaaacttctgaaggctaccatgatcacttccatctccatcggattggggcttatgtcgataataaatttcgccactgctcagcttggtgctctgatagtgatcccaatgtgtttgttttctcggcctctgaaggcatcagggatgaatttccttcctcgggcagttttgttggcttcaaatgtagcttttgctgtgttgggttttcctccagttgcgttgctgattatgaaaggagtgtccaagggatcgaggtcgtggacaatagatgttggagatttctgggtatggatggagttcctgtgggaaaggagcagcgcgacgtatctttacctatttcttgtacatcttccctgctggcttttgtgcgtccttgtgttcctgcacccatgtcaccaatcagaatataagctgaagcaggaatagctgtttggcatccatagtcttgtctttttggatggtaaatcttgtagactagtgtagaaatttctcactttcacaaacttttggttacccataattcggaaattattcacccagttggagacgacttgtagacgatgtatcctgcctaatgtactgtctgcaacattttcg

SEQ ID NO: 2006 - DNA, 4467 bp, Oryza sativa Japonica Group
atggcgtcgtcagctaaggaggaggcaaaaccgaagccgcgcctcattgtccgcctcggggtattcctcgcgtcgcaccacatactcttcaggttcgctctcatctcttcgtctttgatccaatcttgattctcctgtttctttctgtctgagacattgacattgttcaccctctgtgaccagcgctgtgtgttgtacggcgggcataatcgcgctcctcttcctcccttcgcttgccaagaacacgtacctatcagagaacgctcttatacccggtaagcttttttcttatactgctattccatgaaacaatcatctccgatgctgattgtcagacgcttctttctcattggtattagctgcaaattaagttgttttaaaatgtaggctctgcgaatacattattttctactgaggatgtccaggaagcaaacagatttgcgaagggaattgaagctgcaattggggaatcaagaggtggaacaacgtatgttattctgtatagagttcccttggttcatattctgcttccttcatagacaatgggctttaacaaaaattgcactgtgtacataatgtttaattatcatgtgatgctctattttgagtctactgttaaggggcttcctctgatgaaatacatccttaataccgcattttagttatactattgagcatagacatggtatccacataactctaaacgcaaagaagttttttcatgggtagtaacaaacgaatgataaaataaaagtcagagatatacaaagttcaggttttttatgagaaaacaatgtagatgcacaagcgcacaccatacatgcacttgagtggaaaccctagcacatgagtagaatggtggatgctgcgcataagttcagagcatcatcaagcaccgtcatgtcctttcctattgagacacacatgtaaatataacttctacatttttgcttatgaaatattaatctaaaagtaaattataagtttgtgcaatgatgatgatactctgcacattgaataagtgataataaattacaagaagtgaaggaacaagtggtataatcctatgttttccatagcttgtaagtttatatgattttctcaatgtctaattttatgcattattgtagggagatcccaaaattcatagcacaacaaacaaaaaatctgggagcagaagtgtattaccatgagttcctccctgacagcaaatgttttcatcctctgaagttctttacatccatgacaaataatatggcagccaaacccaatggaacctacaccaactttggcattaacacagttggcattatacgggctccacgaggtgatggcaaagaagcaattgtactggttactccttataattctcagaaagttacaccaaatgaattattatcacttgcacttggattctctgtcttctccctcctaagtcgagctgcatggctatcaaaggatattgtctggctgtctgcagactcacaatttggagagtactctgcggtctcttcatggttaaatcagtatcataatcctatgtttctgagtcacccagtgaatttggataccaagatctatggtgcaaatcaaattttatataaacctgatggcactgcagaaaaggcagaacttatggctttcaaacgtgctggaacaatggctgctgcactcatatttaaagttggagaaaccaggaaatatggtgatagagatagtgtcacgatgtatgcagaggcatctaatggccaaatgccaaacttggaccttctgaatgtggtgcactatttagctgttcatagacaaggttttcgcgtgaatgtcgagacatttaattccttgttgagctcttcatggcttagggttattgctgaagtatttcaaaatcttgggagtttgttgagaaaaataaatcctgactggaagcttgacgtgaccgttcctgattatgtggagggtactgcaaaccttgctagttctatgtataaccaggtaattgaaatatatattgttcattcatttccatttggtctataaaaatataagttttttcaactctgttaatcccttcttgtttggctttgcaactgcaggctcttggagtgcccacaggttctcatggtgctttccgtgactatcaagttgatgcagtttctttagaatttgcaccagcatttcatcttaaaaacgagaatgctaaatcttcatttcttctcaggggtggaaggtcagtttctattgtgttacggttgtgttattttaagctgctcttttttagagcaagtaggtagggagcgtatcctatgcacacaggccctcgcgtgtacacaccgtgtacaccaactaaaaattatcacaaaaaattctaggaaaattcatacatgtactttcaatagtattacatctacgtgcaaagtcgcatcttcaaattcattctacatagagaataacaaaaaagataaaattctgacaaaattacaaccttaaaactgtcagattttttgttacggctaaaatataatgaatttgacgttaagattttaaccctaggtgtaatacaattgaaagtatgggtatgattttttctagattttttggtgacattttttagttggtatacacgtgtgtacacgtgagggcctgtgtgcataggatatgttgccaagtaggtattgttgacatgcattaagcagttcattacttaattagagtgcatgtttacctattcaaaagtgtttgattgtcagataccagaaaactgaatacatactgaaggttttaaacaaactctagcttgtgccatttgtatgtatgtatttctctctgataaccaaagtaattcagctttgtcaaacattacctaatttcatatatctaattgctttgtgatgctcaattaattttattgtcaaaatatactattagtgagcattaaagcacatgttcgatgctaaagctgtataatctcaggcaacaaaaggctgattataaaataattctgtaactgccttggcctgttaaccttgcatattcttgtgcggaattattctggtgagaggtctgattgcatgtcagcctcataacagtcaaaaatttgctaggtctgtccttatgtcagtatgtgtgtctggattattccatagtaggatttgctaatggcattagcatactgtgatcttatccaatgatagaacatacaatttaacttatttcaagaaaaaaaatggaaacgataagggaagggtactgttgcctttgcctgaatccaagtttgccaaaaacaccagtgtgtgtcaatgacatgccatacccgacatcacctgtcattgtcgcaacacacggtattttcatatagggcgataagggggcgggcaatggtatattggcgtttcccccaaattgatgaagttttggactgaacttaacaaaggagcaggatcacaagacctctgacttatcatattaaagggttcactttatttttgagtaaaatacacctgctgcattttgtagagcagatgcttagcacagcatttatgttgatctcaccacaagattatctaaacatgtttgagaatgccttttgttcaggttaactgaaggggtggtgcgctctgtaaataacctgctcgagaagttccatcaatcgtttttcctgtatttccttacagccccaagcaagttcatttcagttggtgtatatatgattccgtttgcattactcctggcacccctcccaatagttgctgctgctcttgctggtggtagtaaaaccaaggggaaattggaggatgaatgtaaaacaaagggtaatgctgatgacctgcaaatggagggtggatcgtggaaatggcttaaatctgcaagagtactacttatcatccaattttgggcagtacttgtttctttactcccatactacattagccaaattcctggtgctatgccaatacagtatgcagtgatttgggccgttctctccatcactatattgatcatcctgtatgcaatgtttggctctccatcccgtgctggtgtggaatggaagcttctaaaagctacgatgatcacttccatcaccataggaatggggcttatgtcgatcataaattttgctactgctcagcttggggctctgatattgatcccaatgtgcttgttttctcgaccgctgagggcacagctcgagatgaatttcctacctcgcacagtattgttggcctcaaacatacttctcaccgtcttgggtttccctccagctgcatttcttatcatgaaaggtctatccaagggatcatggacagtagacattgttggtgatttctggctgtggatggagttcttgtgggaatggagcagcgcgacatatctgtatgtatttcttgtccatcttccctgctggctcttgtgcatccatgtgttgctgcatccatgctaccagcctgaatcaaagatgaagcaggagta

SEQ ID NO: 2007 - protein, 353 aa, Sorghum bicolor
MAEEGEEAVPPAAATVVGEEDAPAGEAPAPAVDYFGLPAELVSVLPSDPFAQLDVARRITSIALSHRLGLLEAEAALLRSQLAERDAEAEDLRERVEQLDAALAVATGRLRRAEEEKEALQRDNSALSNTVTKLNRDVAKLEVFRKTLVQSLQEDDSSDNTVPGARVAATSNFSSAPSDEDSAFPTSKSSQISETASSVSEENSQVDPDGPRPPRPGRPHVFLPSYNSTPRMTPPGSPPRRYASVSPPRRHSISVTSMNMLNDRSSGFSGQHTSPFDAPSQTGRTRVDGKEFFRNVRNRLSYEQFGAFLTNVKELNAHRQTREDTLRKADEIFGPENKDLYTIFESLITRNIR

SEQ ID NO: 2008 - protein, 337 aa, Zea mays
MADEGEEGVPPAAMVGEAPTEDFGLPAELMAVLPSDPFAQLDVARKITSIALSHRLGRLEAEAARLRSQLAERDAEAEELRERVEKLDSALAVATGRLRRAEEEKETLLRDNSALSNTVRKLNRDVAKLEVFKKTLVQSLQEDDSSDNTAPRASVAATSNFSAPSDEDSAFPTSKSSQISETASSVSEENSQVEPDAPRPPRPHVFLPSYNSTPRRTPPDSPPRRYASVSPPRRHSISVTSMNMFNDRSSGFSSQHSSPFDPPSQTGRTRVDGKEFFRHVRNRLSYEQFGAFLANVKELNAHRQTREDTLRKADEIFGPENKDLYTVFESLITRNIR

SEQ ID NO: 2009 - protein, 338 aa, Zea mays
MADEGEEAVPPAAMVGEAPTEDFGLPAELMAVLPSDPFAQLDVARKITSIALSHRLGRLEAEAARLRSQLAERDAEAEELRERVEQLDSALAVATGRLRRAEEEKETLLRDNSALSNTVRKLNRDVAKLEVFKKTLVQSLQEDDSSDNTAPRASVAATSNFSAPSDEDSAFPTSKSSQISETASSVSEENSQVEPDAPRPPPRPHVFLPSYNSTPRRTPPDSPPRRYASVSPPRRHSISVTSMNMFNDRSSGFSSQHSSPFDPPSQTGRTRVDGKEFFRHVRNRLSYEQFGAFLANVKELNAHRQTREDTLRKADEIFGPENKDLYTVFESLITRNIR

SEQ ID NO: 2010 - protein, 341 aa, Zea mays
MELEEAVPPAAMVGEDNAAAPTQDFGLPAELIAVLPSDPFAQLDVARKITSIALSHRLGLLEAEAARLRSQLAERDAEAEDLREHVEQLDAALAVATGRLRHAEEEKDALQRDNSELSNTVRKLNRDVAKLEVFKKTLVQSLQEDDSSDNTAPRERAAAASNFSSAPSDEDSAFSTSKSSQVSETASSVSEENNQVDPDAPRRPPRPHVFLQSYNSTPRMTPPDSPPRRFASVSPPRRHSISVTSMNMFNDRSSGFSGQHSSPFDAPSQTGRTRVDGKEFFRQVRNRLSYEQFGAFLANVKELNAHRQTREDTLRQAYEIFGPENKDLFTIFEGLISRNIR

SEQ ID NO: 2011 - protein, 322 aa, Zea mays
MADEGEEAVPPAAMVGEAPTEDFGLPAELMAVLPSDPFAQLDVARKITSIALSHRLGRLEAEELRERVEQLDSALAVATGRLRRAEEEKETLLRDNSALSNTVRKLNRDVAKLEVFKKTLVQSLQEDDSSDNTAPRASVAATSNFSAPSDEDSAFPTSKSSQISETASSVSEENSQVEPDAPRPPPRPHVFLPSYNSTPRRTPPDSPPRRYASVSPPRRHSISVTSMNMFNDRSSGFSSQHSSPFDPPSQTGRTRVDGKEFFRHVRNRLSYEQFGAFLANVKELNAHRQTREDTLRKADEIFGPENKDLYTVFESLITRNIR

SEQ ID NO: 2012 - protein, 366 aa, Oryza sativa Indica Group
MEGEVVEEEEEEVTAAPAPAAMVAAAEFGLTAEVMAVLPEDPFEQLDVARKITSIALASRLGRLEAEGARLRAQLAERDAAAEDLRERVEQLDAALAVATGRLRRAEEEKEALQRDNSLLSNTVRRLNRDVAKLEVFKKTLMQSLQEDEDPALEVFKKTLMQSLQEDEDPANTTPKARVSETSNFSSATSVGDEDSAFPVSKSSQLSETASSVSEESSHVEPDVPRPPRPHVFLPSYNSTPRVTPPDSPPRSFASISPPRRHSISITSRNLFDDRSSAYSGHSSVTSPFDAASHTGRTRVDGKEFFRQVRNRLSYEQFSAFLANVKELNSHKQTREDTLRKADEIFGPDNKDLYTIFEGLITRNIH

SEQ ID NO: 2013 - protein, 775 aa, Zea mays
MNGTHPWASMSGGPCSNLGYARDMNGNVPISTTNSSGPSIGVSSLVTDANSSLSGGAQLQPSTSMNGDSLMRVPASPISFSSNNISGSSVIDGCIMQQSPPQEQVQKQRSSSVTSQPVIDAGGALHAQKKSRIDVCQGGITEQQLIQQLLHGQNSLHYQGQQNPQLQALMQHHKLAQLQQRQQQHPFSQMQQPQVGIPRQPQLRPPLAQTGMQLGGPVRSPIESGICSRRILQYLYHKRHRPENNPITYWRKLVEEYFAPRARERWCVSSYENRGNSSAAAPQKALDTWRCGICNTHGGKGYEVTYEVLPRLCQIRFDHGVIDEYLYFDSPNEFRLPNGQMVLEHAKVVQKSVYEHLHVIHEGHLRIIFTPELKIMSWEFCSRRHEEYTTRKTIAPQVNNLLQVAQKFQAVVSESGSAGISNNDAQTICNMFVNASRQLAKNLEHHTLNEHGLSKRYVRCLQISEVVNHMKDLIEFSHKSKLGPKESLNSYSKTTAKFENMHDSRQAMAAANLANNQSNTKLMGVKQETSTSANNQTPGAGAIGNNNLPIAAPLNTYQNMLRSSGASTISLQQEASSVFKGPTAMHNGMQLEAARSFLGPNQVQFQHHPPSSSFQQQQQNSFHGFGVNPQYQQHVLNQLLQEVKNSNNRSKAQQPPLDAPPPNASGGGLAPGVATPNVIAATGEQGQHVNNSSSNHNGTVKGAAGTGPSNVINNSTASMASARNSSFKSVSSSPAAAGNAVSSKVDDSFHQLEDLDDMIANELVESGLFGAGHGW

SEQ ID NO: 2014 - protein, 842 aa, Oryza sativa Japonica Group
MRLRGRSDGPEASRGPHGDRSMAVNVLQSDDWDRTLVTSMSGAPCSNLGLVPRDMHGSIPISTTNSSGPSIGVSSLVTDANSSLSGGAQLQPSTSMNADSFMRLPASPMSFSSNNISGSSVIDGPIVQQSPPQEQMQKRRSSSVTSQPVIDAAGALHAQKKSRVDIRQDDILQHNLIQQLLQGQSSLHLQGQQNPQIQALIHQHKLAQIQQQQQHQMLQPFSQIQQSQVGIPRQPQLRPPLAQPGMQLAGPVRTPVENGLCSRRLKQYLYHKRHRPENNPITYWRKLIDEYFAPRARERWCVSSYEKRGNPSGAVPHTAPDSWRCDICNTHGGKGYEATYEILPRLCQIRFDHGVIDEYLFLDMANEFRLPNGLMLLEHTKVVQKSIYEHMHVIHEGQLRIIFTPELKIMSWEFCSRRHDEYITRRFLSPQVAHLLQVAQKYQTVATESGPAGVSNSDAQNICNMFVTASRQLAKNIDHHTLNEHGLSKRYVRCLQISEVVNHMKDLIEFSHKNKLGPIEGLKSYPKQTAAKLPVQNMHEPKQLMAAAGLPNDQTNLKAMGVKTEMNTHANETHGIGPIGNGPQNAAALNNYQNPIGNGLQNAAALNNYQNILRSSVANQSLLQQEASSMFKGPTAMHNGIQLEASRSFRGPNQVHLAQFQHPASFQQPMPQQSSLQGLGVSPQYQQHVLHQLLQEAKNTNNRVLAQQQQQQQLQHAPANSGLASGGTAITGSAASGDHMNNNGAVKGGTPMVTTGPSSVINNTASILPSRSNSFKSVSSNPQVAAAAGGGIGSGGHAATPKADALHELDDLDNLGNLISTELEESGLFLGDQAGGGYSWNM

SEQ ID NO: 2015 - protein, 803 aa, Oryza sativa Japonica Group
MSGAPCSNLGLVPRDMHGSIPISTTNSSGPSIGVSSLVTDANSSLSGGAQLQPSTSMNADSFMRLPASPMSFSSNNISGSSVIDGPIVQQSPPQEQMQKRRSSSVTSQPVIDAAGALHAQKKSRVDIRQDDILQHNLIQQLLQGQSSLHLQGQQNPQIQALIHQHKLAQIQQQQQHQMLQPFSQIQQSQVGIPRQPQLRPPLAQPGMQLAGPVRTPVENGLCSRRLKQYLYHKRHRPENNPITYWRKLIDEYFAPRARERWCVSSYEKRGNPSGAVPHTAPDSWRCDICNTHGGKGYEATYEILPRLCQIRFDHGVIDEYLFLDMANEFRLPNGLMLLEHTKVVQKSIYEHMHVIHEGQLRIIFTPELKIMSWEFCSRRHDEYITRRFLSPQVAHLLQVAQKYQTVATESGPAGVSNSDAQNICNMFVTASRQLAKNIDHHTLNEHGLSKRYVRCLQISEVVNHMKDLIEFSHKNKLGPIEGLKSYPKQTAAKLPVQNMHEPKQLMAAAGLPNDQTNLKAMGVKTEMNTHANETHGIGPIGNGPQNAAALNNYQNPIGNGLQNAAALNNYQNILRSSVANQSLLQQEASSMFKGPTAMHNGIQLEASRSFRGPNQVHLAQFQHPASFQQPMPQQSSLQGLGVSPQYQQHVLHQLLQEAKNTNNRVLAQQQQQQQLQHAPANSGLASGGTAITGSAASGDHMNNNGAVKGGTPMVTTGPSSVINNTASILPSRSNSFKSVSSNPQVAAAAGGGIGSGGHAATPKADALHELDDLDNLGNLISTELEESGLFLGDQAGGGYSWNM

SEQ ID NO: 2016 - protein, 344 aa, Zea mays
MMEADMKSVSVGTKSKSEVLESCLQQMKACFLDARVKKAKLLDAMGTFFARSNRPINETQNPVEVVRPCGACNGSEMLLKRRASGEFMVGCRSYPQCRNVVWLPGSLSEAAVTNQVCPICAPGPVYKIQFKFRRRDIPPNFDVDHLGCVGGCDDILKDLMEISRFGSRSQAATPARGPTPNGVGQGTPRQDLHTIFRPASQLNNDNPSVMHSQGFRSTHTQNPSNASDAGQVLCTSCGALCISRIANTEANRGRRFYKCQDPGCGFFKWEDEVDNGTGRGRRGRGSSRQASASASAGRRGGGRRGRGRNADGGMFVSATGDTVLGCCFNCGDPSHFANACPNRR

SEQ ID NO: 2017 - protein, 404 aa, Zea mays
MDKAGIGTDATMHDHIKKLLDRCYATKDENTRFSPTNLGEALVMGYDEMGYELWKPYLRSMMEADMKSVSVGTKSKSEVLESCLQQMKACFLDARVKKAKLLDAMGTFFARSNRPINETQNPVEVVRPCGACNGSEMLLKRRASGEFMVGCRSYPQCRNVVWLPGSLSEAAVTNQVCPICAPGPVYKIQFKFRRRDIPPNFDVDHLGCVGGCDDILKDLMEISRFGSRSQAATPARGPTPNGVGQGTPRQDLHTIFRPASQLNNDNPSVMHSQGFRSTHTQNPSNASDAGQVLCTSCGALCISRIANTEANRGRRFYKCQDPGCGFFKWEDEVDNGTGRGRRGRGSSRQASASASAGRRGGGRRGRGRNADGGMFVSATGDTVLGCCFNCGDPSHFANACPNRR

SEQ ID NO: 2018 - protein, 626 aa, Sorghum bicolor
MDNGFVNIPHPPLSEALMNDPFVLVGCSAPSSTMENMGQSTLCMDGLNPAMVSCSHVNGNTQIMNDIAPRDDGSRLVLGLGPTPNFYSAASTGSKQDQRLSGQSSTFTDSGMLRLGLQMDGGEAIQYLQAPNGALHSLGVVDEASTSATVRNMGGYMPSLLFAPRANSTVNETQVETPDSLDLTHSTSNSQHVQHHLQLSPEPSAMTESSFGVSSDVVTATTTSERSHSRHPKKCRFKGCSKGARGASGLCIAHGGGQRCHKSGCHKGAESSSAYCKAHGGGRRCEELGCTKSAEGKTDYCIAHGGGRRCEHPGCPKAARGKSGRCIKHGGGKRCSVKGCIRSAEGKAGLCISHGGGRRCQYPDCGKGAQGSTLYCKGHGGGKRCIFDGCSKGAEGSTPLCKAHGGGKRCMFEGGGVCAKSVHGATEYCVAHGGGKRCSVPGCTKSARGRTDCCVKHGGGKRCKVDNCGKSAQGSTEFCKAHGGGKRCTWSTGCEKFSRGKSGFCAAHGTLMARQREQEVVKNVGSMIGPGLFSGIVVSSATAASSMTNEHSSSGVSTASDCDGTMRSQSMIPPQVLVPRSMMPWSSEPVDGGREGGHVVPEGRVHGGGLLSLLGGSFRNADVEKL

SEQ ID NO: 2019 - protein, 624 aa, Zea mays
MDNGFMDIPHPPLVNDPFVLVGCPAPASTMENMGQSTICMDGLNPAMVSCSHVNGNTHIMNGLTARDDGSRLLLGLGPTPNFYSAVSTGSKQAQRLSGQSSTSIDSGMLKLGLQTDDREAIQYLQQAPNGALHSLDIVDEASTSAAVRNMGGYMPSLLFAPCSNSIANETQVENQDSLDLTHSTSNSQHLQHDLQLSPEPSATTESSFGMSSDVVTATTTSERSHSRHPKKCRFKGCSKGARGASGLCIAHGGGQRCHKPGCHKGAESSSAYCKAHGGGRRCEELGCTKSAEGKTDYCIAHGGGCRCQHPGCPKAARGKSGRCIKHGGGKRCSVKGCIRSAEGKAGLCISHGGGRRCQYPDCGKGAQGSTLYCKGHGGGKRCIFDGCSKGAEGSTPLCKAHGGGKRCMFEGGGVCAKSVHGATEYCVVHGGGKRCSVPGCTKSARGRTDCCVKHGGGKRCKVDSCGKSAQGSTHFCKAHGGGKRCTWSTGCEKFSRGKSGFCAAHGTLMARQREEEVVKNVGSMIGPGLFSGIVASSATAASSMTNEHSASGVSTASDCDGTVRSQSMIPPLVLVPRSMMPSWSTEPVDGGREGGHVVPEGRVHGGGLLSLLGGSFRDADVEKL

SEQ ID NO: 2020 - protein, 632 aa, Hordeum vulgare subsp. vulgare
MDNNFVDIPNQPLMNDPFVLVAQSAPSYALNNLGKSTVRMDCLGSGMANCGHGHESTQNMNNITATDDGCRLVLGLGPTPDFYSTHYQPTGVYKSKESQTLSGQSFCFTDPGVLRLGLQTDGAETIQPLQTPNERVHSFPVVDEASTSAAVRSMGGYMPSLLFAPRSSSSAATEAQLQTRDSLNPTHYNSNNTQHIQQHPQLSPEPSATTETSFGVSSDVVTGATTSEQRSHSRHPKKCRFKGCSKGGRGSSGLCIAHGGGQRCHKPGCHKGAESSTAYCKAHGGGRRCEELGCTKSAEGKTDYCIAHGGGRRCEYPDCPKAARGKSGRCIKHGGGKRCAMEGCIRSAEGKAGLCISHGGGRRCQYPDCAKGAQGSTLYCKAHGGGKRCVFDGCSRGAEGSTPLCKAHGGGKRCMFEGGGVCPKSVHGGTEFCVAHGGGKRCAAPGCTKSARGRTDCCVKHGGGKRCRIDNCGKSAQGSTDFCKAHGGGKRCTWGSGCEKFARGKSGLCAAHGTLVARQQEHGMVKSGGSMIGPGLFSGIVASSTTAASSMTNEHSSSGISTASDSDGTVRSQSMIPPQLLVPRSMMPSSSSEPTVRGGKEAGCAVPEGRVHGGGLLSLLGGSFRNVNIDKL

SEQ ID NO: 2021 - protein, 723 aa, Oryza sativa Japonica Group
MAEGDNQWEREVVKKASTSTSSQALSMVIEGEGNEAAGSGALISGLRGSEAVMLIVGVVLRTSQPIISSLFFSYSVIQLSFALTPLSYCQAVMDNSFVDIPNQPPMNNPFVLMEPSAQSYMVNLGKSTPHMDCLGSAMANYGHGNQNIQCIDSITTRDDGCRLVLGLGPTPNFYSAECQPTGVDKLKEAPSLSGQGLTITDPGTLRLGLQMDVSQTIQPLQAPDGTVHSFTVVDEASASPSVRSIGGYMPSLLFAPRSGSSAVNETHEAETQDSLDLTHSDNDNTQHVQHHLQLSPEPSAMTDTSFGVSSDVVTATTTSEQRNHPRHPKKCRFKGCSKGARGASGLCIAHGGGQRCHKPGCHKGAESSTAYCKAHGGGRRCEELGCTKSAEGKTDYCIAHGGGRRCEHDGCPKAARGKSGRCIKHGGGKRCTVQGCIRSAEGKAGLCISHGGGRRCQFPDCSKGAQGSTLYCKGHGGGKRCIFDGCSKGAEGSTPLCKAHGGGKRCMFEGGGVCPKSVHGGTEYCVAHGGGKRCSVAGCTKSARGRTDCCVKHGGGKRCKVDNCSKSAQGSTDFCKAHGGGKRCTWGTGCEKFARGRSGLCAAHGTLAAKQQERDAANNGAGMIPPGLFSGIVTVAATSSMTNEYSSSGISTASDCDGTVRSQAMMIPPQVLVPRSMMPSSSSEPTVHGGREGGCAVPEGRVHGGGLLSLLGGSFRNADMDKL

SEQ ID NO: 2022 - protein, 717 aa, Oryza sativa Japonica Group
MAEGDNQGEREVVKKASTSTSSQALSMVIEGEGNEAAGSGALISGLRGSEAVMLIVGVVIISSLFFSYSVIQLSFALTPLSYCQAVMDNSFVDIPNQPPMNNPFVLMEPSAQSYMVNLGKSTPHMDCLGSAMANYGHGNQNIQCIDSITTRDDGCRLVLGLGPTPNFYSAECQPTGVDKLKEAPSLSGQGLTITDPGTLRLGLQMDVSQTIQPLQAPDGTVHSFTVVDEASASPSVRSIGGYMPSLLFAPRSGSSAVNETHEAETQDSLDLTHSDNDNTQHVQHHLQLSPEPSAMTDTSFGVSSDVVTATTTSEQRNHPRHPKKCRFKGCSKGARGASGLCIAHGGGQRCHKPGCHKGAESSTAYCKAHGGGRRCEELGCTKSAEGKTDYCIAHGGGRRCEHDGCPKAARGKSGRCIKHGGGKRCTVQGCIRSAEGKAGLCISHGGGRRCQFPDCSKGAQGSTLYCKGHGGGKRCIFDGCSKGAEGSTPLCKAHGGGKRCMFEGGGVCPKSVHGGTEYCVAHGGGKRCSVAGCTKSARGRTDCCVKHGGGKRCKVDNCSKSAQGSTDFCKAHGGGKRCTWGTGCEKFARGRSGLCAAHGTLAAKQQERDAANNGAGMIPPGLFSGIVTVAATSSMTNEYSSSGISTASDCDGTVRSQAMMIPPQVLVPRSMMPSSSSEPTVHGGREGGCAVPEGRVHGGGLLSLLGGSFRNADMDKL

SEQ ID NO: 2023 - protein, 723 aa, Oryza rufipogon
MAEGDNQGEREVVKKASTSTSSQALSMVIEGEGNKAAGSGALISGLRGSEAVMLIVGVVLRTSQPIISSLFFSYSVIQLSFALTPLSYCQAVMDNSFVDIPNQPPMNNPFVLMEPSAQSYMVNLGKSTPHMDCLGSAMANYGHGNQNIQCIDSITTRDDGCRLVLGLGPTPNFYSAECQPTGVDKLKEAPSLSGQGLTITDPGTLRLGLQMDVSQTIQPLQAPDGTVHSFTVVDEASASPSVRSIGGYMPSLLFAPRSGSSAVNETHEAETQDSLDLTHSDNDNTQHVQHHLQLSPEPSAMTDTSFGVSSDVVTATTTSEQRNHPRHPKKCRFKGCSKGARGASGLCIAHGGGQRCHKPGCHKGAESSTAYCKAHGGGRRCEELGCTKSAEGKTDYCIAHGGGRRCEHDGCPKAARGKSGRCIKHGGGKRCTVQGCIRSAEGKAGLCISHGGGRRCQFPDCSKGAQGSTLYCKGHGGGKRCIFDGCSKGAEGSTPLCKAHGGGKRCMFEGGGVCPKSVHGGTEYCVAHGGGKRCSVAGCTKSARGRTDCCVKHGGGKRCKVDNCSKSAQGSTDFCKAHGGGKRCTWGTGCEKFARGRSGLCAAHGTLAAKQQERDTANNGAGMIPPGLFSGIVTVAATSSMTNEYSSSGISTASDCDGTVRSQAMMIPPQVLVPRSMMPSSSSEPTVHGGREGGCAVPEGRVHGGGLLSLLGGSFRNADMDKL

SEQ ID NO: 2024 - protein, 631 aa, Oryza sativa Japonica Group
MDNSFVDIPNQPPMNNPFVLMEPSAQSYMVNLGKSTPHMDCLGSAMANYGHGNQNIQCIDSITTRDDGCRLVLGLGPTPNFYSAECQPTGVDKLKEAPSLSGQGLTITDPGTLRLGLQMDVSQTIQPLQAPDGTVHSFTVVDEASASPSVRSIGGYMPSLLFAPRSGSSAVNETHEAETQDSLDLTHSDNDNTQHVQHHLQLSPEPSAMTDTSFGVSSDVVTATTTSEQRNHPRHPKKCRFKGCSKGARGASGLCIAHGGGQRCHKPGCHKGAESSTAYCKAHGGGRRCEELGCTKSAEGKTDYCIAHGGGRRCEHDGCPKAARGKSGRCIKHGGGKRCTVQGCIRSAEGKAGLCISHGGGRRCQFPDCSKGAQGSTLYCKGHGGGKRCIFDGCSKGAEGSTPLCKAHGGGKRCMFEGGGVCPKSVHGGTEYCVAHGGGKRCSVAGCTKSARGRTDCCVKHGGGKRCKVDNCSKSAQGSTDFCKAHGGGKRCTWGTGCEKFARGRSGLCAAHGTLAAKQQERDAANNGAGMIPPGLFSGIVTVAATSSMTNEYSSSGISTASDCDGTVRSQAMMIPPQVLVPRSMMPSSSSEPTVHGGREGGCAVPEGRVHGGGLLSLLGGSFRNADMDKL

SEQ ID NO: 2025 - protein, 631 aa, Oryza sativa Indica Group
MDNSFVDIPNQPPMNNPFVLMEPSAQSYMVNLGKSTPHMDCLGSAMANYGHGNQNIQCIDSITTRDDGCRLVLGLGPTPNFYSAECQPTGVDKLKEAPSLSGQGLTITDPGTLRLGLQMDVSQTIQPLQAPDGTVHSFTVVDEASASPSVRSIGGYMPSLLFAPRSGSSAVNETHEAETQDSLDLTHSDNDNTQHVQHHLQLSPEPSAMTDTSFGVSSDVVTATTTSEQRNHPRHPKKCRFKGCSKGARGASGLCIAHGGGQRCHKPGCHKGAESSTAYCKAHGGGRRCEELGCTKSAEGKTDYCIAHGGGRRCEHDGCPKAARGKSGRCIKHGGGKRCTVQGCIRSAEGKAGLCISHGGGRRCQFPDCSKGAQGSTLYCKGHGGGKRCIFDGCSKGAEGSTPLCKAHGGGKRCMFEGGGVCPKSVHGGTEYCVAHGGGKRCSVAGCTKSARGRTDCCVKHGGGKRCKVDNCSKSAQGSTDFCKAHGGGKRCTWGTGCEKFARGRSGLCAAHGTLAAKQQERDAANNGAGMIPPGLFNGIVTVAATSSMTNEYSSSGISTASDCDGTVRSQAMMIPPQVLVPRSMMPSSSSEPTVHGGREGGCAVPEGRVHGGGLLSLLGGSFRNADMDKL

SEQ ID NO: 2026 - protein, 404 aa, Zea mays; identical to SEQ ID NO: 2017

SEQ ID NO: 2027 - protein, 344 aa, Zea mays; identical to SEQ ID NO: 2016

SEQ ID NO: 2028 - protein, 405 aa, Zea mays
MAISSSTSRTQDLVPLLCLLLMAAAAPQHSCASPPLPVTLPGCPDKCGNISIPYPFGTKEGCFKPDFEVLCNDSFHPPRAFIQMAGAKITVDDTYYKTNEDGMPDNDIGSSEWPIELVDVSVSEGKARVLGAFSYDCKMNDTYHAVRRQEIDLGYWMPFSMSDADDVLMGIGSNVVAKQTSGPQCQSYLLYQLSTRKTDDPVNGSCSGQGCCSANLRSGGMAATEVTIQKNTKDDGGFYGDGVSCSYAMIVDKSWYNFSSPDVDSDAFLRRNAAGVPVVVNFSFGVDGCPNASEPTPDDFACVSNYSTCIERPPVLDNVSIPYFCSCSAGYEGNPYIHGGCQDIDECARPHMYPCYGGKCKNTPGDYECSCPAGTKGNAKQAPCTDLFPLPAKISVVLGLCSWSS

SEQ ID NO: 2029 - protein, 437 aa, Zea mays
MGCFLSCFRGGSNPSGDLRDPLVRESRIGDAFVNDEKKLDEATGKLDVEAATDHGVDDELRREANYLKSCGTISQTPPEILDSIPINSEDANDCGDTPTNVQQTKHVVVVEENSSELLNSDDHDVLHKQDTDEGRTLRTGSETQPSLEEVKPSCHQNVVRDQSTDSSDSPYPTPLVLRGDIQTPGTVYAAAHKEAWKPGKRARAFIYPVLRPIENKMQWMELKAAESPTVLSPNPPKRRNLSAAGSGDKAHQPPTRSAFAGSSEHGSFPNTYSRAAQDGVMSPDEPKCQNGLEQQDGREELSTRSSGRGKRGVASLSHWLKPSSSSADDGSPDDGSSNFVGTEEEKTRCGANVSDVPFFPAFGLDWEGETDKPTPVLPKAWDGNGIPNTTTKYKEDQKVSWHATPFEERLLKVLSDEKPRHERRISGKLIHLDENAE

SEQ ID NO: 2030 - protein, 437 aa, Zea mays
MGCFLSCFRGGSNPSGDLRDPLVRESRIGDAFVNDEKKLDEATGKLDVEAATDHGVDDELRREANYLKSCGTISQTPPEILDSIPINSEDANECGDTPTNVQQTKHVVVVEENSSELLNSDDHDVLHKQDTDEGRTLRTGSETQPSLEEVKPSCHQNVVRDQSTDSSDSPYPTPLVLRGDIQTPGTVYAAAHKEAWKPGKRARAFIYPVLRPIENKMQWMELKAAESPTVLSPNPPKRRNLSAAGSGDKAHQPPTRSAFAGSSEHGSFPNTYSRAAQDGVMSPDEPKCQNGLEQQDGREELSTRSSGRGKRGVASLSHWLKPSSSSADDGSPDDGSSNFVGTEEEKTRCGANVSDVPFFPAFGLDWEGETDKPTPVLPKAWDGNGIPNTTTKYKEDQKVSWHATPFEERLLKVLSDEKPRHERRISGKLIHLDENAE

SEQ ID NO: 2031 - protein, 431 aa, Sorghum bicolor
MGNCVASGGTTTVTAAGAAGEDGRRRGRRWKAPREEQLGSVPGRIFSNDGRSRTAAVFTQQGRKGINQDAMLVWDGFGGEDDVVLCGVFDGHGPHGHLVARRVRDALPLKLMSAVRASKAGLDMPAAAWRKAFASAYKAMDKDLRSHAILDCFCSGSTAVTVLKLGSDLYMANIGDSRAVLGSRDSGGGGGMVAVQLTVDLKPDVPSEAERIKKCRGRVFALQDEPEVPRVWLPFDDAPGLAMARAFGDFCLKDYGVISVPEFFHWSLTEKDQFVILASDGVWDVLSNQEAVDIVASSPSRSKAAKSLVEAATREWKTKYPTSKIDDCAVVCLYLDGKMDHERDSTASMDNISLEGSVADPNEAPEQEPALTRNFTVRTVAGSAHEKALSGAVDAVVAGAAHDQNWSGLDGVTRVNSLVQLPRFSEEKAIG

SEQ ID NO: 2032 - protein, 431 aa, Zea mays
MGNCVASGGTTTVTAAGAAGEDGRRRGRRWKAPREEQLGSVPGRIFSNDGRSRTAAVFTQQGRKGINQDAMLVWDGFGGEEDVVLCGVFDGHGPHGHLVARRVRDAMPLKLMSAVRASKAGLDMPAAAWRKAFARAYKTMDKDLRSHATLDCFCSGSTAVTVLKLGSDLYMANIGDSRAVLGSRDGGDGGMVALQLTIDLKPDVPSEAERIKKCRGRVFALQDEPEVPRVWLPFDDAPGLAMARAFGDFCLKDYGVISVPEFFHWSLTEKDQFVILASDGVWDVLSNQEAVDIVSSSPSRSKAARSLVEAATREWKTKYPTSKIDDCAVVCLYLDGKMDHERDSTASMDNMSLDEGSAADPNEAQEQEPALTRNFTVRTVAGSAHEKALSGAVDVVVAGAAHDQSWSGLDGVTRVNSLVQLPRFSDEKAIG

SEQ ID NO: 2033 - protein, 431 aa, Hordeum vulgare subsp. vulgare
MGNCAARGDTAVTAAGAGGEDGKRRRGRWKAPREDQLGTVPGRIFSNDGRSRTASVFTQQGRKGINQDAMLIWDGFGGEEDGVLCGVFDGHGPHGHLVARRVRDSLPLRLMSAARASPKTGLDMPATAWRKAFTRAYKAMDKDLRSHPSLDSFCSGSTAVTVLKLGSDLYMANIGDSRAVLGSRDAAAGGMAAVQLTVDLKPDVPSEAERIKKCRGRVFALQDEPEVPRVWLPFDDAPGLAMARAFGDFCLKDYGVISVPEFFHWPLTDKDQFVILASDGVWDVLSNQEAVDIVSSSPSRSKAARTLVEAANREWKTKYPTSRTDDCAVVCLYLDGKMDHERDSTASMDNISIEDDSVADPNEVQEQQEPALTRNFTVRTVPGSAQEKALAGADAKISGGADDHNWSGLDGVTRVNSLVQLPRFTEEKAVS

SEQ ID NO: 2034 - protein, 427 aa, Oryza sativa Japonica Group
MGNCVARSGTAVDAGGDGGEDGKRRRRRWKAPREDQLGMVPGRIFSNDGRSRTATVYTQQGRKGINQDAMLVWDGFGGEDDGVLCGVFDGHGPHGHVVARRVRDSLPLRLMSAARDSGADMPAAAWRKAFARAYKAMDKDLRSHPSLDCFCSGSTAVTVLKLGSDLYMANIGDSRAVLGSREATGGGMVAVQLTVDLKPDVPSEAERIKKCRGRVFALQDEPEVPRVWLPFDDAPGLAMARAFGDFCLKDYGVISVPEFFHWSLTEKDQFVILASDGVWDVLSNQEAVDIVSASPSRSKAAKSLVEAATREWKTKYPTSKIDDCAVVCLYLDGKMDHERDSTASLDNISIEEGSVADPNEPQEQEPTLTRNFTVRTVAGSTQEKTLAGVDARIAGVANDQNWSGLDGVTRVNSLVQLPRFSEERAIG

SEQ ID NO: 2035 - protein, 434 aa, Zea mays
MGNCVASGGATTVTAAGEDGRRRGRRWKAPREEQLGSVPGRIFSNDGRSRTAAVFTQQGRKGVNQDAMLVWDGFGGEEDVVLCGVFDGHGPHGHLVARRVRDALPLKLMAAVRESKPGLDMAAAAWRKAFARAYKAMDKDLRSHATLDCFCSGSTAVTVLKLGSDLYMANIGDSRAVLGSRDGGGMVAVQLTVDLKPDVPSEAERIKKCRGRVFALQDEPEVPRVWLPFDDAPGLAMARAFGDFCLKDYGVISVPEFFHWSLTEKDQFIILASDGVWDVLSNQEAVDIVSSSPSRSKAARSLVEAAAREWKAKYPTSKTDDCAVVCLYLDGKMDQERDSTASMDNISLDYEGSAADPNEAQELQEPALTRNFTVRTVAGSAHEKALSGAADAAVAVGGGAACAHDQSWSGLDGVTRVNSLVQLPRFSEEKAAVG

SEQ ID NO: 2036 - protein, 432 aa, Zea mays
MGNCVASGGATTVTAAGEDGRRRGRRWKAPREEQLGSVPGRIFSNDGRSRTAAVFTQQGRKGVNQDAMLVWDGFGGEEDVVLCGVFDGHGPHGHLVARRVRDALPLKLMAAVRESKPGLDMAAAAWRKAFARAYKAMDKDLRSHATLDCFCSGSTAVTVLKLGSDLYMANIGDSRAVLGSRDGGGMVAVQLTVDLKPDVPSEAERIKKCRGRVFALQDEPEVPRVWLPFDDAPGLAMARAFGDFCLKDYGVISVPEFFHWSLTEKDQFVILASDGVWDVLSNQEAVDIVSSSPSRSKAAISLVEAAAREWKAKYPTSKTDDCAVVCLYLDGKMDQERDSTASMDNISLDYEGSAADPNEAQELQEPALTRNFTVRTVAGSAHEKALSGAADAAVGGGAACAHDQSWSGLDGVTRVNSLVQLPRFSEEKAAVG

SEQ ID NO: 2037 - protein, 427 aa, Oryza sativa Indica Group
MGNCVARSGTAVDAGGDGGEDGKRRRRRWKTPREDQLGMVPGRIFSNEGRSRTATVYTQQGRKGINQEAMLVWDGFGGKDESVLSGVFDGHGPHGHVVARRVRDSLPLRLMSAARDSGADMPAAAWRKAFARAYKAMDKDLRSHPSLDCFCSGSTAVTVLKLGSDLYMANIGDSRAVLGSREATGGGMVAVQLTVDLKPDVPSEAERIKKCRGRVFALQDEPEVPRVWLPFDDAPGLAMARAFGDFCLKDYGVISVPEFFHWSLTEKDQFVILASDGVWDVLSNQEAVDIVSASPSRSKAAKSLVEAATREWKTKYPTSKIDDCAVVCLYLDGKMDHERDSTASLDNISIEEGSVADPNEPQEQEPTLTRNFTVRTVAGSTQEKTLAGVDARIAGVANDQNWSGLDGVTRVNSLVQLPRFSEERAIG

SEQ ID NO: 2038 - protein, 411 aa, Zea mays
MGNCVASGGATTVTAAGEDGRRRGRRWKAPREEQLGSVPGRIFSNDGRSRTAAVFTQQGRKGVNQDGHGPHGHLVARRVRDALPLKLMAAVRESKPGLDMAAAAWRKAFARAYKAMDKDLRSHATLDCFCSGSTAVTVLKLGSDLYMANIGDSRAVLGSRDGGGMVAVQLTVDLKPDVPSEAERIKKCRGRVFALQDEPEVPRVWLPFDDAPGLAMARAFGDFCLKDYGVISVPEFFHWSLTEKDQFVILASDGVWDVLSNQEAVDIVSSSPSRSKAAISLVEAAAREWKAKYPASKTDDCAVVCLYLDGKMDQERDSTASMDNISLDYEGSAADPNEAQELQEPALTRNFTVRTVAGSAHEKALSGAADAAVGGGAACAHDQSWSGLDGVTRVNSLVQLPRFSEEKAAVG

SEQ ID NO: 2039 - protein, 361 aa, Zea mays
MLVWDGFGGEEDVVLCGVFDGHGPHGHLVARRVRDAMPLKLMSAVRASKAGLDMPAAAWRKAFARAYKTMDKDLRSHATLDCFCSGSTAVTVLKLGSDLYMANIGDSRAVLGSRDGGDGGMVALQLTIDLKPDVPSEAERIKKCRGRVFALQDEPEVPRVWLPFDDAPGLAMARAFGDFCLKDYGVISVPEFFHWSLTEKDQFVILASDGVWDVLSNQEAVDIVSSSPSRSKAARSLVEAATREWKTKYPTSKIDDCAVVCLYLDGKMDHERDSTASMDNMSLDEGSAADPNEAQEQEPALTRNFTVRTVAGSAHEKALSGAVDVVVAGAAHDQSWSGLDGVTRVNSLVQLPRFSDEKAIG

SEQ ID NO: 2040 - protein, 236 aa, Sorghum bicolor
MDTDTTSTDSQFRHPAPAISAAGARAVVCSLAARGAESLARGLVTCVFATVGTVLGAITGGLIGLATETGVLRGTGVGGITGALVSMEVVESSLALWRSDEPAIWSVVYVLDVIWSLLTGRLVREKVDPAVLNAVESQMSAAEATVLHGDHADIFGMGGTNGMARVAIDALPVVRFTERSSVDASGDLIACSVCLQEFQAGDSARSLPVCRHTFHLPCIDGWLLRHASCPLCRRSV

SEQ ID NO: 2041 - protein, 223 aa, Zea mays
MDTDTDTTTSTGSRLHPAAGHVRSLAARGAESLVTCVFATVGTVLGAITGGLIGLATETGVLRGTGVGGITGALVSMEVVESLWRSDEPAIWSVVYVLDVIWSLLTGRLVREKVDPAVLSAVESQMSAADTPALHADHADIFDTGGTNGMARVAMDALPVVRFTERSNVDASGELIACSVCLQEFQAGDSARSLPVCRHTFHLPCIDGWLLRHASCPLCRRAV

SEQ ID NO: 2042 - protein, 571 aa, Sorghum bicolor
MRSPVPERSLIIESDDDDDTQSAVATNWIGHGHGHDEEEPEQEPGSDSDSSSSSSSCATPRRGPSSPAYTQQWPQSYRQSIDILSSVHSSNLSFLGTPTLSRLSNSFLAITDSFRGKAPETISNFVKPLLGPTSSDEQQQQQHEDTRKSSQYIMPSRKSSLEQIPEDQKPLVVGHEASRNRNCSYTQGVMNGINVLCGVGILSTPYAIKQGGWIGLVILCLFALLAWYTGVLLRHCLDSKEGLETYPDIGHAAFGSTGRIVISIILYVELYACCIEYLILESDNLTKLFPTAHLTIGSLTLNSHVFFAILTTIIVMPTTWLRDLSCLSYISAGGVIASILVVICLFLVGVVNDVGFENEGTALNLPGIPIAIGLYGYCYSGHGVFPNIYSSLKNRNQFPSILFTCIGLSTFLYAGAAVMGYKMFGEATESQFTLNLPDNSLISKVAVWTTVANPITKYALTIIPLAMSLEELLPPNQQKYSTIIMLRSSLVMSTLLIALSVPFFGLVMALVGSLFAMLVTYILPCACFLAILKTKVGWHQIAACSFIIAVGVCCACVGTYSSLSKIIQNYT

SEQ ID NO: 2043 - protein, 555 aa, Zea mays
MMSPASERSLIIQSDDDDDARSGHDVEEPEQDSDSSSSSSSCATPRRGPSSPPYIQQWPQSYRQSIDILSSVQSPNLSFLGTPTLSRLSNSFLAITDSFRSKAPETISSFIKPLLGPTPSDEQQRQHEGTRKSSEYLVPSRRSSLQQIPEDQKPPVGGHGASHDQNCSYTQGVMNGINVLCGVGILSTPYAIKQGGWIGLAILCTFALLAWYTGVLLRHCLDSKEGLKTYPDIGHAAFGSTGRIVISIILYVELYACCIEYLILEGDNLSKLFPNAHLTIGSMTLNSHVFFAILTTIIVMPTTWLRDLSWLSYISAGGVIASILVVICLFLVGVVNDFGFENEGTALNAPGIPIAIGLYGYCYSGHGVFPNIYSSLKNRNQFPSILFTCIGLSTFLYAGAAVMGYKMFGEATESQFTLNLPDNSVISKIAVWTTVANPITKYALTIIPLAMSLEELLPPNQQKYSTIIMLRSSLVISTLLIALSVPFFGLVMALVGSLFAMLVTYILPCACFLAILKTKVGWHQIAACSFIIVVGVCCAYVGTYSSLSKIIQNYA

SEQ ID NO: 2044 - protein, 559 aa, Zea mays
MMSPASERSLIIQSDDDDDARSGHDVEEPEPEQEQDSDSSSSSSSCATPRRGPSSPPYIQQWPQSYRQSIDILSSVQSPNLTFLGTPTLSRLSNSFLAITDSFRSKAPETISSFIKPLLGPTPSDDQQRQHEGTRKSSEYLVPSRRSSLQQIPEDQKPPVGGHGASHDQNCSYTQGVMNGINVLCGVGILSTPYAIKQGGWIGLAILCIYALLAWYTGVLLRHCLDSKEGLKTYPDIGHAAFGSTGRIVISIILYVELYACCIEYLILEGDNLSKLFPNAHLTIGSMTLNSHVFFAILTTIIVMPTTWLRDLSWLSYISAGGVIASILVVICLFLVGVVNDVGFENEGTALNAPGIPIAIGLYGYCYSGHGFFPNIYSSLKNRNQFPSILFTCIGLSTFLYAGAAVMGYKMFGEATESQFTLNLPDNSVISKIAVWTTVANPITKYALTIIPLAMSLEELLPPNQQKYFTIIMLRSSLVISTLLIALFVPFFGLVMALVGSLFAMLVTYILPCACFLAILKTKVGWHQIAACSFIIVVGVCCAYVGTYSSLSKIIQNYA

SEQ ID NO: 2045 - protein, 576 aa, Sorghum bicolor
MRSSVSERSLIIESDDDDNDDRPQSQPSAAAARSRRRHHQHEEGSGSGSGSGSDSDSGSSSSSCATPRGHAQATASSYTQQWPQSYRQSINILSSVQSPNLSFLGTPTLSRLSNSFITNSFRGKTPEIISNLVKPLLRPTTSDDLQQQHEERKSSQYLLPSRKPSLQQIPEDQKPVPVAHEVSPYHKCSYTQAVVNGINVLCGVGILSTPYAIKQGGWLGLVILCLFAILAWYTGVLLRRCLDSKEGLETYPDIGHAAFGTTGRIAISIILYVELYACCIEYLILEGDNLSKLFPNAHLTIGSLTVNSHVLFAILTTIIVMPTTWLRDLSCLSYLSAGGVIASILGVICLFWVGVVDNVDFENKGTALNLPGIPIAIGLYGYCYSGHGVFPNIYSSLKNRNQFPSILFTCIGLSTILFAGAAVMGYKMFGEATQSQFTLNLPENLVVSKIAVWTTVANPITKYALTITPLAMSLEELLPPNQQKYSNIVMLRSALVVSTLLIALSVPFFGLVMALVGSLLTMLVTYILPCACFLAILRRKVSWHQVAACSFIIMVGVCCACVGTYSSLSKIIQNYT

SEQ ID NO: 2046 - protein, 567 aa, Zea mays
MRSSVSERSLIIESDDDDDDHPQSRSSAAARSRRRHHQHEEDSAAGSDSDSGSSSSSCGTPRGPATDSSYTQQWPQSYRQSIDILSSVQSPNLSFLGTPTLSRLSNSFRGKTPEIISNLVKPLLRPTTSDDHHHHHQQQPEERKSSQYLLPSRKPSLQQIPEDQKPVPVAHEVSPYHKCTYTQAVVNGINVLCGVGILSTPYAIKQGGWLGLVILCLFAILAWYTGVLLRRCLDSKEGLETYPDIGHAAFGATGRIAISIILYVELYACCIEYLILEGDNLSKLFPNAHLSVGSLTMNSHVLFTILTTIIVMPTTWLRDLSCLSYLSAGGVFASILGVICLFWVGVVDNVGFENKGTALNLPGIPIAIGLYGYCYSGHGVFPNIYSSLKKRNQFPSILFTCIGLSTILFAGAAVMGYKMFGEATQSQFTLNLPENLVVSKIAVWTTVANPITKYALTITPLTMSLEELLPPNQQKYSNIVMLRSALVVSTLLIALSVPFFGLVMALVGSLLTMLVTYILPCACFLAILRRKVSWHQVAVCSFIIVVGVCCACVGTYSSLSKIIQNYT

SEQ ID NO: 2047 - protein, 571 aa, Oryza sativa Japonica Group
MRSHEMNNSSSRYASEEERGSNSFLIESEEEEEDEEAHPHSSILLKDADSDSDSDDSSCATPRPSSYATHQWPQSYRQSIDIYSSVQSPNLSFLGTPTLSRLSNSFLTNSFRGKTPEILSNLVKPLLRPSSSSDDQQQQQQHDDDTRKSSQYLLPSRKPSLQQIPEDQKPLVPAHEVPAYQQCSYTQAVMNGINVLCGVGILSTPYAIKQGGWLGLVILCLFAVLAWYTGVLLRRCLDSKEGLETYPDIGHAAFGTTGRIAISIILYIELYACCIEYLILESDNLSKLFPNAHLTIGSMTLNSHVFFAILTTLIVMPTTWLRDLSCLSYLSAGGVIASILVVVCLCWVGVVDHVGFENKGTALNLPGIPIAIGLYGYCYSGHGVFPNIYSSLKNRNQFPSILFTCIGLSSILFAGAAVMGYKMFGESTESQFTLNLPENLVVSKVAVWTTVANPITKYALTITPLAMSLEELLPPNQQKYANIIMLRSSLVVSTLLIALSVPFFGLVMALVGSLLTMLVTYILPCACFLAILKRKVTWHQIAACSFIIVVGVCCACVGTYSSLSKIIQNYT

SEQ ID NO: 2048 - protein, 568 aa, Hordeum vulgare subsp. vulgare
MKSLLGEERSFIIESDDDDDDEEDPTHRDGAGGSSSDSSSCASPRGGSGGGGGDSQPNSYTNQWPQSYRQSIDILSSVQSPSLGFLGTPTLSRLSNSFLNSSFLNNSFRGKTPEVISNLVKPLIRPTTSDEQQQQQQHHEDIRKSSQYLLPSRKPSLQQIPEDQKPLVVGHEVSPYQQCSYTQGAMNGINVLCGVGILSTPYAIKQGGWLGLVILLVFALLAWYTGVLLRRCLDSKEGLQTYPDIGHAAFGTTGRIAISIILYVELYACCIEYLILESDNLSKLFPNVHLNIWGLAINSHVFFAILTTLVVMPTTWLRDLTCLSYISAGGVVASILVVICLCWIGVVDHVGFENKGTALNLPGIPIAIGLYGYCYSGHGVFPNIYSSLKNRNQFPSILFTCIGFSTILFTAAAVMGYKMFGESTESQFTLNLPENLVVSKIAVWATVANPITKYALTITPLAMSLEELLPRSQQKYSNIIILRSALVVSTLIIALSVPFFALVMALIGSLFAMLVTYILPCACFLAILKAKATWYQTATCSFIIAVGVTCACVGTYSSLSGIVQNYST

SEQ ID NO: 2049 - protein, 567 aa, Sorghum bicolor
MKNSVTERSFLMESDEEEDDAAAVEDGKRRGHGHGGGDESGDDDDDGSDSSSPCDSPRVVAARCSQPSSYTQQWPQSYRQSIDMYSSVHSPNLSFLGTPSLSRLSNSFLTNSFRGKPPEIISSLIKPLLPTSIASASDDQQHQQHEDVWKSSHYLPPSRKASSLQRIPEDQRPMVGGHEVGPYRQCSYTQGVMNGVNVLCGVGILSTPYAVKQGGWLGLVILAVLGALAWYTGILLRRCLDSKDGLETYPDIGHAAFGTAGRIIISACCVEYLILESDNLSKLFPDAHLTIGGLTLDSHVLFAILTALIVMPTTWLRDLSCLSFISAGGVIASIVIVSCLFWVGLVDHVGTVKVEGTALNLPGIPIAIGLYGYCYSGHGVFPNIYSSLKKRNQFSAVLFTCIALSTVLFAGAAIMGYIMFGESTESQFTLNLPPDLVASKIAVWTTVTNPITKYALTMTPLALSLEELLPPNQQTYPNIMMLRSALVVSSLIIALSVPFFGLVMSLVGSFLTMFVAYILPCACFLSILRSKVTWYQVVLCVFIIAVGLCCAGVGTYSSLSKIIQQYH

SEQ ID NO: 2050 - protein, 569 aa, Zea mays
MRNSVSERSFLIESDDDDDAAVEDGKRRGLGGGGGDDDDGSDSSSPCDSPRVVAARCSQPSSYTQQWPQSYRQSIDMYSSVHSPNLSFLGTPSLSRLSNSFLTNSFRGKPPEIISSLIKPLLPTSIASASDDHQQQQQHEDVRKSSHYLPPSRKASSLQRIPEDQRPMVGGHEVGPHRQCSYSQGVMNGVNVLCGVGILSTPYAVKQGGWLGLVILAVLGALAWYTGILLRRCLDSKDGLETYPDIGHAAFGTAGRIIISIILYMELYACCIEYLILESDNLSKLFPNAHLTMGNLTLDSHMLFAILTALVVMPTTWLRDLSCLSFISAGGVIASIVIVSCLFWVGLVDHVGTVESEGTALNLPGIPIAIGLYGYCYSGHGVFPNIYSSLKKSNQFPAVLFTCIALSTVLFAAAAIMGYIMFGESTESQFTLNLPPNLVASKIAVWTTVTNPITKYALTMTPLALSLEELLPPNKQTYPNIMILRSALVVSSLIIALSVPFFGLVMSLVGSFLTMFVAYILPCACFLSILRSKVTWYQVVLCVFIIVVGLCCVGVGTYSSLSKIIQKYQ

SEQ ID NO: 2051 - protein, 305 aa, Zea mays
MASLFPQLAQMEHGVAGASHGAPSFLFCNGAGAATADSASLETSSGVLDTSPRGGGADSGGRKAPTKPREDSASASASFSFSSAHSKDSSSKGSTKNRGGKRGRSSKEVDEEEEPKGYIHVRARRGQATDSHSLAERVRRERISERMRVLQALVPGCDKVTGKALVLDEIINYVQSLQNQVEFLSMKIASLSPVLYGFGMDTTDAFSTDHTTQKIEGMLQLHHEALAVPSSALSRPPFEAIADSTHATASASSPRSYELHGDGGGGGASISFPQDGGGYMAQTVGGPRPELFNQVVFSNHMCSFQ

SEQ ID NO: 2052 - protein, 306 aa, Zea mays
MASLFPQLAQTEHGVAGASHGAPSFLFCHGAGAATADSASLETSSGVLDTSPRGGGADSGGRKARTKPREDSASASFSFSSAHSKDSSSKGSTKNRGGKRGRSSKEVEDDEEEPKGYIHVRARRGQATDSHSLAERVRRERISERMRVLQALVPGCDKVTGKALVLDEIINYVQSLQNQVEFLSMKIASLSPVLYGFGMDTTDAFSTDDHTTQKIEGMLQLHHEALAMPPSSALSRPPFEAVANSTHATASSPRSYDELHGDGGGGGAGISFPQEDGGGYMAQTVGGPRPELFNQVVFSNHMCSFQ

SEQ ID NO: 2053 - protein, 281 aa, Sorghum bicolor
MASFPHFTQMEHGLAGASAHGTPSFLFCHGAATADSASLETSSGVLDTSPQGTASDDKKPRKPREDSASFSSAHSKDSNSKESTKKKGGKRDRSSKEVDEEEPKGYIHVRARRGQATDSHSLAERVRRERISERMRVLQALVPGCDKVTGKALILDEIINYVQSLQNQVEFLSMRIASLSPVLYGFGMDTDAFSDHTQKIEGMLHHEALGMPSSVLNRPPSETHMDTHNSTSSPSYEVHGDGGTSISFPQDNGSYMVQTVGEPRQELFNQVVFSNHMCSFQ

SEQ ID NO: 2054 - protein, 287 aa, Zea mays
MASFPHLTQMEHGLASGASHGTPSFFFCHGTATADSASLETSSGVLDTSPRGTSSGDNKACRKHKEDSGASFSSARSKDSNSKESSKRSGGKRDRSSKKVDEEEPKGYIHVRARRGQATDNHSLAERVRRERISERMRVLQALVPGCDKVTGKALILDEIINYVQSLQNQVEFLSMRIASLSPVLYGFGMDSSDAFSDLITQKIEGMAHHEAFAMPSSSVLNGTPSEALVDTHTSSSSPSYEVHGDGGTASVSFPQDSGSYMVQTVGEPRQELFSQVVFSNHMCPFQ

SEQ ID NO: 2055 - protein, 287 aa, Zea mays
MASFPHLTQMEHGLASGASHGTPSFFFCHGTATADSASLETSSGVLDTSPRGTSSDDNKACRKHKEDSGASFSSARSKDSNSKESSKRSGGKRDRSSKKVDEEEPKGYIHVRARRGQATDNHSLAERVRRERISERMRVLQALVPGCDKVTGKALILDEIINYVQSLQNQVEFLSMRIASLSPVLYGFGMDSSDAFSDLITQKIEGMAHHEAFAMPSSSVLNGTPSEALVDTHTSSSSPSYEVHGDGGTASVSFPQDSGSYMVQTVGEPRQELFSQVVFSNHMCPFQ

SEQ ID NO: 2056 - protein, 324 aa, Sorghum bicolor
MLLRLKIVGGVHSVVLPVPGGGYDNHGGGACYAAAAPCCWRRSRRSVVARRPRSGSATVVVMALKEEPDGSRSGFAGGGGPSWDPGLEIQVPFEQRPVNEYSALKDSTLYSWAELSPGSFFLRLGGLCLITFTVLAAPIAAASFNPGKDPLKFVLAAGIGTLLLVSLVVLRIYLGWSYVGDRLLSAVVPYEETGWYDGQMWVKPPEVLARDRLLGSYKVKPVINLLKQTLVGTGALLVGAVSLFAFAAPVEDFLHALNQPPSAASSKPSLRKEELLRLPVEVMQDDDLAAAAAEAADGRPVYCRDRYYRALAGGQYCKWDDLLN

SEQ ID NO: 2057 - protein, 328 aa, Zea mays
MLLRLKIVVGVHSVVLPVPVPGGYGHGACYAAVEPCWRRSRRPALAAAGGLVARRPRQSATVVMALKEEPEGSSRRGFAGGGPSWDPGLEIQVPFEQRPVNEYSALKYSALYSWAELSPGSFFLRLGGLCLVTFTVLAAPIAAASFNPGKDPLKFVLAAGIGTLLLVSLAVLRIYLGWSYVGDRLLSAVVPYEETGWYDGQMWVKPPEVLARDRLLGSYKVKPVVNLLKQTLVGTGALLVGAVSLFAFAAPVEDFLHALSQPPSSATASSKPSLRKEELLRLPVEVMQDDDLAAAAAEAADGRPVYCRDRYYRALAGGQYCRWDDLLN

SEQ ID NO: 2058 - protein, 312 aa, Oryza sativa Japonica Group
MLLRLKAVAVHPAALLGRPRSHDAPQLVGRTGASTTTARRRAARSAVTVTMALKEEPEGSRSGFAGGVPSWDPGLEIQVPFEQRPVNEYSALKDSVLYSWAELSPGSFFLRLGSLWLITFTVLAAPIAAASFSPGKDPLKFVLAAGIGTLLLVSLVVLRIYLGWSYVGDRLLSAVVPYEETGWYDGQMWVKPPEVLARDRLLGSYKVKPVINLLKQTLVGTGALLVGAVSLFAFAAPVEDFLHSVNAPPSAASSKPSLRREELLRLPVEVRQDDDLAAAAAEAADGRPVYCRDRYYRALAGGQYCKWDDLLN

SEQ ID NO: 2059 - protein, 262 aa, Oryza sativa Japonica Group
MALKEEPEGSRSGFAGGVPSWDPGLEIQVPFEQRPVNEYSALKDSVLYSWAELSPGSFFLRLGSLWLITFTVLAAPIAAASFSPGKDPLKFVLAAGIGTLLLVSLVVLRIYLGWSYVGDRLLSAVVPYEETGWYDGQMWVKPPEVLARDRLLGSYKVKPVINLLKQTLVGTGALLVGAVSLFAFAAPVEDFLHSVNAPPSAASSKPSLRREELLRLPVEVRQDDDLAAAAAEAADGRPVYCRDRYYRALAGGQYCKWDDLLN

SEQ ID NO: 2060 - protein, 316 aa, Hordeum vulgare subsp. vulgare
MLLRLKITTVQPVALLLGHDHGGTASPRQFAGAFPQGGRASTRTKRLRGVAVAMALKEEEPESSRSRFAGGGLSWDPRMEIGVPYEQRPVNEYSALKESTLYSWAELSPGSFFMRLGSLCLVTFTVLAAPISAASFSPGKDPLKFVLAAGIGTLLLVSLVVLRIYLGWSYVGDRLLSAVVPYEETGWYDGQMWVKPAEVLARDRLLGSYKVKPVINLLKQTLVGTGALLVGAVVLFAFAVPVEEFVHSFNGAPSTASSKPIMRREELLKLPAEVRQDDDLAAAAAEAANGRPVYCRDRYYRALAGGQYCTSDDLLD

SEQ ID NO: 2061 - protein, 438 aa, Zea mays
MASLLLHRRHGAHPRAAAAACARLLRAFSALPDIDPSASSTASPSPAAPTSTSARASVLDLQLAVRAESDPARIHSLVASALSSHDMPRLHTSRQLFSLATSRLIRLRRADLAASLLDLLLASTPPSPGLLARALSLYPGPDDALRAFSSSPPAARSDVSLSALLSAFLRAGRLDDIKSTITLAESSHGVAPGRASHNVLLHALVKNSELAAARKLLDEMANKKLKHRPAPDIISYNTVLAGYSVQDDEDEFGKLLKEISLSNLEPNVVTYNCRIQWFSKKGETVKGEELLDVMESKEIAPNYVTYNALVQGYCKEGNVGAAMRVFKRMKVMKRREGRSDLGVSAHSQVYVVLFRSLVEKEKLNDALWICKSCFAMKAAPPFEAVKGLVEGLVKAGRSTEAKDVVAKMEFLVKGDAKLAWGKVVGELSFEEGSPNLNP

SEQ ID NO: 2062 - protein, 440 aa, Sorghum bicolor
MASLLLRRRHAAHPRAAAAACAPLLRAFSALPDVDPSASSTATPTSTPAAPTSTSARAPVLDLQLAVRAESDPARIHSLVASALSGDDFPRIHTSRQLFSLATSRLTRLRRPDLAASLLDLLLASTPPSPGLLARALSLYPGPDDALRAFSSSPPAARSDVSLSALLSAFLRAGRLDEIKSTITLAESSHGVAPGRASHNVLLHALVKNSELAAARKLLDEMANKKLKHRPAPDIISYNTVLAGCSVQDDEEGFEKLLKEISLSNLEPNVVTYNCRIQWFSKKGETVKGEELLDVMESKGVAPNYLTYNALVQGYCKEGNVGAATRVFKRMKVMKRREGRSDLGVSAHSQVYVVLFRSLVEKEKLDDALWICKSCFAMKAAPPFEAVKGLVEGLVKAGRSTEAKDVVAKMEFLVKGDAKLAWGKVVAELSFKEGPPNSNP

SEQ ID NO: 2063 - protein, 428 aa, Oryza sativa Japonica Group
MASLLRRHRHPHPLPAAHLLRRFSALPDVDHPPPPASTPTTPASTRSPILDLQLAVRGEADPARIHSLVATALSRPDDYPRLHGSRPLFSLAASRLARLRRPDLAASLLRALLDSAPASPGLLARAISLFPGPDDALRAFSDSAPAARSDVSLSALLSALFRAGRVDDVKSTLASAETSFGVAPGRASHNVLLHALVKNSELAAARKLLGEMAKKLKHRPAPDIVSYNTVLAGYSAQGDEEGFEKLLKEISAKKLEPNVVTYNCRIQWFAKKGETFKGEELLDAMESKDVAPNYLTYNALVQGYCKEGNVGSAMRVFKRMKVMKRREGRSDLGVSAHSQTYVVLFRSLVEKERLDDALWICKSCFAMKAAPPFEAVKGLVEGLVKGGKSAEAKDVVAKMNLLVKGDAKVAWEKIAGELSLEGTPSSNP

SEQ ID NO: 2064 - protein, 428 aa, Hordeum vulgare subsp. vulgare
MASLLLRRHPHPSAVSAHLLRRLSALADVDPSPASAPAPGRAAVRASIIDLQLAVRAETDPDRVHSLVASALSSPDYHRLHTSRALFSLAASRLDRLRRPDLAASLLDQLLASAPVSPGLLARALSLFPGPDDAVRAFSSSAPAARSDVSLSALLSALLRAGRIDDLKSTFKSAESSLGVAPGSASHNVLLHTLVKSSDLPAARKLLNEMAKKKFKHRPPPDIISYNTLLAGFSEQDDVEEFEKLLKEINENKLEPNVVTYNCRMHWFARKGETFKGEELLDVMESKGVLPNYVTYNALVQGYCKEGNVGAAMRVFKRMKVMKRREGRSDLGVSVHSQTYVLLFRTLVEKERLDDALWLCNSCFAMKAAPSFEAVKGLVEGLVKGGRSAEAKAVVAKMNFLVKGDAKVSWEKIAGELSLEEGAPSSNP

SEQ ID NO: 2065 - protein, 430 aa, Hordeum vulgare subsp. vulgare
SKPRARSLTNHPHPSAVSAHLLRRLSALADVDPSPASAPAPGRAAVRASIIDLQLAVRAETDPDRVHSLVASALSSPDYHRLHTSRALFSLAASRLDRLRRPDLAASLLDQLLASAPVSPGLLARALSLFPGPDDAVRAFSSSAPAARSDVSLSALLSALLRAGRIDDLKSTFKSAESSLGVAPGSASHNVLLHTLVKSSDLPAARKLLNEMAKKKFKHRPPPDIISYNTLLAGFSEQDDVEEFEKLLKEINENKLEPNVVTYNCRMHWFARKGETFKGEELLDVMESKGVLPNYVTYNALVQGYCKEGNVGAAMRVFKRMKVMKRREGRSDLGVSVHSQTYVLLFRTLVEKERLDDALWLCNSCFAMKAAPSFEAVKGLVEGLVKGGRSAEAKAVVAKMNFLVKGDAKVSWEKIAGELSLEEGAPSSNP

SEQ ID NO: 2066 - protein, 434 aa, Oryza sativa Japonica Group
MASLLRRHRHPHPLPAAHLLRRFSALPDVDHPPPPASTPTTPASTRSPILDLQLAVRGEADPARIHSLVATALSRPDDYPRLHGSRPLFSLAASRLARLRRPDLAASLLRALLDSAPASPGLLARAISLFPGPDDALRAFSDSAPAARSDVSLSALLSALFRAGRVDDVKSTLASAETSFGVAPGRASHNVLLHALVKNSELAAARKLLGEMAKKLKHRPAPDIVSYNTVLAGYSAQGDEEGFEKLLKEISAKKLEPNVVTYNCRIQWFAKKGETFKGEELLDAMESKDVAPNYLTYNALVQGYCKEGNVGSAMRVFKRMKVMKRREGRSDLGVSAHSQTYVVLFRSLVEKERLDDALWICKSCFAMKAAPPFEAVKGLVEGLVKGGKSAEAKDVVAKMNLLVKGDAKVAWEKIADAVKTSMLLMRCFKFILYT

SEQ ID NO: 2067 - protein, 352 aa, Sorghum bicolor
MATTASSLLKSSFAGARLPASTRTPSSPAVVATPRGAGAIRASSISSSNPPYDLTSFRFSPIKESVVSREMTRRYMTDMITYADTDVVIVGAGSAGLSCAYELSKDPSVSIAIVEQSVSPGGGAWLGGQLFSAMVVRKPAHLFLDELGVAYDEAEDYVVIKHAALFTSTVMSRLLARPNVKLFNAVAVEDLIVKGGRVGGVVTNWALVSMNHDTQSCMDPNVMEAKVVVSSCGHDGPFGATGVKRLQDIGMISDVPGMKALDMNTAEDEIVRLTREVVPGMIVTGMEVAEIDGAPRMGPTFGAMMISGQKAAHLALKALGRPNAVDGTIKVVSPALRQEFVIASKDDEVVDA

SEQ ID NO: 2068 - protein, 354 aa, Zea mays
MATTAASSLLKSSFAGSRLPSATRTTTPSSVAVATPRAGGGPIRASISSPNPPYDLTSFRFSPIKESIVSREMTRRYMTDMITHADTDVVIVGAGSAGLSCAYELSKDPTVSVAIVEQSVSPGGGAWLGGQLFSAMVVRRPAHLFLDELGVGYDEAEDYVVVKHAALFTSTVMSRLLARPNVKLFNAVAVEDLIVRRGRVGGVVTNWALVSMNHDTQSCMDPNVMEAKVVVSSCGHDGPFGATGVKRLQDIGMISAVPGMKALDMNAAEDEIVRLTREVVPGMIVTGMEVAEIDGAPRMGPTFGAMMISGQKAAHLALKALGRPNAVDGTIPEVSPALREEFVIASKDDEVVDA

SEQ ID NO: 2069 - protein, 355 aa, Zea mays
MATTAASSLLKSSFAGSRLPSATRTTTPSSVAVATPRAGGGPIRASISSSPTPPYDLTSFRFSPIKESIVSREMTRRYMTDMITHADTDVVIVGAGSAGLSCAYELSKDPTVSVAIVEQSVSPGGGAWLGGQLFSAMVVRRPAHLFLDELGVGYDEAEDYVVVKHAALFTSTVMSRLLARPNVKLFNAVAVEDLIVRRGRVGGVVTNWALVSMNHDTQSCMDPNVMEAKVVVSSCGHDGPFGATGVKRLQDIGMISAVPGMKALDMNAAEDEIVRLTREVVPGMIVTGMEVAEIDGAPRMGPTFGAMMISGQKAAHLALKALGRPNAVDGTIPEVSPALREEFVIASKDDEVVDA

SEQ ID NO: 2070 - protein, 354 aa, Zea mays
MATAAASSLLKSSFAGSRLPAATRTTPASLVVATGPRGAGAGPICASMSMSSSNPPYDLTSFRFSPIKESIVSREMTRRYMTDMITYADTDVVIVGAGSAGLSCAYELSKDPAVSIAIVEQSVSPGGGAWLGGQLFSAMVVRKPAHLFLDELGVAYDEAEDYVVIKHAALFTSTVMSLLLARPNVKLFNAVAVEDLIVRGGRVGGVVTNWALVSMNHDTQSCMDPNVMEAKVVVSSCGHDGPFGATGVKRLQDIGMISAVPGMKALDMNTAEDEIVRLTREVVPGMIVTGMEVAEIDGAPRMGPTFGAMMISGQKAAHLALKALGRPNAVDGTMSPPLREELMIAYKDDEVVDA

SEQ ID NO: 2071 - protein, 355 aa, Oryza sativa Japonica Group
MAAMATTASSLLKTSFAGARLPAAARNPTVSVAPRTGGAICNSISSSSSTPPYDLNAIRFSPIKESIVSREMTRRYMTDMITYADTDVVVVGAGSAGLSCAYELSKDPSVSVAVIEQSVSPGGGAWLGGQLFSAMVVRKPAHLFLDELGVAYDEQEDYVVIKHAALFTSTVMSRLLARPNVKLFNAVAVEDLIVKEGRVGGVVTNWALVSMNHDTQSCMDPNVMESRVVVSSCGHDGPFGATGVKRLQDIGMIDAVPGMRALDMNTAEDEIVRLTREVVPGMIVTGMEVAEIDGAPRMGPTFGAMMISGQKAAHLALKALGRPNAIDGTIKKAAAAAAHPELILASKDDGEIVDA

SEQ ID NO: 2072 - protein, 352 aa, Oryza sativa Japonica Group
MATTASSLLKTSFAGARLPAAARNPTVSVAPRTGGAICNSISSSSSTPPYDLNAIRFSPIKESIVSREMTRRYMTDMITYADTDVVVVGAGSAGLSCAYELSKDPSVSVAVIEQSVSPGGGAWLGGQLFSAMVVRKPAHLFLDELGVAYDEQEDYVVIKHAALFTSTVMSRLLARPNVKLFNAVAVEDLIVKEGRVGGVVTNWALVSMNHDTQSCMDPNVMESRVVVSSCGHDGPFGATGVKRLQDIGMIDAVPGMRALDMNTAEDEIVRLTREVVPGMIVTGMEVAEIDGAPRMGPTFGAMMISGQKAAHLALKALGRPNAIDGTIKKAAAAAAHPELILASKDDGEIVDA

SEQ ID NO: 2073 - protein, 353 aa, Oryza sativa Indica Group
MATTASSLLKTSFAGVRLPAAARNPTVSVAPRTGGAICNSISSSSSTPPYDLNAIRFSPIKESIVSREMTRRYMTDMITYADTDVVVVGAGSAGLSCAYELSKDPSVSVAVIEQSVSPGGGAWLGGQLFSAMVVRKPAHLFLDELGVAYDEQEDYVVIKHAALFTSTVMSRLLARPNVKLFNAVAVEDLIVKEGRVGGVVTNWALVSMNHDTQSCMDPNVMESRVVVSSCGHDGPFGATGVKRLQDIGMIDAVPGMRALDMNTAEDEIVRLTREVVPGMIVTGMEVAEIDGAPRMGPTFGAMMISGQKAAHLALKALGRPNAIDGTIKKAAAAAAAHPELILASKDDGEIVDA

SEQ ID NO: 2074 - protein, 354 aa, Sorghum bicolor
MATTAASSLLKSSFAGSRLPSATRAPSSVVVSTGGAPRTAAISASISSSNPPYDLTSFKFSPIKESIVSREMTRRYMTDMITHADTDVVIVGAGSAGLSCAYELSKDPTVRVAIVEQSVSPGGGAWLGGQLFSAMVVRKPAHLFLDELGVAYDEAADDYVVVKHAALFTSTVMSAVLARPNVKLFNAVAVEDLIVKGGRVGGVVTNWALVSMNHDTQSCMDPNVMEAKVVVSSCGHDGPFGATGVKRLQDIGMIAAVPGMKALDMNAAEDAIVRLTREVVPGMIVTGMEVAEIDGAPRMGPTFGAMMISGQKAAHLALKALGRPNAVDGTIPKVSPALREEFVIASKDDEVVDA

SEQ ID NO: 2075 - protein, 307 aa, Zea mays
MSMSSSNPPYDLTSFRFSPIKESIVSREMTRRYMTDMITYADTDVVIVGAGSAGLSCAYELSKDPAVSIAIVEQSVSPGGGAWLGGQLFSAMVVRKPAHLFLDELGVAYDEAEDYVVIKHAALFTSTVMSLLLARPNVKLFNAVAVEDLIVRGGRVGGVVTNWALVSMNHDTQSCMDPNVMEAKVVVSSCGHDGPFGATGVKRLQDIGMISAVPGMKALDMNTAEDEIVRLTREVVPGMIVTGMEVAEIDGAPRMGPTFGAMMISGQKAAHLALKALGRPNAVDGTMSPPLREELMIAYKDDEVVDA

SEQ ID NO: 2076 - protein, 352 aa, Oryza sativa Indica Group
MATTASSLLKTSFAGVRLPAAARNPTVSVAPRTGGAICNSISSSSSTPPYDLNAIRFSPIKESIVSREMTRRYMTDMITYADTDVVVVGAGSAGLSCAYELSKDPSVSVAVIEQSVSPGGGAWLGGQLFSAMVVRKPAHLFLDELGVAYDEQEDYVVIKHAALFTSTVMSRLLARPNVKLFNAVAVEDLIVKKGRVGRVVTNLGACVNDHDTQPGMDPNVMEFKVVVSSCGHDGPFGATGVKRLQDIGMIDAVPGMRALDMNTAEDEIVRLTREVVPGMIVTGMEVAEIDGAPRMGPTFGAMMISGQKAAHLALKALGRPNAIDGTIKKAAAAAAHPELILASKDDGEIVDA

SEQ ID NO: 2077 - protein, 203 aa, Zea mays
MLKCSVLTAHRSAPASSHARTAHKYLFSPLPSHSPRQSRPGMASPSSSPSRKALSKIACSRLQKELAEWQVNPPAGFKHRVTDDLQRWVIDVAGAAGTLYTGETYKLQVDFPEHYPMEAPQVIFLHPASMHPHIYSNGHICLDILYDSWSPAMTVSSICISILSMLSSSPEKQRPADNDRYVKNCRNGRSPKETRWWFHDDTV

SEQ ID NO: 2078 - protein, 161 aa, Oryza sativa Japonica Group
MTSSSSPSRKVLSKIACNRLQKELAEWQVNPPSGFKHKVTDNLQRWVIEVAGAAGTLYAGETYQLQVDFPEHYPMEAPQVIFLHPAPMHPHIYSNGHICLDILYDSWSPAMTVSSVCISILSMLSSSPAKQRPADNDRYVRNCRNGRSPKETRWWFHDDKV

SEQ ID NO: 2079 - protein, 165 aa, Sorghum bicolor
MASPSSSSSSPSRKALSKIACSRLQKELAEWQVSPPAGFKHRVTDNLQRWVIDVAGAPGTLYTGETYKLQVDFPEHYPMEAPQVIFLHPAPMHPHIYSNGHICLDILYDSWSPAMTVSSICISILSMLSSSPAKQRPADNDRYVRNCRNGRSPKETRWWFHDDTV

SEQ ID NO: 2080 - protein, 161 aa, Sorghum bicolor
MTSSSSPSRKALSKIACNRLQKELAEWQLNPPAGFKHKVSDNLQRWVIEVTGAAGTLYAGETYQLQVDFPEHYPMEAPQVIFLNPAPMHPHIYSNGHICLDILYDSWSPAMTVSSVCISILSMLSSSPAKQRPADNDRYVRNCRNGRSPKETRWWFHDDTV

SEQ ID NO: 2081 - protein, 161 aa, Zea mays
MTSSSSPSRKALSKIACNRLQKELAEWQQNPPAGFKHKVSDNLQRWVIEVTGAAGTLYAGEAYQLQVDFPEHYPMEAPQVIFLNPAPMHPHIYSNGHICLDILYDSWSPAMTVSSVCISILSMLSSSPAKQRPADNDRYVRNCRNGRSPKETRWWFHDDTV

SEQ ID NO: 2082 - protein, 428 aa, Oryza sativa Japonica Group
MDAASRPAVVIDNGTGYTKMGFAGNVEPCFITPTVVAVNDTFAGQTRANTTKGNWMAQHSAGVMADLDFFIGEDALARSRSSNTYNLSYPIHNGQVENWDTMERFWQQCIFNYLRCDPEDHYFLLTESPLTPPETREYTGEIMFETFNVPGLYIACQPVLALAAGYTTTKCEMTGVVVDVGDGATHIVPVADGYVIGSSIRSIPITGKDVTQFIQQLLKERGEHIPPEESFDVARRVKEMYCYTCSDIVKEFNKHDREPNKYIKHWSGIKPKTGAKYTCDIGYERFLGPEIFFHPEIYNNDFTTPLHVVIDKCIQSSPIDTRRALYKNIVLSGGSTMFKDFHRRLQRDLKKIVDARVLASNARLGGDAKAQPIEVNVVSHPIQRYAVWFGGSVLASTAEFYEACHTKAEYEEYGASICRTNPVFKGMY

SEQ ID NO: 2083 - protein, 433 aa, Zea mays
MDALSRPAVVIDNGTGYTKMGFAGNVEPCFITPTVVAVNDSFSGSAQPAVRGTPARGNWLAQHSAGVMADLDFYIGDEALARSRASSSHSLSYPIRNGQVENWDTMERFWQQCIFNYLRCDPEDHYFLLTESPLTAPETREYTGEIMFETFNVPGLYIAVQPVLALAAGYTTTKCEMTGVVVDVGDGATHIVPVADGYVIGSSIRSIPITGKDVTQFIHQLLKERGENIPAEESFDVARRIKEMYCYTSSDIVKEFNKHDKEPSKYIKHWTGTKPKTGAKYTCDIGYERFLGPEIFFNPEIYNNDFTTPLQVVIDKCIQSSPIDTRRALYKNIVLSGGSTMFKDFHRRLQRDLKKIVDARVRASNSRLISGDAKAQPIEVNVVSHPIQRYAVWFGGSVLASTAEFYEACHTKAEYEEYGASICRTNPVFKGMY

SEQ ID NO: 2084 - protein, 428 aa, Vitis vinifera
MDSAASRPAVVIDNGTGYTKMGFAGNVEPCFIAPTVVAVNESFLNQNRSSTKGNWLAQHSAGVMADLDFFIGDEAIARSRNSSTYNLSYPIVHGQVDNWDAMERFWQQCIFNYLRCDPEDHYFLLTESPLTAPESREYTGEIMFETFNVPGLYIAVQPVLALAAGYTTSKCEMTGVVVDVGDGATHVVPVADGYVIGSSIKSIPIAGKDVTLFVQQLMRERGEHVPPEDSFEVARKVKEMYCYTSSDIVKEFNKHDKEPGKYIKHWRGIKPKTGAPYSCDVGYERFLGPEIFFNPEIYSSDFATPLPAVIDKCIQSAPIDTRRALYKNIVLSGGSTMFKDFHRRLQRDVKKIVDARVLASDSRLDGEVKSQPVEVNVVSHPIQRYAVWFGGSVLASTPEFFAACHTKAEYEEYGASICRTNPVFKGMY

SEQ ID NO: 2085 - protein, 457 aa, Zea mays
MDALSRPAVVIDNGTGYTKMGFAGNVEPCFITPTVVAVNDSFSGSAQPAARGTPARGNWLAQHSAGVMADLDFYIGDEALARSRASSSHSLSYPIRNGQVENWDTMERFWQQCIFNYLRCDPEDHYFLLTESPLTAPETREYTGEIMFETFNVPGLYIAVQPVLALAAGYTTTKCEMTGVVVDVGDGATHIVPVADGYVIGSSIRSIPITGKDVTQFIHQLLKERGENIPAEESFDVARRIKEMYCYTSSDIVKEFNKHDKEPSKYIKHWTGTKPKTGAKYTCDIGYERFLGPEIFFNPEIYNNDFTTPLQVVIDKCIQSSPIDTRRALYKVLMIRASLFILRHYIESEEFPMAQNIVLSGGSTMFKDFHRRLQRDLKKIVDARVRASNSRLISGDAKAQPIEVNVVSHPIQRYAVWFGGSVLASTAEFYEACHTKAEYEEYGASICRTNPVFKGMY

SEQ ID NO: 2086 - protein, 444 aa, Zea mays
MDALSRPAVVIDNGTGYTKMGFAGNVEPCFITPTVVAVNDSFSGSGQPAARGAPARGNWLAQHSAGVMADLDFYIGQEALARSRASSSHSLSYPIRNGQVENWDSMERFWQQCIFNYLRCDPEDHYFLLTESPLTAPEIREYTGEIMFETFNVPGLYIAVQPVLALAAGYTTTKCEMTGVVVDVGDGATHIVPVADGYVIGSSIRSIPITGKDVTQFIHQLLKERGENIPPEESFDVARRIKEMYCYTSSDVVKEFNKHDREPSKYVKHWTGIKPKTGAKYTCDIGYERFLGPEIFFNPEMYNNDFTTPLQVVIDRCIQSSPIDTRRALYKNIVLSGGSTMFKDFHRRLQRDLKKIVDARVRASNSRLLSGDAKFFSDNIIYDFQAQPIEVNVVSHPIQRYAVWFGGSVLASTAEFYEACRTKAEYEEYGASICRSNPVFKGMY

SEQ ID NO: 2087 - protein, 428 aa, Populus trichocarpa
MDASSRPAVVIDNGSGYTKMGFAGNVEPCFILPSVVAVNESFLNQSRTSSSKANWLAQHSAGVMADLDFFIGDEALAKSRSSNTYNLSYPIKHGQVANWDAMERYWQQCIFNYLRCDPEDHYFLLTESPLTAPESREYTGEIMFETFNVPGLYIAVNSVLALAAGYTTSKCEMTGVVVDAGDGATYVVPVADGYVIGSSIKSIPIAGKDVTLFIQQLMRERGENVPPEDSFEVARKAKEMHCYTCSDIVKEFNKHDKEPAKYIKQWRGIKPKTGAPYSCDIGYERFLGPEVFFNPEIYSSDFTTPLPAVIDKCIQSAPIDTRRALYKNIVLSGGSTMFKDFGRRLQRDLKKIVDTRVLASEARLGGGVKSQPVEVNVVSHPIQRFAVWFGGSVLASTPEFFAACHTKAEYEEYGASICRTNPVFKGMY

SEQ ID NO: 2088 - protein, 427 aa, Ricinus communis
MDPTNRPAVVIDNGTGYTKMGFAGNVEPCFILPTVVAVNESFLNQSRTTSKANWLSQHNAGVMADLDFFIGEEAITKSRSSNTYNLSYPIKHGQVDNWDAMERYWQQCIFNYLRCDPEDHYFLLTESPLTAPETREYTGEIMFETFNVPGLYIAVNSVLALAAGYTTSKCEMTGVVVDVGDGATHVVPVADGYVIGSSIKSIPIAGKDVTLFIQQLMRERGENIPLEDSFDVARKVKEMHCYTCSDIVKEFNKHDKEPGKYIKHWRGIKPKTGAPYSCDIGYERFLGPEVFFNPEIYSSDFTTPLPALIDKCIQSAPIDTRRALYKNIVLSGGSTMFKDFGRRLQRDLKKIVDARVLASEARLNGEIKSQPVEVNVVSHPIQRFAVWFGGSVLASTPEFFAACHTKAEYEEYGASICRTNPVFKGMY

SEQ ID NO: 2089 - protein, 428 aa, Populus trichocarpa
MDPTSRPAVVIDYGTGYTKMGFAGNVEPCFILPTAVAVNESFLNQSRTSSSKANWQAQHSAGVMADLDFFIGEEALAKSRSSNTYSLSYPIKHGQVDNWDAMERYWQQCIFNYLRCDPEDHYFLLTESPLTAPESREYTGEIMFETFNVPGLYIAVNSVLALAAGYTTSKCEMTGVVVDVGDGAAHVVPVADGYVIGSSIKSIPIAGKDVTLFIQQLMRERGENVPPEDSFEVARKVKETHCYTCSDIVKEFNKHDKEPAKYIKHWRGIKPKTGAPYSCDIGYERFLGPEVFFNPEIYSSDFTTPLPAVIDKCIQSAPIDTRRALYKNIVLSGGSTMFKDFGRRLQRDLKKIVDTRVLTSEARLGGKIKSQPVEVNVVSHPIQRFAVWFGGSVLASTPEFFAACHTKAEYEEYGASICRTNPVFKGMY

SEQ ID NO: 2090 - protein, 428 aa, Nicotiana tabacum
MDPSTSRPAVVIDNGTGYTKMGFAGNVEPSFILPTVVAVNESFINQPRALTKSSNLAQYSAGVMADLDFFIGEEALSRSKSSSTYNLSYPIKHGQVDNWDAMERFWQQCVFNYLRCDPEDHYFLLTESPMTAPENREYTGEIMFETFNVPGLYIAVQPVLALAAGYTASKCEMTGVVVDVGDGATHVVPVAEGYVIGSSIKSIPVAGKDVTLFIQQLMKERGEHVPAEDSLEVARKVKEMYCYTCSDIVKESNKHDKEPGKYIKQWRGTKPKTGAPYSCDVGYERFLGPEVFFNPEIYNSDFTTPLPDVIDKCIQSAPIDTRRALYKNIVLSGGSTMFKDFHRRLQRDLKKIVDDRVPASDARLGGNVKAQPVEVNVVSNPIQRYAVWFGGSVLASTPEFFAACHTKTEYEEYGASICRTNPVFKGMY

SEQ ID NO: 2091 - protein, 427 aa, Arabidopsis thaliana
MDPTSRPAIVIDNGTGYTKMGFAGNVEPCFILPTVVAVNESFLNQSKSSSKATWQTQHNAGVAADLDFYIGDEALAKSRSSSTHNLHYPIEHGQVEDWDAMERYWQQCIFNYLRCDPEDHYFLLTESPLTPPESREYTGEILFETFNVPGLYIAVNSVLALAAGYTTSKCEMTGVVVDVGDGATHVVPVAEGYVIGSCIKSIPIAGKDVTLFIQQLMRERGENIPPEDSFDVARKVKEMYCYTCSDIVKEFNKHDKEPAKYIKQWKGVKPKTGAPYTCDVGYERFLGPEVFFNPEIYSNDFTTTLPAVIDKCIQSAPIDTRRALYKNIVLSGGSTMFKDFGRRLQRDLKKIVDARVLANNARTGGEITSQPVEVNVVSHPVQRFAVWFGGSVLSSTPEFFASCRTKEEYEEYGASICRTNPVFKGMY

SEQ ID NO: 2092 - protein, 171 aa, Zea mays
MPHARTFLCCRRGSGHPTETVVGMQRDSSFYSRAGSTRDSPVILPPTAVGREQPIARATSCRATAAAASTARAACNPSSSAVPDPSDHVWAHHFNLLNSAPAPAPAAPHLDPSRATTSSLDEASVSVSNASDLEATEWVEQDEPGVSITIREFGDGTRELRRVRFRQVNVH

SEQ ID NO: 2093 - protein, 528 aa, Rattus norvegicus
MAGCRLWVSLLLAAALACLATALWPWPQYIQTSHRRYTLYPNNFQFRYHAGSAAQAGCVVLDEAFRRYRSLLFGSGSWPRPSFSKKQQPLGKNILMVSVVTAECNEFPNLESVENYTLTINDDQCLLSSETVWGALRGLETFSQLVWKSAEGTFFINKTKITDFPRFPHRGILLDTSRHYLPLSSILNTLDVMAYNKFNVFHWHLVDDSSFPYESFTFPELTRKGSFNPVTHIYTAQDVKEVIEYARLRGIRVLAEFDTPGHTLSWGAGVPGLLTPCYSGSRLSGTYGPVNPSLNSTYDFMSTFFLEISSVFPDFYLHLGGDEVDFTCWKSNPNIQAFMKKKGFTDYKQLESFYIQTLLDIVSDYDKGYVVWQEVFDNKVKVRPDTIIQVWREEMPVQYMKEIEAITQAGFRALLSAPWYLNRVKYGPDWKEMYKVEPLAFRGTPAQKALVIGGEACMWGEYVDSTNLVPRLWPRAGAIAERLWSSNLTTNMDFAFKRLSHFRCELLRRGIQAQPISVGYCEQEFEHT

SEQ ID NO: 2094 - protein, 528 aa, Mus musculus
MAGCRLWVSLLLAAALACLATALWPWPQYIQTYHRRYTLYPNNFQFRYHVSSAAQAGCVVLDEAFRRYRNLLFGSGSWPRPSFSNKQQTLGKNILVVSVVTAECNEFPNLESVENYTLTINDDQCLLASETVWGALRGLETFSQLVWKSAEGTFFINKTKIKDFPRFPHRGVLLDTSRHYLPLSSILDTLDVMAYNKFNVFHWHLVDDSSFPYESFTFPELTRKGSFNPVTHIYTAQDVKEVIEYARLRGIRVLAEFDTPGHTLSWGPGAPGLLTPCYSGSHLSGTFGPVNPSLNSTYDFMSTLFLEISSVFPDFYLHLGGDEVDFTCWKSNPNIQAFMKKKGFTDFKQLESFYIQTLLDIVSDYDKGYVVWQEVFDNKVKVRPDTIIQVWREEMPVEYMLEMQDITRAGFRALLSAPWYLNRVKYGPDWKDMYKVEPLAFHGTPEQKALVIGGEACMWGEYVDSTNLVPRLWPRAGAVAERLWSSNLTTNIDFAFKRLSHFRCELVRRGIQAQPISVGYCEQEFEQT

SEQ ID NO: 2095 - protein, 528 aa, Mus musculus
MAGCRLWVSLLLAAALACLATALWPWPQYIQTYHRRYTLYPNNFQFRYHVSSAAQAGCVVLDEAFRRYRNLLFGSGSWPRPSFSNKQQTLGKNILVVSVVTAECNEFPNLESVENYTLTINDDQCLLASETVWGALRGLETFSQLVWKSAEGTFFINKTKIKDFPRFPHRGVLLDTSRHYLPLSSILDTLDVMAYNKFNVFHWHLVDDSSFPYESFTFPELTRKGSFNPVTHIYTAQDVKEVIEYARLRGIRVLAEFDTPGHTLSWGPGAPGLLTPCYSGSHLSGTFGPVNPSLNSTYDFMSTLFLEISSVFPDFYLHLGGDEVDFTCWKSNPNIQAFMKKKGFTDFKQLESFYIQTLLDIVSDYDKGYVVWQEVFDNKVKVRPDTIIQVWREEMPVEYMLEMQDITRAGFRALLSAPWYLNRVKYGPDWKDMYKVEPLAFHGTPEQKALVIGGEACMWGEYVDSTNLVPRLWPRAGAVAERLWSSNLTTNIDFAFKRLSHFRCELVRRGIQAQPISVGYCEQEFEQA

SEQ ID NO: 2096 - protein, 528 aa, Mus musculus
MAGCRLWVSLLLAAALACLATALWPWPQYIQTYHRRYTLYPNNFQFRYHVSSAAQAGCVVLDEAFRRYRNLLFGSGSWPRPSFSNKQQTLGKNILVVSVVTAECNEFPNLESVENYTLTINDDQCLLASETVWGALRGLETFSQLVWKSAEGTFFINKTKIKDFPRFPHRGVLLDTSRHYLPLSSILDTLDVMAYNKFNVFHWHLVDDSSFPYESFTFPELTRKGSFNPVTHIYTAQDVKEVIEYARLRGIRVLAEFDTPGHTLSWGPGAPGLLTPCYSGSHLSGTFGPVNPSLNSTYDFMSTLFLEISSVFPDFYLHLGGDEVDFTCWKSNPNIQAFMKKKGFTDFKQLESFYIQTLLDIVSDYDKGYVVWQEVFDNKVKVRPDTIIQVWREEMPVEYMLEMQDITRAGFRALLSAPWYLNRVKYGPDWKDMYKVEPLAFHGTPEQKALVIGGEACMWGEYVDSTNLVPRLWPRAGAVAERLWSSNLTTNIDFAFKRLSHFRCELVRRGIQAQPIRVGYCEQEFEQT

SEQ ID NO: 2097 - protein, 528 aa, Mus musculus
MAGCRLWVSLLLAAALACLATALWPWPQYIQTYHRRYTLYPNNFQFRYHVSSAAQAGCVVLDEAFRRYRNLLFGSGSWPRPSFSNKQQTLGKNILVVSVVTAECNEFPNLESVENYTLTINDDQCLLASETVWGALRGLETFSQLVWKSAEGTFFINKTKIKDFPRFPHRGVLLDTSRHYLPLSSILDTLDVMAYNKFNVFHWHLVDDSSFPYESFTFPELTRKGSFNPVTHIYTAQDVKEVIEYARLRGIRVLAEFDTPGHTLSWGPGAPGLLTPCYSGSHLSGTFGPVNPSLNSTYDFMSTLFLEISSVFPDFYLHLGGDEVDFTCWKSNPNIQAFMKKKGFTDFKQLESFYIQTLLDIVSDYDKGYVVWQEVFDNKVKVRPDTIIQVWREEMPVEYMLEMQDITRAGFRALLSAPWYLNRVKYGPDWKDMYKVEPLAFHGTPEQKALVIGGEACMWGEYVDSTNLVPRLWPRAGAVAERLWSSNLTTNIDFAFKRLSHFRCELVRRGIQAQPISVGYCEQEIEQT

SEQ ID NO: 2098 - protein, 528 aa, Mus musculus
MAGCRLWVSLLLAAALACLATALWPWPQYIQTYHRRYTLYPNNFQFRYHVSSAAQAGCVVLDEAFRRYRNLLFGSGSWPRPSFSNKQQTLGKNILVVSVVTAECNEFPNLESVENYTLTINDDQCLLASETVWGALRGLETFSQLVWKSAEGTFFINKTKIKDFPRFPHRGVLLDTSRHYLPLSSILDTLDVMAYNKFNVFHWHLVDDSSFPYESFTFPELTRKGSFNPVTHIYTAQDVKEVIEYARLRGIRVLAEFDTPGHTLSWGPGAPGLLTPCYSGSHLSGTFGPVNPSLNSTYDFMSTLFLEISSVFPDFYLHLGGDEVDFTCWKSNPNIQAFMKKKGFTDFKQLESLYIQTLLDIVSDYDKGYVVWQEVFDNKVKVRPDTIIQVWREEMPVEYMLEMQDITRAGFRALLSAPWYLNRVKYGPDWKDMYKVEPLAFHGTPEQKALVIGGEACMWGEYVDSTNLVPRLWPRAGAVAERLWSSNLTTNIDFAFKRLSHFRCELVRRGIQAQPISVGYCEQEFEQT

SEQ ID NO: 2099 - protein, 528 aa, Mus musculus
MAGCRLWVSLLLAAALACLATALWPWPQYIQTYHRRYTLYPNNFQFRYHVSSAAQGGCVVLDEAFRRYRNLLFGSGSWPRPSFSNKQQTLGKNILVVSVVTAECNEFPNLESVENYTLTINDDQCLLASETVWGALRGLETFSQLVWKSAEGTFFINKTKIKDFPRFPHRGVLLDTSRHYLPLSSILDTLDVMAYNKFNVFHWHLVDDSSFPYESFTFPELTRKGSFNPVTHIYTAQDVKEVIEYARLRGIRVLAEFDTPGHTLSWGPGAPGLLTPCYSGSHLSGTFGPVNPSLNSTYDFMSTLFLEISSVFPDFYLHLGGDEVDFTCWKSNPNIQAFMKKKGFTDFKQLESFYIQTLLDIVSDYDKGYVVWQEVFDNKVKVRPDTIIQVWREEMPVEYMLEMQDITRAGFRALLSAPWYLNRVKYGPDWKDMYKVEPLAFHGTPEQKALVIGGEACMWGEYVDSTNLVPRLWPRAGAVAERLWSSNLTTNIDFAFKRLSHFRCELVRRGIQAQPISVGYCEQEFEQT

SEQ ID NO: 2100 - protein, 528 aa, Mus musculus
MAGCRLWVSLLLAAALACLATALWPWPQYIQTYHRRYTLYPNNFQFRYHVSSAAQAGCVVLDEAFRRYRNLLFGSGSWPRPSFSNKQQTLGKNILVVSVVTAECNEFPNLESVENYTLTINDDQCLLASETVWGALRGLETFSQLVWKSAEGTFFINKTKIKDFPRFPHRGVLLDTSRHYLPLSSILDTLDVMAYNKFNVFHWHLVDDSSFPYESFTFPELTRKGSFNPVTHIYTAQDVKEVIEYARLRGIRVLAEFDTPGHTLSWGPGAPGLLTPCYSGSHLSGTFGPVNPSLNSTYDFMSTLFLEISSVFPDFYLHLGGDEVDFTCWKSNPNIQAFMKKKGFTDFKQLESFYIQTLLDIVSDYDKGYVVWQEVFDNKVKVRPDTIIQVWREEMPVEYMLEMQDITRAGFRALLSAPWYLNRVKYGPDWKDMYKVEPLAFHGTPEQKALVIGGEACMWGEYVDSTNLVPRLWPRAGAVAERLWSSNLTTNIDFAFKRLSHFRCELVRRGIQAQPISVGCCEQEFEQT

SEQ ID NO: 2101 - protein, 528 aa, Mus musculus
MAGCRLWVSLLLAAALACLATALWPWPQYIQTYHRRYTLYPNNFQFRYHVSSAAQAGSVVLDEAFRRYRNLLFGSGSWPRPSFSNKQQTLGKNILVVSVVTAECNEFPNLESVENYTLTINDDQCLLASETVWGALRGLETFSQLVWKSAEGTFFINKTKIKDFPRFPHRGVLLDTSRHYLPLSSILDTLDVMAYNKFNVFHWHLVDDSSFPYESFTFPELTRKGSFNPVTHIYTAQDVKEVIEYARLRGIRVLAEFDTPGHTLSWGPGAPGLLTPCYSGSHLSGTFGPVNPSLNSTYDFMSTLFLEISSVFPDFYLHLGGDEVDFTCWKSNPNIQAFMKKKGFTDFKQLESFYIQTLLDIVSDYDKGYVVWQEVFDNKVKVRPDTIIQVWREEMPVEYMLEMQDITRAGFRALLSAPWYLNRVKYGPDWKDMYKVEPLAFHGTPEQKALVIGGEACMWGEYVDSTNLVPRLWPRAGAVAERLWSSNLATNIDFAFKRLSHFRCELVRRGIQAQPISVGYCEQEFEQT

SEQ ID NO: 2102 - protein, 528 aa, Mus musculus
MAGCGLWVSLLLAAALACLATALWPWPQYIQTYHRRYTMYTNNFQFRYHVSSAAQAGCVVLDEAFRRYRNLLFGSGSWPRPSFSNKQQTLGKNILVVSVVTAECNEFPNLESVENYTLTINDDQCLLASETVWGALRGLETFSQLVWKSAEGTFFINKTKIKDFPRFPHRGVLLDTSRHYLPLSSILDTLDVMAYNKFNVFHWHLVDDSSFPYESFTFPELTRKGSFNPVTHIYTAQDVKEVIEYARLRGIRVLAEFDTPGHTLSWGPGAPGLLTPCYSGSHLSGTFGPVNPSLNSTYDFMSTLFLEISSVFPDFYLHLGGDEVDFTCWKSNPNIQAFMKKKGFTDFKQLESFYIQTLLDIVSDYDKGYVVWQEVFDNKVKVRPDTIIQVWREEMPVEYMLEMQDITRAGFRALLSAPWYLNRVKYGPDWKDMYKVEPLAFHGTPEQKALVIGGEACMWGEYVDSTNLVPRLWPRAGAVAERLWSSNLTTNIDFAFKRLSHFRCELVRRGIQAQPISVGYCEQEFEQT

SEQ ID NO: 2103 - protein, 703 aa, Ricinus communis
MASSTAQIHVLGGIGFPSSKSRKPSFSFPKKTVFLGSNLKSHQTAAFLRQSNTNARRKYGPLRVVNEKVVGIDLGTTNSAVAAMEGGKPTIVTNAEGQRTTPSVVAYTKNGDRLVGQIAKRQAVVNPENTFFSVKRFIGRKMSEVDEESKQVSYRVVRDENGNVKLDCPAIGKQFAAEEISAQVLRKLVDDASKFLNDKVTKAVVTVPAYFNDSQRTATKDAGRIAGLEVLRIINEPTAASLAYGFEKKNNETILVFDLGGGTFDVSVLEVGDGVFEVLSTSGDTHLGGDDFDKRIVDWLAGNFKRDEGIDLLKDKQALQRLTETAEKAKMELSSLTQTNISLPFITATADGPKHIETTITRAKFEELCSDLLDRLKTPVENSLRDAKLSFKDIDEVILVGGSTRIPAVQELVKKMTGKDPNVTVNPDEVVALGAAVQAGVLSGDVSDIVLLDVTPLSLGLETLGGVMTKIIPRNTTLPTSKSEVFSTAADGQTSVEINVLQGEREFVRDNKSLGSFRLDGIPPAPRGVPQIEVKFDIDANGILSVTAIDKGTGKKQDITITGASTLPSDEVERMVSEAERFAKEDKEKRDAIDTKNQADSVVYQTEKQLKELGDKVPAPVKEKVEAKLKELKDAIEGGSTQGMKDAMAALNQEVMQLGQSLYNQPGAGGAGPAPGGEAGPSSDSSSKGPEGDVIDADFTDSK

SEQ ID NO: 2104 - protein, 705 aa, Populus trichocarpa
MASSAAQIHGLGVGGGIGSTSSRKPTFSFAPRSVFFGQNLRKTTVTFLKHTNNTSRRRYSTGPVRIVNEKVVGIDLGTTNSAVAAMEGGKPTIVTNAEGQRTTPSVVAYTKNGDRLVGQIAKRQAVVNPENTFFSVKRFIGRKMSEVDEESKQVSYKVVRDENGNVKLECPAIGKQFAAEEISAQVLRKLVDDASKFLNDKVTKAVVTVPAYFNDSQRTATKDAGRIAGLEVLRIINEPTAASLAYGFERKSNETILVFDLGGGTFDVSVLEVGDGVFEVLSTSGDTHLGGDDFDKRVVDWLAGSFKRDEGIDLLKDKQALQRLTETAEKAKMELSSLTQTNISLPFITATADGPKHIETTLTRAKFEELCSDLLDRLKTPVENSLRDAKLSFKDLDEVILVGGSTRIPAVQELVKKLTGKDPNVTVNPDEVVALGAAVQAGVLAGDVSDIVLLDVSPLSLGLETLGGVMTKIIPRNTTLPTSKSEVFSTAADGQTSVEINVLQGEREFVRDNKSLGSFRLDGIPPAPRGVPQIEVKFDIDANGILSVAAIDKGTGKKQDITITGASTLPSDEVGRMVSEAEKFAKEDKEKRDAIDTKNQADSVVYQTEKQLKELGEKVPAPVKEKVEAKLQELKDAVAGGSTQGMKDAMAALNQEVMQLGQSLYNQPGAAPGAGPAPGSEAGPSDSSNKGPDGDVIDADFTDSK

SEQ ID NO: 2105 - protein, 706 aa, Populus trichocarpa
MASSTAQIHVLGGGGGIGGTSSIKPRFSFAPRSSVFFGQNLRGTTATSLKHTNNTSRRRYSTGPVRVVNEKVVGIDLGTTNSAVAAMEGGKPTIVTNAEGQRTTPSVVAYTKNGDRLVGQIAKRQAVVNPENTFFSVKRFIGRKMSEVDEESKQVSYRVVRDENGNVKLECPAIGKQFAAEEISAQVLRKLVDDASKFLNDKVTKAVVTVPAYFNDSQRTATKDAGRIAGLEVLRIINEPTAASLAYGFERKNNETILVFDLGGGTFDVSVLEVGDGVFEVLSTSGDTHLGGDDFDKRVVDWLAGDFKRDEGIDLLKDKQALQRLTETAEKAKMELSSLTQTNISLPFITATADGPKHIETTLTRAKFEELCSDLLDRLKTPVENSLRDAKLSFKDLDEVILVGGSTRIPAVQGLVKKLTGKDPNVTVNPDEVVALGAAVQAGVLSGDVSDIVLLDVTPLSIGLETLGGVMTKIIPRNTTLPTSKSEVFSTAADGQTSVEINVLQGEREFVRDNKSLGSFRLDGIPPAPRGVPQIEVKFDIDANGILSVTAIDKGTGKKQDITITGASTLPSDEVERMVSEADKFAKEDKEKRDAIDTKNQADSVVYQTEKQLKELGEKVPAPVKEKVEAKLQELKDAIAGGSTQVMKDAMTALNQEVMQLGQSLYNQPGAAPGAGPAPGGEAGPTDSSSKGPDGDVIDADFTDSK

SEQ ID NO: 2106 - protein, 707 aa, Vitis vinifera
MASSTAQIHGLGTTGFASSSAKPKRTSSRTVFFGQRLSPSTASFGLPKTAFLKLKRNSRRDYSTGPVRVVNEKVVGIDLGTTNSAVAAMEGGKPTIVTNAEGQRTTPSVVAYTKNGDRLVGQIAKRQAVVNPENTFFSVKRFIGRKMSEVDEESKQVSYRVVRDENGNVKLECPAIGKQFAAEEISAQVLRKLVDDASKFLNDKVTKAVVTVPAYFNDSQRTATKDAGRIAGLEVLRIINEPTAASLAYGFEKKNNETILVFDLGGGTFDVSVLEVGDGVFEVLSTSGDTHLGGDDFDKRVVDWLAASFKKDEGIDLLKDKQALQRLTETAEKAKMELSSLTQTNISLPFITATADGPKHIETTLTRAKFEELCSDLLDRLKTPVENSLRDAKLSFKDLDEVILVGGSTRIPAVQELVKKMTGKDPNVTVNPDEVVALGAAVQAGVLSGDVSDIVLLDVSPLSLGLETLGGVMTKIIPRNTTLPTSKSEVFSTAADGQTSVEINVLQGEREFVRDNKSLGSFRLDGIPPAPRGVPQIEVKFDIDANGILSVTAIDKGTGKKQDITITGASTLPTDEVERMVSEAERFAKEDKEKRDAIDTKNQADSVVYQTEKQLKELGDKVPAQVKEKVEAKLGELKDAISGGSTQVMKDAMAALNQEVMQLGQSLYNQPGAPGAGPAPGSEAGPSESSGKGPDGDVIDADFTDSK

SEQ ID NO: 2107 - protein, 700 aa, Ipomoea nil
MASSTAQIHALGATHFSTKPSSLSKKPPGTVFFGQRLNKAPFGINLKKSACNRRNAPFRVVAEKVVGIDLGTTNSAVAAMEGGKPTIVTNAEGQRTTPSVVAYTKNGDRLVGQIAKRQAVVNPENTFFSVKRFIGRKMAEVDEESKQVSYNVIRDENGNVKLDCPAIGKQFAAEEISAQVLRKLVDDASKFLNDKVTKAVVTVPAYFNDSQRTATKDAGRIAGLEVLRIINEPTAASLAYGFEKKNNETILVFDLGGGTFDVSVLEVGDGVFEVLSTSGDTHLGGDDFDKRIVDWLASSFKKDEGIDLLKDKQALQRLTETAEKAKMELSSLTQTNISLPFITATSDGPKHIETTITRAKFEELCSDLLDRLKTPVQNSLRDAKLSFSDIDEVILVGGSTRIPAVQELVKKLTGKDPNVTVNPDEVVALGAAVQAGVLSGDVSDIVLLDVTPLSIGLETLGGVMTKIIPRNTTLPTSKSEVFSTAADGQTSVEINVLQGEREFVRDNKSLGSFRLDGIPPAPRGVPQIEVKFDIDANGILSVTAVDKGTGKKQDITITGASTLPSDEVERMVSEAERFAQEDKEKRDAIDTKNQADSVVYQTEKQLKELGEKVPGPVKEKVEAKLGELRDAISGGSTQAMKDAMAALNQEVMQLGQSLYNQPSASPGAGPTPGGGSAGPSESSGKGPDGDVIDADFTDSK

SEQ ID NO: 2108 - protein, 707 aa, Cucumis sativus
MGASTAQIHGLGAPSFAAASMRKSNNVSSRSVFFGQKLGNSSAFPAAAFLNLRSNTSRRNSSVRPLRIVNEKVVGIDLGTTNSAVAAMEGGKPTIVTNAEGQRTTPSVVAYTKNGDRLVGQIAKRQAVVNPENTFFSVKRFIGRKMSEVDEESKQVSYRVVRDENGNVKLECPAIGKQFAAEEISAQVLRKLVDDASKFLNDKVTKAVVTVPAYFNDSQRTATKDAGRIAGLEVLRIINEPTAASLAYGFEKKSNETILVFDLGGGTFDVSVLEVGDGVFEVLSTSGDTHLGGDDFDKRIVDWLAANFKRDEGIDLLKDKQALQRLTETAEKAKMELSSLTQANISLPFITATADGPKHIETTITRAKFEELCSDLLDRLKTPVENSLRDAKLSFKDIDEVILVGGSTRIPAVQELVKKMTGKEPNVTVNPDEVVALGAAVQAGVLAGDVSDIVLLDVSPLSLGLETLGGVMTKIIPRNTTLPTSKSEVFSTAADGQTSVEINVLQGEREFVRDNKSLGSFRLDGIPPAPRGVPQIEVKFDIDANGILSVTAIDKGTGKKQDITITGASTLPSDEVERMVSEADKFAKEDKEKRDAIDTKNQADSVVYQTEKQLKELGDKVPGPVKEKVESKLGELKEAISGGSTEAIKEAMAALNQEVMQLGQSLYNQPGAGAAPGPGASSESGPSESTGKGPEGDVIDADFSDSK

SEQ ID NO: 2109 - protein, 707 aa, Medicago truncatula
MASSSAAQIHGLGFSPLRKPSSSTSNSSSYSKTLFFGHRLNSNHATFPRAAFPKLSTNRKPFTFRVVNEKVVGIDLGTTNSAVAAMEGGKPTIITNAEGQRTTPSVVAYTKNGDRLVGQIAKRQAVVNPENTFFSVKRFIGRKMSEVDEESKQVSYRVIRDDNGNVKLDCPAIGKSFAAEEISAQVLRKLVDDASKFLNDKVTKAVVTVPAYFNDSQRTATKDAGRIAGLEVLRIINEPTAASLAYGFERKNNETILVFDLGGGTFDVSVLEVGDGVFEVLSTSGDTHLGGDDFDKRVVDWLAGDFKRDEGIDLLKDKQALQRLTETAEKAKMELSSLTQTNISLPFITATADGPKHIETTLTRAKFEELCSDLLDRLRTPVENSLRDAKLSIKDIDEVILVGGSTRIPAVQELVKKMTGKDPNVTVNPDEVVALGAAVQAGVLAGDVSDIVLLDVSPLSLGLETLGGVMTKIIPRNTTLPTSKSEVFSTAADGQTSVEINVLQGEREFVRDNKSLGSFRLDGIPPAPRGVPQIEVKFDIDANGILSVAAIDKGTGKKQDITITGASTLPGDEVERMVNEAERFSKEDKEKRDAIDTKNQADSVVYQTEKQLKELGEKVPGPVKEKVEAKLVELKDAISGGSTQTMKDAMAALNQEVMQLGQSLYNQPGAADAAGPTPPGSESGPTDSSSGKGADGDVIDADFTDSK

SEQ ID NO: 2110 - protein, 707 aa, Cucumis sativus
MGASTAQIHGLGAPSFAAASMRKSNNVSSRSVFFGQKLGNSSAFPAAAFLNLRSNTSRRNSSVRPLRIVNEKVVGIDLGTTNSAVAAMEGGKPTIVTNAEGQRTTPSVVAYTKNGDRLVGQIAKRQAVVNPENTFFSVKRFIGRKMSEVDEESKQVSYRVERDENGNVKLECPAIGKQFAAEEISAQVLRKLVDDASKFLNDKVTKAVVTVPAYFNDSQRTATKDAGRIAGLEVLRIINEPTAASLAYGFEKKSNETILVFDLGGGTFDVSVLEVGDGVFEVLSTSGDTHLGGDDFDKRIVDWLAANFKRDEGIDLLKDKQALQRLTETAEKAKMELSSLTQANISLPFITATADGPKHIETTITRAKFEELCSDLLDRLKTPVENSLRDAKLSFKDIDEVILVGGSTRIPAVQELVKKMTGKEPNVTVNPDEVVALGAAVQAGVLAGDVSDIVLLDVSPLSLGLETLGGVMTKIIPRNTTLPTSKSEVFSTAADGQTSVEINVLQGEREFVRDNKSLGSFRLDGIPPAPRGVPQIEVKFDIDANGILSVTAIDKGSGKKQDITITGASTLPSDEVERMVSEADKFAKEDKEKRDAIDTKNQADSVVYQTEKQLKELGDKVPGPVKEKVESKLGELKEAISGGSTEAIKEAMAALNQEVMQLGQSLYNQPGAGAAPGPGASSESGPSESTGKGPEGDVIDADFSDSK

SEQ ID NO: 2111 - protein, 706 aa, Pisum sativum
MASSAQIHGLGTASFSSLKKPSSISGNSKTLFFGQRLNSNHSPFTRAAFPKLSSKTFKKGFTLRVVSEKVVGIDLGTTNSAVAAMEGGKPTIITNAEGQRTTPSVVAYTKNGDRLVGQIAKRQAVVNPENTFFSVKRFIGRKMSEVDEESKQVSYRVIRDDNGNVKLDCPAIGKSFAAEEISAQVLRKLVDDASKFLNDKVTKAVVTVPAYFNDSQRTATKDAGRIAGLEVLRIINEPTAASLAYGFERKNNETILVFDLGGGTFDVSVLEVGDGVFEVLSTSGDTHLGGDDFDKRVVDWLAGDFKRDEGIDLLKDKQALQRLTETAEKAKMELSSLSQTNISLPFITATADGPKHIETTLTRAKFEELCSDLLDRLRTPVENSLRDAKLSIKDIDEVILVGGSTRIPAVQELVKKLIGKDPNVTVNPDEVVALGAAVQAGVLAGDVSDIVLLDVSPLSLGLETLGGVMTKIIPRNTTLPTSKSEVFSTAADGQTSVEINVLQGEREFVRDNKSLGSFRLDGIPPAPRGVPQIEVKFDIDANGILSVAAIDKGTGKKQDITITGASTLPGDEVERMVSEAERFSKEDKEKREAIDTKNQADSVVYQTEKQLKELGEKVPAPVKEKVEAKLGELKEAITGGSTQTIKDALAALNQEVMQLGQSLYNQPGAAGQAGPTPPGSESGPSESSGKEGPEGDVIDADFTDSK

SEQ ID NO: 2112 - protein, 693 aa, Vitis vinifera
MASSTAQIHGLGTTGFASSSAKPKRTSSRTVFFGQRLSPSTASFGLPKTAFLKLKRNSRRDYSTGPVRVVNEKVVGIDLGTTNSAVAAMEGGKPTIVTNAEGQRTTPSVVAYTKNGDRLVGQIAKRQAVVNPENTFFSVKRFIGRKMSEVDEESKQVSYRVVRDENGNVKLECPAIGKQFAAEEISAQVLRKLVDDASKFLNDKVTKAVVTVPAYFNDSQRTATKDAGRIAGLEVLRIINEPTAASLAYGFEKKNNETILVFDLGGGTFDVSVLEVGDGVFEVLSTSGDTHLGGDDFDKRVVDWLAASFKKDEGIDLLKDKQALQRLTETAEKAKMELSSLTQTNISLPFITATADGPKHIETTLTRAKFEELCSDLLDRLKTPVENSLRDAKLSFKDLDEVILVGGSTRIPAVQELVKKMTGKDPNVTVNPDEVVALGAAVQAGVLSGDVSDIVLLDVSPLSLGLETLGGVMTKIIPRNTTLPTSKSEVFSTAADGQTSVEINVLQGEREFVRDNKSLGSFRLDGIPPAPRGVPQIEVKFDIDANGILSVTAIDKGTGKKQDITITGASTLPTDEVERMVSEAERFAKEDKEKRDAIDTKNQADSVVYQTEKQLKELGDKVPAQVKEKVEAKLGELKDAIFRREVMQLGQSLYNQPGAPGAGPAPGSEAGPSESSGKGPDGDVIDADFTDSK

SEQ ID NO: 2113 - protein, 476 aa, Saccharum hybrid cultivar SP-80-3280
MSPQTETKASVGFKAGVKDYKLTYYTPEYETKDTDILAAFRVTPQLGVPPEEAGAAVAAESSTGTWTTVWTDGLTSLDRYKGRCYHIEPVPGDPDQYICYVAYPLDLFEEGSVTNMFTSIVGNVFGFKALRALRLEDLRIPPAYVKTFQGPPHGIQVERDKLNKYGRPLLGCTIKPKLGLSAKNYGRACYECLRGGLDFTKDDENVNSQPFMRWRDRFVFCAEAIYKAQAETGEIKGHYLNATAGTCEEMIKRAVFAKELGVPIVMHDYLTGGFTANTTLSHYCRDNGLLLHIHRAMHAVIDRQKNHGMHFRVLAKALRMSGGDHIHSGTVVGKLEGEREITLGFVDLLRDDFIEKDRSRGIFFTQDWVSMPGVIPVASGGIHVWHMPALTEIFGDDSVLQFGGGTLGHPWGNAPGAAANRVALEACVQARNEGRDLAREGNEIIKAACKWSAELAAACEIWKEIKFDTFKAMDTL

SEQ ID NO: 2114 - protein, 476 aa, Zea mays
MSPQTETKASVGFKAGVKDYKLTYYTPEYETKDTDILAAFRVTPQLGVPPEEAGAAVAAESSTGTWTTVWTDGLTSLDRYKGRCYHIEPVPGDPDQYICYVAYPLDLFEEGSVTNMFTSIVGNVFGFKALRALRLEDLRIPPAYSKTFQGPPHGIQVERDKLNKYGRPLLGCTIKPKLGLSAKNYGRACYECLRGGLDFTKDDENVNSQPFMRWRDRFVFCAEAIYKAQAETGEIKGHYLNATAGTCEEMIKRAVFARELGVPIVMHDYLTGGFTANTTLSHYCRDNGLLLHIHRAMHAVIDRQKNHGMHFRVLAKALRMSGGDHIHSGTVVGKLEGEREITLGFVDLLRDDFIEKDRSRGIFFTQDWVSMPGVIPVASGGIHVWHMPALTEIFGDDSVLQFGGGTLGHPWGNAPGAAANRVALEACVQARNEGRDLAREGNEIIKAACKWSAELAAACEIWKEIKFDGFKAMDTI

SEQ ID NO: 2115 - protein, 473 aa, Sorghastrum nutans
QTETKASVGFKAGVKDYKLTYYTPEYETKDTDILAAFRVTPQLGVPPEEAGAAVAAESSTGTWTTVWTDGLTSLDRYKGRCYHIEPVPGDPDQYICYVAYPLDLFEEGSVTNMFTSIVGNVFGFKALRALRLEDLRIPPAYAKTFQGPPHGIQVERDKLNKYGRPLLGCTIKPKLGLSAKNYGRACYECLRGGLDFTKDDENVNSQPFMRWRDRFVFCAEAIYKAQAETGEIKGHYLNATAGTCEEMIKRAVFAKELGVPIVMHDYLTGGFTANTTLSHYCRDNGLLLHIHRAMHAVIDRQKNHGMHFRVLAKALRMSGGDHIHSGTVVGKLEGEREITLGFVDLLRDDFIEKDRSRGIFFTQDWVSMPGVIPVASGGIHVWHMPALTEIFGDDSVLQFGGGTLGHPWGNAPGAAANRVALEACVQARNEGRDLAREGNEIIKAACKWSAELAAACEIWKEIKFDGFKAMDTL

SEQ ID NO: 2116 - protein, 476 aa, Coix lacryma-jobi
MSPQTETKASVGFKAGVKDYKLTYYTPEYETKDTDILAAFRVTPQLGVPPEEAGAAVAAESSTGTWTTVWTDGLTSLDRYKGRCYHIEPVPGDPDQYICYVAYPLDLFEEGSVTNMFTSIVGNVFGFKALRALRLEDLRIPPAYAKTFQGPPHGIQVERDKLNKYGRPLLGCTIKPKLGLSAKNYGRACYECLRGGLDFTKDDENVNSQPFMRWRDRFVFCAEAIYKAQAETGEIKGHYLNATAGTCEEMIKRAVFARELGVPIVMHDYLTGGFTANTTLSHYCRDNGLLLHIHRAMHAVIDRQKNHGMHFRVLAKALRMSGGDHIHSGTVVGKLEGEREITLGFVDLLRDDFIEKDRSRGIFFTQDWVSMPGVIPVASGGIHVWHMPALTEIFGDDSVLQFGGGTLGHPWGNAPGAAANRVALEACVQARNEGRDLAREGNEIIKEACKWSVELAAACEIWKEIKFDTFVTVDTI

SEQ ID NO: 2117 - protein, 470 aa, Cymbopogon citratus
TKASVGFKAGVKDYKLTYYTPEYETKDTDILAAFRVTPQLGVPPEEAGAAVAAESSTGTWTTVWTDGLTSLDRYKGRCYHIEPVPGDPDQYICYVAYPLDLFEEGSVTNMFTSIVGNVFGFKALRALRLEDLRIPPAYAKTFQGPPHGIQVERDKLNKYGRPLLGCTIKPKLGLSAKNYGRACYECLRGGLDFTKDDENVNSQPFMRWRDRFVFCAEAIYKAQAETGEIKGHYLNATAGTCEEMIKRAVFAKELGVPIVMHDYLTGGFTANTTLSHYCRDNGLLLHIHRAMHAVIDRQKNHGIHFRVLAKALRMSGGDHIHSGTVVGKLEGEREITLGFVDLLRDDFIEKDRSRGIFFTQDWVSLPGVIPVASGGIHVWHMPALTEIFGDDSVLQFGGGTLGHPWGNAPGAAANRVALEACVQARNEGRDLAREGNEIIKAACKWSAELAAACEIWKEIKFDGFKAMDTL

SEQ ID NO: 2118 - protein, 468 aa, Pogonatherum sp. Hodkinson 21
ASVGFKAGVKDYKLTYYTPEYETKDTDILAAFRVTPQLGVPPEEAGAAVAAESSTGTWTTVWTDGLTSLDRYKGRCYHIEPVPGDPDQYICYVAYPLDLFEEGSVTNMFTSIVGNVFGFKALRALRLEDLRIPPAYVKTFQGPPHGIQVERDKLNKYGRPLLGCTIKPKLGLSAKNYGRACYECLRGGLDFTKDDENVNSQPFMRWRDRFVFCAEAIYKAQAETGEIKGHYLNATAGTCEEMIKRAVFAKELGVPIVMHDYLTGGFTANTTLSHYCRDNGLLLHIHRAMHAVIDRQKNHGMHFRVLAKALRMSGGDHIHSGTVVGKLEGEREITLGFVDLLRDDFIEKDRSRGIFFTQDWVSMPGVIPVASGGIHVWHMPALTEIFGDDSVLQFGGGTLGHPWGNAPGAAANRVALEACVQARNEGRDLAREGNEIIKAACKWSAELAAACEIWKEIKFDNFQAQDTL

SEQ ID NO: 2119 - protein, 469 aa, Coix lacryma-jobi
KASVGFKAGVKDYKLTYYTPEYETKDTDILAAFRVTPQLGVPPEEAGAAVAAESSTGTWTTVWTDGLTSLDRYKGRCYHIEPVPGDPDQYICYVAYPLDLFEEGSVTNMFTSIVGNVFGFKALRALRLEDLRIPPAYAKTFQGPPHGIQVERDKLNKYGRPLLGCTIKPKLGLSAKNYGRACYECLRGGLDFTKDDENVNSQPFMRWRDRFVFCAEAIYKAQAETGEIKGHYLNATAGTCEEMIKRAVFARELGVPIVMHDYLTGGFTANTTLSHYCRDNGLLLHIHRAMHAVIDRQKNHGMHFRVLAKALRMSGGDHIHSGTVVGKLEGEREITLGFVDLLRDDFIEKDRSRGIFFTQDWVSMPGVIPVASGGIHVWHMPALTEIFGDDSVLQFGGGTLGHPWGNAPGAAANRVALEACVQARNEGRDLAREGNEIIKEACKWSAELAAACEIWKEIKFDTFVTVDTI

SEQ ID NO: 2120 - protein, 458 aa, Sorghum halepense
MSPQTETKASVGFKAGVKDYKLTYYTPEYETKDTDILAAFRVTPQLGVPPEEAGAAVAAESSTGTWTTVWTDGLTSLDRYKGRCYHIEPVPGDPDQYICYVAYPLDLFEEGSVTNMFTSIVGNVFGFKALRALRLEDLRIPPAYVKTFQGPPHGIQVERDKLNKYGRPLLGCTIKPKLGLSAKNYGRACYECLRGGLDFTKDDENVNSQPFMRWRDRFVFCAEAIYKAQAETGEIKGHYLNATAGTCEEMIKRAVFAKELGVPIVMHDYLTGGFTANTTLSHYCRDNGLLLHIHRAMHAVIDRQKNHGMHFRVLAKALRMSGGDHIHSGTVVGKLEGEREITLGFVDLLRDDFIEKDRSRGIFFTQDWVSMPGVIPVASGGIHVWHMPALTEIFGDDSVLQFGGGTLGHPWGNAPGAAANRVALEACVQARNEGRDLAREGNGIIKAACKWSAELAAA

SEQ ID NO: 2121 - protein, 463 aa, Arthraxon sp. Hodkinson 111
ETKASVGFKAGVKDYKLTYYTPEYETKDTDILAAFRVTPQPGVPPEEAGAAVAAESSTGTWTTVWTDGLTSLDRYKGRCYHIEPVPGEADQYICYIAYPLDLFEEGSVTNMFTSIVGNVFGFKALRALRLEDLRIPPAYSKTFQGPPHGIQVERDKLNKYGRPLLGCTIKPKLGLSAKNYGRACYECLRGGLDFTKDDENVNSQPFMRWRDRFVFCAEAIYKAQAETGEIKGHYLNATAGTCEEMMKRAVFAKELGVPIVMHDYLTGGFTANTTLSHYCRDNGLLLHIHRAMHAVIDRQKNHGIHFRVLAKALRMSGGDHIHSGTVVGKLEGEREITLGFVDLLRDDFIEKDRSRGIFFTQDWVSMPGVVPVASGGIHVWHMPALTEIFGDDSVLQFGGGTLGHPWGNAPGAAANRVALEACVQARNEGRDLAREGNEIIKAACKWSAELAAACEIWKEIKFD

SEQ ID NO: 2122 - protein, 475 aa, Cenchrus setiger
MSPQTETKASVGFKAGVKDYKLTYYTPEYETKDTDILAAFRVTPQPGVPPEEAGAAVAAESSTGTWTTVWTDGLTSLDRYKGRCYHIEPVPGEADQYICYIAYPLDLFEEGSVTNMFTSIVGNVFGFKALRALRLEDLRIPPSYSKTFQGPPHGIQVERDKLNKYGRPLLGCTIKPKLGLSAKNYGRACYECLRGGLDFTKDDENVNSQPFMRWRDRFVFCAEAIYKAQAETGEIKGHYLNATAGTCEEMIKRAVFARELGVPIVMHDYLTGGFTANTSLSHYCRDNGLLLHIHRAMHAVIDRQKNHGIHFRVLAKALRMSGGDHIHSGTVVGKLEGEREITLGFVDLLRDDFIEKDRSRGIFFTQDWVSMPGVIPVASGGIHVWHMPALTEIFGDDSVLQFGGGTLGHPWGNAPGAAANRVALEACVQARNEGRDLAREGNEIIKAACKWSPELAAACEVWKEIKFEFEAMDTL

SEQ ID NO: 2123 - protein, 451 aa, Trachypogon spicatus
TPEYETKDTDILAAFRVTPQLGVPPEEAGAAVAAESSTGTWTTVWTDGLTSLDRYKGRCYHIEPVPGDPDQYICYVAYPLDLFEEGSVTNMFTSIVGNVFGFKALRALRLEDLRIPPAYAKTFQGPPHGIQVERDKLNKYGRPLLGCTIKPKLGLSAKNYGRACYECLRGGLDFTKDDENVNSQPFMRWRDRFVFCAEAIYKAQAETGEIKGHYLNATAGTCEEMIKRAVFAKELGVPIVMHDYLTGGFTANTTLSHYCRDNGLLLHIHRAMHAVIDRQKNHGMHFRVLAKALRMSGGDHIHSGTVVGKLEGEREITLGFVDLLRDDFIEKDRSRGIFFTQDWVSMPGVIPVASGGIHVWHMPALTEIFGDDSVLQFGGGTLGHPWGNAPGAAANRVALEACVQARNEGRDLAREGNEIIKAACKWSAELAAACEIWKEIKFDGFKAMDTL

SEQ ID NO: 2124 - protein, 473 aa, Sorghastrum nutans; identical to SEQ ID NO: 2115

SEQ ID NO: 2125 - protein, 476 aa, Zea mays; identical to SEQ ID NO: 2114

SEQ ID NO: 2126 - protein, 476 aa, Saccharum hybrid cultivar SP-80-3280; identical to SEQ ID NO: 2113

SEQ ID NO: 2127 - protein, 470 aa, Cymbopogon citratus; identical to SEQ ID NO: 2117

SEQ ID NO: 2128 - protein, 468 aa, Pogonatherum sp. Hodkinson 21; identical to SEQ ID NO: 2118

SEQ ID NO: 2129 - protein, 469 aa, Coix lacryma-jobi; identical to SEQ ID NO: 2119

SEQ ID NO: 2130 - protein, 476 aa, Coix lacryma-jobi; identical to SEQ ID NO: 2116

SEQ ID NO: 2131 - protein, 443 aa, Bothriochloa ischaemum
TDILAAFRVTPQLGVPPEEAGAAVAAESSTGTWTTVWTDGLTSLDRYKGRCYHIEPVPGDPDQYICYVAYPLDLFEEGSVTNMFTSIVGNVFGFKALRALRLEDLRIPPAYAKTFQGPPHGIQVERDKLNKYGRPLLGCTIKPKLGLSAKNYGRACYECLRGGLDFTKDDENVNSQPFMRWRDRFVFCAEAIYKAQAETGEIKGHYLNATAGTCEEMMKRAVFAKELGVPIVMHDYLTGGFTANTTLSHYCRDNGLLLHIHRAMHAVIDRQKNHGIHFRVLAKALRMSGGDHIHSGTVVGKLEGEREITLGFVDLLRDDFIEKDRSRGIFFTQDWVSLPGVIPVASGGIHVWHMPALTEIFGDDSVLQFGGGTLGHPWGNAPGAAANRVALEACVQARNEGRDLAREGNEIIKAACKWSAELAAACEIWKEIKFDGFKAMDTL

SEQ ID NO: 2132 - protein, 463 aa, Arthraxon sp. Hodkinson 111; identical to SEQ ID NO: 2121

SEQ ID NO: 2133 - protein, 759 aa, Sorghum bicolor
MPVYRIRGVDVDFPFDAYDCQITYMDRVIESLQQGKNALLESPTGTGKTLCLLCASLAWRRTFGEFLRVGRGGGGGGTQQLPYGSQPSVSQQSEDSTSQQQQSRYPVIIYASRTHSQLRQVIKELKATSYRPKMAVLGSREQMCIHNEVSKLRGRAQNNACHFLCKKRRCPHNNHVSEFMKNKPELGNEPFDIEDLINIGRRKGPCPYYISRELSKSVDILFAPYNYLIDPGNRRSLNGIPWDNAVLIFDEAHNLESICADAASFDLFPNNLTACIAEAHECIKLCAAKRSIEKSADKQFDPENYAILKALLMALEKKIGELLIASKELGYTKAGSYIYDFLSELNITSDTSKKLIETIDGASLLLEEGNSAETGRGVQAKATVSRLESIRDMLDIIFRGGGQNHAKYYRFHVNESQQTSGDALKVLGKSSRTLSWWCFNPGLAMEEFLKLGVRSIILTSGTLSPLDSLAMELNLEFPVRLENPHVISSDQIWVGVVPVGPSGHALNSSYRMRNTIQYKQELGTAIVNFARIVPDGLLVFFPSYSMMDMCVEFWKNRNHSNSASENTIWQRICKHKQPVIEPRQSSNFQSAIEDYRAKLHDSSSGAIFFAVCRGKVSEGLDFADRAGRAVIVTGMPFATPTDAKVRLKREYLDKQGTPSNKNTKTLTGEEWYVQQAARAVNQAVGRVIRHRHDYGAILYCDERFAWPNYQSQMSYWLRPHIKCYSKYGEVVQGLTRFFRDKASSDPLSLEPTDCNKIYH

SEQ ID NO: 2134 - protein, 984 aa, Oryza sativa Indica Group
MDRVLESLQQGKNALLESPTGTGKTLCLLCSALAWRRTFGEFLRGGGGGGGGGGSQQPPYGSQPSGSQHSGGSASQSSRYPVIIYASRTHSQLRQVIKELKATSYRPKMAVLGSREQMCIHEEVSKLRGRQQNNACHYLCKKRWCRHHNSVAEFMRNNSELGSEACDIEDLVNIGRTKGPCPYYISRELSKSVDILFAPYNYLIDPGNRRSLNGIPWDNAVLIFDEAHNLESICADAASFDLLPNNLSSCIAEAQECIQLCSAKRTFENSADKQFDPENYAILKALLMALEKKISEVVIDSKELGHTKPGNYIYEFLSELNITSETSKKLIDTIDGASLLLEEGNSAETGPGMKAKATVCRLETIRDILDIIFRGGGQSHAKYYRFHVNECQQNSGDALKVLGKVSRTLSWWCFNPGLAMEEFLKLGVRSIILTSGTLSPLDSLALELNLEFPVRLENPHVIASDQIWVGVVPVGPSGHPLNSSYRTRETLKYKQELGITIVNFARIVPDGLLVFFPSYSMMDKCINCWKDRNHENSSDEHTIWQRICKHKQPVIEPRQSSNFPNAIEDYAAKLRDSSTTGAIFFAVCRGKVSEGLDFADRAGRAVIVTGMPFATPTDPKVRLKRDYLDKLGSASNKNSKALTGEEWYVQQAARAVNQAVGRVIRHRHDYGAIIYCDERFVWQNYQSQMSYWLRPYIKCYKKYGEVVQGLTRFFRDKVSIDSSKPNETDFNDNIVLLADKHKPQETISALAVTTANENQRTALSVNPTTKRSNYIKFAQITPANRSTLSMKHGCSSTSQLLYSGDKLSTDAQVIDLAADVATSHLAGYRFKSLGPKKAKVMVGSKDVCFDDGSPKLQHNVESRALAGCLGEQSTASSKKSNITHAPGNSGAIHEKSGGQESNAGPAFLKLAREKLSTAEYRDFVEYMKALKLKTMHIKDSLDAIAKLFSSPERLPLLEGFRVFVPKNHLSLYEQLVQSYTVPNT

SEQ ID NO: 2135 - protein, 619 aa, Zea mays
MPVYSIRGVNVDFPFDAYDCQITYMDRVIESLQQGKNALLESPTGTGKTLCLLCASLAWRRTFGEFLRVGRGGGGTMQLPYGSQPSASQQSEDSTSQKQQQSRYPVIIYASRTHSQLRQVIKELKATSYRPKMAVLGSREQMCIHDEVSKLHGRAQNNACHFLCKKRRCPHNNHVAEFIKNKPELGNEPFDIEDLINIGRHKGPCPYYISRELSKSVDILFAPYNYLIDPGNRRSLNGIPWDNAVLIFDEAHNLESICADAASFDLFPNNLTACIAEAHECIKLCSAKRSIKNSADKQFDPENYAILKALLMALEKKIAELLIGSELGYTKAGSYIYDFLSELNITSDTSKKLIETIDCASLLLEEGNSAQTGPGVQAKAAVSRLESIRDMLDIIFRGGGQNHAKYYRFHVNESQQTHGDALKFLGKSSRTLSWWCFNPGLAMEEFLKLGVRSIILTSGTLSPLDSLAMELNLEFPVRLENPHVISSDQVWVGVVPVGPSGHALNSSYRTRNTIQYKQELGTAIVNFARIVPDGLLVFFPSYSMMDMCVDFWKNRNHSNSASENTIWQRICKHKQPVIEPRQSSNFQSAIEDYRAKLHDSSSGAIFFAVCRGKVCSCSL

SEQ ID NO: 2136 - protein, 876 aa, Oryza sativa Japonica Group
MAVLGSREQMCIHEEVSKLRGRQQNNACHYLCKKRWCRHHNSVAEFMRNNSELGSEACDIEDLVNIGRTKGPCPYYISRELSKSVDILFAPYNYLIDPGNRRSLNGIPWDNAVLIFDEAHNLESICADAASFDLLPNNLSSCIAEAQECIQLCSAKRTFENSADKQFDPENYAILKALLMALEKKISEVVIDSKELGHTKPGNYIYEFLSELNITSETSKKLIDTIDGASLLLEEGNSAETGPGMKAKATVCRLETIRDILDIIFRGGGQSHAKYYRFHVNECQQNSGDALKVLGKVSRTLSWWCFNPGLAMEEFLKLGVRSIILTSGTLSPLDSLALELNLEFPVRLENPHVIASDQIWVGVVPVGPSGHPLNSSYRTRETLKYKQELGITIVNFARIVPDGLLVFFPSYSMMDKCINCWKDRNHENSSDEHTIWQRICKHKQPVIEPRQSSNFPNAIEDYAAKLRDSSTTGAIFFAVCRGKVSEGLDFADRAGRAVIVTGMPFATPTDPKVRLKRDYLDKLGSASNKNSKALTGEEWYVQQAARAVNQAVGRVIRHRHDYGAIIYCDERFVWQNYQSQMSYWLRPYIKCYKKYGEVVQGLTRFFRDKVSIDSSKPNETDFNDNIVLLADKHKPQETISALAVTTANENQRTALSVNPTTKRSNYIKFAQITPANRSTLSMKHGCSSTSQLLYSGDKLSTDAQVIDLAADVATSHLAGYRFKSLGPKKAKVMVGSKDVCFDDGSPKLQHNVESRALAGCLGEQSTASSKKSNITHAPGNSGAIHEKSGGQESNAGPAFLKLAREKLSTAEYRDFVEYMKALKLKTMHIKDSLDAIAKLFSSPERLPLLEGFRVFVPKNHLSLYEQLVQSYTVPNT

SEQ ID NO: 2137 - protein, 414 aa, Zea mays
MALKQKDTDAAATATGTKKRRRVFFSDTDAGVEANECMKVFLVWNPGEGGKGITDLKPVLQNIFGENLVEKEEFLHTFSKECEYIRTAVTNGSAIKHDGSYESDPAVEIVRVELQGAAAFLYSRLVPLVLLLVEGSTPIDIGEHGWEMLLVVKKATQEAGSKFELLGFAAVHNFYHYPESIRLRISQILVLPPYQGEGHGLGLLEAINYIAQSENIYDVTIESPSDYLQYVRSSIDCLRLLMFDPIKPALGAIVLSLKETNLSKRAQSLRMVPPADLMETVRQKLKINKKQFLRCWEILIFLSLDSQDHKSMDNFRACIYDRMKGEILGSASGTNRKRLLQMPTSFNKEASFAVYWTQEIEDEDEQTVEQQPEDLKTQEQQLNELVDIQIEEIAGVAKNVTSRCKDKMTELVVQ

SEQ ID NO: 2138 - protein, 468 aa, Zea mays
MALKQKDTDAAATATGTKKRRRVFFSDTDAGVEANECMKVFLVWNPGEVSSVDCTAIQPFDLNHFFGEDGKIYGYKNLKINVWISAKSFHGYADVSFDETSDGGKGITDLKPVLQNIFGENLVEKEEFLHTFSKECEYIRTAVTNGSAIKHDGSYESDPAVEIVRVELQGAAAFLYSRLVPLVLLLVEGSTPIDIGEHGWEMLLVVKKATQEAGSKFELLGFAAVHNFYHYPESIRLRISQILVLPPYQGEGHGLGLLEAINYIAQSENIYDVTIESPSDYLQYVRSSIDCLRLLMFDPIKPALGAIVLSLKETNLSKRAQSLRMVPPADLMETVRQKLKINKKQFLRCWEILIFLSLDSQDHKSMDNFRACIYDRMKGEILGSASGTNRKRLLQMPTSFNKEASFAVYWTQEIEDEDEQTVEQQPEDLKTQEQQLNELVDIQIEEIAGVAKNVTSRCKDKMTELVVQ

SEQ ID NO: 2139 - protein, 468 aa, Zea mays
MALKQKDTDAAATATGTKKRRRVFFSDTDAGVEANECMKVFLVWNPGEVSSVDCTAIQPFDLNHFFGEDGKIYGYKNLKINVWISAKSFHGYADVSFDETSDGGKGITDLKPVLQNIFGENLVEKEEFLHTFSKECEYIRTAVTNGSAIKHDGSYESDPAVEIVRVELQGAAAFLYSRLVPLVLLLVEGSTPIDIGEHGWEMLLVVKKATQEAGSKFELLGFAAVHNFYHYPESIRLRISQILVLPPYQGEGHGLGLLEAINYIAQSENIYDVTIESPSDYLQYVRSSIDCLRLLMFDPIKPALGAIVLSLKETNLSKRAQSLRMVPPADLMETVRQKLKINKKQFLRCWEILVFLSLDSQDHKSMDNFRACIYDRMKGEILGSASGTNRKRLLQMPTSFNKEASFAVYWTQEIEDEDEQTVEQQPEDLKTQEQQLNELVDIQIEEIAGVAKNVTSRCKDKMTELVVQ

SEQ ID NO: 2140 - protein, 465 aa, Sorghum bicolor
MALKQKGTDAAATDTKKRRRVGFSGTDAGVEANECMKVFLVRNPDEVGSVDCTSIEPFDLNHFFGEDGKIYGYKNLKINVWISAKSFHGYADISFDETSDGGKGITDLKPVLQNIFGENLVEKEEFLHTFSKECECIRTAVTNGSAIKLDGSYESDPAVEIVRVELQGAAAFLYSRLVPLVLLLVEGSTPIDIGEHGWEMVLVVKKTTQEAVSKFELLGFAAVHNFYHYPESTRLRISQILVLPPYQGEGHGLRLLEAINYIAQSENIYDVTIEDPSDYLQYVRSSIDCLRLLTFDPIKSALSAIVSSLKETNLSKRTHSLRMVPPAELMETVRQKLKINKKQFLRCWEILIFLSLDSQEHKSMDNFRACIYDRIKGEILGSASGTNGKRLLQMVSSSNEESFAVYWTQESGDADDQTVEQQPEDLKTQEQQLNELVDNQMEEIIGVAKNVTSRGKDKLVELVAQ

SEQ ID NO: 2141 - protein, 466 aa, Oryza sativa Japonica Group
MALKQKGTDAAADPKKRRRVGFSGIDAGVEANECMKVFIARNPDEAGSANSTSLQPFDLNHFFGEDGKIYGYKNLKINVWISAISFHAYADISFEETSDGGKGITDLKPVLQNIFGENLVEKDEFLKTFSKECEYLSNVVTDGNVIKHDASIDEDSAVEIVRVELQGAAAFLYCRLVPLILLLVEGSTPIDITEHGWEMLLVVKKSAQASSSSNFLVLGFAAVHHFYHYPESTRLRISQILVLPPYQGEGHGLRLLETINSISESENIYDVTIEDPSDYLQYIRSSIDCLRLLTFDPIKPALCSMVSSLKDTNLSKRTSSLKMVPPSDLAETVRQKLKINKKQFLRCWEILIYLNLDAEDRKSMDNFRACIYDRIKGEILGTSTGPNGKRLVQMPSNFDEETCFAVYWTQDGGDADDQTVEQQPEDLKTQEQQLNEVVDSQMEEIVEIAKNVTSRGKDKLSVSCSV

SEQ ID NO: 2142 - protein, 468 aa, Oryza sativa Indica Group
MALKQKGTDAAADPKKRRRVGFSGIDAGVEANECMKVFIARNPDEAGSANSTSLQPFDLNHFFGEDGKIYGYKNLKINVWISAISFHAYADISFEETSDGGKGITDLKPVLQNIFGENLVEKDEFLKTFSKECEYLSNVVTDGNVIKHDASIDEDSAVEIVRVELQGAAAFLYCRLVPLILLLHYVLGSTPIDITEHGWEMLLVVKKSAQASSSSNFLVLGFAAVHHFYHYPESTRLRISQILVLPPYQGEGHGLRLLETINSISESENIYDVTIEDPSDYLQYIRSSIDCLRLLTFDPIKPALCSMVSSLKDTNLSKRTSSLKMVPPSDLAETVRQKLKINKKQFLRCWEILIYLNLDAEDRKSMDNFRACIYDRIKGEILGTSTGPNGKRLVQMPSNFDEETCFAVYWTQDGGDADDQTVEQQPEDLKTQEQQLNEVVDSQMEEIVEVAKNVTSRGKDKLSVSCSV

SEQ ID NO: 2143 - protein, 468 aa, Oryza sativa Japonica Group
MALKQKGTDAAADPKKRRRVGFSGIDAGVEANECMKVFIARNPDEAGSANSTSLQPFDLNHFFGEDGKIYGYKNLKINVWISAISFHAYADISFEETSDGGKGITDLKPVLQNIFGENLVEKDEFLKTFSKECEYLSNVVTDGNVIKHDASIDEDSAVEIVRVELQGAAAFLYCRLVPLILLLHYVLGSTPIDITEHGWEMLLVVKKSAQASSSSNFLVLGFAAVHHFYHYPESTRLRISQILVLPPYQGEGHGLRLLETINSISESENIYDVTIEDPSDYLQYIRSSIDCLRLLTFDPIKPALCSMVSSLKDTNLSKRTSSLKMVPPSDLAETVRQKLKINKKQFLRCWEILIYLNLDAEDRKSMDNFRACIYDRIKGEILGTSTGPNGKRLVQMPSNFDEETCFAVYWTQDGGDADDQTVEQQPEDLKTQEQQLNEVVDSQMEEIVEIAKNVTSRGKDKLSVSCSV

SEQ ID NO: 2144 - protein, 463 aa, Hordeum vulgare subsp. vulgare
MAPKQKGSDASAADTSKRRRVGFAGIDAGTEANECMQVFLARNPDEVGSADSTPIEPFDLNHFFGEGGKIYGYTNLKINVWISAISFHAYADISFKETSDGGRGITDLKPVLQNIFGENLVEKDEFLESFSKGCQYISDVVTNGKSIKYDASDEDDLEVEIVRVELQGAAAYLYSRLVSLVLLLVEGSTPVDITEHGWEMLVVVKKAELEPSDSKFQLLGFAAVHHFYHYPESTRLRISQILVLPSYQGEGHGRRLLEAINSIAESENMYDLTIEDPSDYLQYVRSSMDCLRLLTFEPIKPALGAMVLSLEQTNLSKRTHSLIMVPPADLAETVRLKLKINKKQFLRCWEILIYLHLDAENPKCIGNFRACIYDRTKGELLGAASGTNGKRLVQVPTSFDEDTSFAVFWTKEGGDEDNQTVQQQPEDLATQEEQLNELVDNQMEEIAEVAKNVTSRGKDKLAA

SEQ ID NO: 2145 - protein, 465 aa, Sorghum bicolor; identical to SEQ ID NO: 2140

SEQ ID NO: 2146 - protein, 468 aa, Zea mays; identical to SEQ ID NO: 2138

SEQ ID NO: 2147 - protein, 468 aa, Zea mays; identical to SEQ ID NO: 2139

SEQ ID NO: 2148 - protein, 466 aa, Oryza sativa Japonica Group; identical to SEQ ID NO: 2141

SEQ ID NO: 2149 - protein, 468 aa, Oryza sativa Indica Group; identical to SEQ ID NO: 2142

SEQ ID NO: 2150 - protein, 468 aa, Oryza sativa Japonica Group; identical to SEQ ID NO: 2143

SEQ ID NO: 2151 - protein, 463 aa, Hordeum vulgare subsp. vulgare; identical to SEQ ID NO: 2144

SEQ ID NO: 2152 - protein, 414 aa, Zea mays; identical to SEQ ID NO: 2137

SEQ ID NO: 2153 - protein, 693 aa, Sorghum bicolor
MAMAAHHHHLRPYLATATALFLAFTSAPLDAGDPLGQFCGTGFNYTLNSTYQGNIQRLAATLPRNTSASPTLFAKDTVGAVPDIVYALALCRGDTNASACSDCVATAFQDAQQLCAYNKDATVFYDPCLLRFSNQNFIASPSNSDDKVLILMNTQNVTAPFKVFDAAVAVLLNATAAYAAANSSKRFGTGVERFQTFDSKNPTIYGLAQCTPDMSPADCRRCLSGIIQMAPKYFNGKPGGRILGLRCNYRYEQYSFFTSTPLLQLPEPTVGAPAPAPAVVNGTPTVPTNGGARGTTGKKTGRVLAIALPIVAAAILATIVLCSCLWRRKRKPGKSTLPDTTNPEDIQSIDSLIIDISTLRAATENFDEANKLGEGGFGSVYKGILPDDQEIAVKRLSQTSRQGMEELKNELVLVAKLQHKNLVRLVGVCLEDHEKLLVYEYMPNKSLDTILFNHERCGELDWGKRFKIVNGIARGLQYLHEDSQVKIIHRDLKASNVLLDYDFNPKISDFGLARLFGSDQSQDVTNRVVGTYGYMAPEYAMRGHYSIKSDVFSFGVLILEIVTGRRNGGSYSSDEYADLLSLVWEHWTTGTLIDIMDSSLSSLAPRDQMLKCIHIGLLCVQDDPADRPMMSTVNVMLSSSTVTLQAPSRPAFCIPKSGFSEMNSEGYPPGASQSASRSPMSLNDVSITELEPR

SEQ ID NO: 2154 - protein, 691 aa, Zea mays
MTTVAHHHHLAAATVLFFVAFTMAPLAAGDPVGQLCGTSGNYTLNSTYQGNIRRLAATLPKNTSTSATLFATDTFGAVPDIVYALALCRGDTNASACSGCVAAAFLDAQQLCAYNKDATMFYDPCLLRYSNQNFLADPSSDGRGTALILMNTQNVTARFKVFDAAVAALLNATAAYAAANSSKRFGTGVEAFQNFDSNRPRIYGLAQCTPDMTPADCQSCLSGIIQTGPKYFSGKQGGRILSVRCNYRYEQYPFFTSTPLLQLAEPTVGAPAPAPAVVNGTPTPPTTGGARGTTGNKTGRVLAITLPIVAAVLATIVLCSCLWRKRKTPGKSALPDTTNPEDIQSIDSLIIDVSTLRAATENFAEANKLGEGGFGSVYKGILPDDQEIAVKRLSQTSRQGMEELKNELVLVAKLQHKNLVRLVGVCLEDHEKLLVYEYMPNKSLDTILFNHERCGELDWGKRFKIVNGIARGLQYLHEDSQVKIIHRDLKASNVLLDNDFNPKISDFGLARLFGSEQSRDVTNRVVGTYGYMAPEYAMRGHYSVKSDVFSFGVLILEIVTGRRNGGSYSSEESADLLSLVWEHWTTGTLVEIMDPSLSSLAPRDLMLKCIHIGLLCVQDDHEDRPMMSTVNVMLSSSTVTLQAPSRPAFCFPKSGFNSEINSEVYPPGAYQSASRSPMSLNDVSITELEPR

SEQ ID NO: 2155 - protein, 687 aa, Hordeum vulgare subsp. vulgare
MASHHGGHIPSYLAPAAALLFAFIIAFPASGDPLQQFCGSSGNFTANSTYQANIRRLSATLPKNTSSSPTLFATDTFGTLPDIVYALAFCRGDTSAANCSECVATAFLDAQQRCPYNQDATIFYDPCALRFSNQNFLSSTNGDNRLFILLNTQNMSVPAKVFDTAVGVLVNATADYAAANSSRRFGTGEAGFETVDEANPKIYGLAQCTPDMAPADCRTCLQGIIAMMPQYFSGRKGGRIQQLRCNYRYELYRFFNGPSLLQLRAPSVGLAPAPAPANVKPPLAGGGSTGNGTARILAITLPIVAAVLAAVVICLYLWRRKSTPARKTSLSYPTIPEDIQSIDSLILDLSTLRVATDNFDERNKLGEGGFGVVYKGILPDNEEIAVKRLSQSSRQGIEELKNELVLVAKLQHKNLVRLLGVCLEEQEKLLAYEYMPNKSLDTILFDPDRSSQLDWGMRFRIVNGIARGLQYLHEDSQLKIIHRDLKASNVLLDSDFNPKISDFGLARLFGSDQSHDVTNRVVGTYGYMAPEYAMRGSYSIKSDVFSFGVLILEIVTGKRNSVAYDSEQAVDLLSLVWEHWTMGTIVEIMDSSMTSHSPGDQMLKCMHIGLLCVQEDPADRPMMSVVTVMLSSSTVSLQAPSRPAFCIQKSDMNYSGMHTDPYPGVSHSTSRSPMSPNEVSITELEPR

SEQ ID NO: 2156 - protein, 173 aa, Zea mays
MHSGARKLMWGTSPDRPDDHDVVIVLASLLCALITVLGIGLVARCACARGPSAQAAAAANRGVKKSVLRRIPTVPYAACSQGEGDDADECAICLAEFEEGEPTRVLPQCGHAFHAACVDRWLRAHSSCPSCRRILSLQLPPGERCRRCGARPLDDGDAGWKPTYYSAMPPFLA

SEQ ID NO: 2157 - protein, 177 aa, Zea mays
MHSGARKLMWGTSPDRPDDHDVVIVLASLLCALITVLGIGLVARCACARGPSAQAAAAANRGVKKSVLRRIPTVPYAASAAACSQGEGDDADECAICLAEFEEGEPTRVLPQCGHAFHAACVDRWLRAHSSCPSCRRILSLQLPPGERCRRCGARPLDDGDAGWKPTYYSAMPPFLA

SEQ ID NO: 2158 - protein, 199 aa, Sorghum bicolor
MHGAARKLLMWGSSPVGAAGSDRPDDHDVVIVLASLLCALITVLGIGLVARCACGRGGPRARAAAAANRGVKKSVLRKIPTVPYVAPAPACAAGGGDVESGEPAAEAGEAEAAECAICLAEFEEGESMRVLPQCGHAFHAACIDKWLRGHSSCPSCRRILSLQQLPPGERCRRCGARPQDGDTAGWKPTYYSAMPPFLA

SEQ ID NO: 2159 - protein, 410 aa, Zea mays
MKRRRRRARRAVAAAAMVQQTLGMSLPMAAFVPEHCSANKLARPPGLPPLPQAFVAQQRGDVCMEAADPAAGPRKAHRRSRSDVPFGYFPPAGHHQLPPPKVEAGWGGHLPAGGGDDDLFNAYLNLEGLDGLNSSDDRLDDGDSRGSSMRTNGADSSENESEECAADSRAGIRLCAAAADRREGLKRAAAAPVPRHARSLSMDSLIGKLNFSAGATGAASGVIPGPNRFSLEFGSAEFSPVEMKKIMADEKLAEMALADPKRVKRVLANRQSAARSKERKMRYIGELEHKVQILQTEATTLSAQLTLLQRDSAGIATQNNELKFRLQAMEQQAQLRDALNEALTAEVQRLKLATAELGDSCSSSNLAQQIQISVQDQMFQLHQQQATPIPFYQLQQAQQNGAGKKHEPTE

SEQ ID NO: 2160 - protein, 422 aa, Sorghum bicolor
MMQQALGMSLPMAQFLPDQGSAKLTRPPGLPPTPPQAFAALQRGDVCMEAVVDPAAQQQGPRKAHRRSRSDVPFGYFPPASGGGGHGHHQLPPPKVEAGWGGGHLHGGGGGDEDLFNAYLNLEGLDGLNSSDDRHDDGDSRGSSMKTNGADSSENESDECAADSRAGIRLWSEAAVAAAADRREGLKRTAAGEPAAAPLPRHARSLSMDSLIGKLNFSAGATGAASGVIPGPNMFKLEFGSGEFTPGEMKKIMADDKLAEMALADPKRVKRVLANRQSAARSKERKMRYIAELEQKVQILQTEATTLSAQLTLLQRDSAGIATQNNELKFRLQAMEQQAQLRDALNEALTGELQRLKVATAELGDSCSSNNLAQQIQISVQEQMFQLHQHQQQQQQQATPIPFYQLQQAQQNGAGMKHESKE

SEQ ID NO: 2161 - protein, 426 aa, Oryza sativa Japonica Group
MNGGIGDALMQPQHVQVMSSSLPMVASTFVAEPAAAANKPRAAGLPPTPPQVFAAQRAAAAAGGDVCMEESAQGGGGGLPPRKAHRRSSSDVPFGYLAGQHQLLPPKVEAGWGHLGAGAGGAAAADDLFNAYLNLEGLDGLNSSDDRHDEGDSRGSSIKTNGADSSENESEECADDTRGGIRLWSADGGERREGVKRNAAGEPATAPLARHARSLSMDSLIGKFNFTAGTAAAAGNGVALGPNRFSLEFGSGEFTPSEMKKIMADEKLAEMALADPKRVKRVLANRQSAARSKERKMRYIAELEQKVQILQSEATNLSAQLTMMQRDSAGLATQNNELKFRLHAMEQQAQLRDALNEALTTEVQRLKLATAELGDSCSSSSLAQQIQLNAQNQMFQLQQQQATQIPFYQLQQSQQNGAAKNNESKE

SEQ ID NO: 2162 - protein, 426 aa, Oryza sativa Japonica Group
MNGGIGDALMQPQHVQVMSSSLPMVASTFVAEPAAAANKPRAAGLPPTPPQVFAAQRAAAAAGGDVCMEESAQGGGGGLPPRKAHGRSSSDVPFGYLAGQHQLLPPKVEAGWGHLGAGAGGAAAADDLFNAYLNLEGLDGLNSSDDRHDEGDSRGSSIKTNGADSSENESEECADDTRGGIRLWSADGGERREGVKRNAAGEPATAPLARHARSLSMDSLIGKFNFTAGTAAAAGNGVALGPNRFSLEFGSGEFTPSEMKKIMADEKLAEMALADPKRVKRVLANRQSAARSKERKMRYIAELEQKVQILQSEATNLSAQLTMMQRDSAGLATQNNELKFRLHAMEQQAQLRDALNEALTTEVQRLKLATAELGDSCSSSSLAQQIQLNAQNQMFQLQQQQATQIPFYQLQQSQQNGAAKNNESKE

SEQ ID NO: 2163 - protein, 429 aa, Oryza sativa Indica Group
MNGGIGDALMQPQHVQVMSSSLPMVASTFVAEPAAAAAAANKPRAAGLPPTPPQVFAAQRAAAAAGGDVCMEESAQGGGGGLPPRKAHRRSSSDVPFGYLAGQHQLLPPKVEAGWGHLGAGAGGAAAADDLFNAYLNLDGLDGLNSSDDRHDEGDSRGSSIKTNGADSSENESEECADDTRGGIRLWSADGGERREGVKRNAAGEPATAPLARHARSLSMDSLIGKFNFTAGTAAAAGNGVALGPNRFSLEFGSGEFTPSEMKKIMADEKLAEMALADPKRVKRVLANRQSAARSKERKMRYIAELEQKVQILQSEATNLSAQLTMMQRDSAGLATQNNELKFRLHAMEQQAQLRDALNEALTTEVQRLKLATAELGDSCSSSSLAQQIQLNAQNQMFQLQQQQATQIPFYQLQQSQQNGAAKNNESKE

SEQ ID NO: 2164 - protein, 723 aa, Sorghum bicolor
MATGTAAASASGGPAVHAGADALESGASLLRRRHADGLAVAGADDGDDGGGNAEEEVVASVEQAFEDKPVPSWREQLTVRAFVVGFILSILFSVIVMKLNLTTGIIPSLNVSASLLGFFLVRLWTKAIESMGLLKQPFTRQENTVIQTCVVSAYGLAFSGGFGSYLFGMSRSIAEQATEANDAQNIKDPHLGWMIGFMFLVSFVGLFVLVPLRKVMIVDYKLTYPSGTATAYLINGFHTPQGAERSKKQVRTLGKYFSLSFLWAFFQWFYTAGDDCGFTSFPSLGLEAYKNKFYFDFSATYVGVGMICPYIVNVSLLLGGIISWGVMWPLISTKKGSWYPESLPDSSLHGLNGYKVFITISVILGDGLYNFLKVFGNTIRAFISMYWKKHANTLPVSDNGGPPATTETESFDDKRRIELFVKDQIPKSVALGGYVCLAAITIGCLPLIISQIKWYHILVAYIFAPILAFCNAYGCGLTDWSLASTYGKLAIFVIGAWAGASHGGVLVGLAACGVMMSIVGTASDLMQDFKTGYLTLASPRSMFISQVIGTAIGCVVAPCVFWLFYKSFDIGVSGGAYPAPYAIMYRNMSILGVDGLSLLPKNCLTLCYIFFAVSFAINLIKDLLPQKVAKFIPIPMAAAIPFYLGPYFAIDMFLGSVILFFWEWKNKAEADTFTPAVASGLMCGDGLWALPQAVLSLANVNPPICMKFLSRSVNAKVDTFLGN

SEQ ID NO: 2165 - protein, 714 aa, Zea mays
MATGTAAASASGVGADSLESGAMLLRRRHAGGLAGAGDDDGVGNAEEVAASVEQAFADEPVPSWREQLTVRAFVVGFILAVLFSVIVMKLNLTTGVIPSLNVSASLLGYFLVRLWTKAIESVGLLKHPFTRQENTVIQTCVVSAYGLAFSGGFGSYLFGMSRTIAIQATEANDAQNIKDPQLGWMIGFMFLVSFVGLFVLVPLRKVMIVDYKLTYPSGTATAYLINGFHTPQGAERAKKQVRTLGKYFSLSFLWAFFQWFYTAGDDCGFASFPTLGLEAYKNKFYFDFSATYVGVGMICPYIVNVSLLLGGIISWGLMWPLISTKKGSWYPESLPDSSLHGLNGYKVFITIAVILGDGLYNFLKVFGHTIGALISMYWKKHANRLPVSDNMTPPATVETESFDDKRRIELFVKDQIPKTVALGGYVVLAATSIGCLPLIIPQIKWYQIFVAYIFAPILAFCNAYGSGLTDWSLASTYGKLAIFVIGAWAGASHGGVLVGLAACGVMMSIVGTASDLMQDFKTGYLTLASPRSMFISQVIGTAIGCVTAPCVFWLFYKSFDIGASGGAYPAPYAIMYRNMSILGVDGLSLLPKNCLTLCYIFFAVSFTINLIKDLVPKKVAKFIPIPMAAAIPFYLGPYFAIDMFLGSVILFFWEWKNKAEADSFGPAVASGLMCGDGLWALPQAVLSLANVKPPICMKFLSRSLNAKVDTFLGN

SEQ ID NO: 2166 - protein, 712 aa, Oryza sativa Indica Group
MASAAANNSSSAAYDAAETGGLLRRRNTTAAARGNAGEEEEEAEAVAPSVEQAFADKPVPSWREQLTVRAFVVGFLLSIMFNIIVMKLSLTTGVIPSLNVSASLLGFFLVRLWTAAIERVGFLKQPFTRQENTVIQTCVVSAYGVAFSGGFGSYLFGMSETIAKQATEANDPMNIKNPHLGWIIGFMFLVSFVGLFALVPMRKVMIVDYKLTYPSGTATAYLINGFHTPEGADLAKKQVRTLGKYFSISFLWAFFQWFYTAGDNCGFSSFPTFGLEAFKNRFYFDFSPTYVGVGMICPYIVNVSLLIGGIISWGIMWPLISKKKGSWYPETLPESSLLGLQAYKVFITIAVILGDGLYNFVKVFGYTIKGFIVMYKNKNSNTLPISDNGTPANATEEESFDDKRRNELFLKDQIPKTVAIGGYVVLAVITSGCLPLIIPQLKWYYILIAYIFAPIMAFCNAYGSGLTDWSLATTYGKLAIFVFGAWAGASHGGVLVGLAACGVMMNIVGTASDLMQDFKTGYMTLASPRSMFVSQVIGTAMGCVIAPCVFWLFYKSFDIGASDGAYPAPYTIMYRNMAILGVNGLSSLPKYCLTLCYIAFVAAFIINLIKDLVPERVAKYIPIPMAAAIPFYLGPYFAIDMFMGSVILYFWEWRNKDEAQSFGPAVASGLMCGDGLWALPQAVLSLVNVNPPLCMKFLSRAANAKVDTFLGN

SEQ ID NO: 2167 - protein, 712 aa, Oryza sativa Japonica Group
MASAAANNSSSAAYDAAETGGLLRRRNTTAAARGNAGEEEEEAEAVAPSVEQAFADKPVPSWREQLTVRAFVVGFLLSIMFNIIVMKLSLTTGVIPSLNVSASLLGFFLVRLWTAAIERVGFLKQPFTRQENTVIQTCVVSAYGVAFSGGFGSYLFGMSETIAKQATEANDPMNIKNPHLGWIIGFMFLVSFVGLFALVPMRKVMIVDYKLTYPSGTATAYLINGFHTPEGADLAKKQVRTLGKYFSISFLWAFFQWFYTAGDNCGFSSFPTFGLEAFKNRFYFDFSPTYVGVGMICPYIVNVSLLIGGIISWGIMWPLISKKKGSWYPETLPESSLLGLQAYKVFITIAVILGDGLYNFVKVFGYTIKGFIVMYKNKNSNTLPISDNGTPANATEEESFDDKRRNELFLKDQIPKTVAIGGYVVLAVITSGCLPLIIPQLKWYYILIAYIFAPIMAFCNAYGSGLTDWSLATTYGKLAIFVFGAWAGASHGGVLVGLAACGVMMNIVGTASDLMQDFKTGYMTLASPRSMFVSQVIGTAMGCVIAPCVFWLFYKSFNIGASDGAYPAPYTIMYRNMAILGVNGLSSLPKYCLTLCYIAFVAAFIINLIKDLVPERVAKYIPIPMAAAIPFYLGPYFAIDMFMGSVILYFWEWRNKDEAQSFGPAVASGLMCGDGLWALPQAVLSLVNVNPPLCMKFLSRAANAKVDTFLGN

SEQ ID NO: 2168 - protein, 712 aa, Oryza sativa Japonica Group
MASAAANNSSSAAYDAAETGGLLRRRNTTAAARGNAGEEEEEAEAVAPSVEQAFADKPVPSWREQLTVRAFVVGFLLSIMFNIIVMKLSLTTGVIPSLNVSASLLGFFLVRLWTAAIERVGFLKQPLTRQENTVIQTCVVSAYGVAFSGGFGSYLFGMSETIAKQATEANDPMNIKNPHLGWIIGFMFLVSFVGLFALVPMRKVMIVDYKLTYPSGTATAYLINGFHTPEGADLAKKQVRTLGKYFSISFLWAFFQWFYTAGDNCGFSSFPTFGLEAFKNRFYFDFSPTYVGVGMICPYIVNVSLLIGGIISWGIMWPLISKKKGSWYPETLPESSLLGLQAYKVFITIAVILGDGLYNFVKVFGYTIKGFIVMYKNKNSNTLPISDNGTPANATEEESFDDKRRNELFLKDQIPKTVAIGGYVVLAVITSGCLPLIIPQLKWYYILIAYIFAPIMAFCNAYGSGLTDWSLATTYGKLAIFVFGAWAGASHGGVLVGLAACGVMMNIVGTASDLMQDFKTGYMTLASPRSMFVSQVIGTAMGCVIAPCVFWLFYKSFNIGASDGAYPAPYTIMYRNMAILGVNGLSSLPKYCLTLCYIAFVAAFIINLIKDLVPERVAKYIPIPMAAAIPFYLGPYFAIDMFMGSVILYFWEWRNKDEAQSFGPAVASGLMCGDGLWALPQAVLSLVNVNPPLCMKFLSRAANAKVDTFLGN

SEQ ID NO: 2169 - protein, 717 aa, Oryza sativa Indica Group
MASHANASGGGGDEEMVEASTLRHRHGAGKDANGVGTERQLAAAAAEGEEEGPSSVERAFVDRAVPSWREQLTVRAFVVSFFLSIMFSIIVMKLNLTTGIIPSLNVSAGLLGFFFVRLWTAAIERVGLLRQPFTRQENTVIQTCVVAAYGIAFSGGFGTYLFGMSETIAKQATEANNAQNVKNPHIGWMIGFLFLVSFIGLLALVPLRKIMIVDYKLTYPSGTATAYLINGFHTPEGAKLAKKQVKELGKFFLFSFVWGFFQWFYTAGDGCGFQSFPTLGLQAYKNRFYFDFSPTYVGVGMICPHIVNVSVLLGGILSWGIMWPLIRNKKGSWYAASLSETSLHGLQGYRVFISIALILGDGLYNFVKVLIRTTAGFVVMMKKNSTLPVSNNGSPMVATEAISFDDERRTELFLKDQIPKTVAFGGYVAVAAVSIGTLPQIFPQLKWYYILVAYVFAPVLAFCNAYGAGLTDWSLASTYGKLAIFIFGAWAGASNGGVLVGLAACGVMMSIVSTASDLMQDFKTGYLTLASPRSMFVSQVIGTAMGCVIAPCVFWLFYKAFADIGVSGTEYPAPYAIVYRNMAILGVDGFSSLPKHCLTLCYIFFAAAIAINLARDLAPSKVARFIPLPMAMAIPFYIGSYFAIDMFIGTVILFVWEMVNKAKAEAFAPAVASGLICGDGIWTLPQSILALAKVKPPICMKFLSRSVNAQVDGFLGN

SEQ ID NO: 2170 - protein, 718 aa, Zea mays
MAPHTTAAAGGGGGEEALEEASTLRHRHSAAKDGGEEGQANNGVAAAADDDGEGNALSVERAFADQAVPSWREQLTVRAFVVSFFLAIMFSVIVMKLNLTTGIIPSLNVSAGLLGFFFVRLWTAAIERVGLLRQPFTRQENTVIQTCVVAAYDIAFSGGFGTYLFGMSETIAKQATEADNPQNVKNPHIGWMIGFLFLVSFIGLFALVPLRKVMIVDYKLTYPSGTATAYLINGFHTPEGAKLAKKQVKTLGKFFLMSFLWGFFQWFYTGGDNCGFQNFPTLGLQAYKNKFYFDFSPTYVGVGMICPHIVNVSVLLGGILSWGIMWPLIGNQKGNWYDASLPESSLHGLQGYRVFISIAIILGDGLYNFVKVLIRTTAGFISMMKKNSTLPVSNNGSPITEGVSFDDERRRDLFLKDQIPRSVAYGGYVAVAAISIGTLPQVFPQLKWYYILVAYIFAPVLAFCNAYGTGLTDWSLASTYGKLAIFIFGAWAGASNGGVLVGLAACGVMMSIVSTAADLMQDLKTGYLTLASPRSMFISQVIGTAMGCVIAPCVFWLFYKAFADIGLSGSEYPAPYAIVYRNMAILGVDGFSSLPKNCLTLCYIFFAAAIVVNLVRDLVPKKVARFIPLPMAMAIPFYLGSFFAIDMFIGTVILFAWETINKAKANAFAPAVASGLICGDGIWTLPQSILALAKVKPPICMKFLSRSVNAQVDGFLGS

SEQ ID NO: 2171 - protein, 728 aa, Sorghum bicolor
MAPHTTAAGGGDGGEEEVSEAAAASPAALRHRHAGGKGDGDGDGLGGNGGGAGADGGGQAAASVERVFADKALPSWREQLTLRAFVVSALLAVMFSVIVMKLNLTTGIIPSLNVSAGLLGFFFVRMWTAAVERMGFLRQPFTRQENTVIQTCVVSAYGIAFSGGFGSYLFGMSDKIANQATEAKDANNIKDPHLGWMIGFLFLVSFIGLFALVPLRKIMIVDYKLTYPSGTATAYLINGFHTPEGAKLAKKQVKTLGKYFVFSFFWGLFQWFYTAGDECGFKNFPTLGLEAYNNRFYFDFSPTYVGVGMICPYIVNVSVLLGGILSWGVMWPLIAKKKGSWYPANLEDSSLHGLQAYRVFISIALILGDGLYNFIKVLIRTIAGFISMVQQNSKIMLPVSDNGSSMSSTEAVSFDDERRIEIFLKDQIPKSVAYGGYVAVAAISIGTLPQIFPQLKWYYILVAYVVAPVLAFCNAYGSGLTDWSLASTYGKLAIFVFGAWAGLSQGGVLVGLAACGVMMSIVSTASDLMQDFKTGYLTLASPRSMFISQVIGTGMGCVIGPCVFWLFYKAFGDIGESGTEYPAPYAIVYRNMAILGVDGFRSLPENCLTLCYIFFAAAIVINLVRDLTPQRVSRFIPLPMAMAIPFYIGSYFAIDMFLGCVILFVWEQLNKAKADAFGPAVASGLICGDGIWTLPQSILALAKVQPPICMKFLSRSTNAKVDSFLGLS

SEQ ID NO: 2172 - protein, 716 aa, Oryza sativa Japonica Group
  misc_feature (50)..(50): Xaa can be any naturally occurring amino acid
MASHANASGGGGDEEMVEASTLRHRHGAGKDANGVGTERQLAAAAAEGEXEGPRRWSARSGQGVPSWREQLTVRAFVVSFFLSIMFSIIVMKLNLTTGIIPSLNVSAGLLGFFFVRLWTAAIERVGLLRQPFTRQENTVIQTCVVAAYGIAFSGGFGTYLFGMSETIAKQATEANNAQNVKNPHIGWMIGFLFLVSFIGLLALVPLRKIMIVDYKLTYPSGTATAYLINGFHTPEGAKLAKKQVKELGKFFLFSFVWGFFQWFYTAGDGCGFQSFPTLGLQAYKNRFYFDFSPTYVGVGMICPHIVNVSVLLGGILSWGIMWPLIRNKKGSWYAASLSETSLHGLQGYRVFISIALILGNGLYNFVKVLIRKTAGFVVMMKKNSTLPVSNNGSPMVATEAISFDDERRTELFLKDQIPKTVAFGGYVAVAAVSIGTLPQIFPQLKWYYILVAYVFAPVLAFCNAYGAGLTDWSLASTYGKLAIFIFGAWAGASNGGVLVGLAACGVMMSIVSTASDLMQDFKTGYLTLASPRSMFVSQVIGTAMGCVIAPCVFWLFYKAFADIGVSGTEYPAPYAIVYRNMAILGVDGFSSLPKHCLTLCYIFFAAAIAINLARDLAPSKVARFIPLPMAMAIPFYIGSYFAIDMFIGTVILFVWEMVNKAKAEAFAPAVASGLICGDGIWTLPQSILALAKVKPPICMKFLSRSVNAQVDGFLGN

SEQ ID NO: 2173 - protein, 722 aa, Sorghum bicolor
MAPQTTAAAGGGGEEAVEEASTLRHRPNAAKNGGEEDQANNGVASSQLPLPTAEGEGNAALSVERVFAEQAVPSWREQLTVRAFVVSFFLAVMFSIIVMKLGLTTGIIPSLNVSAGLLGFFFVRLWTAAIERVGLLKQPFTRQENTVIQTCVVAAYDIAFSGGFGTYLFGMSETIAKQATEADDPQNVKNPHIGWMIGFLFLASFIGLFALVPLRKVMIVDYKLTYPSGTATAYLINGFHTPEGAKLAKKQVKTLGKFFLFSFLWGFFQWFYTGGDNCGFQNFPTLGLQAYKNRFYFDFSPTYVGVGMICPHIVNVSVLLGGILSWGIMWPLIRNKKGSWYPASLSESSLHGLQGYRVFISIAIILGDGLYNFVKVLIRTTIRFISMMKKNSTLPVSNNGSPIAEAVSFDDERRTELFLKDQIPRSVAYGGYVVVAAISIGTLPQVFPNLKWYYILVAYIFAPVLAFCNAYGTGLTDWSLASTYGKLAIFIFGAWAGASNGGVLVGLAACGVMMSIVSTAADLMQDFKTGYLTLASPRSMFISQVIGTAMGCVIAPCVFWLFYKAFTDIGMSGSEYPAPYAIVYRNMAILGVDGFSSLPKNCLTLCYIFFAAAIVVNLIRDLVPKKVAGFIPLPMAMAIPFYLGSYFAIDMFIGTVILFAWQMINRAKADAFGPAVASGLICGDGIWTLPQSILALAKVKPPICMKFLSRSVNAQVDGFLGN

SEQ ID NO: 2174 - protein, 633 aa, Sorghum bicolor
MKYMKLGSKPDVFQTEGSNIRFVATELATDIVISIGDVKFYLHKFPLLSKSSRLQRLVASSNEEKNDEVDISDIPGGPSAFEICAKFCYGMIVTLNAYNVLAARCAAEYLEMFETIEKGNLIYKIDVFLTSSVFRTWKDSIIVLQSTKSLLPWCENLKVINHCIDSIASKASIDPSEVEWSYTYNRKKLPSENGIDSHWNGVRKQPMVPSDWWVEDLCELEVDLYKRVIMTVKAKGSTPAVVIGEALRAYAYRRLLGSLEDAVSNGVDCTKRRAALDAILFLLPAEEGSVSCGFLLKLLRAACLLGSGESHRINLIKRIGTQLDGASVSDLLIPPNTDENNTYNIDLIMPIVEEFMLQNSDSGKEKFQDDEEIVEIENVTSVSSTSKLAVAKLIDGYLAEIAKDPNLPLPKLIALAEMVSSLPRPTHDGLYRAIDMYLKEHPGLSKSEKKKLCGLMDCKQLSQDACMHAVQNERLPLRVVVQVLFFEQVRASVASARSDPSSELPSVVRSLLPRENGNSIGSSRSAATTTTEEECGVPTSSDINSLRSMRLANNSGGSERSSGSSDINKNSDDKSTAGKAKGMLMPKKILSKLWSGKTNAGENSSSDTSESPGSVNPEEVKSTQSRITRRSVS

SEQ ID NO: 2175 - protein, 635 aa, Zea mays
MKYMKLGSKPDVLQTEGSNIRFVATDLATDVVILIGDVKFYLHKFPLLSKSSRLQRLVASINEEKNDEVDISDIPGGPSAFEICAKFCYGMIVTLNAYNVLAARCAAEYLEMFETIDKGNLIYKIDVFLTSSVFRTWKDSIIVLQSTRSLVPWCEDLKVISHCIDSIASKASIDPSEVEWSYTYNRKKLPSENGIDSHWNGVRMQPMVPTDWWVEDLCELEVDSYKRVIMSIKAKGSTPAVVVGEALRAYAYRRLLGSLEDAVSNGVDCAKPRAVLDAIVSLLPAEEGSVSCGFLLKLLGAACLLESGESSHRSNLIKRIGAQLDGASVSDLLIIPPNTDENDTYSIDLVMAIVEEFMSLQNSDSGKEKFQDDEEIVETENVASVSSTSKLAVAKLIDGYLAEVAKDPNLPLPKLTALAEMVSSLPRPTHDGLYRAIDMYLKEHPSLSKSEKKKLCGLMDCKQLSHDACMHAVQNERLPLRVVVQVLFFEQVRASVASARSDPSSAELPSAVRSLLPRENGNSVGSSRSAATTTTEEDGCGVPTSSDVNSLRSTRLANNSGGSERSSGSSDINRSAAGRGARGILMPKKMLSKLWSGKTNAGENSSSDTSQSPGSVNNPEEVKSTQSRITRRSVS

SEQ ID NO: 2176 - protein, 643 aa, Zea mays
MKYMKLGSKPDVFQTEGSNIRFVATELATDIVISVGDAKFYLHKFPLLSKSSLLQRLVASSNDEKNDEVDISDIPGGPSAFEICAKFCYGVIVTLNAYNVLAARCAAEYLEMFESIDKGNLIYKIDVFLTSSVFRTWKDSIIVLQSTKSLQPWCENLKVINHCIDCIASKASIDPSEVEWSYTYNRKKLPSENGIDSHWNGVRKQPMVPSDWWVEDLCELEVDLYKRVIMTIKAKGSTPAAVIGEALRAYAYRRLLGSLEDAVSNGVDCTKRRAALDAIVFLLPAEEGSVSCGFLLKLLGAACLLESGESHRVNLIKRIGTQLDGASVPDLLIPLNTNEDNISSIDLIMAIVEEFMSRNGDSGTEKFQDDEGIVDIEKSTSVSSASKLAVAKLIDGYLAEIAKDPNLPLPKLIALAEMVSSLPRPTHDGLYRAIDMYLKEHPSLSKSEKKKLCGLMDCKQLSQDACMHAVQNERLPLRVVVQVLFFEQVRASSSVASARSDANSTSGLPSAVRSLLPRENGNSIGSSRSAATTMTTEEEESGVPTSSDINSLRSMRLANNSGGSERSSGSSDVNNKSSDDRSAAATGKAKGTMLMPKKMLSKLWSGKTNAGESSSSDTSDSPGSANPEEAKSTQSRITWRSVS

SEQ ID NO: 2177 - protein, 634 aa, Oryza sativa Indica Group
MKHMKLGSKPDLFQTEGGNIRFVATELATDIVISIGDVKFCLHKFPLLSKSSCLQRLVASSNVEGNEELDISDIPGGPSAFEICAKFCYGMIVTLNAYNVLAARCAAEYLEMFETIEKGNLIYKIDVFLTSSIFRAWKDSIIVLQSTKSLLPWSENLKVINHCIDSIASKALIDPSEVEWSYTYNRKKLPSENGHDSHWNGVRKQLIVPKDWWVEDLCDLEMDLYKRVIMMIKAKGRTSPIVIGEALRAYAYRRLLGSLEDAVSNGVDCTKRRAVLETIIFLLPTEKGSVSCGFLLKLLKAACLLEAGESCHDILIKRIGTQLDGASVSDLLIPANTSENTLYNVNLIIAIVEEFVSRQSDTGKMKFQDDDEIVEVENLTPVSSTSNLAVANLIDGYLAEIAKDTNLPLSKFIAIAEMVPPASRKNHDGLYRAIDMYLKEHPSLSKSEKKALCRLMDCKKLSQDACLHAVQNERLPLRVVVQVLFFEQIRASAASGRTDAAAELTSAVHSLLPRENGNSYGSSRSAATTTTEEDGTGVPTSSDINSFRSLRLANNSGGSERSSGSSDINNKSCDDKSSSKSKGSLMPKKILSKLWSGKTNASENSSSDTSESPGSLNPEEVKSTTSRNTRRLVT

SEQ ID NO: 2178 - protein, 634 aa, Oryza sativa Japonica Group
MKHMKLGSKPDLFQTEGGNIRFVATELATDIVISIGDVKFCLHKFPLLSKSSCLQRLAASSNVEGNEELDISDIPGGPSAFEICAKFCYGMIVTLNAYNVLAARCAAEYLEMFETIEKGNLIYKIDVFLTSSIFRAWKDSIIVLQSTKSLLPWSENLKVINHCIDSIASKALIDPSEVEWSYTYNRKKLPSENGHDSHWNGVRKQLIVPKDWWVEDLCDLEMDLYKRVIMMIKAKGRTSPIVIGEALRAYAYRRLLGSLEDAVSNGVDCTKRRAVLETIIFLLPTEKGSVSCGFLLKLLKAACLLEAGESCHDILIKRIGTQLDGASVSDLLIPANTSENTLYNVNLIIAIVEEFVSRQSDTGKMKFQDDDEIVEVENLTPVSSTSNLAVANLIDGYLAEIAKDTNLPLSKFIAIAEMVPPASRKNHDGLYRAIDMYLKEHPSLSKSEKKALCRLMDCKKLSQDACLHAVQNERLPLRVVVQVLFFEQIRASAASGRTDAAAELTSAVHSLLPRENGNSYGSSRSAATTTTEEDGTGVPTSSDINSFSSLRLANNSGGSERSSGSSDINNKSCDDKSSSKSKGSLMPKKILSKLWSGKTNASENSSSDTSESPGSLNPEEVKSTTSRNTRRLVT

SEQ ID NO: 2179 - protein, 638 aa, Oryza sativa Japonica Group
MKYMKLGSKPDVFQTEGNNIRFVATELATDIVIIVGEVKFYLHKFPLLSKSSRLQTLVASTNEESNDEIDISDIPGGPAAFEICAKFCYGMIVTLNAYNVLAARCAAEYLEMFETIDKGNLIYKIDVFLSSSIFRTWKDSIIVLQTTKSLLPWSENLKVINHCVDSIATKASIDPSEVEWSYTYNRRKLPSENGLDSHWNGVRKQQMVPRDWWVEDLCDLEMCLYKKVIMAIKAKGRISSEVIGEALRAYAHRRLFSSLESAVSNGLDCTRHSAALETIISLLPSEEGSVPCSFLLKLLRASCLLGSDEACRDNLTKRIGAKLDEASVSDLLIPANSDEAAMYNVDMISAMLEEFMAQHREDDDGAKLQEDDDQEAMDGDDDNLNGVSRSSKLAIAKLVDGYLAEIAKDPNLPLSKFIALTEMVPLATRPVHDGLYRAIDMYLKEHPGLTKGEKKRLCGLMDCKKLSPEASMHAVQNERLPLRVVVQVLFFEQVRAASSASAAAAADMPPAARSLLPREQDGNSYGSSRSTATEDDQWAPPPTTTSVDVTSFRSMSLANNKNGGVSGGGGDQAACKKPQPSSASAKGSGGGGLMPKKILSKLWSGKASSGENSSSDTSESPGEETRSTPSRNTRHSVS

SEQ ID NO: 2180 - protein, 638 aa, Oryza sativa Japonica Group
MKYMKLGSKPDVFQTEGNNIRFVATELATDIVIIVGEVKFYLHKFPLLSKSSRLQTLVASTNEESNDEIDISDIPGGPAAFEICAKFCYGMIVTLNAYNVLAARCAAEYLEMFETIDKGNLIYKIDVFLSSSIFRTWKDSIIVLQTTKSLLPWSENLKVINHCVDSIATKASIDPSEVEWSYTYNRRKLPSENGLDSHWNGVRKQQMVPRDWWVEDLCDLEMCLYKKVIMAIKAKGRISSEVIGEALRAYAHRRLFSSLESAVSNGLDCTRHSAALETIISLLPSEEGSVPCSFLLKLLRASCLLGSDEACRDNLTKRIGAKLDEASVSDLLIPANSDEAAMYNVDMISAMLEEFMAQHREDDDGAKLQEDDDQEAMDGDDDNLNGVSRSSKLAIAKLVDGYLAEIAKDPNLPLSKFIALTEMVPLATRPVHDGLYRAIDMYLKEHPGLTKGEKKRLCGLMDCKKLSPEASMHAVQNERLPLRVVVQVLFFEQVRAASSASAAAAADMPPAARSLLPREQDGNSYGSSRSTATEDDQWAPPPTTTSVDVTSFRSMSLANNKNGGVSGGGGDQAACKKPPPSSASAKGSGGGGLMPKKILSKLWSGKASSGENSSSDTSESPGEETRSTPSRNTRHSVS

SEQ ID NO: 2181 - protein, 638 aa, Oryza sativa Indica Group
MKYMKLGSKPDVFQTEGNNIRFVATELATDIVIIVGEVKFYLHKFPLLSKSSRLQTLVASTNEESNDEIDISDIPGGPAAFEICAKFCYGMIVTLNAYNVLAARCAAEYLEMFETIDKGNLIYKIDVFLSSSIFRTWKDSIIVLQTTKSLLPWSENLKVINHCVDSIATKASIDPSEVEWSYTYNRRKLPSENGLDSHWNGVRKQQMVPRDWWVEDLCDLEMCLYKKVIMAIKAKGRISSEVIGEALRAYAHRRLFSSLESAVSNGLDCTRHSAALETIISLLPSEEGSVPCSFLLKLLRASCLLGSDEACRDNLTKRIGAKLDEASVSDLLIPANSDEAAMYNVDMISAMLEEFMAQHREDDDGAKLQEDDDQEAMDGDDDNLNGVSRSSKLAIAKLVDGYLAEIAKDPNLPLSKFIALTEMVPLATRPVHDGLYRAIDMYLKEHPGLTKGEKKRLCGLMDCKKLSPEASMHAVQNERLPLRVVVQVLFFEQVRAASSASAAAAVDMPPAARSLLPREQDGNSYGSSRSTATEDDQWAPPPTTTSVDVTSFRSMSLANNKNGGVSGGGGDQAACKKPPPSSASAKGSGGGGLMPKKILSKLWSGKASSGENSSSDTSESPGEETRSTPSRNTRHSVS

SEQ ID NO: 2182 - protein, 630 aa, Hordeum vulgare subsp. vulgare
MKYMKLGAKPDVFQTEGNIRFVATELATDIVITVGDVKFYLHKFPLLSKSSRLQTLVASTDEEGNDEVDISDIPGGPSSFEICAKFCYGMTVTLNAYNVLAARCAAEFLEMFETIDKGNLIYKIDVFLSSSIFRTWKDSIIVLQTTKSLLPWSENLKVINHCVDSIAAKASIDPSEVDWSYTYNRKKLPSESDPDSHWNGVRKQLTVPRDWWVEDICDLEMSLYKKVILAIKAKGRTAGAVVGEALRAYAYRRLFSTLDSAASNGLDCTRHRAALDTIISLLPPERGSVSCGFLLKLVRAACLLGSDEALRGDLIKRIGSQLDRASVSDLLIPASSDENALYNVDLVSSILDEFMVQRNADEEALEDGESYPASLVSGGESELALVRLIDGYLAEIGKDPNLPLQKFIAIAEMAPLAARSTHDGLYRAIDMYLKEHPSLSKSEKKRLCGLMDCKKLTAEASSHAVQNERLPLRLVVQVLFFEQLRASAAADAAASDQHPSSALRSLLPRENGNSYGSSRSAATTATTTEDDQWGGGGGGAPASGDTSSFRSMSGLGNNKSGGDGGKNGGGKAAAKGPLQMPRKMLSKLWSSKASSGENSGGSDTSESPGSVNLDAETKSTHSRNTRHSVS

SEQ ID NO: 2183 - protein, 718 aa, Zea mays; identical to SEQ ID NO: 2170

SEQ ID NO: 2184 - protein, 722 aa, Sorghum bicolor; identical to SEQ ID NO: 2173

SEQ ID NO: 2185 - protein, 717 aa, Oryza sativa Indica Group; identical to SEQ ID NO: 2169

SEQ ID NO: 2186 - protein, 716 aa, Oryza sativa Japonica Group; identical to SEQ ID NO: 2172
  misc_feature (50)..(50): Xaa can be any naturally occurring amino acid

SEQ ID NO: 2187 - protein, 728 aa, Sorghum bicolor; identical to SEQ ID NO: 2171

SEQ ID NO: 2188 - protein, 727 aa, Oryza sativa Japonica Group
MAQHSAAAAGGDEEVAEAEAAAAAAAGSTLRHRHAGKGAEEHEAAGRGRGGRNGGADDPDATSVERVFADKAVPSWREQLTLRAFVVSALLAVMFSVIVMKLNLTTGIIPSLNVSAGLLGFFFVRLWTSAVERIGLLKQPFTRQENTVIQTCVVSAYGIAFSGGFGSYLFGMSETIAKQATEAKDAQNIKDPHLGWMIGFLFLVSFIGLFALVPLRKIMIVDYKLTYPSGTATAYLINGFHTPEGAKLAKKQVKTLGKYFLFSFFWGFFQWFYTAGDDCGFKNFPTLGLEAYNNRFFFDFSPTYVGVGMICPYIVNVSVLLGGILSWGVMWPLIAKKKGSWYPADISDNSLHGLQAYRVFISIALILGDGLYNFLKVLIRTIAGFISMVQNNSKGMLPVSDNGMSMSTAEEVSFDDERRTEIFLKDQIPKSVAYGGYVVVAALSIGTLPEIFPQLKWYYILVAYIVAPVLAFCNAYGSGLTDWSLASTYGKLAIFVFGAWAGLSHGGVLVGLAACGVMMSIVSTASDLMQDFKTGYLTLASPRSMFISQVIGTGMGCVIAPCVFWLFYKAFSNIGTSGTEYPAPYAIVYRNMAILGVDGFNSLPENCLTLCYIFFAAAIAINLIRDLAPHKVSRFIPLPMAMAIPFYIGSYFAIDMFLGSVILFVWEKLNKAKADAFGPAVASGLICGDGIWTLPQSILALAKVKPPICMKFLSRAANAKVDSFLAG

SEQ ID NO: 2189 - protein, 727 aa, Oryza sativa Japonica Group
MAQHTAAAAGGDEEVAEAEAAAAAAAGSTLRHRHAGKGAEEHEAAGGGGGGRNGGADDPDATSVERVFADKAVPSWREQLTLRAFVVSALLAVMFSVIVMKLNLTTGIIPSLNVSAGLLGFFFVRLWTSAVERIGLLKQPFTRQENTVIQTCVVSAYGIAFSGGFGSYLFGMSETIAKQATEAKDAQNIKDPHLGWMIGFLFLVSFIGLFALVPLRKIMIVDYKLTYPSGTATAYLINGFHTPEGAKLAKKQVKTLGKYFLFSFFWGFFQWFYTAGDDCGFKNFPTLGLEAYNNRFFFDFSPTYVGVGMICPYIVNVSVLLGGILSWGVMWPLIAKKKGSWYPADISDNSLHGLQAYRVFISIALILGDGLYNFLKVLIRTIAGFISMVQNNSKGMLPVSDNGMSMSTAEEVSFDDERRTEIFLKDQIPKSVAYGGYVVVAALSIGTLPEIFPQLKWYYILVAYIVAPVLAFCNAYGSGLTDWSLASTYGKLAIFVFGAWAGLSHGGVLVGLAACGVMMSIVSTASDLMQDFKTGYLTLASPRSMFISQVIGTGMGCVIAPCVFWLFYKAFSNIGTSGTEYPAPYAIVYRNMAILGVDGFNSLPENCLTLCYIFFAAAIAINLIRDLAPHKVSRFIPLPMAMAIPFYIGSYFAIDMFLGSVILFVWEKLNKAKADAFGPAVASGLICGDGIWTLPQSILALAKVKPPICMKFLSRAANAKVDSFLAG

SEQ ID NO: 2190 - protein, 711 aa, Hordeum vulgare subsp. vulgare
MATRTTHGAAGDDDVAEAAGTTGPTLRHRHAGKGAEEAGNGGASPEDASVEQVFADKAVPSWREQLTLRALVVSALLAVMFSVIVMKLNLTTGIIPSLNVSAGLLGFFFVRLWTSAFERMGLIGQPFTRQENTVIQTCVVSAYGIAFSGGFGSYLFGMSDTIAKQATEANDAWNIKEPHLGWMIGFLFLVSFIGIFALVPMRKIMIVDYKLTYPSGTATAYLINGFHTPEGAKLAKKQVKILGRYFMVSFFWGFFQWFFSGGDDCGFKNFPTLGLEAYKNRFYFDFSPTYIGVGMICPHIVNVSVILGGIISWGIMWPLIGKKKGSWYPASLPESSLHGLQAYRVFISIALILGDGLYNFVKVLIRTIAGFISMVQKNSKAMLPVSDNGSPTAEAMSFDDERRTELFLKDQIPMAVAYGGYAAVASISIGTLPQIFPQLKWYYILVAYVVAPVLAFCNAYGNGLTDWSLASTYGKLAIFVFGAWAGLANGGVLVGLAACGVMMSIVSTASDLMQDFKTGYLTLASPKSMFISQVIGTSMGCVISPCVFWLFYKAFSDIGTSGTEYPAPYAIVYRNMAILGVDGFNTLPANCMTLCYIFFAAAIAINLIRDLTPHKFSRFIPLPMAMAIPFYIGSYFAIDMFLGSFILFVWEKVNKAKADAFGPAVASGLICGDGIWTLPQSILALAKVNPPICMKFLTRGDNVKVDKFLGG

SEQ ID NO: 2191 - protein, 711 aa, Hordeum vulgare subsp. vulgare
MATRTTHGAAGDDDVAEAAGTTGPTLRHRHAGKGAEEAGNGGASPEDASVEQVFADKAVPSWREQLTLRALVVSALLAVMFSVIVMKLNLTTGIIPSLNVSAGLLGFFFVRLWTSAFERMGLIGQPFTRQENTVIQTCVVSAYGIAFSGGFGSYLFGMSDTIAKQATEANDAWNIKEPHLGWMIGFLFLVSFIGIFALVPMRKIMIVDYKLTYPSGTATAYLINGFHTPEGAKLAKKQVKILGRYFMVSFFWGFFQWFFSGGDDCGFKNFPTLGLEAYKNRFYFDFSPTYIGVGMICPHIVNVSVILGGIISWGIMWPLIGKKKGSWYPASLPESSLHGLQAYRVFISIALILGDGLYNFVKVLIRTIAGFISMVQKNSKAMLPVSDNGSPTAEAMSFDDERRTELFLKDQIPMAVAYGGYAVVASISIGTLPQIFPQLKWYYILVAYVVAPVLAFCNAYGSGLTDWSLASTYGKLAIFVFGAWAGLANGGVLVGLAACGVMMSIVSTASDLMQDFKTGYLTLASPKSMFISQVIGTSMGCVISPCVFWLFYKAFSDIGTSGTEYPAPYAIVYRNMAILGVDGFNTLPANCMTLCYIFFAAAIAINLIRDLTPHKFSRFIPLPMAMAIPFYIGSYFAIDMFLGSFILFVWEKVNKAKADAFGPAVASGLICGDGIWTLPQSILALAKVNPPICMKFLTRGDNVKVDKFLGG

SEQ ID NO: 2192 - protein, 716 aa, Zea mays
MAPHTTAGGGGGAEDEVSEAAAASPALRHRHAGKGEGLGGNGGAGADGQASVERVFADKAVPSWREQLTLRAFVVSALLAVMFSVIVMKLNLTTGIIPSLNVSAGLLGFFFVRMWTAAAERMGFLRQPFTRQENTVIQTCVVSAYGIAFSGGFGSYLFGMSDKIAKQATEAKDANNIKDPHLGWMIGFLFLVSFIGLFALVPLRKIMIVDYKLTYPSGTATAYLINGFHTPEGAKLAKKQVKTLGKYFVFSFFWGFFQWFYTAGDECGFKNFPTLGLEAYNNRFFFDFSPTYVGVGMICPYIVNVSVLLGGILSWGLMWPLIAKKKGSWYPANLEDSSLHGLQAYRVFISIALILGDGLYNFIKVLIRTIAGFISMVQQNSKSMLPVSDNGSSMSSMEAVSFDDERRIENFLKDQIPKSVAYGGYVAVAAISIGTLPQIFPQLKWYYILVAYVVAPVLAFCNAYGSGLTDWSLASTYGKLAIFVFGAWAGLSHGGVLVGLAACGVMMSIVSTASDLMQDFKTGYLTLASPRSMFISQVIGTGMGCVIGPCIFWLFYKAFGDIGESGTEYPAPYAIVYRNMAILGVDGFGSLPKNCLTLCYIFFAAAITINLVRDLTPYKVSRFIPLPMAMAIPFYIGSYFAIDMFLGSAILFVWERLNKAKADAFGPAVASGLICGDGIWTLPQSILALAKVQPPICMKFLSRSTNAKVDSFLGLS

SEQ ID NO: 2193 - protein, 527 aa, Sorghum bicolor
MHSTNLLLEEPIRMASILEPSKPSFFPAMTKIVGTLGPKSRSVDTISACLKAGMSVARFDFSWGDAAYHQETLENLKLAIKSTKKLCAVMLDTVGPELQVVNKKETTISLEENGTVVLTPHRGQEASSSLLPINFSGLAKAVTPGATIFVGQYLFTGSETTSVWLEVSEVKGDDVVCIIKNTATLAGSLFTLHCSQIHIDLPTLSDEDKDVIRKWGTPNKIDFLSLSYTRHAEDVRQAREFLSKLGDLSQTLIFAKIENVEGLNHFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKRTVKYVGEPMTHLESIASSAVRAAIKVKASVIICFTSSGRAARLIAKYRPSMPVLSVVIPRLKTNQLKWSFTGAFEARQSLIVRGLFPMLADPRHPAESTNSTNESVLKVALDHGKASGVIKSHDRVVVCQKVGDSSVVKIIELDD

SEQ ID NO: 2194 - protein, 527 aa, Zea mays
MHSTNLLLEEPIRMASILEPSKPSYFPAMTKIVGTLGPKSRSVDTISACLKAGMSVARFDFSWGDAAYHQETLENLKLSIKSTKKLCAVMLDTVGPELQVVNKSETPISLEENGTVVLTPHRGQDASSSLLPINFSGLAKAVTPGATIFVGQYLFTGSETTSVWLEVSEVKGDDVVCIIKNTATLAGSLFTLHCSQIHIDLPTLSDEDKDVIRKWGTPNKIDFLSLSYTRHAEDVRQAREFLSKLGDLSQTLIFAKIENVEGLNQFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKQTVKYVGEPMTHLESIASSAVRAAIKVKASVIICFTSSGRAARLIAKYRPTMPVLSVVIPRLKTNQLRWSFTGAFEARQSLIVRGLFPMLADPRHPAESTSNTNESVLKVALDHGKACGVIKSHDRVVVCQKVGDSSVVKIIELDD

SEQ ID NO: 2195 - protein, 527 aa, Zea mays
MHSTNLLLEEPIRMASILEPSKTSFFPAMTKIVGTLGPKSRSVDTISSCLKAGMSVARFDFSWGDAAYHQETLENLKLAIKSTKKLCAVMLDTVGPELQVVNKSETPISLEENGTVVLTPHQGQEASSTLLPINFDGLAKALTPGATIFVGQYLFTGSETTSVWLEVSEVKGDDVVCIIKNTATLAGSLFTLHCSQIHIDLPTLSDEDKDVIKKWGAPNKIDFLSLSYTRHAEDVRQAREFLSKLGDLSQTQIFAKIENVEGLNHFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYYKRTVKYVGEPMTHLESIASSAVRAAIKVKASVIICFTSSGRAARLIAKYRPSMPVLSVVIPRLKTNQLKWSFTGAFEARQSLIVRGLFPMLADPRHPAESTSATNESVLKVALDHGKASGVIKSHDRVVVCQKVGDSSVVKIIELDD

SEQ ID NO: 2196 - protein, 527 aa, Hordeum vulgare subsp. vulgare
MHSTNLLLEEPIRMVSILEPSKPNFFPAMTKIVGTLGPKSRSVEAISACLKAGMSVARFDFSWGDAAYHQETLENLKIAIKATKKLCAVMLDTVGPELQVVNKSEVTISLEENESVVLTPHKGQEASSKLLPINFSGLAKAVKPGATIFVGQYLFTGSETTSVWLEVSEVQGDDVVCVIKNSATLAGSLFTLHCSQIHIDMPTLSDEDKDVMKKWGAPNKIDFLSLSYTRHAEDVRQAREFLSKLGDLSQTLIFAKIENVEGLNHFDEILEEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKRTVKYVGEPMTHLESIASSAVRAAIKVKASVIICFTSSGRAARLIAKYRPTMPVLSVVIPRLKTNQLKWSFTGAFEARQSLIVRGLFPMLADPRHPAESTSTTNESVLKVALDHGKASGVIKSHDRVVVCQKVGDSSVVKIIELDD

SEQ ID NO: 2197 - protein, 527 aa, Hordeum vulgare subsp. vulgare
MHSTNLLLEEPIRMVSILEPSKPNFFPAMTKIVGTLGPKSRSVEAISACLKAGMSVARFDFSWGDAAYHQETLENLKIAIKATKKLCAVMLDTVGPELQVVNKSEVTISLEENESVVLTPHKGQEASSKLLPINFSGLAKAVKPGATIFVGQYLFTGSETTSVWLEVSEVQGDDVVCVIKNSATLAGSLFTLHCSQIHIDMPTLSDEDKDVMKKWGAPNKIDFLFLSYTRHAEDVRQAREFLSKLGDLSQTLIFAKIENVEGLNHFDEILEEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKRTVKYVGEPMTHLESIASSAVRAAIKVKASVIICFTSSGRAARLIAKYRPTMPVLSVVIPRLKTNQLKWSFTGAFEARQSLIVRGLFPMLADPRHPAESTSTTNESVLKVALDHGKASGVIKSHDRVVVCQKVGDSSVVKIIELDD

SEQ ID NO: 2198 - protein, 527 aa, Oryza sativa Japonica Group
MHSTNLLLEEPIRMASILEPSKPSFFPAMTKIVGTLGPKSRAVDTISSCLKAGMSVARFDFSWGDAEYHQETLENLKLAIKSTKKLCAVMLDTVGPELQVVNKSEAAISLEANGTVVLTPDQGQEASSELLPINFSGLAKALKPGATIFVGQYLFTGSETTSVWLEVSEVKGDDVVCVIKNSATLAGSLFTLHCSQIHIDLPTLSDEDKEVIRRWGAPNKIDFLSLSYTRHAEDVRQAREFLSKLGDLSQTQIFAKIENVEGLNHFDEILQEADGIILSRGNLGIDLPPEKVFLFQKSALHKCNMAGKPAVVTRVVDSMTDNLRPTRAEATDVANAVLDGSDAILLGAETLRGLYPVETISIVGKICAEAEKVFNQDLYFKRTVKYVGEPMTHLESIASSAVRAAIKVKASVIICFTSSGRAARLIAKYRPTMPVLSVVIPRLKTNQLRWSFTGAFEARQSLIVRGLFPMLADPRHPAESTSATNESVLKVALDHGKASGVIKSHDRVVVCQKVGDSSVVKIIELDD

SEQ ID NO: 2199 - protein, 527 aa, Oryza sativa Japonica Group
MHSTNLLLEEPIRMASILEPSKPSFFPAMTKIVGTLGPKSRSVDTISSCLKAGMSVARFDFSWGDAEYHQETLENLKVAIKSTKKLCAVMLDTVGPELQVVNKSEASISLEENGTVILTPDQGQEASSQVLPINFAGLAKAVKPGDTIFVGQYLFTGSETTSVWLEVSQIKGDDVVCVIKNTATLAGSLFTLHCSQIHIDLPTLSDEDKEVIRKWGAPNKIDFLSLSYTRHVEDVRQAREFLSKLGDLSQTQIFAKIENVEGLNNFDEILQEADGIILSRGNLGIDLPPEKVFLFQKSALHKCNMAGKPAVVTRVVDSMTDNLRPTRAEATDVANAVLDGSDAILLGAETLRGLYPVETISIVGKICAEAEKVFNQDLYFKRTVKHVGEPMTHLESIASSAVRAAIKVKASVIICFTSSGRAARLIAKYRPTMPVLSVVIPRLKTNQLRWSFTGAFEARQSLIVRGLFPMLADPRHPAESTNATNESVLKVALDHGKVSGVIKSHDRVVVCQKVGDSSVVKIIELDD

SEQ ID NO: 2200 - protein, 527 aa, Vitis vinifera
MHANHLLLEEPIRMASILEPSKASFFPAMTKIVGTLGPKSRSVEVISGCLKVGMSVARFDFSWGDPDYHQETLENLKAAVKSTKKLCAVMLDTVGAELQVVNKCEKSISLLADGFVVLTPYQDQEASSELLPINFNGLAKAVKKGDTIFVGQYLFTGSETTSVWLEVSEVKGDDVVCMIKNSATLAGSLFTLHVSQIHIDLPTLSDKDKEVISTWGVKNKIDFLSLSYTRHAEDVRHARDHLSKLGDLHQTQIFAKIENVEGLNHFDEILQEADGIILSRGNLGIDLPPEKVFLFQKAAVYKCNMAGKPAVITRVVDSMTDNLRPTRAEATDVANAVLDGSDAILLGAETLRGLYPVETISIVGKICAEAEKVFNQDLYFKKTVKYVGEPMTHLESIASSAVRAAIKVKASVIICFTSSGRAARLIAKYRPTMPVLSVVIPRLKTNQLKWSFSGAFEARQSLIVRGLFPMLADPRHPAESTSATNESVLKVALDHGKASGVIKSHDRVVVCQKVGDASVVKIIELED

SEQ ID NO: 2201 - protein, 491 aa, Deschampsia antarctica
GPKSRSVEAISACLKAGMSVARFDFSWGDAAYHQETLENLKLAIKATKKLCAVMLGTVGPELQVVNKSEVTISLEENESVVLTPHQGQEASSKLLPINFSGLAKALKPGDTIFVGQYLFTGSETTSVWLEVSEVQGDDVVCVIKNSATLAGSLFTLHCSQIHIDLPTLSDEDKDVIKKWGAPNKIDFLSLSYTRHAEDVRQAREYLSKLGDLSQTLIFAKIENVEGLNHFDEILEEADGIFLSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKRTVKYVGEPMTHLESIASSAVRAAIKVKASVIICFTSSGRAARLIAKYRPTMPVLSVVIPRLKTNQLKWSFTGAFEARQSLIVRGLFPMLADPRHPAESTSTTNESVLKVALDHGKTSGVIKSHDRVVVCQKVGDSSVVKIIELDD

SEQ ID NO: 2202 - protein, 529 aa, Medicago truncatula
MPSSHLLLEEPIRMASILEPSKASFFSAMTKIVGTLGPKSRSVETISGCLKAGMSVARFDFSWCDPEYHQETLENLKTAIKGTKKLCAVMLDTVGAEMQVVNKSETTISLEIDAQVVLTPNQGQEASSEILPINFDGLAQAVKTGDTIFIGQYLFTGSETTSVWLEVSEVKGNDVVCIIKNSATLTGSLFTLHASQIHIDLPTLTEKDKEVISTWGVKNKIDFLSLSYTRHAKDVREARDFLSKLGDLSQTQIFAKIENVEGLTHFDEILQEADGIILSRGNLGIDLPPEKVFLFQKSALHKCNMAGKPAVLTRVVDSMTDNLRPTRAEATDVANAVLDGSDAILLGAETLRGLYPVETISTVGRICSEAEKVFNQDLYFKRTVKYVGEPMTHLESIASSAVRAAIKVKASIIICFTSSGRAARLIAKYRPTMPVLSVVIPRLKTNQLKWSFSGAFEARQSLIVRGLFPMLADPRHPAESETTTASNESILKVALDHGKALGVIKSHDRVVVCQKLGDASVVKIIELED

SEQ ID NO: 2203 - protein, 343 aa, Oryza sativa Japonica Group
MEQHQGQAGMDLPPGFRFHPTDEELITHYLAKKVADARFAALAVAEADLNKCEPWDLPSLAKMGEKEWYFFCLKDRKYPTGLRTNRATESGYWKATGKDKDIFRRKALVGMKKTLVFYTGRAPKGEKSGWVMHEYRLHGKLHAAALGFLHGKPASSKNEWVLCRVFKKSLVEVGAAGGKKAAVVTMEMARGGSTSSSVADEIAMSSVVLPPLMDMSGAGAGAVDPATTAHVTCFSNALEGQFFNPTAVHGHGGGDSSPFMASFTQYGQLHHGVSLVQLLESCNGYGGLVDMAASGSQLQPAACGGERERLSASQDTGLTSDVNPEISSSSGQKFDHEAALWGY

SEQ ID NO: 2204 - protein, 334 aa, Oryza sativa
MDLPPGFRFHPTDEELITHYLAKKVADARFAALAVAEADLNKCEPWDLPSLAKMGEKEWYFFCLKDRKYPTGLRTNRATESGYWKATGKDKDIFRRKALVGMKKTLVFYTGRAPKGEKSGWVMHEYRLHGKLHAAALGFLHGKPASSKNEWVLCRVFKKSLVEVGAAGGKKAAVVTMEMARGGSTSSSVADEIAMSSVVLPPLMDMSGAGAGAVDPATTAHVTCFSNALEGQFFNPTAVHGHGGGDSSPFMASFTQYGQLHHGVSLVQLLESCNGYGGLVDMAASGSQLQPAACGGERERLSASQDTGLTSDVNPEISSSSGQKFDHEAALWGY

SEQ ID NO: 2205 - protein, 356 aa, Sorghum bicolor
MEQELHRPMELPPGFRFHPTDEELITHYLARKVADARFAALAVGEADLNKCEPWDLPSLAKMGEKEWYFFCLKDRKYPTGLRTNRATEAGYWKATGKDKDIFRGNGGKVLVGSKKTLVFYTGRAPKGEKSGWVMHEYRLHGKLHGAIVPPKAAAGSKNEWVLCRVFKKSLVVGGAAAAAPAAGKRGAMEMSKMNDDMAAISHLPPLMDVSGAGANVNPAAAAHVTCFSDALEGHQFFNQQQTPPEADATDHLGLAASSPFLLSGFAHYGPLHHGATSLVQLLEGSVVYAAAGGGGLPDMSNKQQQQPVPAPPCKVGGERERLSLSQDTGLTSDVNPEISSSSGAQRFDHDHLCWGY

SEQ ID NO: 2206 - protein, 566 aa, Zea mays
MERYSDMRPKAEVSYLGRGSRFSSRNQSSEERTNHSSDKPGSSTRFNPTKARIGGNQGRPRYVCDSFKSPSSKVSPAGSSKFPLSKFEERRRQPFVPGFDIAESSRRKADAKQLQGSKKIAAENDSSDNLRGESEGFTTEQVVKPEGSHVVGHSGVSAYTVGSLVQTASLGSRTHRQKHKEVNLGTPGASSSTLTNRSTIPGNSTMGVRPAYGHVNGGQIHGLKNLGCSSVPDAQPSGCPSESVISRRRFEFMRKRAFDQESSSRSVNLSLGHSTPTDIRRIRMNEQSLCQQIPRSSSRSHQESAGSVRTRRPSPHATRMSVPDGRADGVLSLHESSTKDVQPAQEHLSLEEVSTESSIRPFFVEFDNNIFSSSHLRRSSTRAERGRPSSLFEESPRQMFHSLMGERDRHRHITMEGITEVLAALERIEQQAELTYDQLLMLEANLFFGAFASYDRHRDMRMDIDDMSYEELLALEERIGSVSTALSEEQFTKCLKRSIYSQVALEVNKSTVDDMKCIICQEEYAEGEEVGRLPCEHRYHVCCIGQWLGQKNWCPVCKASAVPSKG

SEQ ID NO: 2207 - protein, 518 aa, Sorghum bicolor
MEEYSDRGSKAEIAYLRRGSRFSSRNQSSEERTNNHSSDKPGSSTRFNPMKARIGDNQERPRYVRDSFKSSSSKVAPASSSKFPLSKFEERRRQPFLPGFDNAGSSRRKVDAKRLVGSKKIAVDNESSDTLQGESEGFTTEQVPYPEGSHFTGHSGVSSYTVKSLVQTASLSSRTQRQKHKEVNMGTPGACSSSLTNGSSIPGNSTMGVRPAYGHVSGGQVRGLKNLGCTSVPDAQPSGCPSESVSSRRFEFMRKRAFDQENSSRSRSLSLGLSPPTDIHNTGHRIRMNEQSLSQQIPQRSSRNHQEPAVSVRTRRPSPHATRMSVPDERADGMLSLHESPTRNVQPAQEHLSLEEVSTESSIRPFFVEFDNNIFSSSRRRCSNTRAERQLLVLETNLFFGAFASYDRHRDMRMDIDNMSYEELLALEERIGSVSTALSEEQFTKCLRRSIYSQVASEVSKSTVDDMKCSICQEEYMEGEEVGRLPCEHWYHVCCIGQWLRQKNWCPVCKASAVPSKG

SEQ ID NO: 2208 - protein, 123 aa, Agrostis stolonifera
MIQPQTLLNVADNSGARKLMCIRVIGAAGNQRYARIGDVIVAVIKDALPQMPLERSEVIRAVIVRTCKEFKCEDGIIIRYDDNAAVIIDQKGNPKGTRVFGAIAEELRELNFTKIVSLAPEVL

SEQ ID NO: 2209 - protein, 123 aa, Festuca arundinacea
MIQPQTLLNVADNSGARKLMCIRVIGAAGNQRYARMGDVIVAVIKDALPQMPLERSEVIRAVIVRTCKEFKCEDGIIIRYDDNAAVIIDQKGNPKGTRVFGAIAEELRELNFTKIVSLAPEVL

SEQ ID NO: 2210 - protein, 123 aa, Triticum aestivum
MIQPQTLLNVADNSGARKLMCIRVIGAAGNQRYARIGDVIVAVIKDALPQMPLERSEVIRAVIVRTCKEFKCEDGIIIRYDDNAAVIIDQKGNPKGTRVFGAIAEELRGLNFTKIVSLAPEVL

SEQ ID NO: 2211 - protein, 123 aa, Oryza sativa Japonica Group
MIQPQTLLNVADNSGARKLMCIRVIGAASNQRYARIGDVIVAVIKDAVPQMPLERSEVIRAVIVRTCKEFKCEDGIIIRYDDNAAVIIDQKGNPKGTRVFGAIAEELRELNFTKIVSLAPEVL

SEQ ID NO: 2212 - protein, 123 aa, Brachypodium distachyon
MIQPQTLLNVADNSGARKLMCIRVIGTAGNQRYARIGDVIVAVIKDAVPQMPLERSEVIRAVIVRTCKEFKCEDGIIIRYDDNAAVIIDQKGNPKGTRVFGAITEELRELNFTKIVSLAPEVL

SEQ ID NO: 2213 - protein, 122 aa, Phyllostachys edulis
MIQPQTLLNVADNSGARKLMCIRVIGAASNQRYARIGDVIVAVIKDAVPQMPLERSEVIRAVIVRTCKEFKCEDGIIIRYDDNAAVIIDQKGNPKGTRVFGAIAEELRELNFTKIVSLAPEV

SEQ ID NO: 2214 - protein, 123 aa, Oryza sativa Japonica Group
MIQPQTLLNVADNSGAQKLMCIRVIGAASNQRYARIGDVIVAVIKDAVPQMPLERSEVIRAVIVRTCKEFKCEDGIIIRYDDNAAVIIDQKGNPKGTRVFGAIAEELRELNFTKIVSLAPEVL

SEQ ID NO: 2215 - protein, 123 aa, Anomochloa marantoidea
MIQPQTLLNVADNSGARKLMCIRVIGAAGNQRYARIGDVIVAVIKDALPKMPLEKSEIVRAVIVRTCKEFKCEDGIIIRYDDNAAVIIDQKGNPKGTRVFGAIAEELRELHFNKIVSLAPEVL

SEQ ID NO: 2216 - protein, 123 aa, Oryza sativa Japonica Group
MIQPQTLLNVADNTGARKLMCIRVIGAASSQRYARIGDVIVAVIKDVVPQMPLERSEVIRAVIVRTCKEFKCEDGIIIRYDDNAAVIIDQKGNPKGTRVFGAIAEELRELNFTKIVSLAPEVL

SEQ ID NO: 2217 - protein, 123 aa, Oryza sativa Japonica Group
MIQPQTLLNVADNSGARKLMCIRVIGAASNQQYARIGDVIVAVIKDAVPQMPLERSQVIRAVIVRTCKEFKCEDGIIIRYDDNAAVIIDQKGNPKGTRVFGTIVEELRELNFTKLVSLAPEVL

SEQ ID NO: 2218 - protein, 432 aa, Sorghum bicolor
MATCRESGGLVAVRCAGRIGVVASVAMNLAWIAMYIRRRYFGAGGGGSDNNGRGVTTVEPSKGKPPVTEDSIVNLDHGDPTMYEEFWRGTGDSASIFIPGWQTMSYFSDLGGICWFVEPGFEREVRRLHRLVGNAMVDGYHVLVGTGSTQLFQAVLYALSPASDGTPMNVVSPAPYYSSYPSVTNFLNSGLYRWGGDANTFDGDTCIELVCSPNNPDGSIRKAVIKSKSSKAVYDFAYYWPQYAPITEAAGHDIMLFTVSKCTGHAGTRLGWALVKDTEVAQKMIKFIELNTIGVSKDSQLRAAKIIGAICNGYELSSAGKTSHLFHFAKEKMAERWIRLRAAVAASDIFTLPNELSGYCSFSKEAVTANPPFAWLRCKKDDIEDLEGFLRGKKIITRGGTKFGVDGRVVRVSMVDTDQAFNVFINRLATMK

SEQ ID NO: 2219 - protein, 431 aa, Zea mays
MAGRESGGMAAALRCAGRIGILATVAVNLAWIATYIRRRYFGGGNRSDNNGGGGEVEPSRGKPPVTSDSIVNLDHGDPTMYEEFWRGTGDSASIFIPGWQTMSYFSDLGGICWFLEPGFEREVRRLHRLVGNAVVDGYHVLVGTGSTQLFQAVLYALSPASDGTPMNVVSPAPYYSSYPSVTNYLNSALYRWAGDANTFDGDTCIELVCSPNNPDGGLRKPVIKSKSSKPVYDFAYYWPQYTPITEAAAHDIMLFTVSKCTGHAGTRLGWALVKDTKVAQKMIKFIELNTIGVSKDSQLRAAKIIGAICNGYEPVPSSGKTSQLFHFAKEKMAARWARLRAAVAASDIFTLPYELSGYCSFSNETVTANPPFAWLRYNKDDIEDLEAFLLEKKIITRGGTRFGVDARAVRVSMVDTDQAFNVFINRLATMK

SEQ ID NO: 2220 - protein, 431 aa, Zea mays
MAGRESGGMAAALRCAGRIGILATVAVNLAWIATYIRRRYFGGGNRSDNNGGGGEVEPSRGKPPVTSDSIVNLDHGDPTMYEEFWRGTGDSASIFIPGWQTMSYFSDLGGICWFLEPGFEREVRRLHRLVGNAVVDGYHVLVGTGSTQLFQAVLYALSPATDGTPMNVVSPAPYYSSYPSVTNYLNSALYRWAGDANTFDGDTCIELVCSPNNPDGGLRKPVIKSKSSKPVYDFAYYWPQYSPITEAAAHDIMLFTVSKCTGHAGTRLGWALVKDTKVAQKMIKFIELNTIGVSKDSQLRAAKIIGAICNGYEPVPSSGKTSQLFHFAKEKMAARWARLRAAVAASDIFTLPYELSGYCSFSNETVTANPPFAWLRYNKDDIEDLEAFLLEKKIITRGGTRFGVDARAVRVSMVDTDQAFNVFINRLATMK

SEQ ID NO: 2221 - protein, 425 aa, Zea mays
MAAKESSRTMKAARSAGRIGVVASVAMNLAWLAMYIRQRYGEITTVEASRGKPPVTQDSVVILDHGDPVMYEEFWRREGDSASILIPAWQTMSYFSNLGGICCFLEPGLEREVRRLHRLVGNAVVDGYHVIVGTGSTQLFQAVLYAISPASDGTPIDVVSPAPYYSCYPVASSFLNSGLYRWGGDANTFAGDDTSCVEVVCSPNNPDGGIRHAVVKSKSSKAIYDFAYYWPQYTPITEAAAHDVMLFTFSKCSGHAGTRLGWALVKDTEVAKKMTKFMELTTIGVSKDSQLRAAKILGAICNGYEQLPSPAGQTRSHLFHFAREKMAARWTRLRAALAASDIFTLPDELSEYCGFFKKTVTANPAFAWLRCKKDGIEDLESFLRENKIVTRGGTKFGVDGRVVRVSMVDTDQAFNVFLDRLATMK

SEQ ID NO: 2222 - protein, 431 aa, Zea mays; identical to SEQ ID NO: 2219

SEQ ID NO: 2223 - protein, 431 aa, Zea mays; identical to SEQ ID NO: 2220

SEQ ID NO: 2224 - protein, 432 aa, Sorghum bicolor; identical to SEQ ID NO: 2218

SEQ ID NO: 2225 - protein, 425 aa, Zea mays; identical to SEQ ID NO: 2221

SEQ ID NO: 2226 - protein, 305 aa, Sorghum bicolor
MDPSSHGGGAADGSADGHSQILWDWTAEHCEPNGSSHADATKFVWDCLNQDDDELLGLLGNQTPLRDCRNFFADLGDITCKETLDLEESRESKRRRTLEYPSESSQSEVGTHGTGSPFVTPEVAEISLLCADKPQSLNCDMHNTSNNLDEAPYHQEDNLLEHCSYETPVYLEPDQTPCSQESIACINDQAGISGTTEIAPMTESFIMQETRKLSTLKVSKGPSSSLVRVKENLTISVAYPFTLIKPSWEEGDVTLQDINQRIRAPPKKAPEILGTSAFSGKPVIGKTRIRTEGGKGSITILRTKG

SEQ ID NO: 2227 - protein, 306 aa, Zea mays
MDPSYDGSAPAAGGSADDHGQTLWDWTVEHCEPNDSSHADATKFVWDCLNQDDDELMGLLGNQTPLRDCRDFFADLGDFTCKETLDLEESRESKRRRTLEYPSESSQSEVGTHDAASPFVTSEAAEISLLCTDKPQSLNWDMHHTSNNLDEAPYRQEDILSEHCSYGTPVYLEPDQTPCSQESIACINDQSGISGTSETGPMTESFIMQETRKLCTLKVSKGSSSTLVKVKENLTTSVAYPFTLIKPSWEEGDVTLQDINQRIRAPPKKAPEILGTSAFSGKPVIGKTRIRTEGGKGSITILRTKG

SEQ ID NO: 2228 - protein, 313 aa, Zea mays
MDPSYDGSAPAAGGSADDHGQTWVRGPRVVLWDWTVEHCEPNDSSHDATKFVWDCLNQDDDELMGLLGNQTPLRDCRDFFADLGDFTCKETLDLEESRESKRRRTLEYPSESSQSEVGTHDAASPFVTSEAAEISLLCTDKPQSLNWDMHHTSNNLDEAPYRQEDILSEHCSYGTPVYLEPDQTPCSQESIACINDQSGISGTSETGPMTESFIMQETRKLCTLKVSKGSSSTLVKVKENLTTSVAYPFTLIKPSWEEGDVTLQDINQRIRAPPKKAPEILGTSAFSGKPVIGKTRIRTEGGKGSITILRTKG

SEQ ID NO: 2229 - protein, 310 aa, Zea mays
MDPSYHGGGAAGGSADDHGQILWDWTEQHCEPNDSSHDATKFVWDCLNQDDNELLGLLGNQTPLRYCRDFFADLDDITCKETLDLEESRESKRRRTLEYPLESSQSEVGTHETGSPFVTPEVAEISLLCTDKPQSLNCGMHHTLNNLDTINSLSDEAPYQQEDILLEHCSYGTAVYLEPDQTPCSQQSIACTNDQAGISGTSEIAPMTESFIMQETRKLSTLKVSNGASSSLVTKDNLTTSVAYPFTLIKPSWQEGDVTLQDINRRIRPPPKKAPEILGTSAFSGKPVINKTRIRTEGGKGSITILRTKG

SEQ ID NO: 2230 - protein, 309 aa, Zea mays
MDPSYHGGGAAGGSADDHGQILWDWTEQHCEPNDSSHDATKFVWDCLNQDDNELLGLLGNQTPLRYCRDFFADLDDITCKETLDLEESRESKRRRTLEYPLESSQSEVGTHETGSPFVTPEVAEISLLCTDKPQSLNCGMHHTLNNLDTINSLSDEAPYQQEDILLEHCSYGTAVYLEPDQTPCSQQSIACTNDQAGISGTSEIAPMTESFIMQETRKLSTLKVSNGASSSLVTKDNLTTSVAYPFTLIKPSWQEGDVTLQDINRRIRPPKKAPEILGTSAFSGKPVINKTRIRTEGGKGSITILRTKG

SEQ ID NO: 2231 - protein, 307 aa, Sorghum bicolor
MDQSYHGGAAAAAAGGSDGQILWDWQTGEHCEPSDGSHDATKFLWDCLNQDDNELLGLLGNRTPLRDCCDFFADLGDITCKETLDLEESRESKRRRILEYPSESSQSEVASHETGSPFVTSEVAEVSLLCTDEPESLNCDMQYTSNNLDTNSNEAPYEQEDNHFEHCSYGTPVYIEPDQVPCSWESIANIDDQAGISGTSEIAPLTESFIMQETRKLSTLKVSKGASTVKVKQNLTTSVAYPFTLIKPSWEEGDVTLQDINKRIHAPPKKAPEILGTSAFSGKPVIGKTRIRTEGGRGSITILRTKG

SEQ ID NO: 2232 - protein, 579 aa, Sorghum bicolor
MVQSRRRGGNYPCPRRAALPAAGLLLFLLAAVALLYVSPPPLADHPVLASSRRRRPPHTLLNSSGSGAMEETERREISHAPTNGSTVRDDLWGSKLASKFYGCSNSSSKFLDSNITTQPDRYLMIVTSGGLNQQRTGIIDAVVAARILNATLVVPKLDQASFWKDSSNFSDIFDANWFISSLSKDVKIVKELPHIGGKLRAPHRMRVPRKCTERCYLNRVLPALLKKHVIRLTKFDYRLANRLQTDLQKLRCRVNYHALRFTAPIQEMGEKLIQRMRERSEYFIALHLRFEPDMLAFSGCYYGGGEKERRELGAIRKRWKGLHPNPEKGRRQGRCPLTPEEVGLMLRALGYRKDVHIYVASGEIYGGARTLAPLKALFPNLHTKETISSKEELAPFSKYSSRMAALDFIVCDESDAFVANNNGNMAKILAGRRRYFGHKRTIRPNAKRLYPLFLNRGNMSWDAFSLKVHMVQKGFMGEPKELRPGRGEFHENPSTCICERTDGKAVARAKSQDDQVLNSGADQGKGIGEPVVPNRTDEEVGEPDDDEDDPAEREIVDAEMDDDVLVGPEDPELEQILSD

SEQ ID NO: 2233 - protein, 577 aa, Zea mays
MVQSRRRSGNYRCPRRAALPAAALLLFLLAAVALLYVSPPPLADHPVLASSRRRRSAHTLLNSSGAGSMEEFERREISRAPTNGSAVRDDLWGSKLASKFYGCSNSSSRFLDSNITTQPERYLMIVTSGGLNQQRTGIIDAVVAARILNATLVVPKLDQASFWKDSSNFSDIFYADWFISSLSKDVKIVKELPHIGGKLRAPHRMRVPRKCTERCYLNRVLPALLKKHVIRLTKFDYRLANRLQTDLQKLRCRVNYHALRFTAPIQEMGEKLIQRMRERSMYFIALHLRFEPDMLAFSGCYYGGGEKERRELGAIRKRWKGLHPNPEKGRRQGRCPLTPEEVGLMLRALGYRKDVHIYVASGEIYGGARTLAPLKALFPNLHTKETISSKEELAPFSKYSSRMAALDFIVCDESDAFVANNNGNMAKILAGRRRYFGHKRTIRPNAKRLYPLFLNRGNMSWNAFSSKVHMVQKGFMGEPKELRPGRGEFHENPPTCICERTDGKAVARAKSQDDQVLNSVADQGKGIGEPAVPNHTDEEAGEPDDDEDVPADKEVVDAEMVDDVLAGDPELEQILSD

SEQ ID NO: 2234 - protein, 607 aa, Oryza sativa Japonica Group
MMPEISGLRRMAQPRRRGGGGHNKCPRPALLPAAALLLFLLAAVALLYVSPPPLIDHPALASSRRRSPHAPLLNSSGGGSTVVSEHSEISRVPISKEADGLWGSKFASRFYGCSNSSSRFLGSSVITQPDRYLMIVTSGGLNQQRTGIIDAVVAARILNATLVVPKLDQTSFWKDASNFSEIFDVDWFISNLSKDVKIVKELPEIGGKLRTPHRMRVPRKCTQRCYVNRVLPALLKKHVVRLTKFDYRLANRLDTDLQKLRCRVNYHGLRFTGLIEEMGEKLIQRMRERSKHFIALHLRFEPDMLAFSGCYYGGGEKERKELGAIRKRWKTLHAINPEKGRRQGRCPLTPEEVGLMLRALGYRNDVHIYVASGEIYGGARTLAPLKAFFPNLHTKETISSKEELAPFSKYSSRMAALDFIVCDGSDAFVTNNNGNMAKILAGRRRYFGHKRTIRPNAKRLYSLISNRRNMSWDSFSSRVRMVQKGFMGEPKELRPGRGEFHENPSTCICEKTVSKTVAKSNSQSEQVLSNDTERGIAIQTEQVSSNDTEMGIATSEPTVPDHTDEEAGESEADEDAPGEKEEIIDPEADDDVQFRLEDPELEGILSD

SEQ ID NO: 2235 - protein, 595 aa, Sorghum bicolor
MGQPRRRGYPHGHGRHHRCPRRIALPAAGLGLLFLAVSLLSVSLLSAPPLADPRTGLGTSSSSRRFLRRYPTNGSGGELEGSESGDAFSVTTHGWTGQDDLWRSKLASNFHRCSNSSNKFLDSGVTTQPDRYLIVVTSGGLNQQRTGIVDAVVAARILNATLVVPRLDQTSFWKDSSNFSEIFDMDWFISYLEKDVRIIKEPPEKGGKAMKPYKMRVPRKCTPRCYLNRVLPALLKKHVIRMTKYDYRLSNKLDTDLQKLRCRVNYHALRFTDPIQELAEKLIQRMREKSRYFIALHLRFEPDMLAFSGCYYGGGEKERRELASIRKRWRTLHIRDPEKGRRQGRCPLTPEEVGLMLRALGYRSDVYIYVASGEIYGGEDTLAPLKALFPNFHTKETLSSQEELAPFLKFSSRMAAIDFIVCDESDAFVANNIGNMAKILAGQRRYFGHKRTIRPNAKQLYPLFMKRGNMSWDAFASQVRTIQKGYMGEPMEITPGRGEFHANPAACICEKSGRNSVIVKSISGSTQEPVTDTRIRKAIDIGRPPYPVYTDEEADGSDTEEDPDSSGRGEVIDTEPDDDSVVRQEDPELEEILSD

SEQ ID NO: 2236 - protein, 110 aa, Zea mays
MAAKAISSPVPVEWYPTLAVVMVSVGLMFTASFFIYEATSSKRSRSLAKEITTAAVASVLLGFGSLFVLLQVVFMFDDCVWGRVLGFSRLRACTSLRLHFSMRQLRDYMT

SEQ ID NO: 2237 - protein, 390 aa, Zea mays
MEEAAPAAVMERERLTAEMAFRGADEARREGGDPAPSIVIKIRRRLPDFARNIKLKYVKLGIRHGGSPTSLLPALCVPAVAAAAYSFVRLDVIYYSVDLLTCVAWLGTALLLLTVYYLKRPRPVYLVEFACYKPEERLKISKSAFLEMTESTGSFNEAALDFQTKITSRSALGDETYLPPGVQARPPRLNMAEARKEAEAVMFGCLDALFESTGIDPRRDVRILIVNCSLFNPTPSLASMVINHYRMREDVKSFNLGGMGCSAGLIAVDLAKDMLQANPGSYAVVLSTENITLNWYFGNDRSMLLSNCIFRMGGAAALLSNRRADAGRAKYRLLHTVRTHKAPPTSASTACTSARTRPARRASRWRGSSWRWPATRSRPTSRRWGPWCCP

SEQ ID NO: 2238 - protein, 547 aa, Sorghum bicolor
MEAAPAAVMERERLTAEMAFRGADEALRDGGGEPAPSIVIKIRRRLPDFARNIKLKYVKLGIRHGGSPTSVLPMLCVPAIAAAAYSFVRLDVIYYSIDLLTCVAWLGTALLLLTVYYFKRPRPVYLVEFACYKPEEQLKISKSAFLEMTESTGSFNEAALDFQTKITNRSALGDETYLPPGVQARPPRLNMAEARMEAEAVMFGCLDALFASTGIDPRRDVRILIVNCSLFNPTPSLASMIINHYRMREDVKSFNLGGMGCSAGLIAIDLAKDMLQANPNSYAVVLSTENITLNWYFGNDRSMLLSNCIFRMGGAAALLSNKRADAGRAKYRLLHTVRTHKGATDECFNCVYQREDEVGKVGVSLARELMAVAGDALKTNITTLGPLVLPLSEQLKFLKSLMMRRVFRVKGVRPYIPDFRRAFEHFCVHAGGRAVLEEVQRSLSLQDTDMEPSKCSLHRFGNTSSSSLWYELAYAEAKGRVRRGNRVWQIGFGSGFKCNSAVWRALQDVPALSSSSSTGAAAAGKGAQSKSCCNPWVDDVDSKYRLA

SEQ ID NO: 2239 - protein, 532 aa, Oryza sativa Japonica Group
MEAAVMERERLTAEMAFRDDARAAGGEWAPSIVIKIRRRLPDFARSVNLKYVKLGIRHGGSVTSYLPMLCVPLLASAAYSFVRLDVIYRSIDLLTCVAWLGTAVLLLTVYYFKRPRPVYLVEFACYKPDDQHKISKEGFLEMTESTGCFNDAALDFQTKITNRSALGDETYLPPGVQARPPRLNMAEARMEAEAVMFGCLDALFESTGINPKRDVGILIVNCSLFNPTPSLSSMIINHYEMRADVKSFNLGGMGCSAGLIAIDLAKDMLQANPNSYAVVLSTENITLNWYFGNDRSMLLSNCIFRMGGAAALLSNRRADAGRAKYRLLHTVRTHKGATDECFNCVYQREDEDGKVGVSLARELMAVAGDALKTNITTLGPLVLPLTEQLKFLKSLMMRRVFRVKGVRPYIPDFRRAFEHFCVHAGGRAVLEEVQRSLSLEDRDMEPSKCSLHRFGNTSSSSLWYELAYAEAKGRVQRGNRVWQIGFGSGFKCNSAVWRALRDVPAVSPPPKGKKSCNPWVDCVAKYPPKAYV

SEQ ID NO: 2240 - protein, 545 aa, Hordeum vulgare subsp. vulgare
MESAPAAAFMERERLTAEVTFSGDAQAAASTEGLPSIIIKIRRRLPDFARSVNLKYVKLGIRHGGSLTSYLPMLCVPVLAAAAYSFVRLDVIYLSIDLLSCVAWLGTAMLLLTVYYMKRPRPVYLVEFACYKPEDQNKISKEAFLDMTESTGCFNDETLAFQTKITTRSALGDETYLPSGVQARPPRLNMAEARLEAEAVMFGCLDALFASTGIDPRRDVRILIVNCSLFNPTPSLASMIIHHYKMREDVKSFNLGGMGCSAGLIAIDLAKDMLQANPNSYAVVLSTENITLNWYFGNDRSMLLSNCIFRMGGAAALLSNRRADAGRAKYRLLHTVRTHKGATDECFNCVYQREDDVGKVGVSLARELMTVAGDALKTNITTLGPLVLPLSEQLKFLKSLMMRRVFRAKGVRPYIPNFRRAFEHFCVHAGGRAVLEEVQRSLSLEDKDMEPSRCALHRFGNTSSSSLWYELAYAEAKGRVKRGNRVWQIGFGSGFKCNSAVWRALRDVPPVSPPHAGAAAPGPEKKAACNPWVDCVAKYPPKAYV

SEQ ID NO: 2241 - protein, 535 aa, Sorghum bicolor
MESAPSTAAVMERERLTAELDLAVVAAEPSSFVVKIRRRLPDFARSVNLKYVRLGLRSGGIPAPSTWVPLALAPPLLAAAVYSLVGADKLYSLDLLTCVAWLAAAVLLLTVYFLKRPRPVYLVDFACYRPADEHAISKEGFLDMTESTGWFNAEALEFQTKITRRSGLGDRTYLPPGIQARPPRLSLTEARAEAEAVMFGCLDALFAATGIDPRRDVRVLIVNCSLFNPTPSLASMVVHRYKMREDVKSFNLAGMGCSAGLIAVDLARDMLQANPRCYAVVVSTENITLNWYFGNDRSMLLSNCIFRMGGAAALLSNRRADARRAKYRLLHTVRTHKGAADECYSCVYQREDGAGSVGVSLARELMAVAGDALKTNITTLGPLVLPLSEQLKFLKSLVLRRVLRSRGVRPYIPDFRRAFEHFCVHAGGRAVLEEVQRSLGLRDVDMEPSRCTLHRFGNTSSSSLWYELAYAEAKGRVRRGHRVWQIGFGSGFKCNSAVWRALRDVPPVHADGAGGGSNCNPWVDSIHRYPPKAYI

SEQ ID NO: 2242 - protein, 517 aa, Hemerocallis hybrid cultivar
MDRERLTAEMAFRDSSIVIKIRRKLPDFLQSVKLKYVKLGYRSTTKPPFYLLLPLLLIAASLIFRIHTTLTFPANFSIDFVTAFSSSSIALLLLGVYYTRRPRPVYLVDFACYKPEDEHKISNEGFLEMTESTTAFNDKSLDFQTKITVRSGLGDETYLPPGIQARPPKLSMAEARLEAETVMFGCLDALFESTGINPSRDIGILIVNCSLFNPTPSLSAMIVNHYKMREDVKSFNLGGMGCSAGLISIDLAKDMLQANPNSYALVLSTENITLNWYFGNDRSMLLSNCIFRMGGAAVLLSNKRKDAKRAKYRLLHTVRTHKGADDSCYNCVYQREDEGGKVGVSLAKELMAVAGDALKTNITTLGPLVLPLTEQGKFLATLITRKLLKLKGVRPYIPNFKRAFEHFCVHAGGRAVLDEVEKNLGLEKTDMEASRSVLHRFGNTSSSSLWYELAYNEAKGRVGKGDRVWQIGFGSGFKCNSAVWKAMKDVPAIDRTASGSSRMCNPWGDCIDRYPVK

SEQ ID NO: 2243 - protein, 549 aa, Oryza sativa Indica Group
MASTAAVMERERLTAEMAFPPAVVAAGGGASCKPGAEPRSIVIKIRRRLPDFARSVNLKYVKLGLLSAGFPMPPSPSWVVMLALAAAAAYGLFDVAALYAVDLVGCAAWLCAAALLVAVWYARRPRPVYLVEFACYKPDGDEHEISKGGFLEMTESTGFFNGEAVAFQTKITRRSGLGDRTYLPPGIQARPPRLSMAEARAEAEAVMFGCLDKLFAATGVDPSRDVGILIVNCSLFNPTPSLASMVVNRYRMREDVKSFNLGGMGCSAGLIAVDLARDLLQANAGALAVVVSTENITLNWYFGNDRSMLLSNCIFRMGGAAALLSSRGGDARRAKYRLLHTVRTHKGAADGCFGSVYQREDERGRVGVSLARELMAVAGDALKTNITTLGPLVLPLAEQLKFLRSLVLRRVLRRGARRPYIPDFRRAFEHFCVHAGGRAVLEEVQRSLGLGDGDMEASKCALHRFGNTSSSSLWYELAYAEAKGRVRRGHRVWQIGFGSGFKCNSAVWRALRDVPPVSSGAGDGEEERRRVSCNPWVDSVESYPPKAYI

SEQ ID NO: 2244 - protein, 549 aa, Oryza sativa Japonica Group
MASTAAVMERERLTAEMAFPPAVVAAGGGASCKPGAEPRSIVIKIRRRLPDFARSVNLKYVKLGLLSAGFPMPPSPSWVVMLALAAAAAYGLFDVAALYAVDLVGCAAWLCAAALLVAVWYARRPRPVYLVEFACYKPDGDEHEISKDGFLEMTESTGFFNGEAVAFQTKITRRSGLGDRTYLPPGIQARPPRLSMAEARAEAEAVMFGCLDKLFAATGVDPSRDVGILIVNCSLFNPTPSLASMVVNRYRMREDVKSFNLGGMGCSAGLIAVDLARDLLQANAGALAVVVSTENITLNWYFGNDRSMLLSNCIFRMGGAAALLSSRGGDARRAKYRLLHTVRTHKGAADGCFGSVYQREDERGRVGVSLARELMAVAGDALKTNITTLGPLVLPLAEQLKFLRSLVLRRVLRRGARRPYIPDFRRAFEHFCVHAGGRAVLEEVQRSLGLGDGDMEASKCALHRFGNTSSSSLWYELAYAEAKGRVRRGHRVWQIGFGSGFKCNSAVWRALRDVPPVSSGAGDGEEERRRVSCNPWVDSVESYPPKAYI

SEQ ID NO: 2245 - protein, 556 aa, Oryza sativa Japonica Group
MASTAAVMERERLTAEMAFPPAVVAAGGGASCKPGAEPRSIVIKIRRRLPDFARSVNLKYVKLGLLSAGFPMPPSPSWVVMLALAAAAAYGLFDVAALYAVDLVGCAAWLCAAALLVAVWYARRPRPVYLVEFACYKPDGDEHEISKDGFLEMTESTGFFNGEAVAFQTKITRRSGLGDRTYLPPGIQARPPRLSMAEARAEAEAVMFGCLDKLFAATGVDPSRDVGILIVNCSLFNPTPSLASMVVNRYRMREDVKSFNLGGMGCSAGLIAVDLARDLLQANAGALAVVVSTENITLNWYFGNDRSMLLSNCIFRMGGAAALLSSRGGDARRAKYRLLHTVRTHKGAADGCFGSVYQREDERGRVGVSLARELMAVAGDALKTNITTLGPLVLPLAEQLKFLRSLVLRRVLRRGARRPYIPDFRRAFEHFCVHAGGRAVLEEVQRSLGLGDGDMEASKCALHRFGNTSSSSLWYELAYAEAKGRVRRGHRVWQIGFGSGFKCNSAVWRALRDVPPVSSGAGDGEEERRRVIVIVAIIRLFEKDQLTLRNQNIVSR

SEQ ID NO: 2246 - protein, 175 aa, Zea mays
MPRKITLVKEGEPQPVDAAQGEPAPAPAAPTAALTEAEVDELPRAIVRRLVKDKLSHVAGGEGAEVIVNKDAMAAFAESARIFIHYLSATANDMCKESKRQTINADDVLNALDDMEFSEFVEPLRTSLQEFRNKNADKRSEAKKQQKEKRRKLNEETLPQKENDPADDAKENGVA

SEQ ID NO: 2247 - protein, 172 aa, Sorghum bicolor
MPRKATKAKEGEPQPADAAQEEPVPAPAAPAAALTEAEVGELPKAIVRRLVKDKLSHVAGGEGAEVIVNKDAMAAFAESARIFIHYLSATSVTSQIPFSRSSVPPLSDSDPDCPLFALGVWNSEENAKFRNKNADKRSEANKKQKEKRRKLNEETPPEKENDPADDAKENDE

SEQ ID NO: 2248 - protein, 553 aa, Zea mays
MMGNKTGKPVFSELKSTEFSLLESTLVQDHCAIPTCVPLDFLKAITSDFSKEQELGRGGFGVVYKGLLKNGKAIAVKKLSEMNLDDDQFHNEVTYLFGLKHKNIVQLKAYCAESRWEAIELRRKYVMAESRKRLLCFECINNKSLDKHLSAESHGVEWHIRYEIIKGICHGLHYLHTDCQIVHLDLKPENILLDDNMEPKITDFGMSRLFGLQQSKIITKTCGGTLGYMAPEYLLKGLISVKADIFSLGVIIIEVMTGGRNYPTCEKSCEQFAVDVVGRWRKRLLEEAGRYTPLEKYVEQVETCILIGLMCVDDDPNKRPTTLDIIERLTKVDVTNTDRGPPKTLEAATGLTGHPNLATRSFLDRFRRTIVIGMLKKALKIQDVSQLEQLLAKEVLLELHKIGTNATGNRSFLERLHASITMATLVQALHSLDLDPSAALRMEVLFLALENMRGKNNSRRRSEDVLELEERPEQIRSVLEAGTRARLSDEEHMPSVSVQAEDQAFPKPKLAKVRATAPVCVSAVWLAAGIGFLCGFTLGEMRGLRRTRVHERT

SEQ ID NO: 2249 - protein, 389 aa, Sorghum bicolor
MCPMETEEDDSGGCDFLDWLGPDTSTTVFELLDDPADLARVGAVSRSWRRFVTENEFSKRLCRRICPEAASFTRAVVVTRSPPPPQPAASASESSQDAECRAREGEHAAYSYLAGAIVSAKPAMDLIMRCVGASSTDFFPDESMENTLVPHEWVNHRHSYWSSGGKDNPDAPESLTYRLSSDLCVIDEIRVRPYKAAFQLGHPIYSSKAVRIRLGHSKLDPGTETFVSAENENLTAIADENYTWTYTSPEFPMLQENVLQTFKLPRPALCIGGIVKIELLGRLQKQSTDDKYYICVCHVQVMGRSLSPDLMIDISDPADYSNLKYLPGAGNLRPEDLLSSDAKEDSSDWRSLVSRYRQMRQLAMVYMLLGPVQFADEEDEAEADMLHLL

SEQ ID NO: 2250 - protein, 384 aa, Zea mays
MRPMETEDSVGWDFLDWLGPDISTTIFQLLDDPADLARVAAVSRSWRRFVAVNKFSKHLCRQICPEAASFTRAVVVARLPPPPPPAAHAACESSQVAECRARDGEHAAYSYLAGALVSGKPATDLVMRCVGASSTDNFPDETIENTLVPHDMVNFRPSYWSSGGEDDPDVPESLTYTLASDLCVIEEIRIRPFEATFQHGHPIYSSKAVRIRLGHSKLDPGRETFVSDEDENLTAIADENYMWTYTSPEFPMLQENVLQTFKLPRPALCIGGIVKIELLGRIQKQFTDDKYYICVCHVQVTGRSLSPDLMIDLSDPAGYSNLKYLPGAGNLRPEDLISIDAKDSPDWRSLVSRYRQMRQLAMVYMLLGPVQLQFMDEDEADLQM

SEQ ID NO: 2251 - protein, 250 aa, Sorghum bicolor
MAREDCSSGAEMDALVRRLRLHRPPPSPYDPEPDAAPVPATAGDGQLFRPRRAAVLVCLFRGDGGELRVILTKRSSSLSTHSGEVSLPGGKVEEGDADDAATALRESKEEIGLDPALVTVVASLEHFLSKHLLVVVPVVGILLDRQAFKPALNIAEVDEIFDVPLEMFLKDENRTSEEREKMGQAFTVHYFTYEKGIQKYLIWGLTARILIHAASVVYQRPPDFTERSAHFKLPKFTKDCSSMLAGPAKH

SEQ ID NO: 2252 - protein, 250 aa, Zea mays
MAGEDCRSGAEMDALVRRLKLHRPSPSPYDPDPAAAPVPATAGDGELFRPRRAAVLVCLFRGDGGELRVILTKRSSSLSTHSGEVSLPGGKVEEGDADDVATALRESKEEIGLDPALVTVVASLEHFLSKHLLVVVPVVGILLDRQAFKPALNIAEVDEIFDVPLEMFLKDENRTSEEREKMGQTFTVHYFTYENGIQKYLIWGLTARVLIHAASVVYERPPDFTERRAHFKLPKFTKDCSSMLAGPAKH

SEQ ID NO: 2253 - protein, 250 aa, Zea mays
  misc_feature (46)..(46): Xaa can be any naturally occurring amino acid
MAGEDCRSGAEMDALVRRLKLHRPSPSPYDPDPAAAPVPATAGDGXLFRPRRAAVLVCLFRGDGGELRVILTKRSSSLSTHSGEVSLPGGKVEEGDADDVATALRESKEEIGLDPALVTVVASLEHFLSKHLLVVVPVVGILLDRQAFKPALNIAEVDEIFDVPLEMFLKDENRTSEEREKMGQTFTVHYFTYENGIQKYLIWGLTARILIHAASVVYERPPDFTERRAHFKLPMFTKDCSSMLAGPAKH

SEQ ID NO: 2254 - protein, 232 aa, Oryza sativa Indica Group
MVGTTEVEGIEALVRRLRLYQPPPSPYDGASTTAAGGGGELFRPRRAAVLVCLFRRGGGDGELRVILTKRSSSLSTHSGEVALPGGKAEEGDADDAATALREAKEEIGLDPSLVTVVASLEHFLSKHLLVVVPIVGILSDIEAFKPVLNVDEVDDIFDVPLEMFLKDENRTSEEREKMGQTFTIHYFNYEKENQKYLIWGLTARILIHAASVVYQRPPDFPERRVHFNLPKF

SEQ ID NO: 2255 - protein, 232 aa, Oryza sativa Japonica Group
MVGTTEVEGIEALVRRLRLYQPPPSPYDGASTTAAGGGGELFRPRRAAVLVCLFRRRGGDGELRVILTKRSSSLSTHSGEVALPGGKAEEGDADDAATALREAKEEIGLDPSLVTVVASLEHFLSKHLLVVVPIVGILSDIEAFKPVLNVDEVDDIFDVPLEMFLKDENRTSEEREKMGQTFTIHYFNYEKENQKYLIWGLTARILIHAASVVYQRPPDFPERRVHFNLPKF

SEQ ID NO: 2256 - protein, 240 aa, Oryza sativa Indica Group
MEAPGADIQALIQRLRLHRPRPSPYAAAAAPSPDAAAPPAELLFRPRRAAVLICLFRGAAGELRVLLTKRSSKLSSHSGEVSLPGGKAEEGDADDAATALREAKEEIGLDPASVTVVASLEHFLSKHLLVVVPVVGILSDIQAFKPVLNVDEVDSIFDVPLEMFLKDEKRTSEEREWMGQEFTIHYFNYEKGSEKYVIWGLTAGILIHAASVVFQRPPDFPARTVQFNLPKYSKECSSMP

SEQ ID NO: 2257 - protein, 250 aa, Oryza sativa Japonica Group
MSTDLTIPPSMEAPGADIQALIQRLRLHRPRPSPYAAAAAPSPDAAAPPAELLFRPRRAAVLICLFRGAAGELRVLLTKRSSKLSSHSGEVSLPGGKAEEGDADDAATALREAKEEIGLDPASVTVVASLEHFLSKHLLVVVPVVGILSDIQAFKPVLNVDEVDSIFDVPLEMFLKDEKRTSEEREWMGQEFTIHYFNYEKGSEKYVIWGLTAGILIHAASVVFQRPPDFPARTVQFNLPKYSKECSSMP

SEQ ID NO: 2258 - protein, 241 aa, Sorghum bicolor
MEEEVGPGADMEALVRRLRLHRPAPSPYELSAAVAPAPAPGAGELFRPRRAAVLVCLFRGAAGELRVILTKRSSSLSTHSGEVALPGGKAEEGDADDAATALRESKEEIGLDPALVTVVTSLEHVLSKHLLVVVPIVGILSDINTFKPVPNAAEVDKIFDVPLEMFLKDENRTSNDLEWMGQEFTIHHFSYAKENEKYMIWGLTAGILIHAASVVYQRPPDFAEKRAQFNLPTYFNAMARA

SEQ ID NO: 2259 - protein, 519 aa, Sorghum bicolor
MQFSSVFPLEGKACMSPVRRGGEGAWSERVRIGNSCSIRRNKALRRMCFGARGAVSSAQCVLTSDAGPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGAALEEMKVDTSFLNFAIDDPTKYPYIASMGVYVFKRDVLLDLLKSRYAELHDFGSEILPKALHEHNVQAYVFTDYWEDIGTIRSFFDANMALCEQPPKFEFYDPKTPFFTSPRYLPPTKSDKCRIKDAIISHGCFLRECAIEHSIVGVRSRLNSGCELKNTMMMGADLYETEDEISRLLSEGKVPIGVGENTKISNCIIDMNARVGRNVSITNTEGVQEADRPELGYYIRSGIVVILKNATIKDGTVI

SEQ ID NO: 2260 - protein, 518 aa, Zea mays
MQFSSVLPLEGKACMSPVRRGSGGYGSERMRINCCSIRRNKALRRMCFSARGAVSSTQCVLTSDAGPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGAALEEMKVDTSFLNFAIDSPAEYPYIASMGVYVFKRDVLLDLLKSRYAELHDFGSEILPKALHEHNVQAYVFTDYWEDIGTIRSFFDANMALCEQPPKFEFYDPKTPFFTSPRYLPPTKSDKCRIKDAIISHGCFLRECAIEHSIVGVRSRLNSGCELKNTMMMGADLYETEDEISRLLAEGKVPIGVGENTKISNCIIDMNARVGRNVSITNKEGVQEADRPDEGYYIRSGIVVVLKNATIKDGTVI

SEQ ID NO: 2261 - protein, 519 aa, Oryza sativa Japonica Group
MQFSSVFPLEGKACVSPIRRGGEGSASDRLKIGDSSSIKHDRAVRRMCLGYRGTKNGAQCVLTSDAGPDTLHVRTSFRRNFADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGTDLEAMKVDTSFLNFAIDDPTKFPYIASMGVYVFKRDVLLNLLKSRYAELHDFGSEILPRALHEHNVQAYVFADYWEDIGTIRSFFDANMALCEQPPKFEFYDPKTPFFTSPRYLPPTKSDKCRIKDAIISHGCFLRECTIEHSIVGVRSRLNSACELKNTMMMGADLYETEDEISRLLSEGKVPIGVGENTKINNCIIDMNARVGRNVVITNSEGVQESDRPEEGYYIRSGIVVILKNATIKDGKVI

SEQ ID NO: 2262 - protein, 519 aa, Oryza sativa Japonica Group
MQFSSVFPLEGKACVSPIRRGGEGSASDRLKIGDSSSIKHDRAVRRMCLGYRGTKNGAQCVLTSDAGPDTLHVRTSFRRNFADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGTDLEAMKVDTSFLNFAIDDPTKFPYIASMGVYVFKRDVLLNLLKSRYAELHDFGSEILPRALHEHNVQAYVFADYWEDIGTIRSFFDANMALCEQPPKFEFYDPKTPFFTSPRYLPPTKSDKCRIKDAIISHGCLLRECTIGHSIVGVRSRLNSACELKNTMMMGADLYETEDEISRLLSEGKVPIGVGENTKINNCIIDMNARVGRNVVITNSEGVQESDRPEEGYYIRSGIVVILKNATIKDGKVI

SEQ ID NO: 2263 - protein, 529 aa, Oryza sativa Japonica Group
MQFSSVFPLEGKACVSPIRRGGEGSASDRLKIGDSSSIKHDRAVRRMCLGYRGTKNGAQCVLTSDAGPDTLHVRTSFRRNFADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGTDLEAMKVDTSFLNFAIDDPTKFPYIASMGVYVFKRDVLLNLLKSRYAELHDFGSEILPRALHEHNVQVKVFKLEHYYAYVFADYWEDIGTIRSFFDANMALCEQPPKFEFYDPKTPFFTSPRYLPPTKSDKCRIKDAIISHGCFLRECTIEHSIVGVRSRLNSACELKNTMMMGADLYETEDEISRLLSEGKVPIGVGENTKINNCIIDMNARVGRNVVITNSEGVQESDRPEEGYYIRSGIVVILKNATIKDGKVI

SEQ ID NO: 2264 - protein, 522 aa, Triticum aestivum
MSSMQFSSVLPLEGKACISPVRREGSASERLKVGDSSSIRHERASRRMCNGGRGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKNKSIEHILILSGDQLYRMDYMELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 2265 - protein, 523 aa, Hordeum vulgare subsp. vulgare
MSSMQFSSVLPLEGKACVSPVRREGSACERLKIGDSSSIRHERASRRMCNGGARGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKHKSIEHILILSGDQLYRMDYMELVQKHVDDNADITLSCAPVGESRASEYGLVKFDSSGRVIQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 2266 - protein, 522 aa, Triticum aestivum
MSSMQFSSVLPLEGKACVSPVRREGSACERLKVGDSSSIRHDRASRRMCNGGRGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKNKSIEHILILSGDQLYRMDYMELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGQSDPSFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 2267 - protein, 521 aa, Zea mays
MQFSSVLPLEGKACMSPVRRGSGGYGSERMRINCCSIRRNKALRRMCFSARGAVSSTQCVLTSDAGPDTLVRPNHPFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGAALEEMKVDTSFLNFATCTLPAEYPYIASMGVYVFKRDVLLDLLKSRYAELHDFGSEILPKALHEHNVQAYVFTDYWEDIGTIRSFFDANMALCEQPPKFEFYDPKTPFFTSPRYLPPTKSDKCRIKDAIISHGCFLRECAIEHSIVGVPSRLNSGCELKNTMMMGADLYETEDEISRLLAEGKVPIGVGENTKISNCIIDMNCQGWKERLHNKQRGRSKSPDRPGRRILIRSGIVVVLKNATIKDGTVI

SEQ ID NO: 2268 - protein, 527 aa, Hordeum vulgare
MSSMQFSSVLPLEGKACVSPVRREGSACERLKIGDSSSIRHERASRRMCNGGAGAPPPPVRSACSPPTPARPTPLFSGRPSGGITPIRTRSRPSVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKHKSIEHILILSGDQLYRMDYMELVQKHVDDNADITLSCAPVGESRASEYGLVKFDSSGRVIQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 2269 - protein, 271 aa, Botryotinia fuckeliana B05.10
MPVTFSFVHNTRTEHVVFDIIDMEYPYNAIIGRGTLNAFEAILHPAYLCMKIPSEQGPIVVHGSQEAARKAEGNWTDLKAIHNIDGAEVCEQYKYKREKAASADQPKPMLLCEDIVDQKVLLGSQLSEEQEKTLIRFLFNNKDVFAWSANDLCGVNRDVNEHSLNVDPSFRPRKQRLRNMSDDKAEGARNEVKRLLSAGVIREVKYPEWLANTIMVKKANGKWRMCIDFTDLNKACPKDEFSLPRIDSLVDAAASSELMSLLDCYSGYHQI

SEQ ID NO: 2270 - protein, 631 aa, Sorghum bicolor
MGPLEPRYRPAGAPEDTTKRRASKSKSFKDVENFEVIVLEKSCGCKFKSLRILLIAIISATVLTLVTPTLYEHQLQSASRYVDVGWMWDKTSSDPRYVSSVDVRWEDVYKALGNLRSGNQNLKVGLLNFNSTEYGSWTQLLSDSHVSIIRLEHAKDSITWQTLYPEWIDEEEETEIPSCPSLPEPDVRRDVRFDVIAVKLPCTHVAGWSRDVARLHLQLSAAKLAVTSSKRNHKVHVLFVTECFPIPNLFPCKNLVRHEGNAWLYSPDSKALREKLRLPVGSCELAVPLKAKSRLFSVDRRREAYATILHSASEYVCGAITAAQSIRQAGSTRDLVILVDETISDHHRRGLEAAGWKVRIIQRIRNPKAERDAYNEWNYSKFRLWQLTDYDKIIFIDADLLILRNVDFLFAMPEITATGNNATLFNSGVMVIEPSNCTFQLLMDHINEITSYNGGDQGYLNEIFTWWHRIPKHMNFLKHFWEGDSQAMKAKKTQLFGADPPILYVLHYLGLKPWLCFKDYDCNWNNAGMREFASDVAHARWWKVHDKMPRKLQSYCLLRSRQKASLEWDRRQAEKANSEDGHWRRNITDTRLKTCFEKFCFWESMLWHWGENNNRTKSIPMAVKTASLARS

SEQ ID NO: 2271 - protein, 632 aa, Zea mays
MGPLEPRYRPGGAPEDTTKRRASKSKSFKDAENFEVLVLEKSCGCKFKSLRILLIAIISATVLTLVTPTLYERQLQSASRYVDVGWMWDRASSDPRYASSADVGWEDVYKALGNLRSGNRQSHLRVGLLNFNSTEYGSWTQLLPADSHVISTVRLEHAKDSVTWQTLYPEWIDEEEETEIPSCPSLPEPNVPRGARFDVVAVKLPCTRVAGWSRDVARLHLQLSAAKLAVASSKRNHDVHVLFVTDCFPIPNLFPCKNLVTREGSAWLYSPDSKALREKLRLPVGSCELAVPLKAKSRLFSVDRRREAYATILHSASEYVCGAISAAQSIRQAGSTRDLVILVDETISDHHRRGLEAAGWKVRVIQRIRNPKAERDAYNEWNYSKFRLWQLTDYDKVIFIDADLLILRNVDFLFAMPEIAATGNNATLFNSGVMVVEPSNCTFRLLMDHIDEITSYNGGDQGYLNEIFTWWHRVPRHMNFLKHFWEGDSEAMKAKKTQLFGADPPVLYVLHYLGLKPWLCFRDYDCNWNNAGMREFASDVAHARWWKVHDRMPRKLQSYCLLRSRQKARLEWDRRQAEKANSQDGHWRLNVTDTRLKTCFEKFCFWESMLWHWGENSNRTKSVPMAATTARS

SEQ ID NO: 2272 - protein, 633 aa, Zea mays
MGPLEPRYRPGGAPEDTTKRRASKSKSFKDAENFEVLVLEKSCGCKFKSLRILLIAIISATVLTLVTPTLYERQLQSASRYVDVGWMWDRASSDPRYASSADVRWEDVYKALGNLRSGNRQSHLRVGLLNFNSTEYGSWTQLLPADSHVISTVRLEHAKDSVTWQTLYPEWIDEEEETEIPSCPSLPEPNVPRGARFDVVAVKLPCTRVAGWSRDVARLHLQLSAAKLAVASSKRNHDDVHVLFVTDCFPIPNLFPCKNLVTREGSAWLYSPDSKALREKLRLPVGSCELAVPLKAKSRLFSVDRRREAYATILHSASEYVCGAISAAQSIRQAGSTRDLVILVDETISDHHRRGLEAAGWKVRVIQRIRNPKAERDAYNEWNYSKFRLWQLTDYDKVIFIDADLLILRNVDFLFAMPEIAATGNNATLFNSGVMVVEPSNCTFRLLMDHIDEITSYNGGDQGYLNEIFTWWHRVPRHMNFLKHFWEGDSEAMKAKKTQLFGADPPVLYVLHYLGLKPWLCFRDYDCNWNNAGMREFASDVAHARWWKVHDRMPRKLQSYCLLRSRQKARLEWDRRQAEKANSQDGHWRLNVTDTRLKTCFEKFCFWESMLWHWGENSNRTKSVPMAATTARS

SEQ ID NO: 2273 - protein, 628 aa, Hordeum vulgare subsp. vulgare
MEQRYRPGGAADDTTKRRTTKTKSFKDVESYEVLVLEKNCGCKFKSLRYLLIAIVSATFLTLLTPTLYERQLQSSSRYVDVDWIWDKTSADPRYVSSADVQWADVYTAIEDLSAGNQKLKIGLLNFNSTEYGSWSQILPESHVSIIRLEHAKDSITWPTLYPEWIDEEEESEIPSCPSFPEPNVRRGAWFDVIAVKLPCTRVAGWSRDVARLHLQLSAAKLAVSSSRGNRMVHVLFVTDCFPIPNLFPCKNLVKHEGNAWLYRPDLKAVREKLRLPVGSCELAIPLKAKARLFSVDRRREAYATILHSASEYVCGAITAAQSIRQAGSTRDLVILVDNTISDHHRRGLEAAGWKVRIIERIRNPKAERDAYNEWNYSKFRLWQLTDYDKIIFIDADLLILRNVDFLFAMPEITATGNNATLFNSGVMVIEPSNCTFQLLMEHINEITSYNGGDQGYLNEIFTWWHRIPKHMNFLKHFWEGDSEAAKAKKTQLFGADPPNLYVLHYLGLKPWLCFRDYDCNWNNFIMREFASDVAHNRWWKVHDKMPRKLQSYCLLRTRQKAGLEWDRRQAEKANLEDGHWRRNITDPRLKTCFEKFCFWESMLWHWGEAKNQTKSIPAPTTTSLSSTS

SEQ ID NO: 2274 - protein, 671 aa, Oryza sativa Japonica Group
MGSLETRYRPAGAPSIWRFDLFVDQPLNLLDDAMVPRGCRLWLMLPSGDLSVLGSSHRLDDTTKRRTPKSRIYKDVENFGVLVLEKNSGCKFKTLRYLLLAITSATFLTLLTPTFYEHQLQSSRYVDVGWIWDKPSYDPRYVSSVDVQWEDVYKALENLNDGSQKLKVGLLNFNSTEYGSWAQLLPGSAVSIVRLEHAKDSITWDTLYPEWIDEEEETDIPACPSLPDPNVRKGSHFDVIAVKLPCTRVGGWSRDVARLHLQLSAAKLAVASSKGNQKVHVLFVTDCFPIPNLFPCKNLVKHEGNAWLYSPDLKALREKLRLPVGSCELAVPLKAKARLYSVDRRREAYATILHSASEYVCGAISAAQSIRQAGSTRDLVILVDDTISDHHRKGLEAAGWKVRVIQRIRNPKAERDAYNEWNYSKFRLWQLTDYDKIIFIDADLLILRNVDFLFAMPEITATGNNATLFNSGVMVIEPSNCTFQLLMDHINEITSYNGGDQGYLNEIFTWWHRIPKHMNFLKHFWEGDDDSAKAKKTELFGADPPILYVLHYLGMKPWLCFRDYDCNWNIPLMREFASDVAHARWWKVHDNMPEKLQSYCLLRSKLKAGLEWERRQAEKANLEDGHWRRNITDPRLTICYEKFCYWESMLLHWGEKNPTNNNPVPATISSS

SEQ ID NO: 2275 - protein, 671 aa, Oryza sativa Indica Group
MGSLETRYRPAGAPSIWRFDLFVDQPLNLLDDAMVPRGCRLWLMLPSGDLSVLGSSHRLDDTTKRRTPKSRIYKDVENFGVLVLEKNSGCKFKTLRYLLLAITSATFLTLLTPTFYEHQLQSSRYVDVGWIWDKPSYDPRYVSSVDVQWEDVYKALENLNVGSQKLKVGLLNFNSTEYGSWAQLLPGSAVSIVRLEHAKDSISWDTLYPEWIDEEEETDIPACPSLPDPNVRKGSHFDVIAVKLPCTRVGGWSRDVARLHLQLSAAKLAVASSKGNQKVHVLFVTDCFPIPNLFPCKNLVKHEGNAWLYSPDLKALREKLRLPVGSCELAVPLKAKVRLYSVDRRREAYATILHSASEYVCGAISAAQSIRQAGSTRDLVILVDDTISDHHRKGLEAAGWKVRVIQRIRNPKAERDAYNEWNYSKFRLWQLTDYDKIIFIDADLLILRNVDFLFAMPEITATGNNATLFNSGVMVIEPSNCTFQLLMDHINEITSYNGGDQGYLNEIFTWWHRIPKHMNFLKHFWEGDDDSAKAKKTELFGADPPILYVLHYLGMKPWLCFRDYDCNWNIPLMREFASDVAHARWWKVHDNMPEKLQSYCLLRSKLKAGLEWERRQAEKANLEDGHWRRNITDPRLTICYEKFCYWESMLLHWGEKNPTNNNPVPATISSS

SEQ ID NO: 2276 - protein, 684 aa, Oryza sativa Japonica Group
MAVALVKAIDWVVKRWGLRIWLIGLFIRIWRFDLFVDQPLNLLDDAMVPRGCRLWLMLPSGDLSVLGSSHRLDDTTKRRTPKSRIYKDVENFGVLVLEKNSGCKFKTLRYLLLAITSATFLTLLTPTFYEHQLQSSRYVDVGWIWDKPSYDPRYVSSVDVQWEDVYKALENLNDGSQKLKVGLLNFNSTEYGSWAQLLPGSAVSIVRLEHAKDSITWDTLYPEWIDEEEETDIPACPSLPDPNVRKGSHFDVIAVKLPCTRVGGWSRDVARLHLQLSAAKLAVASSKGNQKVHVLFVTDCFPIPNLFPCKNLVKHEGNAWLYSPDLKALREKLRLPVGSCELAVPLKAKARLYSVDRRREAYATILHSASEYVCGAISAAQSIRQAGSTRDLVILVDDTISDHHRKGLEAAGWKVRVIQRIRNPKAERDAYNEWNYSKFRLWQLTDYDKIIFIDADLLILRNVDFLFAMPEITATGNNATLFNSGVMVIEPSNCTFQLLMDHINEITSYNGGDQGYLNEIFTWWHRIPKHMNFLKHFWEGDDDSAKAKKTELFGADPPILYVLHYLGMKPWLCFRDYDCNWNIPLMREFASDVAHARWWKVHDNMPEKLQSYCLLRSKLKAGLEWERRQAEKANLEDGHWRRNITDPRLTICYEKFCYWESMLLHWGEKNPTNNNPVPATISSS

SEQ ID NO: 2277 - protein, 635 aa, Oryza sativa Japonica Group
MGSLETTNTRYRPAGAADDTAKRRTQKSKSFKEVEKFDVFVLEKSSGCKFRSLQLLLFAIMSAAFLTLLYTPSVYDHQMQSSSRFVSGWIWDKTIPDPRYVSSLGVQWEDVYKTVENLNDGERKLKVGLLNFNSTEIGSWTQLLPDSDFSIIRLEHAKESITWQTLYPEWIDEEEETEIPSCPSLPDPIFPRGTHFDVVAVKLPCTRAGGWSRDVARLHLQLSAAKVAVTASRGNRGIHVLFVTDCFPIPNLFSCKNLVKHEGNAWMYKPDLKALREKLRLPVGSCELAVPLKAKARLYSVDRRREAYATILHSASEYVCGAITAAQSIRQAGSTRDFVILVDETISNHHRKGLEAAGWKVRIIQRIRNPKAERDAYNEWNYSKFRLWQLTDYDKIIFIDADLLILRNVDFLFAMPEITATGNNATLFNSGVMVIEPSNCTFQLLMDHINEITSYNGGDQGYLNEIFTWWHRIPKHMNFLKHFWEGDEEEVKVKKTRLFGADPPILYVLHYLGLKPWLCFRDYDCNWNNPILREFASDVAHARWWKVHDKMPKKLQHYCLLRSRQKAGLEWDRRQAEKANFTDGHWRRNITDPRLKTCFEKFCFWESMLWHWGESKNSTKENPVPATPTASLTSS

SEQ ID NO: 2278 - protein, 635 aa, Oryza sativa Indica Group
MGSLETTNTRYRPAGAADDTAKRRTQKSKSFKEVEKFDVFVLEKSSGCKFRSLQLLLFAIMSAAFLTLLYTPSVYDHQMQSSSRFVSGWIWDKTIPDPRYVSSLGVQWEDVYKTVENLNDGERKLKVGLLNFNSTEIGSWTQLLPDSDFSIIRLEHAKESTTWQTLYPEWIDEEEETEIPSCPSLPDPIFPRGTHFDVVAVKLPCTRAGGWSRDVARLHLQLSAAKVAVTASRGNRGIHVLFVTDCFPIPNLFSCKNLVKHEGNAWMYKPDLKALREKLRLPVGSCELAVPLKAKARLYSVDRRREAYATILHSASEYVCGAITAAQSIRQAGSTRDFVILVDETISNHHRKGLEAAGWKVRIIQRIRNPKAERDAYNEWNYSKFRLWQLTDYDKIIFIDADLLILRNVDFLFAMPEITATGNNATLFNSGVMVIEPSNCTFQLLMDHINEITSYNGGDQGYLNEIFTWWHRIPKHMNFLKHFWEGDEEEVKVKKTRLFGADPPILYVLHYLGLKPWLCFRDYDCNWNNPILREFASDVAHARWWKVHDKMPKKLQHYCLLRSRQKAGLEWDRRQAEKANFTDGHWRRNITDPRLKTCFEKFCFWESMLWHWGESKNSTKENPVPATPTASLTSS

SEQ ID NO: 2279 - protein, 633 aa, Hordeum vulgare subsp. vulgare
MGSLEARYRPAGAADDTAKRRTQKSKSFKEVEKFDVFVLEKSSGCKFRSLQLLLFAIMSAAFLTLLYTPSVYEHQLQSNSRFVNVGWIWDKTIPDPRYVSSMAVQWDDVYKTIESLNGGEQKLKVGLLNFNSTEFGSWTQLLPESEFSIIRLEHANESITWQTLYPEWIDEEEETEIPSCPSLSEPNFPRGTHFDVIAVKLPCTRVGGWSRDVARLHLQLSAAKLAVSAARGNRGVHVMFVTECFPLPNLFSCKNLKKHEGNAWLYKPDPKALKEKLRLPIGSCELAVPLKAKSRLFSVDRRREAYATILHSASEYVCGAIAAAQSIRQAGSTRDFVILVDDTISDHHRKGLESAGWKVRIIERIRNPKAERDAYNEWNYSKFRLWQLTDYDKIIFIDADLLILRNIDFLFTMPEISATGNNATLFNSGVMVIEPSNCTFQLLMEHINEITSYNGGDQGYLNEIFTWWHRIPKHMNFLKHFWEGDEEEVKAKKTQLFGANPPILYVLHYLGRKPWLCFRDYDCNWNVPILREFASDIAHTRWWKVHDKMPKKLQSYCLLRSRLKAGLEWERRQAEKANFTDGHWKRNITDKRLKICFEKFCFWESMLWHWGEAPNSTKKASTPALPTATLSSS

SEQ ID NO: 2280 - protein, 380 aa, Oryza sativa Indica Group
MDPSAPSGSSADASASSSSSAVEDLAPGMAAMSLQDRFELLRGIGEECIQEDELMNLLQKKPVPICYDGFEPSGRMHIAQGIVKTINVNKMVRAGCKVKIWIADWFAQLNNKMGGDLKKIQTVGRYMIEIWRAAGMNLDGVEFLWSSEEINNRANEYWPLVMDIACKNNVKRIMRCCQIMGRNDSDELTAAQIFYPCMQCADIFFLKADICQLGMDQRKVNVLAREYCTDIKRKNKPIILSHHMLPGFKEGQEKMSKSDPSSAIFMEDDEAQVNLKIKQAFCPPNVVDGNPCLEYIKYIVFPWFEMFEVVRKEANGGNKTFTNMDELIDDYKTGALHPADVKPALAKAINQILQPIRDHFNNNSEAKILLNTVKKYRVTN

SEQ ID NO: 2281 - protein, 394 aa, Oryza sativa Japonica Group
MDPSQPSGSSADASASSSSSSSSSAVENLAAGMAAMSLQDRFELLRGIGEECIQEDELMNLLQKKPVPICYDGFEPSGRMHIAQGIVKTINVNKMVRAGCKVKIWIADWFAQLNNKMGGDIKKIQTVGRYMIEIWRAAGMNLDGVEFLWSSEEINKRANEYWPLVMDIARKNNVKRIMRCCQIMGRNDSDELTAAQIFYPCMQCADIFFLKADICQLGMDQRKVNMLAREYCDDIKRRNKPIILSHHMLPGFKEGQEKMSKSDPSSAIFMEDDEAQVNLKIKQAFCPPNIVDGNPCLEYIKYIVFPWFETFEVVRKEENGGNKTFANMNELIADYESGALHPADVKPALAKAINQILQPIRDHFKNNSEAKVLLNTVKNYKVKTEDTSSSPQAS

SEQ ID NO: 2282 - protein, 379 aa, Zea mays
MDSTPAHEAAPGASSSATAAAEDLAGGVAAMTLDERFALLRGIGEECIQEDELRRLLENKPVPICYDGFEPSGRMHIAQGIVKTINVNKMVRAGCKVKIWIADWFAQLNNKMGGDLKKIQTVGRYMIEIWKAAGMNLDGVEFLWSSEEINRRAHEYWPIVMDIARKNNVKRIMRCCQIMGRSDQDDLTAAQIFYPCMQCADIFFLKADICQLGMDQRKVNVLAREYCDDIKRKNKPIILSHHMLPGFKEGQEKMSKSDPSSAIFMEDDEAQVNVKIKQAFCPPKIVEGNPCLEYIKYIVFPWFGRFEVARKESNGGNKTFTSMDELISDYETGALHPADVKPALAKAINEILQPVRDHFNNNNEAKVLLNTVKKYRVTS

SEQ ID NO: 2283 - protein, 379 aa, Zea mays
MDSTPAPEAAPGASSSATAAAEDLAGGVAAMTLDERFALLRGIGEECIQEDELRRLLENKPVPICYDGFEPSGRMHIAQGIVKTINVNKMVRAGCKVKIWIADWFAQLNNKMGGDLKKIQTVGRYMIEIWKAAGMNLDGVEFLWSSEEINRRAHEYWPIVMDIARKNNVKRITRCCQIMGRSDQDDLTAAQIFYPCMQCADIFFLKADICQLGMDQRKVNVLAREYCDYIKRKNKPIILSHHMLPGFKEGQEKMSKSDPSSAIFMEDDEAQVNVKIKQAFCPPKIVEGNPCLEYIKYIVFPWFGRFEVARKESNGGNKTFTSMDELISDYETGALHPADVKPALAKAINEILQPVRDHFNNNNEAKVLLNTVKKYRVTS

SEQ ID NO: 2284 - protein, 380 aa, Zea mays
MDSTPAPEAAPGTSSSSPAAAAEGLAGGVAAMTLDERFEMLRGIGEECIQEDELRRLLENKPVPICYDGFEPSGRMHIAQGVVKTINVNKMVSAGCKVKIWIADWFAQLNNKMGGDLKKIQTVGRYMIEIWKAAGMNLDGVEFLWSSEEINKRAHEYWPIVMDIARKNNVKRIMRCCQIMGRSDQDDLTAAQIFYPCMQCADIFFLKADICQLGMDQRKVNVLAREYCDDIKRKNKPIILSHHMLPGFKEGQEKMSKSDPSSAIFMEDDEAQVNVKIKQAFCPPKIVEGNPCLEYIKYIVFPWFGRFEVIRKESNGGNKTFTCMNELISDYETGALHPADVKPALAKAINEILQPVRDHFNNNNEAKVLLNTVKKYRVTN

SEQ ID NO: 2285 - protein, 399 aa, Hordeum vulgare subsp. vulgare
MDSSVAADAVNAEASAPAAASMEPSAAPEASNRASSSAAAAEDLVGGVAGLSLDERFDLLMSIGEECIQPDELKRLLQNKPVPICYDGFEPSGRMHIAQGVVKTINVNKMIRAGCKVKIWIADWFAQLNNKMGGDLKKIQTVGRYMIEIWKAAGMNLDGVEFLWSSEEINRCANEYWPLVMDIGRKNNIKRITRCCTIMGRSDNEELTAAQIFYPCMQCADIFFLKADICQLGMDQRKVNMLAREYCDDIKRKNKPIILSHHMLPGFKEGQEKMSKSDPTSAIFMEDDEAQVNLKIKQAFCPPKIVDKNPCLEYIQYIVFPWFDKFEVVRKENNGGNKTFLTMDELVADYEAGDLHPADVKPALAKAINEILKPVRDHFNSSSEAKVLLNTVKKYRVSS

SEQ ID NO: 2286 - protein, 408 aa, Nicotiana tabacum
MDNKEASEAINALSSPPSSADTPISTSQNMDNQETSEAIDALSLAASSSNPSISTSQMSLEEKFKIVRSIGEECIQEDELMNLLAKKPQPVCYDGFEPSGRMHIAQGVLKALNVNKLTSAGCKVKIWIADWFAQLNNKMGGDLKKIEVVGQYLIEIWKAVGMNLEGGHVEFLWSSKEINSRAHEYWPLVMDVARRNKLPRILRCCQIMGRSEQDELTAAQIFYPCMQCADIFFLKADICQLGMDQRKVNVLAREYCDDIRRKNKPIILSHHMLPGLQEGQEKMSKSDPSSSIYMEDEEADVNLKIKKAFCPPKVVEKNPCLEYIKYIVLPWFNEFKIERSAENGADKTYKNFEELAADYESGNLHPADLKPALSKAINKILQPVRDHFKNDQKAKDLMKRVKSFKVTR

SEQ ID NO: 2287 - protein, 413 aa, Ricinus communis
MSTEEDKIAPSEEMQSLSVNSASPSSSSQTMSPEERFQIVRGIGEECIQEDELLNLLTKKPQPICYDGFEPSGRMHIAQGVMKTINVNKLTSAGCKVKIWIADWFAQLNNKMGGDLKKIQTVGRYFVEIWKAAGMDLDGGKVEFLWSSEEINSRAAEYWPLVMDIARRNKLPRILRCVQIMGRSEQDELTAAQILYPCMQCADIFFLKADICQLGMDQRKVNVLAREYCDDIKRKNKPIILSHHMLPGLQEGQDKMSKSDPSSSIFMEDEEAEVNLKIKKAFCPPQQVEKNPCLEYLKYIIFPWFNEFKVERSEKNGGEKTYESFEKLVADYESGELHPGDLKPALSKAINMILKPVRDHFNNDANAKDLLKRVKSNTIRQKRMFTVGVNHLKGNSLGVLMLLWIHWRQCLEC

SEQ ID NO: 2288 - protein, 385 aa, Vitis vinifera
MESEASDPTPNMQSLSVNDSQNHDSASSSNPAPAMTLEEKFRIVRSVGEECIQEDELMNLLRNKPEPICYDGFEPSGRMHIAQGVMKTISVNKLTSAGCRVKIWIADWFAQLNNKMGGDLKKIETVGRYLIEIWKAVGMDLDGGKVEFLWSSKEINARAHEYWPRVMDIARRNKLPRIMRCVQIMGRSEQEELSAAQILYPCMQCADIFFLKADICQLGMDQRKVNVLAREYCDDIKMKNKPIILSHHMLPGLQQGQEKMSKSDPSSSIFMEDEEAEVNVKIKKAYCPPKVVEGNPCLEYVNYIIFPWFNEFKVERKAENGGDKIFKSYEELIADYENGELHPGDLKPSLSKALNKILQPVRDHFANDSNAKDLLKRVKAYRVTR

SEQ ID NO: 2289 - protein, 385 aa, Vitis vinifera
  misc_feature (19)..(19): Xaa can be any naturally occurring amino acid
MESEASDPTPNMQSLSVNXSQNHDSASSSNPAPAMTLEEKFRIVRSVGEECIQEDELMNLLRNKPEPICYDGFEPSGRMHIAQGVMKTISVNKLTSAGCRVKIWIADWFAQLNNKMGGDLKKIETVGRYLIEIWKAVGMDLDGGKVEFLWSSKEINARAHEYWPRVMDIARRNKLPRIMRCVQIMGRSEQEELSAAQILYPCMQCADIFFLKADICQLGMDQRKVNVLAREYCDDIKMKNKPIILSHHMLPGLQQGQEKMSKSDPSSSIFMEDEEAEVNVKIKKAYCPPKVVEGNPCLEYVNYIIFPWFNEFKVERKAENGGDKIFKSYKELIADYENGELHPGDLKPSLSKALNKILQPVRDHFANDSNAKDLLKRVKAYRVTR

SEQ ID NO: 2290 - protein, 306 aa, Zea mays
  misc_feature (17)..(17): Xaa can be any naturally occurring amino acid
MATPLDVPLDDLIKSRXGRGTGRGRGQGGGRGRGDGQRLARGSWRGRGTGNFRERGLGVSSRRPLGVNTWSSSFAIAKSFNKAKDFVWRHDLFEDSMVAAGLSGIESGTKLYISNLHYGVTSEDLQELFSEMGHLKHCAVHYDSYRHPTGSAEVIFTRRSEALAALKRYNNMRLDGKAMKIEVIGAELGLSAAAVPQISVVPGASRRGQREVVMMPGGSGFGQGASGPSSSLPGWKRGGFVRRGQGRVSFPQRGRGQVRSRGRGRGRSSLVQSRGRGYVRRGNAEKSAKQLDNELDNYNSGAMNVD

SEQ ID NO: 2291 - protein, 306 aa, Zea mays
MATPLDVPLDDLIKSRAGRGTGRGRGQGGGRGRGDGQRLARGSWRGRGTGNFRERGLGVSSRRPLGVNTWSSSFAIAKSFNKAKDFVWRHDLFEDSMVAAGLSGIESGTKLYISNLHYGVTSEDLQELFSEMGHLKHCAVHYDSYRHPTGSAEVIFTRRSEALAALKRYNNMRLDGKAMKIEVIGAELGLSAAAVPQISVVPGASRRGQREVVMMPGGSGFGQGASGPSSSLPGWKRGGFVRRGQGRVSFPQRGRGQVRSRGRGRGRSSFVQSRGRGYVRRGNAEKSAKQLDNELDNYNSGAMNVD

SEQ ID NO: 2292 - protein, 307 aa, Sorghum bicolor
MATSLDVPLDDLIKSRNGRGRGRGRGQGGRGRGDGQRLARGSWRGRGTGTFRGRGLGVPSRRPLGVNTRSSSFAIAKSFNKAKDFVWRHDLFEDSMVAAGLSGIESGTKLYISNLHYGVTREDIQELFSEMGHLKHCAVHYDSYRHPTGSAEVIFTRRSEALAALKRYNNVRLDGKAMKIEVIGADLGLSSAAAPRISVVPGASGRGQREVVMMPGGSGFGLGASGPSSSLPGWKRGGFVQRGGQGRGGFAQRGRGQVRGRGRGRGRSSFGQVRGRGYVRKGNVEKSAEQLDKDLDNYHHSGAMNVD

SEQ ID NO: 2293 - protein, 694 aa, Zea mays
MASGSDAPKQYGITKPLSLLGPVEADLQRTEELEKFLLESGLYESPDESARREEVLGKLDQIVKDWVKQLTSQRGYTDQMVEEANAVLFTFGSYRLGVHGPGADIDTLCVGPSYVNREEDFFIVLHGILAQTEDVTELQPVPDAHVPVMKFKFHGISIDLLYASVSLLVVPADLDISQGSVLYDVDEATVRSLNGCRVADQIIRLVPNFENFRTALRCLKYWAKRRGVYSNVTGFLGGVNWALLVARVCQLYPNAVPSMLVSRFFRVFTQWQWPNPVMLCSIEEEELGFPVWDPRKNPRDRCHHMPIITPAYPCMNSSYNVSTSTLRVMLEQFQFGNRICQEIEMNKTSWPALFEPFQFFEAYKNYLQVDIIAEDDEDLRLWKGWVESRLRQLTLKIERDTYGMLQCHPYPHEYADPSRQCAHCAFFMGLSRKEGVKIQEGQQFDIRGTVDEFRHEINMYMFWKPGMELAVSHVRRKQVPAYVFPEGYKRPRPSRHVNHQSDKNDTEDGTATRSPDSQLKRKHDSVGTDDIRYAKRSSTSPVHPKNSPQSGSTGDETRCNNQIKRAPSDASGGSPASPQASERSPDTILSAPRCTTTGAVCSGDAISKHSSVPLVENCTTPTVAVCTTLKRVAEKVVSELVGSERLGSNNSAELLESMEKEDVLAENVRFGGNGVAQGGLPEELEPNNRIEAVS

SEQ ID NO: 2294 - protein, 740 aa, Oryza sativa Japonica Group
MAACNAAAAAAVAEQPQKQYGITKPISLAEPAEVDLQKTAELEKFLVEAGLYESPEESARREEVLGELDKIVKDWVKQLTSQRGYTDQMVEEANAVLFTFGSYRLGVHGPGADIDTLCVGPSYVNREEDFFIVLHDILAQTEEVTELQPVPDAHVPVMKFKFHGISIDLLYASVSLLVVPPDLDISQGSVLYDVDEVTVRSLNGCRVADQILRLVPNVENFRTTLRCLKYWAKKRGVYSNVTGFLGGVNWALLVARVCQLYPNAVPSMLVSRFFRVFTQWQWPNPVMLCAIEEDELGFPVWDPRKYHRDRSHHMPIITPAYPCMNSSYNVSTSTLRVMMEQFQFGNKICQEIDISKANWSALFEPFQFFEAYKNYLQVDIIAEDGEDLRLWKGWVESRLRQLTLKIERDTYGMLQCHPYPHEYADPSRQCAHCAFFMGLSRKEGAKIQEGQQFDIRGTVDEFRHDIGMYGYWRPGMELAVSHVRRKQIPSYVFPEGYKRPRPSRHINHPQQSNKNDVEDGTANRSPDGQPKRKHDTAGVYDSEPGRSVKRASISPSISPVHQKTSSPPSGNIADASGASGGSPVSLANGNLEQANCLNSPLASEKSLDSVTSGSKCVGVEAVCPSDATKEHDNCGSNMKNCTTTTVAVSLKRVAEKVVSELVGSESLGGNKSGELLERAEDMGSALVENVHFGGNGVVQTGLPEELEPNNGIEVVSKAHAGVNSDAPQKASLRVSLTSTA

SEQ ID NO: 2295 - protein, 694 aa, Hordeum vulgare subsp. vulgare
MATSNKPISLAGPLDADVQRTAELNKFLVEAGLYESADESARREEVLGELDKIVKVWVKQLTSQRGYTDQMVEEANAVLFTFGSYRLGVHGPGADIDTLCVGPSYVNREEDFFIVLHDILAQTEEVSQLQPVPDAHVPVMKFKFHGISIDLLYASVSLLVVPSDLDISQEAVLYDIDEATVRSLTGCRVADQILRLVPNIESFRTTLRCLKHWARRRGVYSNVTGFLGGVNWALLVARVCQLYPNAVPSMLVSRFFRVFTQWRWPTPVMLCAIEEEELGFPVWDPRKNPRDRTHHMPIITPAYPCMNSSYNVSTSTLRVMIEQFQFGNKICQEIEMNKASWSALFEPFNFFEAYKNYLQVDIIAEDDEDLRLWKGWVESRLRQLTLKIERDTYGKLQCHPYPYEYADPSRQCAHCAFFMGLSRKEGVKIQEGQQFDIRGTVDEFRHEINMYMFWKPGMELAVSHVRRKEIPAYVFPEGYKRPRPQRHVNHQHQSDKNDPGNGSPDSQLKRKHDSTGIDDTEPCQSVKRASISPGHPKTSSPRSGNVSDEPISNSQQKVTSNASGGSQDSPGSGNQDQTKCSGSSHASEKSLDSVASGSKCVKIEAVCSGDVTSKHVDCISPVKDSIAPTVAVSTTLKRVAEKVVLELVGSESMGGNNAELLQIAETDMGNVLVENLHFGGNGVPQSGLPEELEV

SEQ ID NO: 2296 - protein, 708 aa, Oryza sativa Japonica Group
MAACNAAAAAAVAEQPQKQYGITKPISLAEPAEVDLQKTAELEKFLVEAGLYESPEESARREEVLGELDKIVKDWVKQLTSQRGYTDQMVEEANAVLFTFGSYRLGVHGPGADIDTLCVGPSYVNREEDFFIVLHDILAQTEEVTELQPVPDAHVPVMKFKFHGISIDLLYASVSLLVVPPDLDISQGSVLYDVDEVTVRSLNGCRVADQILRLVPNVENFRTTLRCLKYWAKKRGVYSNVTGFLGGVNWALLVARVCQLYPNAVPSMLVSRFFRVFTQWQWPNPVMLCAIEEDELGFPVWDPRKYHRDRSHHMPIITPAYPCMNSSYNVSTSTLRVMMEQFQFGNKICQEIDISKANWSALFEPFQFFEAYKNYLQVDIIAEDGEDLRLWKGWVESRLRQLTLKIERDTYGMLQCHPYPHEYADPSRQCAHCAFFMGLSRKEGAKIQEGQQFDIRGTVDEFRHDIGMYGYWRPGMELAVSHVRRKQIPSYVFPEGYKRPRPSRHINHPQQSNKNDVEDGTANRSPDGQPKRKHDTAGVYDSEPGRSVKRASISPSISPVHQKTSSPPSGNIADASGASGGSPVSLANGNLEQANCLNSPLASEKSLDSVTSGSKCVGVEAVCPSDATKEHDNCGSNMKNCTTTTVAVSLKRVAEKVVSELVGSESLGGNKSGELLERAEDMGSALVENVHFGGNGVVQTGLPEELEV

SEQ ID NO: 2297 - protein, 708 aa, Oryza sativa Indica Group
MAACNAAAAAAVAEQPQKQFGITKPISLAEPAEVDLQKTAELEKFLVEAGLYESPEESARREEVLGELDKIVKDWVKQLTSQRGYTDQMVEEANAVLFTFGSYRLGVHGPGADIDTLCVGPSYVNREEDFFIVLHDILAQTEEVTELQPVPDAHVPVMKFKFHGISIDLLYASVSLLVVPPDLDISQGSVLYDVDEVTVRSLNGCRVADQILRLVPNVENFRTTLRCLKYWAKKRGVYSNVTGFLGGVNWALLVARVCQLYPNAVPSMLVSRFFRVFTQWQWPNPVMLCAIEEDELGFPVWDPRKYHRDRSHHMPIITPAYPCMNSSYNVSTSTLRVMMEQFQFGNKICQEIDISKANWSALFEPFQFFEAYKNYLQVDIIAEDGEDLRLWKGWVESRLRQLTLKIERDTYGMLQCHPYPHEYADPSRQCAHCAFFMGLSRKEGAKIQEGQQFDIRGTVDEFRHDIGMYGYWRPGMELAVSHVRRKQIPSYVFPEGYKRPRPSRHINHPQQSNKNDVEDGTANRSPDGQPKRKHDTAGVYDSEPGRSVKRASISPSISPVHQKTSSPPSGNIADASGASGGSPVSLANGNLEQANCLNSPLASEKSLDSVTSGSKCVGVEAVCPSDATKEHDNCGSNMKNCTTTTVAVSLKRVAEKVVSELVGSESLGGNKSGELLERAEDMGSALVENVHFGGNGVVQTGLPEELEV

SEQ ID NO: 2298 - protein, 761 aa, Oryza sativa Japonica Group
MAACNAAAAAAVAEQPQKQYGITKPISLAEPAEVDLQKTAELEKFLVEAGLYESPEESARREEVLGELDKIVKDWVKQLTSQRGYTDQMVEEANAVLFTFGSYRLGVHGPGADIDTLCVGPSYVNREEDFFIVLHDILAQTEEVTELQPVPDAHVPVMKFKFHGISIDLLYASVSLLVVPPDLDISQGSVLYDVDEVTVRSLNGCRVADQILRLVPNVEDSSLMMSICLMVELSNNAKVTGFLGGVNWALLVARVCQLYPNAVPSMLVSRFFRVFTQWQWPNPVMLCAIEEDELGFPVWDPRKYHRDRSHHMPIITPAYPCMNSSYNVSTSTLRVMMEQFQFGNKICQEIDISKANWSALFEPFQFFEAYKNYLQVDIIAEDGEDLRLWKGWVESRLRQLTLKIERDTYGMLQCHPYPHEYADPSRQCAHCAFFMGLSRKEGAKIQEGQQFDIRGTVDEFRHDIGMYGYWRPGMELAVSHVRRKQIPSYVFPEGYKRPRPSRHINHPQQSNKNDVEDGTANRSPDGQPKRKHDTAGVYDSEPGRSVKRASISPSISPVHQKTSSPPSGNIADASGASGGSPVSLANGNLEQANCLNSPLASEKSLDSVTSGSKCVGVEAVCPSDATKEHDNCGSNMKNCTTTTVAVSLKRVAEKVVSELVGSESLGGNKSGELLERAEDMGSALVENVHFGGNGVVQTGLPEELEICKQGGLLREDGDKIIMSSNDKGSNQGSFITGKIVESCAENPLDLRQVLQSFACAP

SEQ ID NO: 2299 - protein, 760 aa, Oryza sativa Indica Group
MAACNAAAAAAVAEQPQKQYGITKPISLAEPAEVDLQKTAELEKFLVEAGLYESPEESARREEVLGELDKIVKDWVKQLTSQRGYTDQMVEEANAVLFTFGSYRLGVHGPGADIDTLCVGPSYVNREEDFFIVLHDILAQTEEVTELQPVPDAHVPVMKFKFHGISIDLLYASVSLLVVPPDLDISQGSVLYDVDEVTVRSLNGCRVADQILRLVPNVEDSSLMMSICLMVELSNNAKVTGFLGGVNWALLVARVCQLYPNAVPSMLVSRFFRVFTQWQWPNPVMLCAIEEDELGFPVWDPRKYHRDRSHHMPIITPAYPCMNSSYNVSTSTLRVMMEQFQFGNKICQEIDISKANWSALFEPFQFFEAYKNYLQVDIIAEDGEDLRLWKGWVESRLRQLTLKIERDTYGMLQCHPYPHEYADPSRQCAHCAFFMGLSRKEGAKIQEGQQFDIRGTVDEFRHDIGMYGYWRPGMELAVSHVRRKQIPSYVFPEGYKRPRPSRHINHPQQSNKNDVEDGTANRSPDGQPKRKHDTAGVYDSEPGRSVKRASISPSISPVHQKTSSPPSGNIADASGASGGSPVSLANGNLEQANCLNSPLASEKSLDSVTSGSKCVGVEAVCPSDAKEHDNCGSNMKNCTTTTVAVSLKRVAEKVVSELVGSESLGGNKSGELLERAEDMGSALVENVHFGGNGVVQTGLPEELEICKQGGLLREDGDKIIMSSNDKGSNQGSFITGKIVESCAENPLDLRQVLQSFACAP

SEQ ID NO: 2300 - protein, 588 aa, Sorghum bicolor
MAIRAGRSVLHLLTLAFLLILAASPCLQARVDHRKHISDWSRQPNFELQNISSSRKDGPHLLSRSEEITHRKLRGRIGVRKKMEVMQQDDEALVKLENAGIERSKAVDSAVLGKYSIWRRENENEKADSRVRLMRDQMIMARIYSVLAKSRDKLDLYQELLARLKESQRSLGEATADAELPKSASDRIKAMGQVLSKARDLLYDCKEITERLRAMLQSADEQVRSLKKQSTFLSQLAAKTIPNGIHCLSMRLTIDYYLLSPEKRKFPNSENLENPDLYHYALFSDNVLAASVVVNSTIMNAKEPEKHVFHLVTDKLNFGAMNMWFLLNPPGDATIHVENVDDFKWLNSSYCPVLRQLESAAMREYYFKAGPKTLSAGSSNLKYRNPKYLSMLNHLRFYLPQVYPKLNKILFLDDDIVVQRDLTGLWEVDLNGNVNGAVETCGESFHRFDKYLNFSNPNISQNFDPNACGWAYGMNMFDLEEWKNKDITGIYHKWQNMNENRLLWKLGTLPPGLLTFYKLTHPLDKSWHVLGLGYNPTIERSEIDNAAVIHYNGNMKPWLEIAMTKYRPYWTKYINYEHPYIHGCKISQ

SEQ ID NO: 2301 - protein, 590 aa, Zea mays
MAIRAGRSALHLHALAFLILAASPCLQVQALVDHRKQISDWGRQPNFELQNMSSSQRDGSHLLGRSKEITHRKLRGRIGVRNKMEVVQQDDEALVKLENTGIERSKAVDSAVLGKYSIWRRENENEKADSRVRLMRDQMIMARIYSVLAKSRGKLDLYQELLARLKESQRSLGEATADAELPKSASDRIKAMGQVLSKARDLLYDCKEITQRLRAMLQSADEQVRSLKKQSTFLSQLAAKTIPNGIHCLSMRLTIDYYLLSPEKRKFPNSENLENPDLYHYALFSDNVLAASVVVNSTIMNAKEPEKHVFHLVTDKLNFGAMNMWFLLNPPGDATMHVENVDDFKWLNSSYCPVLKQLESAAMKEYYFKADRPKTLSAGSSNLKYRNPKYLSMLNHLRFYLPQVYPKLNKILFLDDDIVVQRDLTGLWEVDLNGNVNGAVETCGESFHRFDKYLNFSNPNIAQNFDPNACGWAYGMNMFDLEEWKKKDITGIYHKWQNMNENRLLWKLGTLPPGLLTFYKLTHPLDKSWHVLGLGYNPTVERSEIDNAAVIHYNGNMKPWLEIAMTKYRPYWTKYINYEHPYIHGCKFSQ

SEQ ID NO: 2302 - protein, 588 aa, Zea mays
MAIRAGRSPLLHLLALAFLILAASPCLQARVDHRKQISHWTGQPNFDLQNVSSGRKDGPHLLGRSKEITHMKLRRVAVRKKMEVVQQDDEALVKLENAGIERSKAVDSAVLGKYSIWRRENENEKADSRVRLMRDQMIMARIYSVLAKSRDKLDLYQELLARLKESQRSLGEATADAELPKSASDRTKAMGQVLSKARDLLYDCKEITQRLRAMLQSADEQVRSLKKQSTFLSQLAAKTIPNGIHCLSMRLTIDYYLLSPEKRKFPNSENLENPDLYHYALFSDNVLAASVVVNSTIMNAKEPEKHVFHLVTDKLNFGAMNMWFLLNPPGDATIHVENVDDFKWLNSSYCPVLKQLESAAMKEYYFKADRPKTLSAGSSNLKYRNPKYLSMLNHLRFYLPQVYPKLNKILFLDDDIVVQRDLTGLWEVDLNGNVNGAVETCGESFHRFDKYLNFSNPNIAQNFDPNACGWAYGMNMFDLEEWKKKDITGIYHKWQNMNENRLLWKLGTLPPGLLTFYKLTHPLDKSWHVLGLGYNPTIERSEIDNAAVIHYNGNMKPWLEIAMIKYRPYWTKYINYQHSYIHGCKISQ

SEQ ID NO: 2303 - protein, 588 aa, Oryza sativa Indica Group
MAGARAMAFVALCALAAFPVAVTGAQVDPLYSSKQVLDWSSQANIKLQNFSLTEEDGLQLLVRPEEVTHRKLRERTRIKKKIEPVQQDDEALVKLENAGIERSKAVDSAVLGKYSIWRRENENEKADSKVRLMRDQMIMARIYSVLAKSRDKLDLHQDLLSRLKESQRSLGEATADAELPKSASERVKVMGQLLAKARDQLYDCKAITQRLRAMLQSADEQVRSLKKQSTFLSQLAAKTIPNGIHCLSMRLTIDYYLLSPEKRKFPKSENLENPDLYHYALFSDNVLAASVVVNSTIMNAKEPEKHVFHLVTDKLNFGAMNMWFLLNPPGDATIHVENVDDFKWLNSSYCPVLKQLESVAMKEYYFKADRPKTLSAGSSNLKYRNPKYLSMLNHLRFYLPQVYPKLNKILFLDDDIVVQKDLTGLWEVDLNGNVNGAVETCGESFHRFDKYLNFSNPNIAQNFDPNACGWAYGMNMFDLEEWKKKDITGIYHKWQNMNENRLLWKLGTLPPGLLTFYKLTHPLDKSWHVLGLGYNPSIERSEIDNAAVIHYNGNMKPWLEIAMSKYRPYWTKYINYEHTYVRGCKISQ

SEQ ID NO: 2304 - protein, 591 aa, Hordeum vulgare subsp. vulgare
MPRAVSLAALCLLLLLLHLHLHLAAAAGARVDPIYSGKLVPDWSRQPKFKPQNFSLNREDSLELLSRPRYVTRRKLGERTGVIKMETVQQDDEALVKLENAGIERSKAVDSAVLGKYSLWRRENENEKADANVRLMRDQMIMARIYSVLAKSRDKLDLYRELLARIKESQRSLGEATADAELPKSASERAKAMGQVLSKARDQLYDCKEITHRLRSMLQSADEQVRSLKKQSTFLSQLAAKTIPNSIHCLSMRLTIDYYLLSPEKRKFPNSENLEDPDLYHYALFSDNVLAASVVVNSTIVNAKEPEKHVFHLVTDKLNFGAMNMWFLLNPPGDATIHVENVDDFKWLNSSYCPVLKQLESAAMKEYYFKADRQKTLSAGSSNLKYRNPKYLSMLNHLRFYLPQVYPKLNKILFLDDDIVVQKDLTGLWEVDLNGNVNGAVETCGESFHRFDKYLNFSNPNISQNFDPNACGWAYGMNMFDLEEWKKKDITGIYHKWQNMNENRLLWKLGTLPPGLMTFYKLTHPLDKSWHVLGLGYNPTVEHAEIDTAAVIHYNGNMKPWLEIAMTKYRPYWTKYINYEHSYVRGCKISQ

SEQ ID NO: 2305 - protein, 688 aa, Hordeum vulgare subsp. vulgare
MASPKRLPYSSAGAGGGGGARRGSGAVPPVVVLVFLFVVAPSIFFVARSGGHVHVASDPRGADGNQETDWQEQLATDNLKSVLSKEVIDAIAASQQETGTLNLDFFRDHPSPSWKTDDLVDHKMNANLVVDDKAKAQNSSADHVIPLTHKAPKDGSDGHQVDTAAKMARRKLREARREKRAIDLVRKDDEALVKLENAAIERSKAVDSAVLGKYSIWRKENENENSDSTVRLMRDQIIMARVYSVLAKSRNKHGIYQELQSRIKESQRAVGEATADADLHHSAPDKIRVMGQVLTKAREELYDCKVISQRLRAMLQSADEQVRSLKKQSTFLSQLAAKTIPNSIHCLSMRLTIDYYLLPLEKRKFPRSENLENPELYHYALFSDNVLAASVVVNSTIMNAKEPEKHVFHLVTDKLNFGAMNMWFLLNPPGKATIHVENVDEFKWLNSSYCPVLRQLESVAMKEYYFKADRPATLSAGSSNLKYRNPKYLSMLNHLRFYLPQIYPKLDKILFLDDDIVVQKDLTGLWDVDLNGMVNGAVFTCGESFHRFDKYLNFSNPHIARNFDPNACGWAYGMNIFDLKQWKNKDITGIYHKWQNMNEDRVLWKLGTLPPGLMTLYKLTHPLDKSWHVLGLGYNPSIDRSEIDNAAVAHYNGNMKPWLELAMTKYRPYWTRYIKYDHPYIRGCNLSE

SEQ ID NO: 2306 - protein, 695 aa, Oryza sativa Japonica Group
MANSKRLPYSTAGGGGGGGGGGGRRGGASGSGVVAPLVVLVFLFVLAPSIFFVARNGGHVHVASDPKDREGNQETDWQKQLATNNLKSILSKEMIDALASSQQEAGTLSVDFFRKRASPSWKTDDLVNDLSNASLDVDDKVKSENSSAEHELSLTDKTPKDDTAEHQVDAPAKNARRKLREKRREKRAMDLVRKDDEARVKLENAAIERSKAVDSAVLGKYSIWRKENENENSDSTVRLMRDQIIMARVYSVLAKSKNKNDLYQELQTRIKESQRAVGEATADSDLHHSAPEKVRVMGQLLSKAREDVYDCKAVTQRLRAMLQSADEQVRSLKKQSTFLSQLAAKTIPNSIHCLSMRLTIDYYLLPLEKRKFPRSENLENPELYHYALFSDNVLAASVVVNSTIMNAKEPEKHVFHLVTDKLNFGAMNMWFLLNPPGKATIHVENVDEFKWLNSSYCPVLRQLESAAMKEYYFKADRPTTLSAGSSNLKYRNPKYLSMLNHLRFYLPQVYPKLDKILFLDDDIVVQKDLTGLWDVDLNGKVNGAVETCGESFHRFDKYLNFSNPHIARNFDPNACGWAYGMNIFDLKEWKKKDITGIYHKWQSMNEDRVLWKLGTLPPGLLTFYKLTHPLDKSWHVLGLGYNPSIDRSEIDNAAVVHYNGNMKPWLELAMTKYRPYWTRYIKYDHPYIRGCNLAE

SEQ ID NO: 2307 - protein, 695 aa, Oryza sativa Indica Group
MANSKRLPYSTAGGGGGGGGGGGRRGGASGSGVVAPLVVLVFLFVLAPSIFFVARNGGHVHVASDPKDREGNQETDWQKQLATNNLKSILSKEMIDALASSQQEAGTLSVDFFRKRASPSWKTDDLVNDLSNASLDVDDKVKSENSSAEHELSLTDKTPKDDTAEHQVDAAAKNARRKLREKRREKRAMDLVRKDDEARVKLENAAIERSKAVDSAVLGKYSIWRKENENENSDSTVRLMRDQIIMARVYSVLAKSKNKNDLYQELQTRIKESQRAVGEATADSDLHHSAPEKVRVMGQLLSKAREDVYDCKAVTQRLRAMLQSADEQVRSLKKQSTFLSQLAAKTIPNSIHCLSMRLTIDYYLLPLEKRKFPRSENLENPELYHYALFSDNVLAASVVVNSTIMNAKEPEKHVFHLVTDKLNFGAMNMWFLLNPPGKATIHVENVDEFKWLNSSYCPVLRQLESAAMKEYYFKADRPTTLSAGSSNLKYRNPKYLSMLNHLRFYLPQVYPKLDKILFLDDDIVVQKDLTGLWDVDLNGKVNGAVETCGESFHRFDKYLNFSNPHIARNFDPNACGWAYGMNIFDLKEWKKKDITGIYHKWQSMNEDRVLWKLGTLPPGLLTFYKLTHPLDKSWHVLGLGYNPSIDRSEIDNAAVVHYNGNMKPWLELAMTKYRPYWTRYIKYDHPYIRGCNLAE

SEQ ID NO: 2308 - protein, 683 aa, Sorghum bicolor
MPTPKQRLPYSTSGGGGGGGRRAASSSAALPPVVVLVFLFVVAPSLFFVARNGGRGHVHVASDPKGKNVDQEAAAMKNLKSILPKEVFDAITASQQESGTLSLDFFRNHASPSWKTDDLVTEKSMDVDDKAKAENSLPEHDLPTNRSPKDPDEHQVDKAAKVARRKLREKRREKRTMDLVHKDDEARAKLENAAIERSKAVDSAVLGKYSIWRKENENENSDSTVRLMRDQVIMARVYSVLAKSKNKNDLYQKLQTRIKESQRAVGEASADADLHHSAPEKIRAMGQVLSKAREELYDCMAITQRLRAMLQSADEQVRSLKKQSTFLSQLAAKTIPNSIHCLSMRLTIDYYLLPLEEWKFPRSENLENPNLYHYALFSDNVLAASVVVNSTIMNAKEPEKHVFHLVTDKLNFGAMNMWFLLNPPGKATIHVENVDEFKWLNSSYCPVLRQLESAAMKEYYFKADRPTTLSAGSSNLKYRNPKYLSMLNHLRFYLPEVYPKLDKILFLDDDIVVQKDLTGLWDVDLNGKVNGAVETCGESFHRFDKYLNFSNPHIARNFDPNACGWAYGMNIFDLREWKKKDITGIYHKWQNLNEDRALWKLGTLPPGLLTFYKLTHPLDKSWHVLGLGYNPSIDRSEIDSAAVVHYNGNMKPWLELAMTKYRPYWTKYIKYDHPYIRGCNLSE

SEQ ID NO: 2309 - protein, 681 aa, Vitis vinifera
MALRRGLSGAALQRNRPSRSRLPLAVVISLSLLAPLIFFVGRGIYTIDHTDVTSSSSKQDVDWRERLALQHIKSLLSKEVIDIITATTDDLGPFSLDYFRKSNLSASWKVVGLGTSVENNTSSLEPNQMGPAVKQERPGGKQDKYSGGDHSQFIDSPAKLVRRQLREKRRDKRAADLVRQDDEATVKLENAAIERSKSVDSAVLGKYSIWRKENDNENTDSTVRLMRDQMIMARVYASIAKMKNKLDLQQELLARLKESQRSLGEASADSDLHHSAPEKIKAMGQVLSKAKEQLYDCKLVTGKLRAMLQSADEQVRSLKKQSTFLSQLAAKTIPNGIHCLSMRLTIEYYLLPPEKRRFPRSENLENPNLYHYALFSDNVLAASVVVNSTILNAKEPEKHVFHLVTDKLNFGAMNMWFLLNPPGKATIHVENVDEFKWLNSSYCPVLRQLESAAMKAFYFNQGHPSTLSSGSSNLKYRNPKYLSMLNHLRFYLPEVYPKLDKILFLDDDIVVQKDLTGLWSVNLHGKVNGAVETCGESFHRFDKYLNFSNPHIARNFDPNACGWAYGMNIFDLKEWTRRDITGIYHKWQNMNEDRTLWKLGTLPPGLITFYKLTHPIEKSWHVLGLGYNPSIDKSDIENAAVIHYNGNMKPWLELAMTKYRSYWTKYIKYDHPYLRSCNLSE

SEQ ID NO: 2310 - protein, 468 aa, Sorghum bicolor
MIAAAAEKSPEREAEESNPRAEAFLDIICRVPAGEVEAALSACGIGPTAEVAELVLKSCECYKRPKSAVRFFRWAGLSLSHTAYAWNLLVDILGKAAMFEPMWDAIRSMHQEGGGRLVSVATFASVFASYCASGNLKDAIAALDVMDRYGLKPDAVALNSLLSAICRVEGRAQAAHDVFERTKATIPPDADTFAILLEACEKEGNAMRAKSVFGEMVVRVGWDAANVPAYDSFLSTLVRGGLFDEAFKFLQVMRSKGCLPGIKFFATAVDLVVLKRDYPNAVAIWNLMVSEAGLVPNFSMYNAMIGLYCNAGAMDYALGMLDEMPLNGVFANSVTYNTILEGFIKHCKAREAERFLTEMSKNEQLPTASNCAAAISLFFKEFNPSAAIDVWRCIVEHNITPAEDSAKELIAGLLDFGRLTEVERRADEMIDMRVELSRSTMDNMKRAFAKAQRHQSYDRIARRLKRHT

SEQ ID NO: 2311 - protein, 467 aa, Zea mays
MITAEEKSPEREEEEEANPRAEAFLEIICRVPAGEVEAALSACGIGPTAEVEELVLKSRECYKRPKSAVRFFRWAGQSVSHTAYAWNLLVDILGKAAMFEPMWDAIRSMKQEGGGGLVSVATFASVFASYCAAGNIKDAIAALDVMDRYGLKHDAVALNSLLSAICRVEGRAQDAQDVFERTKATIPPDGDTFAILLEAWEKEGNAVRAKSVFGEMVVRIGWDAANVSAYDSFLSTLVRGGLLDEAFKFLQVMRSKGCLPGINFFSTAVDLVVRKGDYLNAVAIWHMMVSEAGLVPNFSMYSAMIGLHCNAGSIDDALGLLDEMPLNGVFANSVTYNTILEGFIKHRKAREAESFLTEMSKNEQLPTASNCAAAISLFFKEFNPSAAIDVWRCIVEHNITPAEDSAKELIAGLLDFGRFTEVTKRADEMIDMRVELSRSTMENMKRAFAKAGRHQSYDNIARRLKRY

SEQ ID NO: 2312 - protein, 468 aa, Zea mays
MITAEEKSPEREEEEEEANPRAEAFLEIICRVPAGEVEAALSACGIGPTAEVEELVLKSRECYKRPKSAVRFFRWAGQSVSHTAYAWNLLVDILGKAAMFEPMWDAIRSMKQEGGGGLVSVATFASVFASYCAAGNIKDAIAALDVMDRYGLKHDAVALNSLLSAICRVEGRAQDAQDVFERTKATIPPDGDTFAILLEAWEKEGNAVRAKSVFGEMVVRIGWDAANVSAYDSFLSTLVRGGLLDEAFKFLQVMRSKGCLPGINFFSTAVDLVVRKGDYLNAVAIWHMMVSEAGLVPNFSMYSAMIGLHCNAGSIDDALGLLDEMPLNGVFANSVTYNTILEGFIKHRKAREAESFLTEMSKNEQLPTASNCAAAISLFFKEFNPSAAIDVWRCIVEHNITPAEDSAKELIAGLLEFGRFTEVTKRADEMIDMRVELSRSTMENMKRGFAKAGRHQSYDNIARRLKRY

SEQ ID NO: 2313 - protein, 464 aa, Oryza sativa Japonica Group
MSAATEEGRPDGEEDSPRAEAFLEILGRVQPGDAEAELSSCGIGPTAEVAEQVLRSRVCYSRPKSAVRFFVWSGRSVKHTGYAWNLLVDILGKADMEEPMWDAVRTMNKEGGGLVTVATFASIFSSYCASGNLRKAVEAFDVMGKYGVEPDAVALNSLLSAMCRGEGRAQAAQDLFERTKATVAPDADTFGILLEAWEKEGNAQRAKSTFGEMIVRVGWDAGNMPAYDAFLSTLVRGDQFGEALKFLQVMRSKGCLPGLKFFARAIDLVVRKRDYANSLAIWQMMISDAGLVPNLPMYNAMIDLCCSVGDTDYALRMLDEMPFNGVFADFITYNAILEGLIKQRKAREAEAFLAEMSKNEQLPSPTNCAAAISMFSKEFNPSAAIDVWHCIVEHQITPADESARELIVGLLDFGRFAEVKKYTDEMLDMGIELPQSTIDNMKRTFDKVGKHHTYDHIARRPKRC

SEQ ID NO: 2314 - protein, 467 aa, Zea mays; identical to SEQ ID NO: 2311

SEQ ID NO: 2315 - protein, 468 aa, Zea mays; identical to SEQ ID NO: 2312

SEQ ID NO: 2316 - protein, 468 aa, Sorghum bicolor; identical to SEQ ID NO: 2310

SEQ ID NO: 2317 - protein, 464 aa, Oryza sativa Japonica Group; identical to SEQ ID NO: 2313

SEQ ID NO: 2318 - protein, 281 aa, Sorghum bicolor
MSGLYSQGFSPARTLSPQIRSNPDADSQYLAELLAEHQKLGPFMQVLPICSRLLNQEIMRVSSMVHDHGFSDLDRRRFRSPSPMSSPIVRPNLHGNGFGPWNGMHQERLGLPPPGTSMDWQGAPPSPGSYIVKKIVRLEVPVDSYPNFNFVGRILGPRGNSLKRVEASTGCRVFIRGKGSIKDTEKEEKLKGKPGYEHLNEPLHILIEAELPANVIDTRLRQAQEVMEELLKPVEESQDFYKRQQLRELAMLNSTLREDSPHPGSVSPFSNGGMKRAKPSQ

SEQ ID NO: 2319 - protein, 281 aa, Zea mays
MSGLYSQGFSPARTLSPQIRSNPDADSQYLAELLAEHQKLGPFMQVLPICSRLLNQEIMRVSSMVHDHGFSDLDRRRFRSPSPMSSPIVRPNLHGNGFGPWNGMHQERLGFPPPGTSMDWQGAPPSPGSYIVKKIVRLEVPVDSYPNFNFVGRILGPRGNSLKRVEASTGCRVFIRGKGSIKDTEKEEKLKGKPGYEHLNEPLHILIEAELPANIVDTRLRQAQEVMEELLKPVDESQDFYKRQQLRELAMLNSTLREDSPHPGSVSPFSNGSMKRAKPSQ

SEQ ID NO: 2320 - protein, 281 aa, Zea mays
MSGLYNQGFSPARTLSPQIRSNPDADSQYLAELLAEHQKLGPFMQVLPICSRLLNQEIMRVSSMVHDHGFSDLDRRRFRSPSPMSSPIVRPNLHGNGFGPWNGMHQERLGFPPPGTSMDWQGAPPSPGSYIVKKIMRLEVPVDSYPNFNFVGRILGPRGNSLKRVESSTGCRVFIRGKGSVKDTEKEDKLKGKPGYEHLNEPLHILIEAELPANIVDTRLRQAQEVMEELLKPVDESQDLYKRQQLRELAMLNSTLREDSPHPGSVSPFSNGGMKRAKPSQ

SEQ ID NO: 2321 - protein, 286 aa, Oryza sativa Japonica Group
MSGGLYNHQGFSPARTLSPQIRSNPEADSQYLSELLAEHHKLGPFMQVLPICSRLLNQEIMRVSSMVNDHGFNDFDRRRYRSPSPMSSPIMRPNLHGNGFGPWNGIHQERLGFPPPPPPGTSMDWQGAPPSHGSYIVKKIVRMEVPVDAYPNFNFVGRILGPRGNSLKRVEASTGCRVFIRGKGSIKDADKEEKLKGKPGYEHLNDPLHILIEAELPANIIDTRLRQAQEIMDELLKPVDESQDYYKRQQLRELAMLNSTLREDSPHPGSVSPFSNGGMKRAKPSH

SEQ ID NO: 2322 - protein, 299 aa, Oryza sativa Japonica Group
MSGGLYNHQGFSPARTLSPQIRSNPEADSQYLSELLAEHHKLGPFMQVLPICSRLLNQEIMRVSSMVNDHGFNDFDRRRYRSPSPMSSPIMRPNLHGNGFGPWNGIHQERLGFPPPPPPGTSMDWQGAPPSHGSYIVKKIVRMEVPVDAYPNFNFVGRILGPRGNSLKRVEASTGCRVFIRGKGSIKDADKEEKLKGKPGYEHLNDPLHILIEAELPANIIDTRLRQAQEIMDELLKPVWICNVKFMMKGPKDESQDYYKRQQLRELAMLNSTLREDSPHPGSVSPFSNGGMKRAKPSH

SEQ ID NO: 2323 - protein, 279 aa, Zea mays
MSGLYSQGFSPARNLSPQIRSNPDADSQYLAELLAEHHKLGPFMQVLPVCNKLLSQEIMRVSSIVHNHGFGDFDRHRFRSPSPMSSPNPRANLPGNGFSPWSGLQERLGFPQGTSMDWQGAPPSPSSHVVKKILRLEVPVDSYPNFNFVGRILGPRGNSLKRVEASTGCRVFIRGKGSIKDSGKEDKLRGKPGYEHLSDPLHILIEAEFPASIIDARLRQAQEIIEELLKPVDESQDLYKRQQLRELAMLNSTLREDSPHPGSVSPFSNGGMKRAKTGQ

SEQ ID NO: 2324 - protein, 279 aa, Sorghum bicolor
MSGLYGQGFSPARNLSPQIRSNPDVDSQYLAELLAEHQKLGPFMQVLPICNKLLSQEIMRVSSIVHNHGFGDFDRHRFRSPSPMSSPNPRANLPGNGFSPWSGLQERLGFPQGTSMDWQGAPPSPSSHVVKKILRLEVPVDSYPNFNFVGRILGPRGNSLKRVEASTGCRVFIRGKGSIKDPGKEDKLRGKPGYEHLSDPLHILIEAEFPASIIDARLRHAQEIIEELLKPVDESQDFYKRQQLRELAMLNSTLREDSPHPGSVSPFSNGGMKRAKTGQ

SEQ ID NO: 2325 - protein, 281 aa, Oryza sativa Japonica Group
MSGLYSPGFSPARNLSPQIRSNPTDVDSQYLAELLAEHQKLGPFMQVLPICSKLLSQEIMRVSSIVHNHGFGDFDRHRFRSPSPMSSPNPRSNRSGNGFSPWNGLHQERLGFPQGTSMDWQGAPPSPSSHVVKKILRLDVPVDSYPNFNFVGRILGPRGNSLKRVEASTGCRVFIRGKGSIKDPGKEDKLRGKPGYEHLSDPLHILIEAEFPASIIDARLRHAQEVIEELLKPVDESQDFYKRQQLRELAMLNSTLREDSPHPGSVSPFSNGGMKRAKTGQ

SEQ ID NO: 2326 - protein, 279 aa, Zea mays
MSGLYSQGFSPARNLSPQIRSNPDVDSQYLAELLAEHQKLGPFMQVLPICNKLLSQEIMRVSSIVHNHGFGDHDRHRFRSPSPMSSPNPRANLPGNGFSPWSGLQERLGFPQRTSMDWQGAPPSPSTQVVKKILRLEVPVDSYPNFNFVGRILGPRGNSLKRVEASTGCRVFIRGNGSIKDPGKEDKLRGKPGYEHLSDPLHILIEAEFPASIIDARLRHAQEIIEELLKPVDESHDFYKRQQLRELALLNSTLREDSPHPGSVSPFSNGGMKRAKTGQ

SEQ ID NO: 2327 - protein, 282 aa, Hordeum vulgare subsp. vulgare
MSGLYGQQGFSPSRNLSPQIRSNPDVVDSQYLAELLAEHEKLGPFMQVLPICSRLLVHEIMRVSNSSHNPGFSDFDRHRFRSPSPMSSPNPRSNLSGNGFSPWNGLHQERIGFPQANSMDWQGAPPSPSSHVMKKILRLEVPVDSYPSFNFVGRILGPRGNSLKRVEASTGCRVFIRGKGSIKDPGKEDKLRGKPGYEHLSEQLHILIEAEFPANIIDARLRHAQEILEELLKPVDETQDIYKRQQLRELAMLNSTLREDSPHPGSVSPFSNGGMKRAKTGQ

SEQ ID NO: 2328 - protein, 321 aa, Sorghum bicolor
MVGRMERQTASSSASCSPSAAAAASSSSSSVCGGKKRPDILNMIRNAACLNSSSTDTGKGRSKLSTNKVAHGFHLVEGKSGHDMEDYHVAEYKYVKNHELGLFAIFDGHLGDKVPCYLKANLFSNIMKEPLFWSSPQEAIKNAYCSTNKFILENAKQLGPGGSTAVTAIVVDGKDMWIANVGDSRAVVCEKGAANQLTVDHEPHTTNERQRIEKHGGFVTTFPGDVPRVNGQLAVARAFGDQSLKAHLSSEPDIRHVPISSNIEFVILASDGLWKVMKNQEAVDLVKSIKDPQAAAKRLTTEALARKSKDDISCIVIRFRC

SEQ ID NO: 2329 - protein, 318 aa, Zea mays
MVGRMERQTASSSASCSPAAAATTSSSSCGGKKRPDILNMIRNASCLNSSSADTGKGRSKLSTNKVTHGFHLVEGKSGHDMEDYHVAEYKYVKNHELGLFAIFDGHLGDKVPSYLKANLFSNIMKEPLFWSSPQEAIKNAYCSTNKYILENTKQLGPGGSTAVTAIVVDGKDMWIANVGDSRAVVCERGSAKQLTVDHEPHETNERQRIEKHGGFVTTFPGDVPRVNGQLAVARAFGDQSLKAHLSSEPDISHVPINSSIEFVILASDGLWKVMKNQEAVDLVKSIKDPQAAAKRLTTEALARKSKDDISCIVIRFRC

SEQ ID NO: 2330 - protein, 321 aa, Oryza sativa Japonica Group
MVGRMERQSASSSASCSPSSSAAGTSSSSSACGGKKRPDILNMIRSATCLNSSSTDTGKGRSKQSSNKVTHGFHLVEGKSGHDMEDYHVAEYKYDKSHELGLFAIFDGHLGDSVPSYLKANLFCNILKEPIFWTNPQEAIKNAYRSTNKYILENAKQLGPGGSTAVTAIVVDGKDMWVANVGDSRAVVCERGAANQLTVDHEPHTTNERQRIEKQGGFVTTFPGDVPRVNGQLAVARAFGDQSLKAHLSSEPDVRHVPINSSIEFVILASDGLWKVMKNQEAVDLVKSIKDPQAAAKRLTTEALARKSKDDISCIVIRFRC

SEQ ID NO: 2331 - protein, 317 aa, Oryza sativa Japonica Group
MERQSASSSASCSPSSSAAGTSSSSSACGGKKRPDILNMIRSATCLNSSSTDTGKGRSKQSSNKVTHGFHLVEGKSGHDMEDYHVAEYKYDKSHELGLFAIFDGHLGDSVPSYLKANLFCNILKEPIFWTNPQEAIKNAYRSTNKYILENAKQLGPGGSTAVTAIVVDGKDMWVANVGDSRAVVCERGAANQLTVDHEPHTTNERQRIEKQGGFVTTFPGDVPRVNGQLAVARAFGDQSLKAHLSSEPDVRHVPINSSIEFVILASDGLWKVMKNQEAVDLVKSIKDPQAAAKRLTTEALARKSKDDISCIVIRFRC

SEQ ID NO: 2332 - protein, 295 aa, Ricinus communis
MSKHSVAGASRTSKPPTFFQKIKSSCLNSSSPDTGKGRSKSSSKKMSHGFQLVEGKSGHDMEDYHVAEYRKIKNHELGLFAIFDGHLGDRVPSYLKDNLFLNILQEPQFWDDPKTAIKNAYKNTDKFILENSMQLGPGGSTAVTAIVIDGKDLWVANIGDSRAVVCERGSANQLTVDHEPHTERKRIEKQGGFVTTLPGDVPRVNGQLAVARAFGDQSLKAHLSSEPDVRHVPIDSTMEFVILASDGLWKVMQNQEAVDLVKPIKDPQAAAKRLTTEALARKSKDDISCIVIRFG

SEQ ID NO: 2333 - protein, 579 aa, Sorghum bicolor; identical to SEQ ID NO: 1077

SEQ ID NO: 2334 - protein, 587 aa, Zea mays; identical to SEQ ID NO: 1075

SEQ ID NO: 2335 - protein, 584 aa, Zea mays; identical to SEQ ID NO: 1080

SEQ ID NO: 2336 - protein, 585 aa, Zea mays; identical to SEQ ID NO: 1076

SEQ ID NO: 2337 - protein, 579 aa, Oryza sativa Japonica Group; identical to SEQ ID NO: 1082

SEQ ID NO: 2338 - protein, 577 aa, Oryza sativa Japonica Group; identical to SEQ ID NO: 1083

SEQ ID NO: 2339 - protein, 577 aa, Oryza sativa Indica Group; identical to SEQ ID NO: 1084

SEQ ID NO: 2340 - protein, 577 aa, Hordeum vulgare subsp. vulgare; identical to SEQ ID NO: 1085

SEQ ID NO: 2341 - protein, 579 aa, Sorghum bicolor; identical to SEQ ID NO: 1068

SEQ ID NO: 2342 - protein, 551 aa, Oryza sativa Japonica Group; identical to SEQ ID NO: 1087

SEQ ID NO: 2343 - protein, 317 aa, Oryza sativa Japonica Group; identical to SEQ ID NO: 2331

SEQ ID NO: 2344 - protein, 321 aa, Oryza sativa Japonica Group; identical to SEQ ID NO: 2330

SEQ ID NO: 2345 - protein, 321 aa, Sorghum bicolor; identical to SEQ ID NO: 2328

SEQ ID NO: 2346 - protein, 318 aa, Zea mays; identical to SEQ ID NO: 2329

SEQ ID NO: 2347 - protein, 238 aa, Oryza sativa Japonica Group
MEDYHVAEYKYDKSHELGLFAIFDGHLGDSVPSYLKANLFCNILKEPIFWTNPQEAIKNAYRSTNKYILENAKQLGPGGSTAVTAIVVDGKDMWVANVGDSRAVVCERGAANQLTVDHEPHTTNERQRIEKQGGFVTTFPGDVPRVNGQLAVARAFGDQSLKAHLSSEPDVRHVPINSSIEFVILASDGLWKVMKNQEAVDLVKSIKDPQAAAKRLTTEALARKSKDDISCIVIRFRC

SEQ ID NO: 2348 - protein, 285 aa, Vitis vinifera
MDKKTSFLNKIKKATCLDSSTPDSGKGKCKSCSNIVAHGFHLVEGKSGHDMEDYHVAEYRNKKSHVLGLFAIFDGHLGNSVPSYLKDNLFNNILEEPNFWNDPKIAIKNAYRATDKYILENSMKLGPGGSTAVTAIVIDGKDLWVANIGDSRAVVCERGAANQLTVDHEPDSERRRIEKQGGFVTNLAGDVPRVNGQLAVARAFGDQSLKAHLSSEPDVRHVPIDSTIEFVILASDGLWKVMKNQEAVDMVKSIKDPQVAAKRLTTEALERKSKDDISCIVIRFG

SEQ ID NO: 2349 - protein, 295 aa, Ricinus communis; identical to SEQ ID NO: 2332

SEQ ID NO: 2350 - protein, 275 aa, Vitis vinifera
MRVKESFYSSTPDSGKGKCKSCSNIVAHGFHLVEGKSGHDMEDYHVAEYRNKKSHVLGLFAIFDGHLGNSVPSYLKDNLFNNILEEPNFWNDPKIAIKNAYRATDKYILENSMKLGPGGSTAVTAIVIDGKDLWVANIGDSRAVVCERGAANQLTVDHEPDSERRRIEKQGGFVTNLAGDVPRVNGQLAVARAFGDQSLKAHLSSEPDVRHVPIDSTIEFVILASDGLWKVMKNQEAVDMVKSIKDPQVAAKRLTTEALERKSKDDISCIVIRFG

SEQ ID NO: 2351 - protein, 354 aa, Oryza sativa Japonica Group
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQLSLSVLLFGVGVATVTDLQLNAVGSVLSLLAIITTCIAQIMTNTIQKKFKVSSTQLLYQSCPYQSLTLFLIGPFLDGFLTNQNVFAFDYTSQVVFFIVLSCLISVSVNFSTFLVIGKTSPVTYQVLGHLKTCLVLTFGYVLLHDPFSWRNILGILIAVVGMVLYSYFCTLEGQQKNAEVSPQQAKEGDSAPLISDSLSKVENGGGVVDDEPLKVPMWSSKYSRA

SEQ ID NO: 2352 - protein, 354 aa, Oryza sativa (japonica cultivar-group)
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQLSLSVLLFGVGVATVTDLQLNAVGSVLSSLAIITTCIAQIMTNTIQKKFKVSSTQLLYQSCPYQSLTLFLIGPFLDGFLTNQNVFAFDYTSQVVFFIVLSCLISVSVNFSTFLVIGKTSPVTYQVLGHLKTCLVLIFGYVLLHDPLSWRNILGILIAVVGMVLYSYFCTLEGQQKNAEVSPQQAKEGDSAPLISDSLSKVENGGGVVDDEPLKVPMWSSKYSRA

SEQ ID NO: 2353 - protein, 354 aa, Zea mays
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLTFGYVLLHDPFSWRNILGILIAVVGMVLYSYFCTVETQHKNTEVSPQQVKESEAAPLISDSLSKVENGGGVVDDEPLKVPMWSSKYSRE

SEQ ID NO: 2354 - protein, 354 aa, Sorghum bicolor
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLTFGYVLLHDPFSWRNILGILIAVVGMVLYSYFCTVETQQKNTEVSPQQVKESEAAPLISDSLSKAENGGGGVDDEPLKVPMWSSKYSRE

SEQ ID NO: 2355 - protein, 354 aa, Zea mays
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLAFGYVLLHDPFSWRNILGILIAVVGMVLYSYFCTVETQQKNVEVSPQQVKESEAGPLIADSMSKVENGGGGVDDEPLKVPMWSSKYSRE

SEQ ID NO: 2356 - protein, 352 aa, Hordeum vulgare subsp. vulgare
MGVGGEKFQLGTVGALGLSVVSSVSIVICNKALMSSLGFTFATTLTSWHLLVTFCSLHVALWMKFFEHKAFDSRTVMGFGVLNGISIGLLNLSLGFNSVGFYQMTKLAIIPCTVILETLFFRKKFSRTIQISLSVLLLGVGVATVTDLQLNAVGSILSLLAIITTCIAQIMTNTIQKKFKVSSTQLLYQSCPYQSLTLFLIGPFLDGFLTNQNVFAFNYTSNVVFFIVLSCLISVSVNFSTFLVIGKTSPVTYQVLGHLKTCLVLTFGYVLLHDPFSWRNILGILIAVVGMVLYSYFCSIETQPKNTEVSSQQAKEGDSAPLISDSLSKVENGGDDDEPLKVPMWSSKYSKA

SEQ ID NO: 2357 - protein, 321 aa, Zea mays
MSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLTFGYVLLHDPFSWRNILGILIAVVGMVLYSYFCTVETQHKNTEVSPQQVKESEAAPLISDSLSKVENGGGVVDDEPLKVPMWSSKYSRE

SEQ ID NO: 2358 - protein, 356 aa, Oryza sativa Japonica Group
MGVTGEKFQLGTVGALSLSVVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIQLSLSVLLFGVGVATVTDLQLNAVGSVLSLLAIITTCIAQIMTNTIQKKFKVSSTQLLYQSCPYQALTLFIVGPFLDGFLTNQNVFAFDYTSQVVFFIVLSCLISVSVNFSTFLVIGKTSPVTYQVLGHLKTCLVLAFGYVLLHDPFSWRNILGILIAVIGMVSYSYFCTKEAPPKPTEASPQLNQVKESESDPLISDSLSTAENGGNAGDDEALKVPMWSSKYSKA

SEQ ID NO: 2359 - protein, 356 aa, Zea mays
MGVAGEKFQLGTVGALSLSVVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLLGVGVATVTDLQLNVMGSVLSLLAIITTCIAQIMTNTIQKKFKVSSTQLLYQSCPYQALTLFLVGPFLDGFLTNQNVFAFDYTTQVLFFIVLSCLISVSVNFSTFLVIGKTSPVTYQVLGHLKTCLVLTFGYVLLHDPFSWRNILGILIAVIGMVLYSYFCTRETQQKPAEASPQAVQAKEGESNPLISDSLSAAENGGSATDDEPLKVPMWSSKYSKA

SEQ ID NO: 2360 - protein, 357 aa, Zea mays
MGVAGEKFQLGTVGALSLSVVSSVSIVICNKALMSSLRFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLLGVGVATITDLQLNLVGSVLSLLAIITTCIAQIMTNTIQKKFKVSSTQLLYQSCPYQALTLFLVGPFLDGFLTNQNVFAFDYTTQVLFFIVLSCLISVSVNFSTFLVIGKTSPVTYQVLGHLKTCLVLAFGYVLLHDPFSWRNILGILIAVIGMVLYSYFCTRETQQKPAEASPQAILQAKEGESNPLILDSLSAAENGGSATDDEPLKVPMWSSKYSKA

SEQ ID NO: 2361 - protein, 377 aa, Sorghum bicolor
MNWCCLPSRRAKKEENPYSNSIGGIYSEKNIRLFSYAELRSATDNFNRTNKVGRGGFGTVYKGTIRNGREVAVKVLSAESRQGIREFLTEIDVITNVKHPNLVELIGCCVEGNNRILVYEYLKNSSLDRALLGSNSEPADFTWSIRSAICLGVARGLAYLHEEIASPIVHRDIKASNILLDRNYVPKIGDFGLAKLFPDNVTHISTRVAGTTGYLAPEYAWHGQLTKKADIYSFGILVLEIVSGTSSSRSILMDDKVLLEKTWELYEAKSLKELVDPTLVDYPEEEVIRYIKVALFCLQAAAARRPTMPQVVTMLSKPIRINDSELTAPGYLHESSRRSPGSRATVSSNYRFKNSASEDSNMFSTVVPPTVTEMSPR

SEQ ID NO: 2362 - protein, 388 aa, Zea mays
MLSEPTVATSADMNWCCVPKAKREENPYSNSIGGIYSEKNIRLFSYAELRSATDNFNRTNKVGRGGFGTVYKGTIRSGREVAVKVLSAESRQGIREFLTEIDVISNVKHPNLVELIGCCVEGSNRILVYEYLKNSSLDRALLASNSEPADFTWSVRSAICLGVARGLAYLHEEIAAPIVHRDIKASNILLDRNYVPKIGDFGLAKLFPDNVTHISTRVAGTTGYLAPEYAWHGQLTKKADIYSFGVLVLEIVSGTSSSRSILMDDKILLEKAWELYEAKRLKELVDPALVDCPEEEAIRYIMVALFCLQAAAARRPTMPQVVTMLSKPVRINESELTAPGYLQEYSRRSPLSKATTSTDSRFKNLASQEDSNMFSTVVPPTVTEMSPR

SEQ ID NO: 2363 - protein, 393 aa, Oryza sativa Japonica Group
MAIGSSGTSVYKTATTTEDMSWWCCIPKSKKGENPYSHGVSGIPPEKNIRLFSYSELRSATENFNRSNKIGRGGFGTVYKGTIRNGRDVAVKVLSAESRQGVREFLTEIDVITNVKHPNLVELIGCCVEGNNRILVYEYLENSSLDRALLGSNSEPANFTWSIRSAICIGIAKGLAYLHEEIASPIVHRDIKASNILLDKLYNPKIGDFGLAKLFPDNITHISTRVAGTTGYLAPEYAWHGQLTKRADIYSFGVLVLEIVSGKSSSRSLLADDKILLEKAWELHEVGKLKELVDSEMGDYPEEEVLRYIKTALFCTQAAAARRPSMPQVVTMLSKPIRINERELTAPGYIHDYNGTVSKATNSSNSRFKHSASDTSDMFSTVVPPTVSEISPR

SEQ ID NO: 2364 - protein, 374 aa, Oryza sativa Japonica Group
MSWWCCIPKSKKGENPYSHGVSGIPPEKNIRLFSYSELRSATENFNRSNKIGRGGFGTVYKGTIRNGRDVAVKVLSAESRQGVREFLTEIDVITNVKHPNLVELIGCCVEGNNRILVYEYLENSSLDRALLGSNSEPANFTWSIRSAICIGIAKGLAYLHEEIASPIVHRDIKASNILLDKLYNPKIGDFGLAKLFPDNITHISTRVAGTTGYLAPEYAWHGQLTKRADIYSFGVLVLEIVSGKSSSRSLLADDKILLEKAWELHEVGKLKELVDSEMGDYPEEEVLRYIKTALFCTQAAAARRPSMPQVVTMLSKPIRINERELTAPGYIHDYNGTVSKATNSSNSRFKHSASDTSDMFSTVVPPTVSEISPR

SEQ ID NO: 2365 - protein, 393 aa, Oryza sativa Indica Group
MAIGSSGTSVYKTATTTEDMSWWCCIPKSKKGENPYSHGVSGIPPEKNIRLFSYSELRSATENFNRSNKIGRGGFGTVYKGTIRNGRDVAVKVLSAESRQGVREFLTEIDVITNVKHPNLVELIGCCVEGNNRILVYEYLENSSLDRALLGSNSEPANFTWSIRSAICIGIAKGLAYLHEEIASPIVHRDIKASNILLDKLYNPKIGDFGLAKLFPDNITHISTRVAGTTGYLAPEYAWHGQLTKRADIYSFGVLVLEIVSGKSSSRSLLADDKILLEKAWELHEVGKLKELVDSEMGDYPEEEVLRFIKTALFCTQAAAARRPSMPQVVTMLSKPIRINERELTAPGYIHDYNGTVSKATNSSNSRFKHSASDTSDMFSTVVPPTVSEISPR

SEQ ID NO: 2366 - protein, 386 aa, Hordeum vulgare subsp. vulgare
MSWCCLPRAKKQQHNLYSHRQQEILHSNTSISGISAEKNIRLFSYAQLRSATDNFNHNNKVGRGGFGIVYKGTLQNKQDVAVKVLSAESRQGIREFLTEIDVISNVKHPNLVELIGCCVEANNRILVYEYLENSSLDRALLGSTSDPANFTWSVRSSICIGVARGLAYLHEEIPSPIVHRDIKASNILMDKNYVPKIGDFGLAKLFPDNITHISTRVAGTTGYLAPEYAWHGQLTKKADIYSFGVLVIEVISGKSGSRSLLADDKFLLEKTWELYEAGNLKELVDPDLGDYPDEEAIRYIKVALFCTQAAAARRPTMLQVVKMLSKPIRINESELTAPGYINEYKSSGSKEMATTSTGSRFKNSTAYDSDMFSTVVPQTVTDISPR

SEQ ID NO: 2367 - protein, 716 aa, Sorghum bicolor
MATDREKEREAELENAMYTNCLLLGLDPAVLGSPSSPAGRVGLFRHSNPRLGEQLLYFLLSSLRGPAQSAKDFDKVWPIFDSAQSREFRKIVQGIISELEQQGALPRSNSRVSSLATCCGPRFVELLWQLSVHALREVHRRTFAADVASNPLPAALTDVSYLHAASLLPVTKARIALERRKFLKNANIAVQRQTTWSNLAHEMTAEFRSLCAEEAYLQQELEKLQDMRNKAKLEGELWDEQLSGSSGQNSHLVSKATRLWESILARKGQHEVLASGPIEDLIAHREHRYRISGSQLLAAMDMSSSVPHSELLSSRAGETSPILGKQEQISQLFQGKEEALSRSDDRNGRTQQTVDVAEILRRWTHALQRIHKQSLHLAKANDGEGPDLLRSALDGEASTHSDSLTATLAEHRQHLVSIQGLINQLKEAIPAMQQSIDELSEEVNSVSINSMDQLNSRLPLSVQNAGLGRSEERSSEVSEISSKLSSTHLDKPGGSPALKLPPLFSLTPSSSGKGTQTQKRNALARQPSQEITSEEKTLTIPSTKDQMNGSMHENDDYSAHDIRRSIREAALSKPLRNTERPQDKNSDDASEHFFIPLSTGAAKKDMDSVTNGHNRRLGLLPSQMKFSKSTSGIYYNADSPIYTSPVLLSELNGHDSISAMSFLDPAGGLAHQSFLTDDALDQVFSPPLLLESSLFHDADEDLLAPLSETEAALMEH

SEQ ID NO: 2368 - protein, 711 aa, Zea mays
MAADREKEREAELEGAMYTNCLLLGLDPAVLGSPSSPAGRVGLFRHSNPRLGEQLLYFLLSSLRGPAQSAKDFDKVWPIFDSAQSREFRKIVQGIISELEQHGALPRSNSRVSSLATCCGPRFVELLWQLSVHALREVHKRTFAADVVSNPLPAALTDVSYLHAASLLPVTKARIALERRKFLKNANIAVQRQMTWSNLAHEMTAEFRSLCAEEAYLQQELEKLQDMRNKAKLEGELWDERLSGSSGQNSHLVSKATRLWESILARKGQHEVLASGPIEDLIAHREHRYRISGSQLLAAMDMSSSVPHSELLSSKAGETSIILEKQEEFSQLFQEKEEALTRSDDRNGRTQQTVDVAEILRRWTHALQRIHKQSLHLAKANDGEGPELLRSASSGEASTHSDSLTATLAEHRQHLVSIQGLINQLKEAIPAMQQSIDELSEEVNSVSINSMDQLNSRLPLPVQIAGFGTSEESSSEVSEINSKLSSTHLDKPGGSPALKLPPLFSLTPSSSGKGIQTQKRSALARQRSQDITSEQKTLTIPSTKDQMNGSMHENDDYSAHDIRRSVREAALSKPLKNTERPQDKNSDDGSEHFFIPLSISAAKKEMDSVANRCNQRLGLSPQMKFPKSTSYNADTPINKSPILLSELNGHDSISAMSFLDPAGGLAHQSFITDDALDQVFSPLLMESSLFHDADEDLLAPLSETDAALMEY

SEQ ID NO: 2369 - protein, 711 aa, Zea mays
MAADREKEREAELEGAMYTNCLLLGLDPAVLGSPSSPAGRVGLFRHSNPRLGEQLLYFLLSSLRGPAQSAKDFDKVWPIFDSAQSREFRKIVQGIISELEQHGALPRSNSRVSSLATCCGPRFVELLWQLSVHALREVHKRTFAADVVSNPLPAALTDVSYLHAASLLPVTKARIALERRKFLKNANIAVQRQMTWSNLAHEMTAEFRSLCAEEAYLQQELEKLQDMRNKAKLEGELWDERLSGSSGQNSHLVSKATRLWESILARKGQHEVLASGPIEDLIAHREHRYRISGSQLLAAMDMSSSVPHSELLSSKAGETSIILEKQEEFSQLFQEKEEALTRSDDRNGRTQQTVYVAEILRRWTHALQRIHKQSLHLAKANDGEGPELLRSASSGEASTHSDSLTATLAEHRQHLVSIQGLINQLKEAIPAMQQSIDELSEEVNSVSINSMDQLNSRLPLPVQIAGFGTSEESSSEVSEINSKLSSTHLDKPGGSPALKLPPLFSLTPSSSGKGIQTQKRSALARQRSQDITSEQKTLTIPSTKDQMNGSMHENDDYSAHDIRRSVREAALSKPLKNTERPQDKNSDDGSEHFFIPLSISAAKKEMDSVANRCNQRLGLSPQMKFPKSTSYNADTPINKSPILLSELNGHDSISAMSFLDPAGGLAHQSFITDDALDQVFSPLLMESSLFHDADEDLLAPLSETDAALMEY

SEQ ID NO: 2370 - protein, 717 aa, Oryza sativa Japonica Group
MATDREKEREAELESAMYTNCLLLGLDLAVLGSPSSPAAGPRVGLFRHSNPRLGEQLLYFLLSSLRGPAQSAKDFDKVWPIFDSAQSREFRKIVQGIISELEQQGALPRSNSRVSSLATCCGPRFVELLWQLSVHALREVHRRTFAADVASSPLPAALTDVSYLHAAALLPVTKARIALERRKFLKNANIAVQRQTTWSNLAHEMTAEFRSLCAEEAYLQQELEKLQDMRNKSKLEGELWDERISSSSGQNSHLVSKATRLWETILARKGQHEVLASGPIEDLIAHREHRYRISGSQLLAAMDLSSSVPHSELLSARASEASPFLDKQEQMSALFQGKEEALSRLDDRNGRAQQQTVDVAEILRRWTHALQRIHKQSLHLAKANDGDGPELLRSASDGETSTHADSLTATLAEHRQHLVSIQGLINQLKEAIPAMQQSIADLSEEVNSVSSNPMDKIISRLSPSVQNSGFGRAEESSSELSEMTSKLSSTHLDKAGSSPALKLPPLFSLTPSSSGKGTQAQKRNALGRQPSQEILSEEKTLPLPSTKDETNGSIHENEGYFAHNIRRSVREAALSKPLRNPERPHDQSSDDGSEHFFIPLSTGASKMEIDAVDNNRRMQKLGFSSPQMKFSDLHFNVDSPMHATPVLSSKLNGHDDPNTVTSMLDPVSGLGHQSFITDDALDQVFSPPLLLETSLFQDAYEDLLAPLSETDTALMEH

SEQ ID NO: 2371 - protein, 717 aa, Oryza sativa Indica Group
MATDREKEREAELESAMYTNCLLLGLDLAVLGSPSSPAAGPRVGLFRHSNPRLGEQLLYFLLSSLRGPAQSAKDFDKVWPIFDSAQSREFRKIVQGIISELEQQGALPRSNSRVSSLATCCGPRFVELLWQLSVHALREVHRRTFAADVASSPLPAALTDVSYLHAAALLPVTKARIALERRKFLKNASIAVQRQTTWSNLAHEMTAEFRSLCAEEAYLQQELEKLQDMRNKSKLEGELWDERISSSSGQNSHLVSKATRLWETILARKGQHEVLASGPIEDLIAHREHRYRISGSQLLAAMDLSSSVPHSELLSARASEASPFLDKQEQMSALFQGKEEALSRLDDRNGRAQQQTVDVAEILRRWTHALQRIHKQSLHLAKANDGDGPELLRSASDGETSTHADSLTATLAEHRQHLVSIQGLINQLKEAIPAMQQSIADLSEEVNSVSSNPMDKIISRLSPSVQNSGFGRAEESSSELSEMTSKLSSTHLDKAGSSPALKLPPLFSLTPSSSGKGTQAQKRNALGRQPSQEILSEEKTLPLPSTKDETNGSIHENEGYFAHNIRRSVREAALSKPLRNPERPHDQSSDDGSEHFFIPLSTGASKMEIEAVDNNRRMQKLGFSSPQMKFSDLHFNVDSPMHATPVLSSKLNGHDDPNTVTSMLDPVSGLGHQSFITDDALDQVFSPPLLLETSLFQDAYEDLLAPLSETDTALMEH

SEQ ID NO: 2372 - protein, 705 aa, Hordeum vulgare subsp. vulgare
MSTDREKERGAELEGAMYTNCLLLGLDPAVLGSPAGAVPTRVGLFRHSNPRLGEQLLYFLLSSLRGPAQSAKDFDKVWPIFDSAQSREFRKIVQGVISELEQQGALPRSNSRVSSLATCCGPRFVELLWQLSVHALREVHRRTFPADAASNPLPAALTDVSYLHAAALLPVTKARIALERRKFLENANIAVQRQATWSNLAHEMTAEFRSLCAEEACLQQELEKLQAMRNRAKLEGELWDERISSSSGQNSHLVSKATRLWESILARQGQHEVLASGPIEDLIAHREHRYRISGSQLLAAMDMGSSLPHSLNLDKQEQISLFQGKEEAVSSRLDDRNGRAQQTVDVAEILRRWTHALQRIHKQSLHLAKANDGEGPELLRSVSDGETSSHADSLTATLAEHRQHLVSIQGLINQLKEAIPAMQQSIAELSEEVNSVPSNPMDQTNSRQLSVRNTVLGRSEESSSQVSEMTSKLSSIHIDKAGSSPALKLPPLFSLTPSSSGKGIQTQRRNALTRQPSKEIMPEEKALIHPSTKDHANGSAHENDGYFAHDIRRSVREAALSKPLSSMEGPQDKSSDDGSEHFFIPLSTVASRKDVGAVANRRKQRTGLPSSQSKLPKSTGDFYFNPDSPMPAAPALSGKLNGHDDPSNAANFFDPVNGRSFMTDDALDQVFSPPPMLEPSLFHDTYAYEDLLAPLSETDAALMEH

SEQ ID NO: 2373 - protein, 585 aa, Zea mays; identical to SEQ ID NO: 1076

SEQ ID NO: 2374 - protein, 587 aa, Zea mays; identical to SEQ ID NO: 1075

SEQ ID NO: 2375 - protein, 584 aa, Zea mays; identical to SEQ ID NO: 1080

SEQ ID NO: 2376 - protein, 579 aa, Sorghum bicolor; identical to SEQ ID NO: 1077

SEQ ID NO: 2377 - protein, 579 aa, Oryza sativa Japonica Group; identical to SEQ ID NO: 1082

SEQ ID NO: 2378 - protein, 577 aa, Oryza sativa Japonica Group; identical to SEQ ID NO: 1083

SEQ ID NO: 2379 - protein, 577 aa, Oryza sativa Indica Group; identical to SEQ ID NO: 1084

SEQ ID NO: 2380 - protein, 577 aa, Hordeum vulgare subsp. vulgare; identical to SEQ ID NO: 1085

SEQ ID NO: 2381 - protein, 579 aa, Sorghum bicolor; identical to SEQ ID NO: 1068

SEQ ID NO: 2382 - protein, 551 aa, Oryza sativa Japonica Group; identical to SEQ ID NO: 1087

SEQ ID NO: 2383 - protein, 328 aa, Zea mays
MAAGFGPRFAAGDAPARRCNLERFLEATTPVVASSSCSSKETANGWGQRQSDDADGSSPFFALGDLWDSFKECSAYGTAVPLALNGCSDGVVQYYVPYLSAIQLYGALRRHIGPSRTGAEESDSDAERETSSSTNTLSAREEASESSTSGSEASGDEGEPGPGSWCQERLLFEFLESEPPYQREPLADKICSLAQRFPELKTLRSCDLSPASWISVAWYPIYRIPTGPTLRDLDACFLTYHSLSTQFAAGASSNGPRPATAATATAMMWLPTFAMASYKLKAAAWTPGWRDRQVAASLAQAADAWLRLLRADHPDHRFFAARRPPRRW

SEQ ID NO: 2384 - protein, 324 aa, Sorghum bicolor
MAAGSGRRFAAAGDAPARRCNLERFLEATTPVVASSCSSKETVNGWGQSDADESLPFFTLSDLWDSFKECSAYGTAVPLVLNSCSDGVVQYYVPYLSAIQLYGGFRRHIGPLRTGAEESDSDVERETSSSTNTLSAQEASSSSGSSEASSSDEGEPGSWCQERLLFEFLESEPPYHREPLADKICSLAQRFPELNTLRSCDLSPTSWISVAWYPIYRIPTGPTLRDLDACFLTYHSLSTQFAAGVGNNSGSPKPTAAAPVTAMWLPTFAMASYKVKAAAWTPGWRDRQMAASLAQAADAWLRLLRADHPDHRFFAARRAPARRW

SEQ ID NO: 2385 - protein, 355 aa, Zea mays
MTSSSNNGGRPDDGGEVVLDHEYQEEYVRNSRGMSLFACRWLPAVAGKRGRAPAPKALVFLCHGYAVECSVTMRGTGERLARAGYAVYGLDYEGHGRSDGLQGYVPDFDALVLDCDEYFTSVVAAAAQSQSKDAHQLPRFLLGESMGGAVALLLHRRRPEYWSGAVLVAPMCKIADDMRPHPLVVNILRAMTTIIPTWKIVPSNDVIDAAYRSQEKRDEIRSNPYCYKDKPRLKTAYELLKVSLDLEHNLLHQVSLPFLIVHGGADKVTDPSVSELLYQSAASQDKTLKFYPGMWHALTSGESPDNIQAVFQDIIAWLDHRSPDTEQEELVSSEVEQKAKHDDQRHQEQLQDGNK

SEQ ID NO: 2386 - protein, 349 aa, Sorghum bicolor
MGRSSSSSGGGGADDGGEVLLDHEYKEEYVRNSRGMNLFACTWLPAGKRKTPKALVFLCHGYAVECGVTMRGTGERLARAGYAVYGLDYEGHGRSDGLQGYVPDFELLVQDCDEYFTSVVRSQSIEDKGCKLRRFLLGESMGGAVALLLDLRRPEFWTGAVLVAPMCKIADDMRPHPLVVNILRAMTSIVPTWKIVPSNDVIDAAYKTQEKRDEIRGNPYCYKDKPRLKTAYELLKVSLDLEQNLLHQVSLPFLIVHGGADKVTDPSVSELLYRSAASQDKTLKLYPGMWHALTSGESPDNIHTVFQDIIAWLDHRSSDDTDQQELLSEVEQKARHDEQHHQQQDGGNK

SEQ ID NO: 2387 - protein, 345 aa, Sorghum bicolor
MSSSSSNGGEVLLLDHEYKEEYVRNSRGMSLFACTWLPGKRRTPKALVFLCHGYAVECGVTMRGTGERLARAGYAVYGLDYEGHGRSDGLQGYVPDFELLVQDCDDYFTSVVRSQPNEDKGCKRRRFLLGESMGGAVALLLDLRRPEFWTGAVLVAPMCKIADDMRPHPLVVNILRAMTSIVPTWKIVPSNDVIDAAYKTQEKRDEIRGNPYCYKDKPRLKTAYELLKVSLDLEQNLLHQVSLPFLIVHGGADKVTDPSVSELLHRSAASQDKTLKLYPGMWHALTSGESSDNIHAVFLDIIAWLDHRSSDDTDQQEQEQELLSSEVEQKARHDDQHPQQDGGNK

SEQ ID NO: 2388 - protein, 354 aa, Sorghum bicolor; identical to SEQ ID NO: 2354

SEQ ID NO: 2389 - protein, 354 aa, Zea mays; identical to SEQ ID NO: 2353

SEQ ID NO: 2390 - protein, 354 aa, Zea mays; identical to SEQ ID NO: 2355

SEQ ID NO: 2391 - protein, 354 aa, Oryza sativa Japonica Group; identical to SEQ ID NO: 2351

SEQ ID NO: 2392 - protein, 354 aa, Oryza sativa (japonica cultivar-group); identical to SEQ ID NO: 2352

SEQ ID NO: 2393 - protein, 352 aa, Hordeum vulgare subsp. vulgare; identical to SEQ ID NO: 2356

SEQ ID NO: 2394 - protein, 321 aa, Zea mays; identical to SEQ ID NO: 2357

SEQ ID NO: 2395 - protein, 356 aa, Oryza sativa Japonica Group; identical to SEQ ID NO: 2358

SEQ ID NO: 2396 - protein, 356 aa, Zea mays; identical to SEQ ID NO: 2359

SEQ ID NO: 2397 - protein, 357 aa, Zea mays; identical to SEQ ID NO: 2360

SEQ ID NO: 2398 - protein, 397 aa, Zea mays
MIHPLDGSNWTNIIFNIVPFPENVTISSTWLSILRSKFMSLVVRQSSIHLTEPLFGNASAFEVIKFPGGITIIPPQTAFLLQKPHATFNFTLNYPIYKLQDRTNELKDQMKAGLLLNPYENLYIKLTNSQGSTILPPTIVETSIVLEVGNHQPSVPRMKQLARTITNSSSSSGNLGLNHTVFGRVKQISLSSYLRHSLHSGRGSDAPSPAPMHHHGHHSHHHRHHHHSHDDNRHPAAPAPAPVHFPAPQPRYGAPPPSGGCPYSKNKPKKSGRAAPAAEPAANDHRSASIALPPHPSSPSPASWSQHAPSTPAVPPPPALPEPPLPTISFAHPRPPSERGTGTSPAPSEEATRAGPSGMSQVAPAPHSSYATRMQGDVPCCWVLFVLALCVLTSLLR

SEQ ID NO: 2399 - protein, 584 aa, Zea mays; identical to SEQ ID NO: 1080

SEQ ID NO: 2400 - protein, 587 aa, Zea mays; identical to SEQ ID NO: 1075

SEQ ID NO: 2401 - protein, 585 aa, Zea mays; identical to SEQ ID NO: 1076

SEQ ID NO: 2402 - protein, 579 aa, Sorghum bicolor; identical to SEQ ID NO: 1077

SEQ ID NO: 2403 - protein, 579 aa, Oryza sativa Japonica Group; identical to SEQ ID NO: 1082

SEQ ID NO: 2404 - protein, 577 aa, Oryza sativa Japonica Group; identical to SEQ ID NO: 1083

SEQ ID NO: 2405 - protein, 577 aa, Oryza sativa Indica Group; identical to SEQ ID NO: 1084

SEQ ID NO: 2406 - protein, 577 aa, Hordeum vulgare subsp. vulgare; identical to SEQ ID NO: 1085

SEQ ID NO: 2407 - protein, 551 aa, Oryza sativa Japonica Group; identical to SEQ ID NO: 1087

SEQ ID NO: 2408 - protein, 579 aa, Sorghum bicolor; identical to SEQ ID NO: 1068

SEQ ID NO: 2409 - protein, 321 aa, Oryza sativa Japonica Group; identical to SEQ ID NO: 2330

SEQ ID NO: 2410 - protein, 317 aa, Oryza sativa Japonica Group; identical to SEQ ID NO: 2331

SEQ ID NO: 2411 - protein, 321 aa, Sorghum bicolor; identical to SEQ ID NO: 2328

SEQ ID NO: 2412 - protein, 318 aa, Zea mays; identical to SEQ ID NO: 2329

SEQ ID NO: 2413 - protein, 238 aa, Oryza sativa Japonica Group; identical to SEQ ID NO: 2347

SEQ ID NO: 2414 - protein, 285 aa, Vitis vinifera; identical to SEQ ID NO: 2348

SEQ ID NO: 2415 - protein, 295 aa, Ricinus communis; identical to SEQ ID NO: 2332

SEQ ID NO: 2416 - protein, 275 aa, Vitis vinifera; identical to SEQ ID NO: 2350

SEQ ID NO: 2417 - protein, 902 aa, Zea mays
MSRARPALAMAAEAEAALLLLLLLCAAAFVERGAALHLCTDRLFNDTKGRHDDGLPHLTPTEEATWMSLLPRRLRGGGRAEFDWLALYRSLTRGDGPDGGAGKAAGPEGLLSPASLHDVRLHGDGSLSSMYWRAQQTNLEYLLYLDPDRLTWTFRQQAGLPTVGDPYGGWEAPDGQLRGHFVGHYLSASAHAWAATHNGTLRERMARVVDILHACQKKMGTGYLSAYPETMFDLYEQLDEAWSPYYTTHKIMQGLLDQYTLASNEKGLDVVLRMADYFSNRVKNLVQIHTIQRHWEAMNEETGGFNDVMYQLYTITRDQKHLTMAHLFDKPCFLGPLGLHKDDISGLHVNTHLPVLVGAQKRYEVVGDRLYKDISTYLFDVVNSSHTFATGGTSTMEHWHDPKRLVDEIKISSNEETCATYNFLKVSRNLFRWTKEAKYADHYERLLINGIMGNQRGTQPGVMLYFLPMGPGRSKSVSGQSPSGLPPKNPGGWGGPNDTFWCCYGTGIESFSKLGDSIYFLEEGDTPGLYIIQYIPSTFDWKATGLTVNQRAKPLLSTDPFFKVSLTISAKRGARQAKVSVRIPSWTTTDGATAILNGQKLNLTPTGNSTNGGFLTITKLWANDTLTLHFPITLRTEAIKDDRPEYASIQAVLFGPHLLAGLTHGKLPVTDSSHSNDGLTAGIWEVDATGAASVAGWVTPLHSETLNSQLVTLKQSIGGRTLVLSVSIADAKLEMQEQPAPGTDACVHATFRAYGQAGGSSQLLRGPNVTIEPFDRPGMAVTNGLAVGCRGGRDTLFNAVPGLDGAPGSVSLELATRPGWFVATAPTAMHANATTQVVCRANKGGAAFRRAASFARAPPLRRYHPLSFAARGTARNFLLEPLRSLQDEFYTVYFSLVSDGES

SEQ ID NO: 2418 - protein, 933 aa, Sorghum bicolor
MARARPALAMVSTAAALLLLLLCAAAFVERGAALQLCTDRLFNNTQGRHNDGLPHLTPTEEATWMALLPRRLRGGGGGGARARAEFDWLALYRSLTRGGGPDDDADAGKPGPGELLTPASLHDVRLHGDDDDDDRVLTGSSSSSAAMYWQAQQTNLEYLLYLDPDRLTWTFRRQAGLPTVGDPYGGWEAPGGQLRGHFTGHYLSASAHMWAATHNSTLRERMTRVVDILYDCQKKMGTGYLAAYPETMFDLYEQLDEAWSPYYTIHKIMQGLLDQYMLASNKKGLDVVVWMTDYFSNRVKNLIQKYTIQRHWEAMNEETGGFNDVMYQLYTITKNQKHLTMAHLFDKPCFLGPLGLHKDDISGLHVNTHLPVIIGTQKRYEVVGDHLYKDISTYLFDVVNSSHTFATGGTSTMEHWHDPKRLVDEIKISSNEETCATYNFLKVSRNLFRWTKEAKYADHYERLLINGIMGNQRGTQPGVMLYFLPMGPGRSKSVSGLSPSGLPPKNPGGWGGPNDTFWCCYGTGIESFSKLGDSIYFLEEGEAPGLYIIQYIPSTFDWKATGLTVNQQAKPLLSTDPFFKVSLTFSAKGDAQLAKVSVRIPSWTSTDGTTATLNGQKLNLTSTGNSTNGGFLTVTKLWAEDTLTLQFPITLRTEAIKDDRPEYASIQAVLFGPHLLAGLTHGKLPVTDSNHSNDGLTPSIWEVNATSATAVTDWVTPLPSETLNSQLVTLTQTAGGRTLVLSVSIADAKLEMQEQPAPGTDACVHATFRVYGQAGSSSSESLLPMQGPNVTIEPFDRPGMAVTNGLLAVGRPAGGRDTLFNAVPGLDGAPGSVSLELATRPGCFVATAPAAGANAATQVVCRGNKNNGGSASGDGAALRRAASFVRAAPLRRYNPLSFAARGTARNFLLEPLRSLQDEFYTVYFSLVVSDAGS

SEQ ID NO: 2419 - protein, 898 aa, Oryza sativa Indica Group
MTRRRSLAGGAAAAVVVLAAAASAFLSLLDGAAALHLCTDRLFNDTQGRHSDGLPHLNQAEEATWMGLLPRRAGPRDELDWLALYRSITRGGGGEPAGFLSPASLHDVRVDPYGANMYWQGQQTNLEYLLYLDPDRLTWTFRQQAKLPIVGEPYGGWEAPDGQLRGHFTGHYLSAAAHMWASTHNDALREKMTKVVDILYSCQKKMNTGYLSAYPESMFDAYDELAEAWSPYYTIHKIMQGLLDQYTLAGNPKGLEIVVWMTDYFSTRVKKLIQEYSIQRHWEAINEETGGFNDVMYQLYAITKNQKHLTMAHLFDKPCFLGPLGLHDDDISGLHVNTHVPVIVGAQKRYEVVGDQLYKEIATFFFDVVNSSHTFATGGTSTMEHWHDPKRLVDEIKISSNEETCATYNLLKVSRNLFRWTKEGKYTDHYERLLINGIMGNQRGKEPGVMIYFLPMGPGRSKSISGMPTSGLPPKNPGGWGNANATFWCCYGTGIESFSKLGDSIYFLEEGEIPGLYIIQYIPSTFDWKAAGLTVKQQAKPLSSTDSHFEVSIFISSKGDARPANVNVRIPSWTSVDGAIATLNGQKLNLTSAGDFLSVTKLWGDDTLSLKFPITLRTEPIKDDRPEYSSIQAVLFGPHLLAGLTHGNQTVKTSNDSNSGLTPGVWEVNATHAAAAVAGWVTPVSQSLNSQLVTLTQRDGDAQAAAAFVLSVSIADGALTMQESPVAGSDACVHATFRAYHSPSGASAIDAATGRLQGRNVALEPFDRPGMAVTDALSVGRPGPATRFNAVAGLDGLPGTVSLELATRPGCFVAAPTTAYLAGAKAQVSCRKPTAAGGGEDDDDTAFRRAASFTQAAPLRLYHPLSFSATGTDRNFLLEPLQSLQDEFYTVYFNVLTK

SEQ ID NO: 2420 - protein, 902 aa, Oryza sativa Japonica Group
MTRRRSLAGGAAAAVVVLAAAAAAAFLSLLDGAAALHLCTDRLFNDTQGRHSDGLPHLNQAEEATWMGLLPRRAGPRDELDWLALYRSITRGGGDVGGEPAGFLSPASLHDVRVDPYGANMYWQGQQTNLEYLLYLDPDRLTWTFRQQAKLPTVGEPYGGWEAPDGQLRGHFTGHYLSAAAHMWASTHNDALREKMTKVVDILYSCQKKMNTGYLSAYPESMFDAYDELAEAWSPYYTIHKIMQGLLDQYTLAGNPKGLEIVVWMTDYFSTRVKKLIQEYSIQRHWEAINEETGGFNDVMYQLYAITKNQKHLTMAHLFDKPCFLGPLGLHDDDISGLHVNTHVPVIVGAQKRYEVVGDQLYKEIATFFFDVVNSSHTFATGGTSTMEHWHDPKRLVDEIKISSNEETCATYNLLKVSRNLFRWTKEGKYTDHYERLLINGIMGNQRGKEPGVMIYFLPMGPGRSKSISGMPTSGLPPKNPGGWGNANATFWCCYGTGIESFSKLGDSIYFLEEGEIPGLYIIQYIPSTFDWKAAGLTVKQQAKPLSSTDSHFEVSIFISSKGDARPANVNVRIPSWTSVDGAIATLNGQKLNLTSAGDFLSVTKLWGDDTLSLKFPITLRTEPIKDDRPEYSSIQAVLFGPHLLAGLTHGNQTVKTSNDSNSGLTPGVWEVNATHAAAAVAVWVTPVSQSLNSQLVTLTQRDGDAQAAAAFVLSVSIADGALTMQESPVAGSDACVHATFRAYQSPSGASAIDAATGRLQGRDVALEPFDRPGMAVTDALSVGRPGPATRFNAVAGLDGLPGTVSLELATRPGCFVAAPTTAYLAGAKAQVSCRKPTAAGGGEDDDDTAFRRAASFTQAAPLRLYHPLSFSATGTDRNFLLEPLQSLQDEFYTVYFNVLTK

SEQ ID NO: 2421 - protein, 902 aa, Oryza sativa Japonica Group
MTRRRSLAGGAAAAVVVLAAAAAAAFLSLLDGAAALHLCTDRLFNDTQGRHSDGLPHLNQAEEATWMGLLPRRAGPRDELDWLALYRSITRGGGDVGGEPAGFLSPASLHDVRVDPYGANMYWQGQQTNLEYLLYLDPDRLTWTFRQQAKLPTVGEPYGGWEAPDGQLRGHFTGHYLSAAAHMWASTHNDALREKMTKVVDILYSCQKKMNTGYLSAYPESMFDAYDELAEAWSPYYTIHKIMQGLLDQYTLAGNPKGLEIVVWMTDYFSTRVKKLIQEYSIQRHWEAINEETGGFNDVMYQLYAITKNQKHLTMAHLFDKPCFLGPLGLHDDDISGLHVNTHVPVIVGAQKRYEVVGDQLYKEIATFFFDVVNSSHTFATGGTSTMEHWHDPKRLVDEIKISSNEETCATYNLLKVSRNLFRWTKEGKYTDHYERLLINGIMGNQRGKEPGVMIYFLPMGPGRSKSISGMPTSGLPPKNPGGWGNANATFWCCYGTGIESFSKLGDSIYFLEEGEIPGLYIIQYIPSTFDWKAAGLTVKQQAKPLSSTDSHFEVSIFISSKGDARPANVNVRIPSWTSVDGAIATLNGQKLNLTSAGDFLSVTKLWGDDTLSLKFPITLRTEPIKDDRPEYSSIQAVLFGPHLLAGLTHGNQTVKTSNDSNSGLTPGVWEVNATHAAAAVAVWVTPVSQSLNSQLVTLTQRDGDAQAAAAFVLSVSIADGALTMQESPVAGSDACVHATFRAYHSPSGASAIDAATGRLQGRDVALEPFDRPGMAVTDALSVGRPGPATRFNAVAGLDGLPGTVSLELATRPGCFVAAPTTAYLAGAKAQVSCRKPTAAGGGEDDDDTAFRRAASFTQAAPLRLYHPLSFSATGTDRNFLLEPLQSLQDEFYTVYFNVLTK

SEQ ID NO: 2422 - protein, 407 aa, Zea luxurians
MAREAAREATTSRESGAEAAGECWSEALKSFLDHIPVSSVPGALQPTASPAVEVKLHGSVLGALDAMYSSNAAGAVIIDVVHSSLGKYVDRDIGFVEFSSLVLWALEELGKVESEPTDSTSDFLSTLKQHHQIAETKIAWLAKLFLWEPFFPVRTHDTLFHAMLLFSKHHRLNVAPVVESMNSSVIGFVTQNAVMELLLQSSGLEWLDKIADKQLSEFRFANVRKPVLVYSDQTLADGLHILSKEKTGVAVIDRKTSRLIGSLQCSDLYLFLDDSTLFSKRTTTTLEEFISLNNKTDRKCSTAENSCAPGRNILALRSRQSGMVGLPATNLESDTLKQAMEKLTTLRSSCSFIVDEHGRVQGVVTTRDIISVFSPPCMDSRIDGATFFSAALEQAGCRVENGQMFQN

SEQ ID NO: 2423 - protein, 407 aa, Zea mays subsp. mexicana
MAREAASEATASRESGAEAAGECWSEALKSFLDHIPVSSVPGALQPTASPAVEVKLHGSVLGALDAMYSSNAAGAVIIDVVHSSLGKYVDRDIGFVEFSSLVLWALEELGKVESEPTDSTSDFLSTLKQHHQIAETKIAWLAKLFLWEPFFPVRTHDTLFHAMLLFSKHHRLNVAPVVESMNSSVIGFVTQDAVMELLLQSSGLEWLDKIADKQLSEFRFANVRKPVLVYSDQTLADGLHILSKEKTGVAVIDRKTSRLIGSLQCSDLYLFLDDSTLFSKRTTTTLEELISLNNKTDRKCSTAENSCAPGRNILALRSRQSGMVGLPATNLESDTLKQAMEKLTTLRSSCSFIVDEHGRVQGVVTTRDIISVFSPPCMDSRIDGATFFSAALEQAGCRVENGQMFQN

SEQ ID NO: 2424 - protein, 407 aa, Zea mays subsp. parviglumis
MAREAASEATASRESGAEAAGECWSEALKSFLDHIPVSSVPGALQPTASPAVEVKLHGSVLGALDAMYSSNAAGAVIIDVVHSSLGKYVDRDIGFVEFSSLVLWALEELGKVESEPTDSTSDFLSTLKQHHQIAETKIAWLAKLFLWEPFFPVRTHDTLFHAMLLFSKHHRLNVAPVVESMNSSVIGFVTQDAVMELLLQSSGLEWLDKIADKQLSEFRFANVRKPVLVYSDQTLADGLHILSKEKTGVAVIDRKTSRLIGSLQCSDLYLFLDVSTLFSKRTTTTLEELISLNNKTDRKCSTAENSCAPGRNILALRSRQSGMVGLPATNLESDTLKQAMEKLTTLRSSCSFIVDEHGRVQGVVTTRDIISVFSPPCMDSRIDGATFFSAALEQAGCRVENGQMFQN

SEQ ID NO: 2425 - protein, 407 aa, Zea mays
MAREAASEATASRESGAEAAGECWSEALKSFLDHIPVSSVPGALQPTASPAVEVKLHGSVLGALDAMYSSNAAGAVIIDVVHSSLGKYVDRDIGFVEFSSLVLWALEELGKVESEPTDSTSDFLSTLKQHHQIAETKIAWLAKLFLWEPFFPVRTHDTLFHAMLLFSKHHRLNVAPVVESMNSSVIGFVTQDAVMELLLQSSGLEWLDKIADKQLSEFRFANVRKPVLVYSDQTLADGLHILSKEKTGVAVIDRKTSRLIGSLQCSDLYLFLDDSTLFSKRTTTTLEELISLNNKTDRKCSTAENSCAPGRNILALRSRQSGMVGLPATNLESDTLKQAMEKLTTLRSSCSFIVDEHGRVQGVVTTRDIISVFSPLCMDSRIDGATFFSAALEQAGCRVENGQMFQN

SEQ ID NO: 2426 - protein, 406 aa, Zea mays
MAREAASEATASRESGAEAAGECWSEALKSFLDHIPVSSVPGALQPTASPAVEVKLHGSVLGALDAMYSSNAAGAVIIDVVHSSLGKYVDRDIGFVEFSSLVLWALEELGKVESESTDSTDFLSTLKQHHQIAETKIAWLAKLFLWEPFFPVRTHDTLFHAMLLFSKHHRLNVAPVVESMNSSAIGFVTQDAVMELLLQSSGLEWLDKIADKQLSEFRFANVRKPVLVYSDQTLADGLHILSKEKTGVAVIDRKTSRLIGSLQCSDLYLFLDDSTLFSKRTTTTLEELISLNNKTDRKCSTAENSSAPGRNILALRSRQSGMVGLPATNLESDTLKQAMEKLTALRSSCSFIVDEHGRVQGVVTTRDIISVFSPPCMDSRIDGATFFSAALEQAGCRVENGQMFQN

SEQ ID NO: 2427 - protein, 374 aa, Zea mays
HIPVSSVPGALQPTASPAVEVKLHGSVLGALDAMYSSNAAGAVIIDVVHSSLGKYVDRDIGFVEFSSLVLWALEELGKVESEPTDSTSDFLSTLKQHHQIAETKIAWLAKLFLWEPFFPVRTHDTLFHAMLLFSKHHRLNVAPVVESMNSSVIGFVTQNAVMELLLQSSGLEWLDKIADKQLSEFRFANVRKPVLVYSDQTLADGLHILSKEKTGVAVIDRKTSRLIGSLQCSDLYLFLDDSTLFSKRTTTTLGEFISLNNKTDRKCSTAENSCAPGRNILALRNRQSGMVGLPATNLESDTLKQAMEKLTALRSSCSFIVDEHGRVQGVVTTRDIISVFSPPCMDSRIDGATFFSAALEQAGCRVENGQMFQN

SEQ ID NO: 2428 - protein, 407 aa, Oryza sativa Japonica Group
METGAAGQAGGGGPAAAAAAGEYWSEALKSFLDHIPVSSVNGAIQPSPSPALEIRLDGSVPDAIDSMYRSDVAGAVIVDDVRTSFGKFVDRDIGFVEFPSLVLWAIEEFDKLGSGAGDKNSDFLTSLKQHPQIAETKIAWLAKSFLWEPFFPVRSHDTLFHAMLLFSKHRRINVVPVVELMNSSVIGFVTQNAVMELLLSSSGLEWLDKIADKQLSEFRFANTTKPVSVYSDQTLADALHILSKEKIGVAVVDRKTSCLIGSIQCSDLYQLLDDSSLFRNRKTLSAEEFVKLKSKDEDISTENSSASGGQNVLSLRTGQRITAGLPVTNRKSDTLKQAMEKLTASRSSCSFIVDEHGRVEGVVTARDIISVFSPPCMDSRIDGGTFFSAALAQTGCRVEHGQMIQNS

SEQ ID NO: 2429 - protein, 359 aa, Sorghum bicolor
MAREAASKATASRGSGAEAEAEAAAGEYWSEALKSFLDHIPVSSVPGALQPTASPAVEVKLDGSVLGALDAMYSSNAAGAVIVDVVQSSFGKYVDRDIGFVEFSSLVLWALEELGKVESEPTDGTSDFLSSLKQHHQIAETKNAVMELLLQSSGLEWLDKIADKQLSEFRFANVRKPVLVYSDQTLADGLHILSKEKMGVAVIDRKTSCLIGSIQCSDLYLFLDDSSLFSKRTTTTLEEFIDLNNKANSKCSTAEDSSPPGQNILALRNRQPSMVGLPATNLKSDTLKQAMEKLTTSRSSCSFIVDEQGHVEGVVTTRDIISVFSPPCMDSRIDGGTFFSAALEQAGCRVENGQMIQNS

SEQ ID NO: 2430 - protein, 437 aa, Oryza sativa Indica Group
METGAAGQAGGGGPAAAAAAAGEYWSEALKSFLDHIPVSSVNGAIQPSPSPGKHRFLDSYTRRPGPGGALIRFWSRVRAAALEIRLDGSVPDAIDSMYRSGVAGAVIVDDVRTSFGKFVDRDIGFVEFPSLVLWAIEEFDKLGSGAGDKNSDFLTSLKQHPQIAETKIAWLAKSFLWEPFFPVRSHDTLFHAMLLFSKHRRINVVPVVELMNSSVIGFVTQNAVMELLLSSSGLEWLDKIADKQLSEFRFANTTKPVSVYSDQTLADALHILSKEKIGVAVVDRKTSCLIGSIQCSDLYQLLDDSSLFRNRKTLSAEEFVKLKSKDEDISTENSSASGGQNVLSLRTGQRITAGLPVTNRKSDTLKQAMEKLTASRSRCSFIVDEHGRVEGVVTARDIISVFSPPCMDSRIDGGTFFSAALAQTGCRVEHGQMIQNS

SEQ ID NO: 2431 - protein, 748 aa, Sorghum bicolor
MNPLCCIAPVSLEHAADQLHEHPTRIHAGAPPPTPAPQQDAVAGVLHKWVNYGKGWRSRWFVLEDGVLSYYKLRGSGGAGGAGAGEVAASSAAAAARVIGDGSALQQAQEVAAGAGKLWKPFGEIHLKVSSVRASKSDDKRLYIFSGTKTLHLRCETEEDRNAWIDALLAAKDQFPRSLTISDLGPADIMLSFEKLRARLLQEGLSEAVVRECESIIMSELLELHKQIKSQQQQHSILIDRLRQLETEKVELERTVVHETKERETLGYANRRQSDFYSVLSGGSTTESDPDTASHMAEVETEEDEVTYFDTRDFLSVESLRSASCQRRELTALGFGSEYVGVSVTNTVKTTKYPFVLRRDKLPEPKEKEKHIGLWSIIRENIGKDLSGVCLPVYFNEPLSSLQKCFEDLEYSYLVDHALHWGKQGDSLMRILHVAAFAVSGYASTEGRQCKPFNPLLGETYEADYPDKGLRFFSEKVSHHPMVVACHCDGRGWRFWGDSNLKGKFWGRSIQLDPIGVLTLQFDDGETFQWSKVTTSIYNIIIGKIYCDHYGTMRINGSGQYSCKLKFKEQSIIDRNPHQVHGFVQDNRTGQKVAMLIGKWDEAMYYVLGDPSVNPKGYDPMSEAVLLWERDKSLNQTRYNLSPFAISLNELTPHLLNKLAPTDSRLRPDQRHLENGEYEMANAEKVRLEELQRQARQLQEKGWRPRWFKKDFDGSYRYVGGYWEAREKGNWDGIPDIFAQNSLSTWLH

SEQ ID NO: 2432 - protein, 743 aa, Zea mays
MNPLCCIAPVSLEHAADQLHEHPQRILAGAPPATPAPKQDAVVGVLHKWVNYGKGWRSRWFVLEDGVLSYYKLRGAGAGGVAVSPAAAAARVIGDGSAVQQAREVAAGAGKLWKPFGVIHLKVSSIRASKSDDKRLYIFSGTKTLHLRCETEEDRNAWIDALLAAKDQFPRSQTSNDVGSMADIMLSSEKLRARLLQEGLCEAVVRECESIMMSELLELHNHIKSQQQQHSILIDRLRQLETEKVELERTVVHETKERETLGYANSRQSDFYSVLSGGSTTESDPDTASHMAEVETEEDEVTYFDTRDFLSAESLRSASCQRRELIAHGFGSEYVGDSVTNTVKTTKYPFVLRRDKLPEPKEKEKHIGLWSIIRENIGKDLSGVCLPVYFNEPLSSLQKCFEDLEYSYLVDHALHWGKQGDSLMRILHVAAFAVSGYASTEGRQCKPFNPLLGETYEADYPDKGLRFFSEKVSHHPMVVACHCDGRGWRFWGDSNLKGKFWGRSIQLDPIGVLTLQFDDGETFQWSKVTTSIYNIIIGKIYCDHYGTMRINGSGQYSCKLKFKEQSIIDRNPHQVHGFVQDNRTGQKVAMLIGKWDEAMYYVLGDPSVKPKGYDPMSEAVLLWERDKSLNQTRYNLSPFAISLNELTPHLLNKLAPTDSRLRPDQRHLENGEYEMANSEKLRLEQLQRQARQLQEKGWRPRWFKKDDGDSYRYMGGYWEARETGNWDGIPDIFRQNSLSPGLH

SEQ ID NO: 2433 - protein, 756 aa, Oryza sativa Japonica Group
MNPLCCIAPVSLDSAVEHHHQPPRILAAAAAAPTSPTPPAAAVAAQVVLDAAQAAVAGVLHKWVNYGKGWRLRWFVLEGGVLSYYKLRVGGGGDSAASPAVAARVIGEGGALRRAREEAAAAGKQWKPFGEIHLKVSSIRASKSDDKRLYIFSGTKTLHLRCETEEDRNAWIQALQAAKDRFPRSLTSNDFSPMSDVLLSTEKLRVRLLQEGLNETVVKECESIMMTELLELHNQMKSQQQQYSILIDRLRQLETEKVELERTVVHETKEREAHGYANGRYSDFYSVLSGGSASESDPDTASQVADVETDEDEVMYFDTRDFLSAESLRSASCRRRELLTNGCNGLEHTDPAANVVKTTQYPSVKRRDKLPEPKEKENPVGLWSIIKENIGKDLSGVCLPVYFNEPLSSLQKCFEDLEYSYLVDHALQWGKQGDSLMRTLHVAAFAVSGYASTEGRQCKPFNPLLGETYEADYPDKGLRFFSEKVSHHPMVVACHCEGRGWKFWGDSNLKGKFWGRSIQLDPIGVLTLQFDDGETFQWSKVTTSIYNIIIGKIYCDHYGTMRIKGSGDYSCKLKFKEQSIIDRNPHQVHGFVQDNRTGQKVAMLIGKWDEAMYYVLGDPSAKPKGYDPMSEAVLLWERDKSLNQTRYNLSPFAISLNELTANLAKKLPPTDSRLRPDQRHLENGEYEMANAEKLRLEQLQRQARRLQEKGWQPRWFSKDDDDSYRYIGGYWEAREKGNWDGIPDIFGQRSASPGWS

SEQ ID NO: 2434 - protein, 765 aa, Oryza sativa Indica Group
MHAVSAQVHQHQTSAQSEQPTNQAQPAESLAGGRPAGSTTVSNTPPAAAGAAAAAQVVLDAAQAAVAGVLHKWVNYGKGWRLRWFVLEGGVLSYYKLRVGGGGDSAASRAVAARVIGEGGALRRAREEAAAAGKQWKPFGEIHLKVSSIRASKSDDKRLYIFSGTKTLHLRCETEEDRNAWIQALQAAKDRFPRSLTSNDFSPMSDVLLSTEKLRVRLLQEGLNETVVKECESIMMTELLELHNQMKSQQQQYSILIDQLRQLETEKVELERTVVHETKEREAHGYANGRYSDFYSVLSGGSASESDPDTASQVADVETDEDEVMYFDTRDFLSAESLRSASCRRRELLTNGCNGLEHIDPAANVVKTKYPSVKRRDKLPEPKEKENPVGLWSIIKENIGKDLSGVCLPVYFNEPLSSLQKCFEDLEYSYLVDHALQWGKQGDSLMRTLHVAAFAVSGYASTEGRQCKPFNPLLGETYEADYPDKGLRFFSEKVSHHPMVVACHCEGRGWKFWGDSNLKGKFWGRSIQLDPIGVLTLQFDDGETFQWSKVTTSIYNIIIGKIYCDHYGTMRIKGSGDYSCKLKFKEQSIIDRNPHQVHGFVQDNRTGQKVAMLIGKWDEAMYYVLGDPSAKPKGYDPMSEAVLLWERDKSLNQTRYNLSPFAISLNELTPNLAKKLPPTDSRLRPDQRHLENGEYEMANAEKLRLEQLQRQARRLQEKGWQPRWFSKDDDDSYRYVGGYWEAREKGNWDGIPDIFGQRSASPGWS

SEQ ID NO: 2435 - protein, 773 aa, Vitis vinifera
MNPLCCIAPVSIDRDRANPAQVSSINAESDAVSHDVEDAFPEARDGKVFGAGGGVAGILYKWVNYGKGWRSRWFVLEDGVLSYYKIHGPDKILMSPAREKSLKVIGEDSLRCMKKNSWSNHHRLAGSAKQWKPFGEIHLKVSSIRASKSDDKRLSIFTGTKTLHLRCISREDRSAWIEALQAAKDLFPRVLTSSDFAPSEDIVVSTEKLRLRLVQEGVGEVVIKDCESIMLSELSELQNQFKALQRKHIILLDTLRQLETEKIELETTVVDETKERESYCGQGNRRFSDFYSIMSEGSGSDSDADNESQDGVDVETDEDDIVFFDTNDFLSSESLRSASYRSRETLGNGTLINNRDPFLSDHLHDEMEIRTVEYPYIKRRDSLPEPKEKEKPVGLWSIIKDNIGKDLSGVCLPVYFNEPLSSLQKCFEDLEYSYLVDRAMEWGKQGNDLMRILNIAAFAVSGYASTEGRQCKPFNPLLGETYEADYPDKGLRFFSEKVSHHPMIVACHCEGRGWKFWADSNLKGKFWGRSIQLDPVGVLTLQFDDDETFQWSKVTTSIYNIILGKIYCDHYGTMRIKGSGNYSCKLKFKEQSIIDRNPHQVHGFVQDNRTGEKVAMLVGKWDEAMYYVLGDPTTKPKGYDPMTEAVLLWEREKFVTKTRYNLTPFAISLNELTPGLLEKLPPTDSRLRPDQRHLENGEYELANAEKLRLEHLQRQARKLQERGWQPRWFRKDKEDGCYRYIGGYWETREKRYWDGIPNIFGQGSDSPSCLIEE

SEQ ID NO: 2436 - protein, 796 aa, Vitis vinifera
MNPLCCIAPVSIDRDRANPGPCQLGLESSVKNVNIGSKQGFSAQVSSINAESDAVSHDVEDAFPEARDGKVFGAGGGVAGILYKWVNYGKGWRSRWFVLEDGVLSYYKIHGPDKILMSPAREKSLKVIGEDSLRCMKKNSWSNHHRLAGSAKQWKPFGEIHLKVSSIRASKSDDKRLSIFTGTKTLHLRCISREDRSAWIEALQAAKDLFPRVLTSSDFAPSEDIVVSTEKLRLRLVQEGVGEVVIKDCESIMLSELSELQNQFKALQRKHIILLDTLRQLETEKIELETTVVDETKERESYCGQGNRRFSDFYSIMSEGSGSDSDADNESQDGVDVETDEDDIVFFDTNDFLSSESLRSASYRSRETLGNGTLINNRDPFLSDHLHDEMEIRTVEYPYIKRRDSLPEPKEKEKPVGLWSIIKDNIGKDLSGVCLPVYFNEPLSSLQKCFEDLEYSYLVDRAMEWGKQGNDLMRILNIAAFAVSGYASTEGRQCKPFNPLLGETYEADYPDKGLRFFSEKVSHHPMIVACHCEGRGWKFWADSNLKGKFWGRSIQLDPVGVLTLQFDDDETFQWSKVTTSIYNIILGKIYCDHYGTMRIKGSGNYSCKLKFKEQSIIDRNPHQVHGFVQDNRTGEKVAMLVGKWDEAMYYVLGDPTTKPKGYDPMTEAVLLWEREKFVTKTRYNLTPFAISLNELTPGLLEKLPPTDSRLRPDQRHLENGEYELANAEKLRLEHLQRQARKLQERGWQPRWFRKDKEDGCYRYIGGYWETREKRYWDGIPNIFGQGSDSPSCLIEE

SEQ ID NO: 2437 - DNA, 1303 bp, Sorghum bicolor
atggcggaggaaggggaggaggcggtgccgccggcggcggcgacggtggtgggggaggaggacgcgccggccggggaggcgccggcgccggccgtggactactttgggctgcccgctgagctggtgtccgtgctgccatcagacccgttcgcgcagctggacgtggcgcgcaggatcacctccatcgcgctctcgcaccgcctcggcctcctcgaggccgaggcggcgctcctgcgctcgcagctcgccgagcgcgacgccgaggccgaggacctccgggagcgcgtcgagcagctcgacgccgcgctcgccgtcgccaccggccgcctccgccgcgccgaggaggaaaaggaggcactgcagcgggacaactctgcgctgtccaacaccgttaccaagttgaacagagatgtcgccaagttggaagttttcagaaagacacttgtgcagtcactccaggaagatgacagcagtgataatactgttcccggggcaagagttgcagcaacttcaaatttctcctctgcaccatcagatgaagattctgcatttccaacttccaaatcatcacagatttcagaaactgcgagttcagtttcagaggaaaatagccaagttgacccagatggacctaggccaccccgtcctggacgtccacatgtatttttgccgtcatacaacagcacaccaaggatgactcccccaggctcacctccaaggcgttatgcatcggtatcaccgccaaggcgacattcaatctctgttacatcgatgaatatgttgaatgacaggtcctcaggcttttctggtcagcatacctctccatttgacgctccaagtcaaacaggacgaacaagagttgatggaaaggagttctttcgtaatgtcagaaatcgattatcatatgagcagtttggtgcattcctgactaatgtgaaggagctgaacgcacacaggcagaccagagaggataccttaagaaaggccgatgaaatcttcggtcctgaaaacaaggacctgtacaccatttttgagagcctgataactcgcaatattcgctagtcttctgaagggttgaaacattacccatgattactagtgattcaagttttaccagtatactgtgattatgatattcatcactattttaatttgaagtctgtagtctgttgtggattcttggtatctagttctatagttacttatgtccatgtagtgtcccacgtttgtctggaagctacaatttatattctaatacaagtggaggaaatattggaataaagggaaatatgttatttgtctg

SEQ ID NO: 2438 - DNA, 1385 bp, Zea mays
cgccaccacaaagagacttcgcgccacactagcctaatccccgcgctggcccctggcgggcagataacggtcgcggcacggaaagggcgagagagaagggcgccagagcactagtacaggaggcgcggagcaggaggaaacacatggcagatgaaggcgaggagggggtgccgccggccgcgatggtgggggaggcgccaaccgaggactttgggctgcccgctgagctgatggccgtgctaccatcggacccgttcgctcagctggacgtggcgcgcaagatcacctccatcgcgctctcgcaccgcctcggccgcctcgaggccgaggcggcgcgcctgcgctcgcagctcgccgagcgcgacgccgaggccgaggagctccgcgagcgcgtcgagaagctcgactccgcgctcgccgtcgccaccggccgcctccgccgcgctgaggaggaaaaggagacactgctgcgggacaactctgcgctgtccaacaccgttaggaagctgaacagagatgtcgccaagttggaagttttcaaaaagacacttgtgcagtcgctccaggaagatgacagcagtgataatactgctcccagggcaagcgttgcagcaacttcaaacttctctgcgccatcagatgaagattctgcatttccaacttccaaatcatcacagatttcagaaactgcgagttcagtttcagaggaaaatagccaagttgaaccagatgcacctaggccaccccgtccacatgtatttttgccgtcatacaacagcacaccaaggagaactcccccagactcacctccaaggcgttatgcatcggtatcaccgccgaggcgacattcaatctccgttacgtcgatgaatatgtttaatgacaggtcctcaggcttttctagtcagcatagctctccatttgaccctccaagtcaaacaggacgaacaagagttgatggaaaggagttctttcgtcatgtcagaaatcggttgtcgtatgagcagtttggtgcattcctggctaatgtgaaggagctgaacgcacacaggcagaccagagaggataccttaagaaaggctgatgagatctttggtcctgaaaacaaggacctgtacaccgtttttgagagcctaataactcgcaacattcgctaatctcctcaagggttgaagcattaccaatgattactagtgattcatgttttaccggtatattttggttacaatgttcaacactttttttgtatttgaagtctgtagtctgttgtggattcttggtatatagtctatagttctttctttttttttcatgctaatgtccatgtagagtcctctgtttctatgtaagctacaacttatattctaatacaaatgttgtctgat

SEQ ID NO: 2439 - DNA, 1303 bp, Zea mays
acaggaggcgcggagcaggaggagacacatggcagatgaaggcgaggaggcggtgccgccggccgcgatggtgggggaggcgccaacagaggactttgggctgcccgctgagctgatggccgtgctaccatcggacccgttcgctcagctggacgtggcgcgcaagatcacctccatcgcgctctcgcaccgcctcggccgcctcgaggccgaggcggcgcgcctgcgctcgcagctcgccgagcgtgacgccgaggccgaggagctccgcgagcgcgtcgagcagctcgactccgcgctcgccgtcgccaccggccgcctccgccgcgctgaggaggaaaaggagacactgctgcgggacaactctgcgctgtccaacaccgttaggaagctgaacagagatgtcgccaagttggaagttttcaaaaagacacttgtgcagtcgctccaggaagatgacagcagtgataatactgctcccagggcaagcgttgcagcaacttcaaacttctctgcgccatcagatgaagattctgcatttccaacttccaaatcatcacagatttcagaaactgcgagttcagtctcagaggaaaatagccaagttgaaccagatgcacctaggccaccaccccgtccacatgtatttttgccgtcatacaacagcacaccaaggagaactcccccagactcacctccaaggcgttatgcatcggtatcaccgccgaggcgacattcaatctccgttacgtcgatgaatatgtttaatgacaggtcctcaggcttttctagtcagcatagctctccatttgaccctccaagtcaaacaggacgaacaagagttgatggaaaggagttctttcgtcatgtcagaaatcggttgtcgtatgagcagtttggtgcattcctggctaatgtgaaggagctgaacgcacacaggcagaccagagaggataccttaagaaaggctgatgagatctttggtcctgaaaacaaggacctgtacaccgtttttgagagcctaataactcgcaacattcgctaatctcctcaagggttgaagcattaccaatgattactagtgattcatgttttaccggtatattttggttacaatgttcaacactttttttgtatttgaagtctgtagtctgttgtggattcttggtatatagtctatagttctttcttttttttttcatgctaatgtccatgtagagtcctctgtttctatgtaagctacaacttatattctaatacaaatgttgtctgatatttcttgaacacaaaaaaaaaaaaaaaa

SEQ ID NO: 2440 - DNA, 1395 bp, Zea mays
ccttcgccaccacaattccacaaagagacctcgcgccccaccagtctaatctcccgcgggcgggcagataacggctcgcggtacggaaagggcgagagagggggagcggagagcaccagtccaccgagaggcgcggagcaggagggcacacatggaactggaggaggcggtgccgccggccgcgatggtgggggaggacaacgcggcggcgccgacccaagactttgggctccccgctgagctgatagccgtgctgccatcggacccgttcgctcagctggacgtagcgcgcaagatcacctccatcgcgctctcgcaccgcctcggcctcctcgaggccgaagcagcgcgcctgcgctcgcagctcgccgaacgcgacgccgaggccgaggacctccgggagcacgtcgagcagctcgacgccgcgctcgccgtcgccaccggccgcctccgccacgccgaggaggaaaaggacgcactgcagcgggacaactctgagctgtccaacaccgttaggaagttgaacagagatgtcgccaagttggaagttttcaagaagacacttgtgcagtcactccaggaagatgacagcagtgataatactgctcccagggaaagagctgcagcagcttcaaatttctcctctgcaccatcagatgaagattctgcattttcgacttccaaatcatcacaggtttcagaaaccgcaagttcagtttcagaggaaaataaccaagttgacccagatgcacctaggcggccaccccggccacatgtatttttgcaatcatacaacagcacaccgaggatgactcccccagactcacctccaaggcgttttgcatcggtatcaccgccaaggcgacattcaatctctgttacatcgatgaatatgtttaatgacaggtcctcaggcttttctggtcagcatagctctccatttgacgctccaagtcaaacaggacgaacaagagttgatggaaaggagttctttcgtcaggtcagaaatagattatcttatgagcagtttggtgcattcctggctaatgtgaaggagctgaacgcacataggcagaccagagaggataccttaagacaagcttatgagatcttcggtcctgaaaacaaggacctgttcaccatttttgagggcctaataagtcgcaatattcgctagtctcattacccatcgttactagtgattcaagttttaccggtatattgttattacgatattcatcactgtttgtatttgaagtctgtggtctgttacggattcttggtatatagtagttctatggttcatcttttcatgcttatgtccatgtagaatgggtttgtctggaagctacaatttatattccaatacaaatggaagctaaaattgtacgtacc

SEQ ID NO: 2441 - DNA, 1297 bp, Zea mays
cggtcgcggcacggaaagggcgagagagaagggcgccagagcactagtacaggaggcgcggagcaggaggagacacatggcagatgaaggcgaggaggcggtgccgccggccgcgatggtgggggaggcgccaacagaggactttgggctgcccgctgagctgatggccgtgctaccatcggacccgttcgctcagctggacgtggcgcgcaagatcacctccatcgcgctctcgcaccgcctcggccgcctcgaggccgaggagctccgcgagcgcgtcgagcagctcgactccgcgctcgccgtcgccaccggccgcctccgccgcgctgaggaggaaaaggagacactgctgcgggacaactctgcgctgtccaacaccgttaggaagctgaacagagatgtcgccaagttggaagttttcaaaaagacacttgtgcagtcgctccaggaagatgacagcagtgataatactgctcccagggcaagcgttgcagcaacttcaaacttctctgcgccatcagatgaagattctgcatttccaacttccaaatcatcacagatttcagaaactgcgagttcagtctcagaggaaaatagccaagttgaaccagatgcacctaggccaccaccccgtccacatgtatttttgccgtcatacaacagcacaccaaggagaactcccccagactcacctccaaggcgttatgcatcggtatcaccgccgaggcgacattcaatctccgttacgtcgatgaatatgtttaatgacaggtcctcaggcttttctagtcagcatagctctccatttgaccctccaagtcaaacaggacgaacaagagttgatggaaaggagttctttcgtcatgtcagaaatcggttgtcgtatgagcagtttggtgcattcctggctaatgtgaaggagctgaacgcacacaggcagaccagagaggataccttaagaaaggctgatgagatctttggtcctgaaaacaaggacctgtacaccgtttttgagagcctaataactcgcaacattcgctaatctcctcaagggttgaagcattaccaatgattactagtgattcatgttttaccggtatattttggttacaatgttcaacactttttttgtatttgaagtctgtagtctgttgtggattcttggtatatagtctatagttctttctttttttttttcatgctaatgtccatgtagagtcctctgtttctatgtaagctacaacttatattctaatacaaatgttgtctgataaaaaaaaaaaaaaaaaaaaga

SEQ ID NO: 2442 - DNA, 2789 bp, Zea mays
ctgacaggcgcaagaagaggagaggagaagaacagaggggagtggaaataatctagcagcggaaggggaagcagcacgaagggaagcggcagcggaagcggggttctggctaaagtacgttaaggtcttttttatcagcaattccagtaatgtgccttgcctcttttacgtgactatacgagacaatgaatggaactcatccctgggcctccatgtccggaggtccatgttctaaccttggatatgccagggacatgaatggtaatgttccaataagcactacaaattcttctgggccaagcattggagttagctcattggtgactgacgccaactcgtcactttccggtggtgcccagttacagccaagtactagcatgaatggtgattcattgatgcgtgttcctgcgtcaccaatatcgttttcatccaataacatctctggctcttcagtcattgacggttgcatcatgcagcaaagtccaccccaagagcaggtgcagaaacagaggtcttcaagtgtaacatcacaacctgtgattgatgctggtggtgcattgcatgctcagaagaaatcaaggattgatgtttgtcagggtggtatcacggaacaacagctgattcagcaactgctccatggtcagaattctcttcattaccaggggcaacagaatccacagcttcaagctttaatgcagcatcataaactggcacaacttcagcaacggcagcagcagcatccattttctcagatgcaacaaccccaagttggtattcctcggcagcctcaacttaggccaccactggcacagactggaatgcagttaggtggtcctgttaggtctcctatcgagagtgggatttgttctcgcaggatactgcagtatttatatcacaagcgtcatcgcccagagaataaccctataacatactggaggaagcttgttgaagagtacttcgcacctcgagcaagagaaagatggtgtgtctcttcttatgaaaacagagggaattcttcagctgctgctccacagaaagctttggatacgtggcgatgtggcatttgcaatacacatggtgggaaaggatatgaagttacctatgaagtacttcctaggctctgccaaattagatttgaccatggtgttattgatgaatacttatactttgactcacccaacgaattccggttgcctaatggacaaatggtgctggagcatgcaaaagtagttcaaaaaagtgtttatgaacatctgcatgttatacacgagggacatctgagaataattttcacaccagaactgaagataatgtcttgggagttctgttcacgacgccatgaggagtacaccactcgcaagactatagcaccacaggttaataatcttctgcaagttgcccagaaattccaagctgttgtcagtgaaagtggatcagctgggatatcaaataatgatgcacaaaccatctgcaacatgtttgttaatgcatcacggcaactggcaaaaaatctagagcatcacaccttaaatgaacatgggctttctaaaagatatgtacgctgcctgcagatatcggaggtggtgaatcacatgaaggacttgatcgagttcagccacaagagcaagcttggtcctaaagagagcctgaacagttattctaaaaccacggcaaagtttgagaatatgcatgattcgagacaggccatggctgccgctaaccttgccaacaaccagagcaacaccaaattgatgggggtcaaacaagagacaagcacttctgcgaacaaccagactcctggtgccggagccattggcaacaacaatctaccgattgccgcacctctaaacacctaccagaacatgctcagaagctcaggtgccagtacgatttcgctgcagcaggaggcgtcgagtgtcttcaaaggtcctacagcaatgcacaacggcatgcagctggaagcggccaggtccttcctgggacctaaccaagttcaattccagcaccacccaccgtcgtcgtcgtttcagcagcagcagcaaaacagtttccatggctttggtgtcaacccgcagtaccagcagcatgtcctcaaccagcttctgcaggaagttaagaacagtaacaaccgctcgaaagcgcagcaaccgcctctggatgcaccaccgccgaatgcgagcggcgggggtctcgcgccaggagttgctacccccaacgtcattgctgctactggggagcaggggcagcatgtcaataacagtagctctaaccataacggcacggtaaagggtgctgctggtactggccctagcaatgtcatcaacaatagcacagccagcatggcttcggccagaaacagcagcttcaagtcggtgagcagcagtccagctgctgctggcaatgccgtgagctcgaaggtcgatgactccttccatcaactggaggacctcgacgacatgatcgctaacgaactggtggagagcgggctgttcggtgcaggacacgggtggtagtacgctactgtggtaaagccaagcaatgagatataagcctaagcctgattggtgctggcaagtgcttttgccgccgccacccttctctttctgtagagctttatgtattgacagttttccgatgatgatcatatcatacactggcgtcgctccagatgtgtgtgagttgagatagtgggttggattggatttggctgatagttagcgtgtgtatggcatgttgctgaatcaaatgatgtgatcatcgcaaggtcacaaacagcctctttgtcatgt

SEQ ID NO: 2443 - DNA, 4934 bp, Oryza sativa Japonica Group
atgtctggggcgccatgctccaaccttggacttgttcccagggatatgcatggtagtatccctattagcactacaaattcctctgggccaagcattggtgttagctctttggtgacggatgctaactcatcgctctccggaggtgcccagttgcagccaagtacgagcatgaatgctgattcattcatgcgccttcctgcttccccaatgtcgttttcatccaataacatctctggatcttcagttattgatggtcccattgtgcaacaaagtcctccccaagagcagatgcagaagcgaaggtcttctagtgtaacatcacaacctgttattgatgctgctggtgcattgcatgctcagaagaagtcaagggttgatattaggcaagatgatatcctgcaacacaatttaatccagcaactgctccaaggccagagttctcttcatctgcagggtcaacagaaccctcagattcaagccttgatccatcagcataaactggcacagattcagcagcaacagcagcatcagatgttgcaaccattttcacagatccaacaatctcaagttggcatacctcggcagccacagttgaggcctccactagcgcagcctggaatgcagctagctggacctgttaggactcctgtcgagaatgggctttgttctcgaaggttaaagcaatacttataccataagcgtcaccgaccagaggtgaggttctgcgttgtaaacatttattgcaagacacatgttcttggctataagatttactatttactggagtacctgcttgtagaataatccaataacatactggaggaagcttattgatgaatattttgcaccacgagcaagagaaagatggtgtgtatcctcgtatgagaaaagaggaaatccttcaggtgctgttccacacacagctccggtcagttcacggttcacacttaaatctttatatctgcattgtacattgacgccctttactttcctgtttcaacagaatacttctcagtgtgatgttcacaacaatattgattagcatctcttttaaactttgcttggatattgaacactatattttgacagtcaagtatcttgtgattgtagtgagaaacaaaatccatatgagcgtgttctatagatgaatattttgaaatagttagcattgcattttcattttttaatgatcgttctactgagagctgagatagctgatgctgttgagattttagtaaactgtgaagcataaattcgtagttgcaccttttaaattactattttctccatgtttcaggattcatggcgctgtgacatttgtaatacacatgggggcaaaggatatggttagttgactacttttttggaaccttatccagcttcattatcataacaatgaaccttgcaatttgctctgttcccactcctgtctttttttatggaagatcaattactgcactgttttgtgcctatagtacttttggtagataaactcaatattcctacatgtcttgtgctatagagattgcctcctcatctcaagacagaaaatgcaaatatataaaactgtattatcttgagtgtatctttcatatgagaaattagccatcacgagcaaaaaagaaagtatcctatgaagtttatatctcaagaggctttgtctgtcttgaatatacttggaatgattggtcagactggcagaaaatatttttcttgaaactacatggtgatatcctagtattgttatgtagttctggttctgcatttctgcatagtatatgttaccatatattgtgcagtttgcacctgccatttcttcaaaatgtacctcacaacatatttttccctggactactttgtattttgctccttttttaaagtactagtgtgttcttctcataagaagtcatgatcttttttgcttttttcattagttcagttccattgtatgatgttgatctcactttgttattattgtttcaatcttatctggcagaggctacctatgaaatacttcctagactctgtcaaattagatttgaccatggtgttatagatgaatacttattccttgacatggccaatgaattccggttgcccaatggactaatgctgctggaacatactaaagttgttcagaaaagcatttatgaacatatgcatgtgatacacgaggggcagttgagaatcatattcacaccagaactgaaggtaaaggcttatttgtaatagcttgcatttgtgaatatctagatgttgcaaatgattggacagtttaggatcattcttatctgctgttttcatgtgaaaatatgcagataatgtcctgggagttctgttcacggcgacatgatgagtatatcactcgcaggtttctttcaccccaggtagatttatgctgttctgttttatttgattaaactttgatcaatagagagcagatagtagattagctgctgtaatatacccaatacacctcttatgtgatagttgtcaacacgtatgtaagcaattttaataaagtggtttagttggatgaatattgcgaatcttggtaggctgggttgtaaaaagccccttctttttcctgctagactgctccaacatctatttagattcttgtttaattttccaatttatgtactggcttcctgagggctgcacatgcaaaaacacaagataatttcgaattttaagccatcttgaccgtccttgtctagtttttattttggtagtgctgtcctgatggtaaacatccctgttttttctgcacattttgatctctgccattctttggtgtactccaattttggtgacttggtatctcattgttcatatgtgctttttccaggttgctcatctgctgcaagttgcccagaaatatcaaactgttgccactgaaagtggtccagctggggtctcaaacagtgatgcacagaacatttgcaacatgttagtgagccaactatgccactagttccttgacatgcaattttaattcctcttctggcatgacaaatcatgattttttaaaaattccatctagagttttttttatttatgatctaattgatctcagcaccccattacgctctttaggtttgtgacggcgtcacgacagctagcgaaaaatatagaccaccacaccttaaatgagcatggtctatctaaaagatatgttcgctgcttgcaggtaagcatagcatttgtaggttatttaattatttttgtgatattatccataaagaagctcctgaattttctttagttattaatatctcgctgctaacagtatccatattttcacgagttctccttgtgttatttaacatttgctataatattatccagaatttcctgtaatatacttctgcacacagcatcttcattgaatttgtgtcctcttcagatatcagaggtggtgaatcacatgaaagacctgattgaattcagccacaagaacaagcttggtcctataggtatggtttatgcaaattcaccactcagttctctattgtttgactaggcgctcaatattatataatgaagttctccaggcagttttgcctgaccaatgttttgcatgaaaatggtaataagcataagcctagaagttcttttggtctgaagtgttgagagatattctattgtttggggaaaatgcttacagggctagatagtaaaagcatatccatggcaaaccaaatccaacatcatatacttgttgttatgatatcacttggtaaacatggtttttgaactagctatggtggtgtgtggttgccgtatggaaggattacctggtaaattattattattgttgctggatactagattataacagcataccaatttagataatacagtgataacagcgaagcagctgtttttccccctttttccctgtaaaattcagcaatttttttatgctttgaaatgtttaatgttttccctgttcatctgcagagggtctgaagagctatcccaagcaaactgcagcaaaacttccagtacaaaacatgcacgagccaaagcaactaatggcagctgctggccttcctaatgaccagactaacctcaaagccatgggtgtcaaaacagaaatgaacacccatgcgaatgagacgcacggtattggaccaattggaaatggtccgcagaatgctgctgcacttaacaattaccagaatcccattggaaatggtctgcagaatgctgctgcacttaacaattaccagaatatccttagaagttcagtcgcaaaccagagtttgcttcagcaggaggcatcaagcatgtttaaaggtcccacagcaatgcacaatggcattcagctggaagcatctagatccttccgtggaccaaaccaggtgcatctcgcgcagttccaacatccggcctcatttcagcagcctatgcctcagcagagcagcctccagggcttgggtgtgagcccacaatatcagcagcatgtgctccatcagttgctgcaagaggccaagaacactaacaaccgtgtcttggcgcagcagcagcagcaacaacaacttcaacatgctcctgctaacagtggtcttgcatcaggaggaacggctatcaccggcagcgccgctagcggggatcatatgaataacaacggcgcggtgaagggtgggactccaatggttacaacaggtcctagcagtgtgatcaacaatacagccagcatcctccccagcagaagtaacagcttcaagtcagtgagcagcaacccccaagttgcagctgctgcgggcggcggcattggcagcggcggccatgcggctacccccaaggctgatgctctgcatgagttggatgatcttgacaatcttgggaatctgatcagtactgaactggaggagagtgggctgttcctgggtgaccaggcaggtggtggctactcatggaacatg

SEQ ID NO: 2444 - DNA, 2013 bp, Zea mays
cagtttggggagcatatgctcagcgacttctaaatcctgaagcaagactttggaggaatcccagtaatggtggtcatgatgacaaggcacatcctcctattcatccaaccaaattttcagaaggtgaaagaaactggagtccagaccacactagattgtatgagtttgttgtccgacatttccttgcatgttgctctcaaccggccgttggagctgaaacaactgtggaaattgacatagctggtgaacagtttaatgcatcagggcgtgtcatacttgctaaaaattatctggatgtttaccgctttgactcatggggtggaacgttacttccaacatacaacattgggcagcagtttgttccgacaactttaacacttgattctggagtgactcggccaccgcctcttctggctgaagccgaccttcttagctgtatggataaagaattggcactgatgcaaccatgcatgatcacataaaaaagttgcttgaccgttgttatgcaaccaaagatgaaaacacacgtttctccccgacaaatcttggtgaggcattggtgatgggttatgatgaaatggggtgagttgactcttaaagttgctgcacttactgaatatataaaggatgatctggttgctttgctcaaacactactttttaggtatgagctttggaagccttatttaagatcaatgatggaagctgatatgaaatcagttagcgtgggtactaagagtaaatcagaagtacttgagagttgtttgcagcagatgaaggcctgttttcttgacgcaagggtgaagaaagcaaaactccttgatgcaatggggacattctttgcaaggtctaataggcctataaatgaaactcaaaatccagtagaggttgtgaggccttgtggtgcatgcaatggatctgaaatgttgcttaagcgaagggcgagtggtgaatttatggttgggtgccgaagttatccacaatgtagaaacgtggtatggctcccaggatctctttcagaagcggctgtaactaatcaagtttgtcctatctgcgcaccaggccctgtttataagattcaattcaagttccgtcggagggatattccaccaaatttcgatgttgatcacctaggttgtgttggtggttgtgatgatatcctcaaagaccttatggagataagtaggtttggaagtcgcagccaggctgcaacaccagcaagaggaccaacaccaaatggtgtgggtcaggggactccaagacaggatttacatactatttttcgtccggcaagccagcttaataatgataacccatcggttatgcattctcaaggtttccgttcaacccatacccaaaatccaagtaatgcatcagatgcaggtcaagtgctgtgcacctcatgtggagcgctttgcatatcacgaattgctaatacagaggctaacagggggaggaggttctacaaatgtcaagatcctggctgtggcttcttcaaatgggaagacgaagtggacaatggtacggggagaggccgccgtgggcgcggcagcagcaggcaggcgtctgcgtctgcatctgcaggacggagaggcggaggccggagaggcagaggccgtaacgctgacggcgggatgttcgtttcagcgacgggcgacaccgtgctcggctgctgctttaactgcggcgatccttcccacttcgcaaacgcctgcccgaaccggagatagttatcagggagctgctcgctatgcgtgtacagagactggcagcgtccgccaaacgatgaagccttcggatggttttcgtgtactgaggtgcatataagtgcacctgacaagctcattttctagacaattactaatatttttaaacaaaatgcagctattaggctgatgctagttcagcaaatctgacggcacttatttacaaaagttagggcgcgaaaaactgacaaaggaagagatgcaaacacgagctgatctactaaggtttcgataacaagtttctactc

SEQ ID NO: 2445 - DNA, 2067 bp, Zea mays
ctgggctcccgggcgcgcggaatcgctgcggaatcgccgctcggcgccgcctaggcgctccaaacgcctagcagcccgcctacccccctagtccaggcgggaggccgtggcctagcgcctaggcgcgcctaggcgcgtcgtaatcgtggattttcaaaaccctgttttgaatacatgtctatccttgacctaggcaatcgtacgtgaacaagtgaatcatccagtttggggagcatatgctcagcgacttctaaatcctgaagcaagactttggaggaatcccagtaatggtggtcatgatgacaaggcacatcctcctattcatccaaccaaattttcagaaggtgaaagaaactggagtccagaccacactagattgtatgagtttgttgtccgacatttccttgcatgttgctctcaaccggccgttggagctgaaacaactgtggaaattgacatagctggtgaacagtttaatgcatcagggcgtgtcatacttgctaaaaattatctggatgtttaccgctttgactcatggggtggaacgttacttccaacatacaacattgggcagcagtttgttccgacaactttaacacttgattctggagtgactcggccaccgcctcttctggctgaagccgaccttcttagctgtatggataaagcaggaattggcactgatgcaaccatgcatgatcacataaaaaagttgcttgaccgttgttatgcaaccaaagatgaaaacacacgtttctccccgacaaatcttggtgaggcattggtgatgggttatgatgaaatggggtatgagctttggaagccttatttaagatcaatgatggaagctgatatgaaatcagttagcgtgggtactaagagtaaatcagaagtacttgagagttgtttgcagcagatgaaggcctgttttcttgacgcaagggtgaagaaagcaaaactccttgatgcaatggggacattctttgcaaggtctaataggcctataaatgaaactcaaaatccagtagaggttgtgaggccttgtggtgcatgcaatggatctgaaatgttgcttaagcgaagggcgagtggtgaatttatggttgggtgccgaagttatccacaatgtagaaacgtggtatggctcccaggatctctttcagaagcggctgtaactaatcaagtttgtcctatctgcgcaccaggccctgtttataagattcaattcaagttccgtcggagggatattccaccaaatttcgatgttgatcacctaggttgtgttggtggttgtgatgatatcctcaaagaccttatggagataagtaggtttggaagtcgcagccaggctgcaacaccagcaagaggaccaacaccaaatggtgtgggtcaggggactccaagacaggatttacatactatttttcgtccggcaagccagcttaataatgataacccatcggttatgcattctcaaggtttccgttcaacccatacccaaaatccaagtaatgcatcagatgcaggtcaagtgctgtgcacctcatgtggagcgctttgcatatcacgaattgctaatacagaggctaacagggggaggaggttctacaaatgtcaagatcctggctgtggcttcttcaaatgggaagacgaagtggacaatggtacggggagaggccgccgtgggcgcggcagcagcaggcaggcgtctgcgtctgcatctgcaggacggagaggcggaggccggagaggcagaggccgtaacgctgacggcgggatgttcgtttcagcgacgggcgacaccgtgctcggctgctgctttaactgcggcgatccttcccacttcgcaaacgcctgcccgaaccggagatagttatcagggagctgctcgctatgcgtgtacagagactggcagcgtccgccaaacgatgaagccttcggatggttttcgtgtactgaggtgcatataagtgcacctgacaagctcattttctagacaattactaatatttttaaacaaaatgcagctattaggctgatgctagttcagcaaaaaaaaaaaaaaag

SEQ ID NO: 2446 - DNA, 2797 bp, Sorghum bicolor
ggtccccctgctctgctcatcagaatttcagaatataggaggcaggccgccgcccggcaagtccaccgaaacaaaaacactactccgcctcgcctccctctccgcctctcttcccagcgacttcctcctccctccccctccagccctcctcgtcgtccggcgaggcagcagcgagatcgaccgtcctccgtccccgcgcgagattgtgaaaccacagaatttggatgctcctgcctatgcaagatgtcaaccaccagagatattgttcagtgttagggaagttgtgcagttttggatcataaattctacagaaacaagataattatggaccgcgcagacacatcagggtttgtcagtggtggttgctttggtactacactcctgctgatattcttccatttcgtctattctacagtccgtgtctgaaagattgtcaagaacccttaagctgcctgggcagaaatatcatcaggcccctgttctttgagctctctggtgttttatctcatcttcttttctgccattgctatagcgtctcaactgtgatggataacggcttcgtgaacattccccatccgccattgtcagaggctctgatgaatgacccctttgttttagtgggttgctcagcgccaagctccacgatggagaacatgggccaaagcacactctgtatggatggcctgaacccagcaatggttagttgcagccatgttaatggaaatacacagataatgaatgacatagcaccgagagatgatggcagcaggttagtccttggtttgggtccaacaccgaatttttattctgcagcgtccactggttcaaaacaagatcagaggttgtctggccagagttccactttcactgattccgggatgctgaggcttggtcttcagatggatggtggggaagcaattcaatatctgcaagcaccaaatggagcactccattctttaggtgtcgttgatgaggcttcaacatctgctactgtaaggaacatgggtggttacatgccatccctactctttgctccccgtgccaattctactgtcaatgagacacaagtagaaaccccagattctctagacctcacgcacagcaccagcaatagtcagcatgttcaacatcacctccagctcagccctgaaccctctgcaatgaccgagtcttcatttggtgtgagttctgatgttgtcactgcaacaactacatcagaacgtagccattcccggcatcctaagaaatgcaggtttaagggatgttccaaaggtgcaagaggcgcatcagggttgtgtattgctcacggaggtgggcagagatgtcataaatctggatgccataaaggtgccgagagcagctctgcgtactgcaaagctcacggtggcggtcgtcggtgtgaggagcttggttgtaccaaaagtgcagaaggaaaaacagattattgcattgctcatggtggaggccgccgatgtgaacatcctggctgtcctaaagctgcccggggtaagtctgggcggtgcatcaagcatggtggtgggaagaggtgctcggttaaaggttgcattcggagtgccgaggggaaggctggactgtgcatttctcatggcggtggccgacggtgccagtatccagattgtggcaagggggcacagggcagcacattgtactgcaagggacatggtggtggcaagaggtgcatcttcgatggttgcagcaaaggcgcagagggtagcacacctctgtgcaaagcacacggtggtgggaagcgatgcatgtttgaaggaggtggtgtctgtgcaaagagtgtgcacggggctactgaatactgtgtggcacatggaggtgggaagcgctgttccgtgcccggctgcaccaaaagtgctcgtggccgcactgactgctgtgtgaagcatggtggtggtaagcggtgcaaggttgacaactgcggcaagagcgcccaggggagcacggaattctgcaaagcccatggtggaggaaaacggtgcacttggagcacagggtgtgaaaagttctcccgtggcaagagtggcttctgtgcggcacatggtaccttgatggccaggcagcgagaacaagaggtggtgaagaatgtaggaagcatgattggaccaggtctcttcagcggcattgtggtgtcatctgccactgcagcaagcagcatgacgaacgagcactcgtcctctggtgtcagtaccgcttcggattgtgacggcaccatgaggagccaatcaatgattcctccgcaggtgctggttcctcgctctatgatgccttggtcttctgagcctgtagatgggggcagagagggaggtcatgttgttcccgaggggagggtccatggaggtggcctcctgtcactactcggtggcagcttcaggaacgctgatgttgaaaagctttgaagctagtgcttttccatcggcagatttggtcagtttgtacataaacagggcgtgtttccgcctattgaattcctattgtgccttttcttgtctagataaacatttcaaaccttcatgtactggttaagtccattgtaaagtggtgactggcaattgatgcgaacgcttttggcttgttggttaagttgtagtcagtactgcaataaattcgtgtacttattatgctgctcttatctgtttgtgcgcattcttaagaaactcgtctagactttccattgcgaagtgttggatgccaattttctgaaacctgaaattttgcatcacgtcggtccaggttatatttgttctgttctgaaacctgaaattgtgca

SEQ ID NO: 2447 - DNA, 2677 bp, Zea mays
ctgccctgctcagctcatcagaacacagaaggcaggccacagcccgcaggtaggtagtccaccgaaacaaaacaccaccccgtctctcctcttcccagcggtttcctgatccccccacctcgttcgccgaggccgcagcgagcccgcccgtcctccgtccccgcgggagattgtgcgaccgcagagtttggatgctcctgcctatgcaagcaagatgtcaaccaccagagatattgtttagtgctgggcaagttatgcaattttggatcataaattacacagggacaagataattatggaccgcgcagacacatcaggctttgtcagtggtggttgctttggtactacactcctgctgatattcttccattttgtctattctacgatccatgtctgaaagaccctcaggaaccctgcagctgtctgggcagaaatatcatcaggcccctgttctttgagatctctggtgttttatctcattttgttttccaccattgttatattgtctcaactgtgatggataacggcttcatggacatccctcatccgcctctggtgaatgacccctttgtgttagtgggatgcccagcgccagcctccacgatggagaacatgggccaaagcacaatctgtatggatggcctgaacccagcaatggttagttgcagccatgttaatggaaacacacatataatgaacggcttaacagcaagagatgatggcagcaggttactccttggtttgggcccaacaccgaatttttattctgcagtgtccacgggctcaaaacaagctcagagattgtctggccagagttcaacttccattgattcagggatgctgaagcttggccttcagacggatgacagggaagcaattcaatatctgcaacaagcaccgaatggagcactccattctttagatattgttgacgaggcttcaacatctgctgctgtaaggaacatgggtggttacatgccatccctactctttgctccctgctccaattctattgccaatgagacacaagtagaaaaccaagattctctagacctcacgcacagcaccagcaacagtcagcaccttcaacatgacctccagctcagccccgaaccttctgcaacgaccgagtcatcatttggtatgagttctgatgttgtcactgcaacaactacatcagagcgtagccattcccgacatcctaagaaatgcaggtttaagggatgttccaaaggtgcaagaggagcatcaggattgtgtattgctcacggaggtgggcagagatgtcataaacctggatgccataaaggtgccgagagcagctccgcgtactgcaaagcccacggtggcggtcgtcggtgtgaggagcttggttgtaccaaaagcgcggaaggaaaaacagattattgcatcgctcatggtggaggctgccgctgccaacatcctggctgtcctaaagctgcccggggtaagtctgggcggtgcatcaagcacggtggtgggaagaggtgctcggttaaaggttgcatcaggagcgctgaggggaaggctgggctgtgcatttctcatggcggcggccgacggtgccagtatcctgattgcggcaagggggctcagggcagcacattgtactgcaaggggcatggtggcggcaagaggtgcatctttgatggttgcagcaaaggcgcagagggtagcacacctctgtgcaaagcacacggtggtgggaaacgatgcatgtttgaaggaggcggcgtctgtgcaaaaagcgtgcacggggctactgaatactgcgtggtgcatggaggagggaagcgctgttccgtgcccggctgcaccaaaagtgcccgtggccgcactgactgctgtgtgaagcacggtggcggcaagcggtgcaaggttgacagctgtggcaagagcgcccaggggagcacgcacttctgcaaagcccatggcggagggaagcggtgcacatggagcacaggctgcgaaaagttctcccgtggcaagagtggcttctgtgcagcacatggtaccttgatggccaggcagcgagaagaagaggtggtgaagaatgtagggagcatgattggaccaggtctcttcagcggcattgtggcgtcatctgccaccgcagcaagcagcatgacgaacgagcactcggcctctggtgtcagcaccgcttccgactgtgacggcacggtgaggagccaatcaatgattcctccgctggtgctggttcctcgctctatgatgccttcatggtcgactgagcctgtagatggaggcagagagggaggtcatgttgttcctgaggggagggtccatggtggtggcctactgtcacttctcggtggcagcttcagggacgccgacgtggaaaagctttgaagattttgtcagtttgtttgtacataaacaggccgcgttcccgcctatagaattgttattgtgccttttcttgtctagataaacatttcaaccttcatgtaccggttaaatcaatactggtttagtccattgtaaagtggtgactgtcaattgtcgtgaacacttttagcttgttggttcggttcggttgtagtctgtctgtttgtgcgtattcttaagaaactcgtctggactttctattgcaaattgtcgaatgtcaattttctgaaatctggaatttttcagc

SEQ ID NO: 2448 - DNA, 3758 bp, Hordeum vulgare subsp. vulgare
ggataaaaaaataacgtttgataaaaaaatatgactaaactcgccatcgtctttgctgttttggcacttagctccgttgctcatgccgcacttgataccagcagtccttcaagcgccttcgctgtcgctcctggaaagatcttcaccaacggtactgataccgctttcaccggtttgagtggtccttgctggttcaatggtggttttgataacaccaccaactatgtctggtgcaaaactcttgttgctactgccaccgttccatacaccttccaaagaagagccatcaatgccagttctccagcaaccatcaactctaccatggataccaaaattgcctccactcacatgatctctaacactggcgtcaagtattgtgctggtgccggatacttcggattcgcctctgactatctgacctcaaatatcgacaatctgtatttcagttatgctgctgttaacgcatccagcttcacaaaggttaccctcaccgctaacactgacacagccatcactactcgcccagctgcttgcttctttgacaacaacatcttctacattgtctactacacctatgtcagttcaaccaaccagacccaaaatgccgtttacatccaaggtgtcaacgttacttctggtgctgtttactacaactctaccggtggtgtcaaacttttctctccaactacccagtcctactctactttgagcttcctatctttggttggaaacagcaagactggctctgctactgctgctctcctcacctacactgactccagctctgtaaccggcaacgttggttctaaatacaacgtcttgccaattactctttctacaggcgctgctggttctgttcaaactttggccactggtgcaacttcatctgcatcagccacatccgtggtctatactaccactgctacctggaccacttctacaactgctaccactaccttcctcaccacctatttgacctcaactgtcttcaccacaactgccgttgtatctagtacgacatctgcggctgcttctggctccactgtctcaaccgccaccttcgtcatcaacccgtcccacccacctgcaccaggcgagccctgccaagccaatctcttcctccccgcccccgcccccgcccccgcctccattcccacgcccacgcgcgcagaccgcgacgccaccaacacaccaaaagcgagaaccaacactccccatcgccgcccgccgcccgccgcgatttccgccctcctccctcctctcccgccgccgtccgcgcgccagtttgaagattggccaacataattcattttattggtcctgcctatgcttgatgtcaactgcaagagatgttgtttagtgctgaggaggctgtttagctgtggatcataaattctcaccagaaacaacacagttatggaccgtgcagacacctcagggtttgtcagtggtggttgctttggtactacgctcctgctgattttcttccattttgtctattctaccatcagtgtctgaaagattatccagcccctgtttcttcagctctccagtaatcctgatattatttgctctaacccagctgtcatagtgttaagctgtgatggataacaactttgtggatatcccaaatcaacctctgatgaatgacccctttgtcttagtggcacaatcagctccaagctatgccctgaacaacctgggcaaaagtacagttcggatggattgccttggctcaggaatggctaattgtggtcatggtcatgaaagtacacaaaacatgaataacatcacagcgacagatgatggttgcaggcttgttcttgggttgggtccaacacctgatttttattcaacacattatcagccgactggtgtatataagtcaaaagaatctcagactttgtctggccagagtttctgtttcactgatccaggggtgctgaggcttggcctgcagacagatggtgcagaaactatccagcctctacaaacaccaaacgaaagagttcattcttttcctgttgttgacgaggcttcaacatctgctgctgtaaggagcatgggtggctacatgccatcgctactctttgctccccgctctagttcttctgctgccactgaggcacaattacaaaccagagattcactaaaccccacacactacaacagcaataatactcagcatattcaacaacatcctcagctcagccctgaaccttctgcgacgacagaaacttcatttggtgtgagctctgatgtggtcactggagcaactacatctgaacaacggagtcattcccgtcatcctaagaagtgcaggttcaaggggtgctccaaaggtggcagaggctcatcagggctgtgtattgctcatggaggcgggcaaagatgccataagcctgggtgccataaaggagccgagagcagcactgcatattgcaaggcccatggcggaggacggcggtgtgaggagcttggttgcaccaagagtgccgagggaaagacagattattgtattgctcatggtggaggccgccgctgtgaatatcctgattgtcctaaagctgcacggggtaagtctgggcggtgcataaagcatggcggtgggaagaggtgtgcaatggaaggctgcattcggagtgctgaggggaaggctggactctgcatttctcatggtggtggacgccggtgccagtatccggactgtgccaagggggctcagggcagcacattatactgcaaagcgcatggtggcggcaagaggtgcgtctttgatgggtgcagcagaggtgcagaggggagcacacctctctgcaaagcccatggcggtgggaagagatgcatgttcgaaggaggtggtgtctgcccaaagagtgtacatggagggactgaattctgtgtggcacatggaggtgggaaacgctgtgcagcgcctggctgcaccaagagcgcccgcggccgcactgactgttgtgtgaagcatggtggtggtaagcgttgcaggattgacaattgtggtaagagtgctcaaggtagtacggacttctgcaaagcccatggtggaggcaaacgttgcacatggggatccggttgtgagaaattcgcccgtggcaagagcggcctgtgtgccgcacatggaaccttggtggccaggcagcaagaacatggaatggtgaagagtggagggagcatgatcggaccaggcctcttcagtggcattgtggcatcatcaactaccgctgcaagtagcatgaccaatgagcattcctcatcaggcatcagcaccgcatcagatagtgatggcacagtgaggagccaatcgatgatacctcctcagctgcttgtgcctcgctccatgatgccctcgtcatcatcggagcctaccgtacgtgggggcaaagaagcaggctgtgctgttcctgagggaagggtgcatggtggcggcctactgtcactcctcggtggcagcttcaggaacgtcaatatagataagctctgaagtgttttctccgcctgcaaattctgtcggtttggttgtacataaaaggcactgtgttgcctattgaattttatgcttcttctcttatagcttgatgaacatttcatggatgtttagtcagtccattgtacatgttgtccggcaattcttctgatctgcattcaacatgccggtccagtcagtcagtcgtagttactgccaataagccttgtgtatttgatatactgttcttattcgcttgtggattattattcct

SEQ ID NO: 2449 - DNA, 2445 bp, Oryza sativa Japonica Group
agttgaggacctcccaaccagtaagcatttcgaggctcctgcctatgcttgatgtcaactatcaaagatgttgtttagtgctgtggaggtcaagtagcattggatcataaattcaaccaaaacaagacaggcatggaccgtgcagacacctcaggctttgtcagtggtggttgcttcagtactacactcctgctgatattcttccattttgtctattctgtgatctgtgtttgaaagatcatcagttccctgttcttcagctattcagtgattcagttgtcatttgctctcaccccgttgtcatattgtcaagctgtgatggataacagctttgtggatatcccaaatcaacctccaatgaataacccgtttgtgttaatggaaccctcagctcagagctacatggtgaaccttggcaaaagcacaccccacatggactgcctgggatctgcaatggctaattatggccatggtaatcaaaatatacagtgcattgatagcatcacaactagagatgatggttgcaggttagtccttgggttgggtccaacgccgaatttttactctgcagagtgtcagcccactggagtagacaagcttaaagaagctccttcgttatctggacagggtttgactatcaccgatcctgggacattgaggcttggccttcaaatggatgtttctcaaacaattcaacctttgcaagcaccagatggaacagttcattcttttactgttgttgatgaagcctcagcatctccttctgtaaggagcatcggtggctacatgccatccctactctttgctccacgctccggttcttctgctgtcaatgagacccacgaagcagaaacccaggattcactagacctgacgcacagcgacaatgataacactcagcacgttcaacatcaccttcagctgagccctgagccttctgccatgacagatacttcatttggtgtgagctccgacgttgtcacggcaacaaccacatcagaacaaaggaatcatccccggcatcccaagaagtgcaggttcaagggatgctcgaaaggtgcgagaggcgcatcagggctgtgtattgcccatggaggtgggcagagatgccataagcctgggtgccataaaggtgcagagagcagcactgcctattgcaaggcccatggcggtggtcggcggtgcgaggagcttggttgcaccaagagtgctgaagggaagacagattattgtatcgctcacggtggaggtcgtcgttgtgaacatgatggctgtcctaaagctgcacggggtaagtctgggcggtgcatcaagcacggtggtggtaagagatgcacggtgcaaggttgcatccggagcgctgagggtaaggccgggctctgcatttctcatggtggtggccgccggtgccagttcccggactgcagtaagggggctcaaggcagcacattgtactgcaaagggcatggcggtggcaagcggtgtatctttgacggctgcagcaaaggtgctgaggggagcacgcctctgtgcaaagcacacggtggcgggaagcgatgcatgttcgaaggtggcggcgtctgcccaaagagcgtccatggtggcactgagtactgcgtggcgcacggaggagggaagcgctgttcggtggctggctgcaccaagagtgcccgtggccgcacggactgttgcgtgaagcacggtggtggcaagaggtgcaaggtcgacaactgcagcaagagcgcccaggggagcacggacttctgcaaagcccacggcggcggcaagcggtgcacttggggaacgggctgcgagaagttcgcccgcggcaggagcggcctgtgcgccgcgcatgggaccttggcggccaagcagcaagagcgcgacgcggcgaacaacggcgcgggcatgatcccgccaggccttttcagcggcatagtgaccgtcgctgccacgagcagcatgacgaacgagtactcgtcgtcgggcatcagcaccgcgtcggactgcgacggcacggtgaggagccaggcgatgatgatacctccccaggtgctggtgcctcgctctatgatgccctcatcgtcgtccgaacctaccgtgcatgggggcagagagggaggctgtgccgttccggagggaagggtgcacggtggcggcctcttgtcactcctcggtggcagcttcaggaacgccgacatggataagctctgaatttgcttctccggctgccgaattctgttagtttggttgtgtacataaacaaggcaatttattttgccgatttgaacttctttggctttttttcctttgtctagataaatggtccgtggttgctttagtccagtcatttgtacattcatgtccgtggcaattgtcctgaacaccttctcatgtcagtttagtcagtcggaggaactggcaataaaatttgtgtattggttt

SEQ ID NO: 2450 - DNA, 1891 bp, Oryza sativa Indica Group
ggataacagctttgtggatatcccaaatcaacctccaatgaataacccgtttgtgttaatggaaccctcagctcagagctacatggtgaaccttggcaaaagcacaccccacatggactgcctgggatctgcaatggctaattatggccatggtaatcaaaatatacagtgcattgatagcatcacaactagagatgatggttgcaggttagtccttgggttgggtccaacgccgaatttttactctgcagagtgtcagcccactggagtagacaagcttaaagaagctccttcgttatctggacagggtttgactatcaccgatcctgggacattgaggcttggccttcaaatggatgtttctcaaacaattcaacctttgcaagcaccagatggaacagttcattcttttactgttgttgatgaagcctcagcatctccttctgtaaggagcatcggtggctacatgccatccctactctttgctccacgctccggttcttctgctgtcaatgagacccacgaagcagaaacccaggattcactagacctgacgcacagcgacaatgataacactcagcacgttcaacatcaccttcagctgagccctgagccttctgccatgacagatacttcatttggtgtgagctccgacgttgtcacggcaacaaccacatcagaacaaaggaatcatccccggcatcccaagaagtgcaggttcaagggatgctcgaaaggtgcgagaggcgcatcagggctgtgtattgcccatggaggtgggcagagatgccataagcctgggtgccataaaggtgcagagagcagcactgcctattgcaaggcccatggcggtggtcggcggtgcgaggagcttggttgcaccaagagtgctgaagggaagacagattattgtatcgctcacggtggaggtcgtcgttgtgaacatgatggctgtcctaaagctgcacggggtaagtctgggcggtgcatcaagcacggtggtggtaagagatgcacggtgcaaggttgcatccggagcgctgagggtaaggccgggctctgcatttctcatggtggtggccgccggtgccagttcccggactgcagtaagggggctcaaggcagcacattgtactgcaaagggcatggcggtggcaagcggtgtatctttgacggctgcagcaaaggtgctgaggggagcacgcctctgtgcaaagcacacggtggcgggaagcgatgcatgttcgaaggtggcggcgtctgcccaaagagcgtccatggtggcactgagtactgcgtggcgcacggaggagggaagcgctgttcggtggctggctgcaccaagagtgcccgtggccgcacggactgttgcgtgaagcacggtggtggcaagaggtgcaaggtcgacaactgcagcaagagcgcccaggggagcacggacttctgcaaagcccacggcggcggcaagcggtgcacttggggaacgggctgcgagaagttcgcccgcggcaggagcggcctgtgcgccgcgcatgggaccttggcggccaaacagcaagagcgcgacgcggcgaacaacggcgcgggcatgatcccgccaggccttttcaacggcatagtgaccgtcgctgccacgagcagcatgacgaacgagtactcgtcgtcgggcatcagcaccgcgtcggactgcgacggcacggtgaggagccaggcgatgatgatacctccccaggtgctggtgcctcgctctatgatgccctcatcgtcgtccgaacctaccgtgcatgggggcagagagggaggctgtgccgttccggagggaagggtgcacggtggcggcctcttgtcactcctcggtggcagcttcaggaacgccgacatggataagctc

SEQ ID NO: 2451 - DNA, 2067 bp, Zea mays; identical to SEQ ID NO: 2445

SEQ ID NO: 2452 - DNA, 2013 bp, Zea mays; identical to SEQ ID NO: 2444

SEQ ID NO: 2453 - DNA, 1363 bp, Zea mays
tgagaagtaagtgcgccatggccatatcatcctccacctcgcgaacacaagatctggtgccattgctgtgtctgttgctaatggcagcagcagcaccacagcatagttgtgcgtcgccgccgttgcctgtgacactcccagggtgccccgacaagtgcggcaacataagcatcccctaccctttcggcaccaaggagggatgcttcaaacccgacttcgaggtcctctgcaacgacagcttccatccgcctcgcgccttcatccagatggcgggagcgaagatcaccgtcgacgacacgtactacaagaccaacgaggacggcatgccggacaatgatatcggaagttctgaatggccgatcgagctcgtcgacgtgtcggtctcggaggggaaagcgcgggtgctcggcgccttcagctacgactgcaagatgaacgacacgtaccacgcggtgaggcggcaggagatcgacttgggctactggatgccgttctccatgtcggacgccgatgatgtgctcatgggcatcgggagcaacgtcgtcgccaagcagacatccggaccgcagtgccagtcctacctcttataccagctctccaccaggaagaccgacgaccccgtcaacgggtcttgctctgggcagggctgctgcagcgccaaccttcgctctggtggcatggccgccaccgaggtgacaatccagaagaacaccaaagacgacggcggcttctacggcgacggtgtctcctgctcgtacgccatgatcgtggacaagtcctggtacaacttctcgtcgccggatgtcgacagcgacgctttcctacggaggaacgccgcgggggtccccgtcgtcgtaaacttctccttcggcgtagatggctgtcccaacgccagcgaaccaacgccagatgacttcgcctgcgtaagcaactacagcacctgcatcgagcgaccacccgtcctcgacaatgtgtccataccgtacttctgcagttgctcggctggatacgaagggaatccatacatccatggaggttgccaagacattgatgagtgcgctcggccacacatgtatccgtgctacggtggcaaatgcaagaacacgccaggagactacgaatgcagctgcccagccggaacaaaaggaaatgcaaaacaagcgccatgcaccgacttgtttcctctgcctgcaaagatatccgtagttttggggttgtgctcttggagctcataagcaggaagaaggccacgtattctgacaacaatagcttggtaaggagttttctcgatgctcacaaaaatcaaaaggaggcaacagagctatttgataaagaaattgcaaaaccagatgttttaaagatt

SEQ ID NO: 2454 - DNA, 1760 bp, Zea mays
ccctcgcggcctcgcccgtggccacctcctttcctctttccatttccgttcctccgctcccgatccctaaaccctacctaccccaaacccgcggcggcggcggcgcgactgttgggtttccttggtcatgggctgcttcctctcctgcttccggggcggctccaacccgtcgggcgatctccgcgacccgctcgtgagggagagccgcatcggggacgcctttgtcaacgacgagaagaagcttgatgaagcgactggaaagctggatgtcgaggcggctactgaccacggagtcgacgacgagcttcggagagaggcaaattatctcaaatcatgtggcacaatatcacagaccccaccggaaattctagattcaatcccaatcaactcagaagatgctaacgactgcggcgatacaccgaccaacgtgcagcagacgaaacatgtagtggtagttgaagagaactcatctgaactgctcaactccgatgatcacgatgtactacataagcaggacactgatgaagggaggactctcaggacgggatcagagactcaaccatccttagaagaagttaagccttcgtgccaccagaacgtggtgagagaccaaagcaccgactccagtgactcgccctatccaacccctctggtgctcaggggtgacatccagactcctggcaccgtatacgccgccgctcacaaggaggcttggaagcctgggaagcgcgcgagggcgttcatctaccctgtcctgcgccccatcgagaacaagatgcagtggatggaactgaaagccgccgagtctcctactgtgctatcacccaaccctccaaaaagaaggaacctgagcgcagcaggttccggcgacaaggctcaccagccgcctacacgttcagcgttcgccggatcttcagagcacggatccttcccaaatacttacagccgtgcagcgcaggacggagtgatgtcgcccgatgaacccaagtgccagaacggcttggaacagcaggacggacgcgaagagctatcgacgcgaagttctggacgcgggaagcgtggtgtcgcaagcctgtctcattggctgaagccatcgtcatcgtccgcggatgacggcagccccgacgacggcagcagcaattttgttggaacggaggaggagaagacacggtgtggggcgaacgtctctgatgtgcccttctttcctgcgttcgggttggactgggagggggagaccgacaagcctactcctgtgctgcccaaggcgtgggacggcaacggcatcccgaacaccacaaccaaatacaaggaggaccagaaggtaagctggcacgcgacgccgttcgaggagaggctgctgaaggttctgtctgacgagaagcctcggcatgaaaggaggatcagcgggaagcttatccacctcgacgaaaacgccgagtagaggggccttttgcgccgtcctctgcatcaagaaccgtctaaagaatggtccaggtggtggtggccgccagcccaccatatgaactccgtttttcagccgcatgtcacctgtagatagagtttctttcgctgagttatgctctgcactctgcagtgctgcgtggaatgttacaagcatatgtgatgacgtgtcaataaaaggacaaacatgccagtctcatagtctggtttcatgagaaacatgaacatcctcatatattaaaaaaaaaaaaaaaaaaaaaaaaaaaaaaaaaaaaaaaaaaagaaaaaaaaaaaaaaaa

SEQ ID NO: 2455 - DNA, 1775 bp, Zea mays
cgcccgtggccacctcctttcctctttccatttccgttcctccgctcccgatccctaaaccctacctaccccaaacccgcggcggcggcggcgcgactgttgggtttccttggtcatgggctgcttcctctcctgcttccggggcggctccaacccgtcgggcgatctccgcgacccgctcgtgagggagagccgcatcggggacgcctttgtcaacgacgagaagaagcttgatgaagcgactggaaagctggatgtcgaggcggctactgaccacggagtcgacgacgagcttcggagagaggcaaattatctcaaatcatgtggcacaatatcacagaccccaccggaaattctagattcaatcccaatcaactcagaagatgctaacgagtgcggcgatacaccgaccaacgtgcagcagacgaaacatgtagtggtagttgaagagaactcatctgaactgctcaactccgatgatcacgatgtactacataagcaggacactgatgaagggaggactctcaggacgggatcagagactcaaccatccttagaagaagttaagccttcgtgccaccagaacgtggtgagagaccaaagcaccgactccagtgactcgccctatccaacccctctggtgctcaggggtgacatccagactcctggcaccgtatacgccgccgctcacaaggaggcttggaagcctgggaagcgcgcgagggcgttcatctaccctgtcctgcgccccatcgagaacaagatgcagtggatggaactgaaagccgccgagtctcctactgtgctatcacccaaccctccaaaaagaaggaacctgagcgcagcaggttccggcgacaaggctcaccagccgcctacacgttcagcgttcgccggatcttcagagcacggatccttcccaaatacttacagccgtgcagcgcaggacggagtgatgtcgcccgatgaacccaagtgccagaacggcttggaacagcaggacggacgcgaagagctatcgacgcgaagttctggacgcgggaagcgtggtgtcgcaagcctgtctcattggctgaagccatcgtcatcgtccgcggatgacggcagccccgacgacggcagcagcaattttgttggaacggaggaggagaagacacggtgtggggcgaacgtctctgatgtgcccttctttcctgcgttcgggttggactgggagggggagaccgacaagcctactcctgtgctgcccaaggcgtgggacggcaacggcatcccgaacaccacaaccaaatacaaggaggaccagaaggtaagctggcacgcgacgccgttcgaggagaggctgctgaaggttctgtctgacgagaagcctcggcatgaaaggaggatcagcgggaagcttatccacctcgacgaaaacgccgagtagaggggccttttgcgccgtcctctgcatcaagaaccgtctaaagaatggtccaggtggtggtggccgccagcccaccatatgaactccgtttttcagccgcatgtcacctgtagatagagtttctttcgctgagttatgctctgcactctgcagtgctgcgtggaatgttacaagcatatgtgatgacgtgtcaataaaaggacaaacatgccagtctcatagtctggtttcatgagaaacatgaacatcctcatatattaaaaaaaacctgtgcggtggttttcgtggcctcgtcggtctttttatgtattgagaccgttctctctgaaccgctaaacataacatc

SEQ ID NO: 2456 - DNA, 2068 bp, Sorghum bicolor
ctctcatccagggacccgccttgacttttcacgttgcgtttgagcggtgctgctgatctgcgattcctcttctctccactccacacctgacctgaccacccgagagggaatcatcatccctcttgcccgcggcggcgttggcgttggcggcatctttggtctccgtgcgggtgtttctgtccggcgtttacttgccgggccagcgcggcattggaggaggaagagggagggagatcggaggcgtgatcgatggggaactgcgtggcgagcgggggcacgacgacggtcacggcggcaggtgctgcaggggaggacgggaggcggcgggggaggagatggaaggcgccgcgggaggagcagctcggttcggtccccggccggatcttctccaacgatggccgcagccgcaccgccgccgtgttcacgcagcaggggcggaaagggatcaatcaggacgccatgcttgtctgggatgggttcggcggggaggacgacgtcgtgctgtgtggggtgttcgacgggcacggcccgcatggccacctggtggcgcgcagggtccgcgacgcgctgccgctcaagctcatgtccgcagtgcgcgcgtccaaggctggcttggacatgcccgccgccgcgtggaggaaggcctttgcgagcgcctacaaggccatggacaaggatcttcgctcccacgccatcctagattgcttctgcagcgggagcaccgccgtcaccgtcctcaagctcggctcggatctctacatggccaacattggtgactcacgcgccgtgctaggctcgagggacagtggcggcggtggcggcatggtagccgtgcaacttactgttgacctcaaaccggatgttcccagcgaggcagaacggattaagaagtgcaggggcagggtatttgctcttcaggacgaaccggaggtgccgcgggtctggctgccgttcgacgacgcgccaggcctggcaatggcccgggcgtttggggacttctgcctcaaggattatggtgtcatttcggttccagagttcttccactggtcgctcacggagaaggaccagtttgtcatccttgcatcagatggggtgtgggatgtccttagcaaccaggaggctgttgacattgtggcatcgtccccaagccgatctaaggctgcaaaatccctagtcgaggccgctacccgtgaatggaaaaccaagtacccgacatcaaagatcgatgactgtgcagtggtttgcctatatttggacggcaaaatggaccatgagcgtgactctacggcctccatggacaacatcagcctcgaaggttcagttgcagacccaaatgaagctccggagcaggagccagcgctgacccgcaacttcacagtcaggacggtagccggaagcgcccatgagaaggcactgtcgggcgcggtagatgcagttgttgccggcgcagcccacgatcagaattggtcaggccttgatggagtgacgcgggtgaactcactcgtccagcttcccaggttctccgaggagaaggcgattggctgatgaactgcaattctttggtttttaattaacttattttctcctgtttgaaaatttagtttagttgcctgttgtttgagaggaaaggtagaaatgaaacatggtcttgtgatttgcatcgggcgcgtagctagtgtgtttgagccacactgtggttagagtgtttgtgagctgcgacttttaacacagcaaaattgtgcttttctgaagtacaaagggttgatcctgtcctgtgttctaccttcaggtatgataagcatgcctgaaaggtgaaacagcaagcagcaagggcacctttgttcagagcttgcagttttgctgtgtttaaacgaacagctcgtgctctcacagtgggcgcaaacgcatgctaggcgccagtcatctgggatgatgacgctgtcgggtgacctgtaaattccaccatcgtccaccggcacttggcttttgtaaagagatgcgtctgtctgggcttttcccgggcgtagcttttgttgacagggcgccgagggctttgtgtgtcggcttt

SEQ ID NO: 2457 - DNA, 2151 bp, Zea mays
ctcactgcctctgcgtgcgtgcgtcactgccgcgccgctcgcccgatcacgcgataaataactcgcctctctctctcctcctcaagcagtcaggctcatccagggatcaggggacccgcccgccttgacttttcacgttgcgtttgagcggtgctgctgatctgcgattcctcctctctctctctctctccactccacacctgagagggaatcctgctccctcttgctccgcgcccgcggcggcggcggcggctttggtatccgtgcgggtgtttctgtccggcgtttacttgccgggccagcgcggcattggaggagggagatcggaggcgtgatcgatggggaactgcgtggcgagcgggggcacgacgacggtcacggcggcaggtgctgcaggggaggacgggaggcggcgggggaggaggtggaaggcgccgcgggaggagcagctcggttcggtccccggccggatcttctccaacgacggccgcagccgcaccgccgccgtgttcacgcagcaggggcggaaggggatcaatcaggacgccatgctcgtctgggatgggttcggcggggaggaagacgtcgtgctttgtggggtgttcgacgggcacggcccgcatggccacctggtggcgcgcagagtccgcgatgcgatgccgctgaagctcatgtccgcggtgcgcgcgtccaaggctggcttggatatgcccgccgccgcgtggaggaaggccttcgcgcgcgcctacaagaccatggacaaggaccttcgctcccacgccaccctagattgcttctgcagtggcagcaccgccgtcaccgtactcaagctcggctcggatctctacatggccaacattggtgactcacgcgccgtccttggctcgagggatggtggcgacggcggcatggtggccttgcaactgactattgacctcaaaccggatgttcccagcgaggcagaacggatcaagaagtgcaggggcagagtatttgctctgcaggacgaaccggaggtgccgcgggtctggctgccgttcgatgacgcgccaggcctggcaatggcccgggcctttggggacttctgcctcaaggattatggtgtcatttcggttccagagttcttccactggtcgctcacagagaaggatcagtttgtcatccttgcatcagatggggtgtgggatgtcctcagcaaccaggaggccgttgacatagtgtcgtcgtccccaagccgatcaaaggccgcaagatccctcgtcgaggccgcgacccgtgaatggaaaaccaagtacccgacatcgaagatcgatgactgcgcagtggtctgcctatatctggacggcaaaatggaccacgaacgtgactcgacggcctccatggacaacatgagcctcgacgaaggttcagccgcggacccaaacgaagcccaggagcaggagccagcgctgacccgcaacttcacggtcaggacggtcgccggaagcgcccacgagaaggcgctgtcgggggcggtggatgtggtcgttgccggcgcagcccacgaccagagttggtcaggcctcgacggggtgacgcgggtgaactcgctcgtccagcttccgaggttctccgacgagaaggcgatcggctgacgagctgtgcaattctttggttttcagttaacttattatcttttcctgcttgaaaatttagtttagtttgcccgttgtttgagagcaaagatggaaacggaatactgtatggtctttgtgatttgcatcggcgcgtaggtatagtgtgttttttgagccactgtggtcttagggtgtgagccgcgacttttaacacggcggaattgtgctttgctggagcacaaagggttcgtcctatgctgtgttctatcttcaggtatgataagcattcctgaaaggtgaaacagcaaggggcgccttttgttcagagcttgcgattttgctgtgtttaaacgaacagctcgtgctcctaagcacactggggcgcaaacgcatgctaggcgccagtcatctgggggtgaggtgatgacgctgtcgggtggcctgtaaattcgagcaccgtccatcggcacagcacttggctttgtaaaaagagaagcgtgtgtctgggcttttcccgggcgtagcttttgttgac

SEQ ID NO: 2458 - DNA, 1973 bp, Hordeum vulgare subsp. vulgare
ggtctgcctcctctcgcctcgtccatgggatgacggggccgccttgacttttcgtgcccatgttgagtttgagtgccgcatctgcaactcccggctcctcctgagacaagcaagcaacaagaaagaatccttcctcctgcacccggcgccggcgacctcttgcggcgtgtttcttgctggctggctggctggcattggtagcgggcgatggggaactgcgcggcgagaggggacacggcggtcacggcggccggcgcgggcggcgaggatgggaagaggcggcgggggaggtggaaggcgccgcgggaggaccagctggggacggtccccgggcggatcttctccaacgacggccgcagccgcacagcctccgtcttcacgcagcagggccgcaaggggatcaaccaggacgccatgctcatctgggatgggttcggcggggaggaggacggcgtgctgtgcggggtgttcgacggccacgggccgcacggccacctggtggcgcgcagggtgcgggactcgctgccgctcaggctcatgtccgccgcgcgcgcctcgcccaagaccgggctggacatgccggccaccgcctggaggaaggccttcacgcgcgcctacaaggccatggacaaggacctgcgctcccacccctcgctcgacagcttctgcagcggcagcaccgccgtcaccgtcctcaagctcggctcggacctttacatggccaacatcggggactcgcgcgccgtcctaggctccagagacgccgccgccggcggcatggcggccgtgcagctcaccgttgacctcaagcccgacgtccccagcgaggcggagcggatcaagaagtgcaggggcagggtgtttgcgctgcaggacgagccggaggtgccgagggtgtggctgccgttcgacgacgcgccgggcctggccatggcgcgggcgttcggggacttctgcctcaaggactacggcgtcatctcggtgccggagttcttccactggcctctcacggacaaggaccagttcgtcatccttgcatccgacggggtgtgggatgtcctgagcaaccaagaggctgttgacatagtgtcctcgtccccaagtcgttcaaaggcggcaaggactcttgtcgaggcagctaatcgtgaatggaaaaccaagtacccaacatcccggaccgacgattgcgcggtcgtttgcttatatttggatggcaaaatggaccacgagcgtgattcgaccgcgtctatggataacatcagcatcgaggatgattcggtcgcagatcctaacgaagtgcaggagcaacaggagcccgccttaacgcgcaattttacggttaggacagtcccggggagcgctcaagagaaagccttggcgggcgcagacgccaagatctccggtggagccgatgatcacaactggtcgggcctcgacggagtgacacgggtgaactcgctcgttcagcttcccaggttcaccgaggagaaggcggtcagttgacgacctcctccccccatttttccttgtttgttgctctgcgtttaggttagtggtctgttgtttcagggaaaattgtagaaatgtaacaagcttctgatttgctgttgtgctccactgcttggcaagccttccgtcactgtgcttggaatttggtttgttgccctttttaccccaacaaaactgtatatcctgaaatgacagaggctcgcatcttcgggtgtcgctcgattatttatgaagactggggggcgcacccgaggataaaacttttaacgagcaattttgtttcaaatgtgcaattttgctgggttaaaaggagcaagcgatgatcctgaacacagcgggcgtggagcacggcaggccccaggcatctgggataatattattgccgggtgatctgtaaattcccctgccggcacttggctttgtagcttttgttgacagaaagcaatgcgctgtgtcgggcttgc

SEQ ID NO: 2459 - DNA, 2074 bp, Oryza sativa Japonica Group
ggaggaggtggaggtggaggtggtggtgtccgctgccccccgcaataaataagcctacctccatgttcccacccccctctctctctcttctccgtctcgcctcgtcacctcacctcggcatcacccaggtgggagggggtccgccttgacttttcgtgttcgggtttgggtttgagtgccgcatctgcaagcttgtgcgaggggggaatctctcttccttgctgtggtggcggcgggcgggagggcggcgttgatttcgttggggtttgcgttgcgtgcggaggacggggttgtgtttgtgtgtgtgtttgtgctgatttgggcattggtgttggtggtggaggaggatggggaactgcgtggcgaggagcgggacggcggtggatgcgggtggtgatggaggggaggatgggaagaggcggaggaggaggtggaaggcgccgcgggaagatcagctcgggatggtgcccggccggatcttctccaacgacggccgcagccggacggcgacggtgtacacgcagcaagggcgcaaggggatcaaccaggacgccatgctcgtctgggatgggttcggcggcgaggacgacggcgtgctgtgcggggtgttcgacgggcacgggccgcacgggcacgtggtggcgcggagggtccgcgactcgctgccgctgaggctcatgtccgcggcgcgcgacagcggggcggacatgccggccgccgcatggaggaaggccttcgcgcgcgcctacaaggccatggacaaggacctccggtcgcacccttccctcgattgcttctgcagcggaagcactgccgtcaccgtcctcaagctcggctcggatctctacatggccaacattggggactcgcgcgccgtgctcggctccagggaggccaccggcggcggcatggtcgccgtgcagctcaccgttgatctcaagccggatgtccccagcgaagcggagaggatcaagaagtgcaggggcagggtgttcgcgctgcaggacgagccggaggtgccaagggtctggctgccgttcgacgacgcgccgggcctcgcgatggcgcgagcgttcggggacttctgcctgaaagattacggggtcatctcggtgccggaattcttccactggtctctcacagaaaaggaccagttcgtcattcttgcatcggatggggtatgggatgtcctcagcaatcaagaggctgttgatatagtgtccgcgtccccaagcagatcaaaggctgcaaaatcccttgttgaggcagccactcgtgaatggaaaaccaaatatccaacatccaaaatcgatgattgcgcggttgtttgcttatatttggatggaaaaatggaccatgagcgtgactcaactgcctcattggacaacatcagtattgaagagggttcagttgcagatcctaatgaacctcaggagcaggagcccaccttaactcggaatttcacagttaggacagttgcaggcagcacgcaagagaagaccttagcaggggtggatgcgaggattgctggtgtagcgaacgaccaaaattggtcaggtctcgatggagtgacacgggtaaactcacttgttcagcttcctaggttttctgaagagagggcaattggctgagctgcccatcttatatttacccccgttattttcacctattgttctgaattttagcgtagttgttctagagaaaggtagatgtgggacgatcttgtgatttggtgcggtacttggcaagcgtttcagccactatgcatagaagtcgagttgcacgttttagcccaacaaaactgcacattgcataggacagaggctctcttttcacccatcttgaggcatgtcaactccatacctcgaagatgaagcacaaaagagcaggccattgctccaaatctgcaattttgctgggttaaaactaacaaaagacgacgccaaacacagtggctaaacgcacgccaggccccagtcacccctgggatgatattgtcgggtgacctgtaaattctccaccggcgcttgctttgcttttgtagagaggtgatgtccagaccattttctccgct

SEQ ID NO: 2460 - DNA, 1826 bp, Zea mays
actgcctctgcgtgcgtgcgtcactgccggtctgccgtgccgctgcgcccgctcccgcaataaataaactcacctctctctgttctccgttctcacctccctcctcatccatccagggacgcgccttgacttctcacgtcgtgtcgtgtgtgagcgcagcggtgctgctgatctgcgattcctccacgccacaccctacctgaccacccgacagggaatcctactccctcttgcgcgccgcggcggcggcggcggcatcttcggtctccgtgcgggtgtttccgttcggcgtttactggccgggcgagcgcggcattggaggagtcgggaggagggagacaggaggcgtgatcgatggggaactgcgtggcgagcgggggcgcgacgacggtcacggcggcaggggaggacgggaggcggcgggggaggaggtggaaggcgccgcgggaggagcagctcggctcggtccccggccggatcttctccaacgacggccgcagccgcaccgccgccgtgttcacgcagcagggccggaagggggtcaatcaggacgccatgctcgtctgggatgggttcggcggggaggaggacgtcgtgctgtgtggggtgttcgacgggcacggcccgcatggccacctggtggcgcgcagggtccgcgacgcgctgccgctgaagctcatggccgcggtgcgcgagtccaagcctggcttggacatggccgccgccgcgtggaggaaggcctttgcgcgcgcctacaaggccatggacaaagatcttcgctcccacgccaccctagactgcttctgcagtggcagcaccgccgtcaccgtcctcaagctcggctcggatctctacatggccaacattggtgactcgcgcgccgtgctaggctcaagggacggcggcggcatggtggccgtgcaactgactgtcgacctcaaaccagatgttcccagcgaggcagaacggatcaagaagtgcaggggcagggtatttgctctgcaggacgaaccggaggtgcctcgggtctggctgccgttcgacgacgcgcctggcctggcgatggcccgggcgtttggggacttctgcctcaaggattatggtgtcatttcggttccagagttcttccactggtcgctcacggagaaggaccagttcatcatccttgcatcagatggggtgtgggatgtccttagcaaccaggaggccgttgacatcgtgtcgtcatccccaagccgatcaaaggccgcgagatccctggtcgaggccgccgctcgtgaatggaaagccaagtacccgacatcgaagaccgacgactgcgcggtggtctgcctatacttggacggcaagatggaccaggaacgcgactcgacggcgtccatggacaacatcagcctggactacgaaggctcagccgcggacccgaacgaagcgcaggagctgcaggagccggcgctgacccgcaacttcacggtcaggacggtggccggaagtgcccacgagaaggcgctgtcgggggcggcagacgcggccgtcgccgtcggcggcggcgcagcctgcgcccacgaccagagctggtcgggccttgacggggtgacgcgggtgaactcgctcgtccagctccctaggttctccgaggaaaaggcggcggttggctgatgagccgccggctgctgcatgcgattctttggttttggttgttgagttgtttgtttcctcgtttttttggaaatctagtttagtagttgccccgttgttgtttgggaggaagggacacggtagaaacagaaatatggtgttgtgattcgaaaaaaaaaaaaaaaaaa

SEQ ID NO: 2461 - DNA, 1794 bp, Zea mays
ctcccacgcccgccgtccccgagagccgcttcttctttctccgtgactcggagctgtctacctcaccctcactgcctctgcgtgcgtgcgtcactgccgggacgcgccttgacttctcacgtcgtgtcgtgtgtgagcgccgcagcggtgctgctgatctgcgattcctccacgccacaccctacctgaccacccgacagggaatcctactccctcttgcgcgccgcggcggcggcgccggcatcttcggtctccgtgcgggtgtttccgttcggcgtttactggccgggcgagcgcggcattggaggagtcgggaggagggagaccggaggcgtgatcgatggggaactgcgtggcgagcgggggcgcgacgacggtcacggcggcgggggaggacgggaggcggcgggggaggaggtggaaggcgccgcgggaggagcagctcggctcggtccccggccggatcttctccaacgacggccgcagccgcaccgccgccgtgttcacgcagcagggccggaagggggtcaatcaggacgccatgctcgtctgggatgggttcggcggggaggaggacgtcgtgctgtgtggggtgttcgacgggcacggcccgcatggccacctggtggcgcgcagggtccgcgacgcgctgccgctgaagctcatggccgcggtgcgcgagtccaagcccggcttggacatggccgccgccgcgtggaggaaggcctttgcgcgcgcctacaaggccatggacaaagatcttcgctcccacgccaccctagactgcttctgcagtggcagcaccgccgtcaccgtcctcaagctcggctcggatctctacatggccaacattggtgactcgcgcgccgtgctaggctcaagggacggcggcggcatggtggccgtgcaactgactgtcgacctcaaaccagatgttcccagcgaggcagaacggatcaagaagtgcaggggcagggtatttgctctgcaggacgaaccggaggtgcctcgggtctggctgccgttcgacgacgcccctggcctggcgatggcccgggcgtttggggacttctgcctcaaggattatggtgtcatttcggttccagagttcttccactggtcgctcacggagaaggaccagttcgtcatccttgcatcagatggggtgtgggatgtccttagcaaccaggaggccgttgacatcgtgtcgtcatccccaagccgatcaaaggccgcgatatccctggtcgaggccgccgctcgtgaatggaaagccaagtacccgacatcgaagaccgacgactgcgcggtggtctgcctatacttggatggcaagatggaccaggaacgcgactcgacggcgtccatggacaacatcagcctggactacgaaggctcagccgcggacccgaacgaagcgcaggagctgcaggagccggcgctgacccgcaacttcacggtcaggacggtggccggaagtgcccacgagaaggcgctgtcgggggcggcagacgcggccgtcggcggcggcgcagcctgcgcccacgaccagagctggtcgggccttgacggggtgacgcgggtgaactcgctcgtccagctccccaggttctccgaggagaaggcggcggttggctgatgagccgccggctgctgcatgcgattctttggttttggttgttgagttgtttgtttcctcgttttttttttttggaaatctagtttagtagttgccccgttgttgtttgagaggaagggacacggtagaaacagaaatatggtgttgtgatttgc

SEQ ID NO: 2462 - DNA, 1643 bp, Zea mays
catccatccagggacgcgccttgacttctcacgtcgtgtcgtgtgtgagcgccgcagcggtgctgctgatctgcgattcctccacgccacaccctacctgaccacccgacagggaatcctactccctcttgcgcgccgcggcggcggcgccggcatcttcggtctccgtgcgggtgtttccgttcggcgtttactggccgggcgagcgcggcattggaggagtcgggaggagggagaccggaggcgtgatcgatggggaactgcgtggcgagcgggggcgcgacgacggtcacggcggcgggggaggacgggaggcggcgggggaggaggtggaaggcgccgcgggaggagcagctcggctcggtccccggccggatcttctccaacgacggccgcagccgcaccgccgccgtgttcacgcagcagggccggaagggggtcaatcaggacgggcacggcccgcatggccacctggtggcgcgcagggtccgcgacgcgctgccgctgaagctcatggccgcggtgcgcgagtccaagcccggcttggacatggccgccgccgcgtggaggaaggcctttgcgcgcgcctacaaggccatggacaaagatcttcgctcccacgccaccctagactgcttctgcagtggcagcaccgccgtcaccgtcctcaagctcggctcggatctctacatggccaacattggtgactcgcgcgccgtgctaggctcaagggacggcggcggcatggtggccgtgcaactgactgtcgacctcaaaccagatgttcccagcgaggcagaacggatcaagaagtgcaggggcagggtatttgctctgcaggacgaaccggaggtgcctcgggtctggctgccgttcgacgacgcccctggcctggcgatggcccgggcgtttggggacttctgcctcaaggattatggtgtcatttcggttccagagttcttccactggtcgctcacggagaaggaccagttcgtcatccttgcatcagatggggtgtgggatgtccttagcaaccaggaggccgttgacatcgtgtcgtcatccccaagccgatcaaaggccgcgatatccctggtcgaggccgccgctcgtgaatggaaagccaagtacccggcatcgaagaccgacgactgcgcggtggtctgcctatacttggatggcaagatggaccaggaacgcgactcgacggcgtccatggacaacatcagcctggactacgaaggctcagccgcggacccgaacgaagcgcaggagctgcaggagccggcgctgacccgcaacttcacggtcaggacggtggccggaagtgcccacgagaaggcgctgtcgggggcggcagacgcggccgtcggcggcggcgcagcctgcgcccacgaccagagctggtcgggccttgacggggtgacgcgggtgaactcgctcgtccagctccccaggttctccgaggagaaggcggcggttggctgatgagccgccggctgctgcatgcgattctttggttttggttgttgagttgtttgtttcctcgttttttttttttggaaatctagtttagtagttgccccgttgttgtttgagaggaagggacacggtagaaacagaaatatggtgttgtgatttgc

SEQ ID NO: 2463 - DNA, 1720 bp, Zea mays
gggacccgcccgccttgacttttcacgttgcgtttgagcggtgctgctgatctgcgattcctcctctctctctctctctccactccacacctgagagggaatcctgctccctcttgctccgcgccgtgttcacgcagcaggggcggaaggggatcaatcaggacgccatgctcgtctgggatgggttcggcggggaggaagacgtcgtgctttgtggggtgttcgacgggcacggcccgcatggccacctggtggcgcgcagagtccgcgatgcgatgccgctgaagctcatgtccgcggtgcgcgcgtccaaggctggcttggatatgcccgccgccgcgtggaggaaggccttcgcgcgcgcctacaagaccatggacaaggaccttcgctcccacgccaccctagattgcttctgcagtggcagcaccgccgtcaccgtactcaagctcggctcggatctctacatggccaacattggtgactcacgcgccgtccttggctcgagggatggtggcgacggcggcatggtggccttgcaactgactattgacctcaaaccggatgttcccagcgaggcagaacggatcaagaagtgcaggggcagagtatttgctctgcaggacgaaccggaggtgccgcgggtctggctgccgttcgatgacgcgccaggcctggcaatggcccgggcctttggggacttctgcctcaaggattatggtgtcatttcggttccagagttcttccactggtcgctcacagagaaggatcagtttgtcatccttgcatcagatggggtgtgggatgtcctcagcaaccaggaggccgttgacatagtgtcgtcgtccccaagccgatcaaaggccgcaagatccctcgtcgaggccgcgacccgtgaatggaaaaccaagtacccgacatcgaagatcgatgactgcgcagtggtctgcctatatctggacggcaaaatggaccacgaacgtgactcgacggcctccatggacaacatgagcctcgacgaaggttcagccgcggacccaaacgaagcccaggagcaggagccagcgctgacccgcaacttcacggtcaggacggtcgccggaagcgcccacgagaaggcgctgtcgggggcggtggatgtggtcgttgccggcgcagcccacgaccagagttggtcaggcctcgacggggtgacgcgggtgaactcgctcgtccagcttccgaggttctccgacgagaaggcgatcggctgacgagctgtgcaattctttggttttcagttaacttattatcttttcctgcttgaaaatttagtttagtttgcccgttgtttgagagcaaagatggaaacggaatactgtatggtctttgtgatttgcatcggcgcgtaggtatagtgtgttttttgagccactgtggtcttagggtgtgagccgcgacttttaacacggcggaattgtgctttgctggagcacaaagggttcgtcctatgctgtgttctatcttcaggtatgataagcattcctgaaaggtgaaacagcaaggggcgccttttgttcagagcttgcgattttgctgtgtttaaacgaacagctcgtgctcctaagcacactggggcgcaaacgcatgctaggcgccagtcatctgggggtgaggtgatgacgctgtcgggtggcctgtaaattcgagcaccgtccatcggcacagcacttggctttgt

SEQ ID NO: 2464 - DNA, 711 bp, Sorghum bicolor
atggacacggacacgacgtccaccgactcccagttccggcaccctgctcctgccatctccgcggccggagcgcgcgccgtcgtatgctcattggccgctcggggcgccgagagcctcgcccgcggcctcgtcacctgcgtcttcgcgacagtgggcacggtcctcggcgcgatcaccggcgggctgatcgggctggccacggagacgggcgtgctgcgcggcacgggcgtcggcggcatcacgggcgcgctggtgtccatggaggtcgtcgagtcgtccctcgccttgtggcgctccgacgagccggccatctggagcgtcgtctacgtgctcgatgtgatctggagcttgctgaccggccgtctcgtgcgcgagaaggtggaccccgccgtgctcaacgccgtcgagagccagatgagcgcagcggaggcaacggtcttgcatggagaccacgccgacatcttcggcatgggtggcaccaacggcatggcgagggtcgccatcgatgcgctccccgtggtgaggttcaccgagcgcagcagcgtcgacgccagcggcgacctcatcgcctgctcggtttgcctccaggaattccaagccggcgacagcgcgaggagcctgccggtgtgccgccacacgttccacctgccgtgcatcgacggctggctgctccggcacgcctcctgcccattgtgccggcgatcggtctag

SEQ ID NO: 2465 - DNA, 952 bp, Zea mays
ttccgacctaaccttccttgcgaactccgccaccgcgtccctgcgttatagggccgtcgacgacgacgggttgcgcgtccccgcctcattcgcgcgaccatggacacggacacggacacgacgacgtccaccggctcccgcctccatcccgcggccggacatgtacgctcattggccgcccggggcgccgagagcctcgtcacctgcgtcttcgcgacggtgggcacggtcctcggcgcgatcaccggtggcctcatcggcctggccacggagacgggcgtgctgcgcggcacgggcgtcggcggcatcacgggcgcgctggtgtccatggaggtcgtcgagtcgctgtggcgctccgacgagccggcaatctggagcgtcgtctacgtgctcgatgtcatctggagcttgctcaccggccgccttgtgcgcgagaaggtggaccccgccgtgctcagcgccgtcgagagccagatgagcgcagcggacacaccggccttgcatgcagaccacgccgacatcttcgacacgggcggcaccaacggcatggcgagggtcgccatggacgcgctccccgtcgttaggttcaccgagcgcagcaacgtcgacgccagcggcgagctcatcgcctgttcggtttgcctccaggaattccaagccggcgacagcgcgaggagcctgccggtgtgccgccacacgttccacctgccgtgcatcgacggctggctgctccggcacgcctcctgccccttgtgccgccgcgctgtctaggccgcgcccgttcctctaccctcaaggatagccgccaccagagctgctctgacaagcgacacccgttccttcaggctgtagccgtacgcacactggcagcgtgatttttctgtagctcatcagatgattcagatgggcgttatgtaaacattggttaatttttaacaaatgcaagtggtgc

SEQ ID NO: 2466 - DNA, 2136 bp, Sorghum bicolor
gcggatatattttagtggtgagatgagtgtacataggcagcaggggtttattcgttttgggtacttgtttcgaagagaagcagatttcgaggagacgaaggctgagtgagcaggagatgaggagcccggtgccggagcgtagcctcatcatcgagagcgatgacgacgacgacacccaatccgctgtcgccaccaactggataggacacgggcacggccacgacgaggaggagccggagcaggagcccggttcggactctgactcttcgtcgtcgtcttcgtcctgcgccaccccacgccgcggcccaagctcccccgcctacacccagcaatggccgcagagttacaggcaatcgattgacattcttagtagcgtgcactcatccaatctgagctttttggggactccaacgctgagcagactgtcaaattctttccttgccatcaccgattcttttcggggcaaagcccctgaaacaatctcaaactttgtcaagccacttcttggtcccacatcaagtgatgagcagcagcagcagcagcatgaagatacccgaaagagttctcagtacattatgccctcaagaaaatcatctttggaacaaatccctgaggatcaaaagccactggtagttggtcatgaggcgtctcgtaatcgaaattgctcttacacccagggagtgatgaatggaataaatgttctatgtggcgtgggaatcctatcaacaccttatgccatcaaacaagggggttggattgggctggtgatactctgtttatttgctttgcttgcatggtacactggcgtgctcctgcgtcattgcctggacagcaaggagggcctcgagacatacccagatattggccatgcagcctttggcagcacaggtcgcatagttatctcgataatactgtacgtggaattgtatgcatgttgcatcgagtatttgatattggagagtgacaatttgacaaaattattccccactgcacacctgaccattgggagcctgacgctgaactcacatgtattttttgcaatcttgactaccatcatagtcatgccaaccacctggctccgtgacctgagctgtttgagctacatttcagctgggggtgtcattgcatcaatccttgtggtcatttgcctgttcttggttggggttgtcaatgatgtcggctttgagaacgaagggactgcactgaaccttccaggaattcctattgcaatcggattatatggttactgctactcagggcatggggtatttccaaacatatattcctctctgaagaatcgcaaccagtttccttcaattctttttacatgcattgggctgtctacctttttgtatgctggtgctgcagtgatgggatacaaaatgtttggtgaagccacagagtcccaattcacactcaacttaccagataattccctcatttctaaggttgctgtttggacaacggtggcaaatccaataaccaaatatgcattaactattattccattggctatgagtttggaagagttgctgccaccaaaccaacaaaagtattctacaataatcatgcttagatcatctctggtgatgtcaaccctcctgattgctctatctgtgcctttctttggacttgtgatggccctggttggttccttgtttgccatgcttgtgacctatattcttccttgcgcatgttttttggcaatcctcaagacaaaagtggggtggcatcagatagcagcttgctcgttcatcatagctgtcggggtttgctgtgcctgcgtgggaacatactcatccctgtcaaagataatccagaactacacataatacagctgttcctgttatgcagctgcccaacaaaatcatgtgtgtgctatatgggccaagcatatacaagatgaaagtttaccctgcaattcactctatgcataataaattattggtgtcttatcatagggctcaacgatttgtactatggttttaaggtggtatatcatgcgtaagtaacattgttccttatggtgcgcaaaaaacaagttgatttggtattcttgcaattttatgatttgattgtatcaaaagttgaatggagcaagagtccatgaacttaataggatgtgccacttagttc

SEQ ID NO: 2467 - DNA, 1850 bp, Zea mays
gagaagccgattttggaggagacgatgatgagtccggcgtcggagcgcagcctcatcatccagagcgacgacgacgacgacgcccgatccggccacgacgtggaggagccggagcaggactccgactcctcctcgtcgtcctcatcctgcgccaccccacgccgcggcccaagctcacccccctacatccagcaatggccgcagagttacaggcaatcgatcgacattctcagcagcgtgcagtcacccaacctgagctttctggggactccaactctgagcaggctgtcgaactctttcctcgccatcaccgattctttccggagcaaggcccccgaaacgatctctagctttatcaagccactccttggccccacgccaagtgacgagcagcagcggcagcatgaaggcacccgaaagagttccgagtaccttgtgccctcgagaagatcatctctgcagcagatcccagaggatcaaaagccacctgtaggtggccatggggcgtctcatgaccagaactgctcttacacccagggagtgatgaatggaataaatgttctatgtggtgtggggatcctatcaacaccttatgccatcaaacaggggggctggattgggctggcgatactctgtacatttgctcttctcgcatggtacacaggtgtgctcctgcgccattgcctggacagcaaggagggcctcaagacatacccagatattggccatgcagcctttggcagcacaggccgcatagttatctcgataatactgtacgtggagttgtatgcatgttgcatcgagtatttgatattggagggtgacaatttgtcaaaattattccccaatgctcacctgaccattgggagcatgacactgaactcacatgtattttttgcaatcttgactaccatcatagtcatgccaaccacctggctccgtgacctgagctggctgagctacatttcagctgggggtgtcattgcatcaatccttgtggtcatctgcctgttcttggttggggttgtcaatgatttcggctttgagaatgaagggactgcactgaacgccccaggaattcctattgcaattggattatatggttactgctactcagggcatggggtttttccaaatatctattcctccctgaagaatcgcaaccagtttccttcaattctttttacttgtattgggctgtctacctttttgtatgctggtgctgcagtgatgggatacaaaatgtttggtgaagccacagagtcccaattcacactcaacttaccagataattctgtcatttctaagattgctgtttggacaacggtggcaaatccaataaccaaatatgcattaactattattccattggctatgagtttggaagagctgctgccaccaaaccaacaaaagtattctacaataatcatgcttagatcatctctggtgatatcaaccctcctgattgctctatctgtgcctttctttggacttgtgatggccttggttggttctttgtttgccatgcttgtgacctacattttgccttgcgcttgttttttggcgatcctcaagacaaaagtggggtggcatcagatagcagcttgctcgttcatcatagttgtcggggtttgctgtgcctacgtgggaacatactcgtccctgtcgaagataatccagaactacgcatagcacagctgttcctgtgatcctgtatatgcatctgcccgacaaaatcatgtgtgtgctatatgggccgaacatatgtacaagatgaaagtttaccattcaattcactcgatgtataataaattattggtgccttatcatagggctcaatgatttctact

SEQ ID NO: 2468 - DNA, 1872 bp, Zea mays
agaacagaggttattcgttttggctacccgttttgaagacgatgatgagtccggcgtcggagcgcagcctcatcatccagagcgacgacgacgacgacgcccgatccggccacgacgtggaggagccggagccagagcaggagcaggactccgactcctcgtcgtcgtcctcatcctgcgccaccccacgccgcggcccaagctcacccccctacatccagcaatggccgcagagttacaggcaatcgatcgacattctcagcagcgtgcagtcacccaacctgacctttctggggactccaactctgagcaggctgtcgaactcattcctcgccatcaccgattctttccggagcaaggcccccgaaacgatctctagctttatcaagccactccttggccccacgccaagtgacgatcagcagcggcagcatgaaggcacccgaaagagttccgagtaccttgtgccctcgagaagatcatctctgcagcagatcccagaggatcaaaagccacctgtaggtggccatggggcgtctcatgaccagaactgctcttacacccagggagtgatgaatggaataaatgttctatgtggtgtggggatcctatcaacaccttatgccatcaaacaggggggctggattgggctggcgatactctgtatatatgctcttctcgcatggtacacaggtgtgctcctgcgccattgcctggacagcaaggagggcctcaagacatacccagatattggccatgcagcctttggcagcacaggccgcatagttatctcgataatactgtacgtggagttgtatgcatgttgcatcgagtatttgatattggagggtgacaatttgtcaaaattattccccaatgctcacctgaccattgggagcatgacactgaactcacatgtattttttgcaatcttgactaccatcatagtcatgccaaccacctggctccgtgacctgagctggctgagctacatttcagctgggggtgtcattgcatcaatccttgtagtcatctgcctgttcttggttggggttgtcaatgatgtcggctttgagaatgaagggactgcactgaacgccccaggaattcctattgcaattggattatatggttactgctactcagggcatgggttttttccaaatatctattcttccctgaagaatcgcaaccagtttccttcaattctttttacttgtattgggctgtctacctttttgtatgctggtgctgcagtgatgggatacaaaatgtttggtgaagccacagagtcccaattcacactcaacttaccagataattctgtcatttctaagattgctgtttggacaacggtggcaaatccaataaccaaatatgcattaactattattccattggctatgagtttggaagagctgctgccaccaaaccaacaaaagtattttacaataatcatgcttagatcatctctggtgatatcaaccctcctgattgctctatttgtgcctttctttggacttgtgatggccttggttggttctttgtttgccatgcttgtgacctacattttgccttgcgcgtgttttttggcgatcctcaagacaaaagtggggtggcatcagatagcagcttgctcgttcatcatagttgtcggggtttgctgtgcctacgtgggaacatactcgtccctgtcgaagataatccagaactacgcgtagcacagctgttcctgtgatcctgtatatgcatctgcctgacaaaatcatgtgtgtgctatatgggccgaacatatgtacaagatgaaagtttaccattcaattcactcgatgtataataaattattggtgcctcaaaaaaaaaaaaaaaaaa

SEQ ID NO: 2469 - DNA, 2651 bp, Sorghum bicolor
gtccacgcaggcgcagaagcaggctcctttttcatcaggtccggagggactaggaggggcagggactgagagagagagagagagagagagagagagagagagcagccgtggagtggagtggagtggagcagactgattgagcccccaagatgaggagctccgtgtctgagcgcagcctcatcatcgagagcgacgacgacgacaacgacgaccgtccccaatcccagccatccgccgccgccgcccgcagcagaagacgccaccaccaacacgaggagggctccggctccggctccggctcaggatccgactccgattccggctcctcctcgtcgtcctgcgccaccccgcgtggtcacgctcaggccaccgcctcctcctacacccagcaatggccacagagctacaggcaatccatcaacattcttagtagcgtgcagtcaccaaatctgagcttcttggggaccccaactctaagcagattatccaactctttcatcaccaattcttttcggggtaaaacccctgaaatcatctctaatcttgttaagccacttcttcgccccactacaagtgatgaccttcagcagcagcatgaagaaagaaagagttcacagtaccttctgccttcgagaaaaccgtctttgcaacagattcctgaggatcaaaagccagtgccagttgctcatgaggtctctccctatcataaatgctcttacactcaggcggttgtgaacgggataaatgttctatgtggtgtgggaatcctatcaacgccttatgccatcaaacaagggggctggcttggactggtgatactctgtttatttgcaattctagcatggtatactggtgtgctcctgcgccgttgcctggacagcaaggagggccttgagacatacccagatattggccatgccgccttcgggaccaccggtcgtatagccatttcgataatcctgtatgtggaactatatgcctgttgcatcgagtatctgatattggaaggtgacaatttatcaaaattattccccaatgcacacctgaccatcgggagcttgacagtgaactcccatgtacttttcgcaatcttgactaccatcatagtcatgccgaccacttggctacgtgaccttagctgcctgagctacctttcagctggaggtgtcattgcatcaatccttggagtcatctgcctattctgggtaggtgttgttgataatgttgactttgagaacaaaggaactgcgctgaacctccctggaatccctattgcaattggattgtatggttattgctactcagggcatggggtgtttccaaacatctactcttctttgaagaaccgtaatcagttcccttcaatcctttttacttgcattgggctgtctaccattttatttgctggtgctgcggtgatgggatacaaaatgtttggtgaagccacacagtctcagttcacactgaacttaccagagaatttagtggtttcaaagattgcagtttggaccacggtggcaaatccaataaccaaatatgcattaaccataaccccactggctatgagtttggaagagttgctgccaccaaatcaacagaagtactcaaacatagtcatgcttagatcagccttggtggtgtcaaccctcctcattgctctatctgtacccttctttggacttgtgatggccttggttggttctttactcacgatgcttgtgacctatattctaccttgtgcgtgctttttagcaatcctgaggagaaaagtgagctggcaccaggtagcagcgtgctcattcatcatcatggtcggggtttgctgtgcatgtgtggggacatactcatctctgtcaaagataatccagaactacacatgagcgcacatgatatatacagctgttcctgcaaatccaaatttagttactcctacatatacagtaaccgaaccaccccattactcatgtgctcacactatgagccatacaagacaaaaattttgcccagcaaattagtcaagttgatgtaatgccagcatattagttaagtttatgtataataaatttgtgtgatgtcaatgcttgcatgttaatggatcaacacaaataagtctgtagcaaggatttaaggttgtatcatgcatatatgtaacaagacattatttgtgaacacaagatcaggtggattttgtgctatcattttttgtgaaccgactgccctgcgcctgtgtctgcctgcctaccttggatggtgccagcccaatccgttgaaagggtcacataggaagggagagaaggggaacctgctacagtgctgcccttgcattgggagaagccgcaacagcggagttttttgagcggctgagaaggtttgcgaagaagacgtcctgggagtttttcagttcgagacgggtggatgctgtttgctgtccactggtagacttttttttttcctttttttgttcaacatttcacggcagaagggagtggagtctggagtccatctggccattggtactttattttcttctttttttattaagcaactccaagccaatgatttgattgacagtgaggtaatggctgatggtaaattggattagggacctactatgttgtgctttagtattacctttgtgatgacgaaattta

SEQ ID NO: 2470 - DNA, 1996 bp, Zea mays
cgcggagtggaggacgagtggtgttgcccacgcagcgcagacgcagtctccttttcatcatcaagtccggagggagagccggagaaccggttcagccagcagagtcgccaaaacaaaagcaaaatgaggagctccgtctctgagcgcagcctcatcatcgagagcgacgacgacgacgacgaccatccccaatcccggtcatccgccgccgcccgcagcagaagacgccaccaccaacacgaggaggactccgccgcaggatccgactccgattccggttcctcctcgtcctcctgcggcaccccgcgcggtccggccaccgactcctcctacacccagcaatggccacagagctacaggcagtccatcgacattcttagtagcgtgcagtcaccaaatctgagcttcttgggaaccccaactctaagcagattgtccaactcttttcggggtaaaacccctgaaatcatctccaatcttgttaagccacttcttcgccccactacaagtgatgaccaccaccaccaccaccagcagcagcctgaagaaagaaagagttctcagtaccttctgccttcgagaaaaccatctttgcaacagattcctgaggatcaaaagccagtgccagttgctcatgaggtgtctccgtatcataaatgcacttacacccaagcagttgtgaatggaataaatgttctatgtggtgtgggaatcctatcaacaccttatgccatcaaacaaggcgggtggcttggactggtgatactctgtttatttgcaattctagcttggtatactggtgtgctcctgcgccgctgcctggacagcaaggagggccttgagacatacccagatattggtcatgccgcctttggagccaccggccgtatagccatctcaataatcctgtatgtggaactgtatgcctgttgcatcgagtatctgatattggaaggtgacaatttatcaaaattattccctaatgcgcacctgagcgttgggagcttgacaatgaactcccatgtacttttcacaatcttgactaccatcatagtcatgccgaccacttggcttcgtgaccttagctgcctgagctacctttcagctggaggtgtttttgcatcaatccttggagtcatctgcctattctgggtaggagttgttgataatgttggctttgagaacaaaggaactgctctgaacctccctggaatccctattgcaattggattgtatggttattgctactcagggcatggggtgtttccaaacatctactcttctctgaagaagcgcaatcagttcccttcaatcctttttacttgcattgggctgtctaccattttatttgctggtgcagcggtgatgggatacaaaatgtttggtgaagccacacagtctcagtttacactgaacttaccagagaatttagtggtttcaaagattgcagtttggaccacggtggcaaatccaataaccaaatatgcattaaccataaccccactgactatgagtttggaagagttgcttccaccaaatcaacagaagtactcaaacatagtcatgcttagatcagccctggtggtgtcaaccctcctcattgctctatctgtacccttttttggacttgtgatggccttagttggttctttacttacgatgcttgtgacctatattctaccttgcgcgtgctttttagcaattcttaggagaaaagtgagctggcaccaggtagcagtatgctcgttcatcatcgtggttggggtttgctgcgcttgtgtgggaacatactcgtctctgtcaaagataatccagaactacacatgatacagttgttcctgcaatccaaatttatgtccaaactcaatgagccaaactgcccagcaaattagtcaagtcgatgtatcataaatttgtgagatgtccatgtttgcatgttaatggatcaacacaaataatacgtttgtggcaaggatttgagacaatatttctgaac

SEQ ID NO: 2471 - DNA, 2158 bp, Oryza sativa Japonica Group
atagtatgcatgtgtggagtcatccaatggttccttctcccttgcatcagctggggctaaaagtgtgtgtgcgacagtgagagagagagagagagagagaggagaactaatttaatcctaatcagttgcagacttgcagagcccaagagaggagaggagattccaagagaagagatgagatcccacgagatgaacaactcttcttctcgttatgcgtcagaggaggagcgcggcagcaacagcttcctcatcgagagcgaggaggaggaggaggacgaggaagcccacccccactcctccatcctcctcaaggatgccgactccgactccgactccgacgactcctcctgcgctaccccgcgcccaagctcctacgccacccaccaatggccgcaaagctacaggcaatcaatcgacatttatagtagcgtgcagtctcccaacctgagctttttgggaactccaactctaagcaggctctccaactcattcctcaccaactcttttcgtggcaaaacccctgaaattctctctaatcttgtcaagccacttctacgcccatcatcttcaagcgacgaccagcagcagcagcagcagcatgacgatgatacccgtaagagttcccagtacctgcttccctcaagaaaaccgtctttgcaacagatcccggaggatcaaaaaccattggtgccggctcatgaggtgccggcttatcaacaatgctcctacacccaggcagtgatgaatggaataaatgttctgtgtggtgtggggatcctatcgactccatatgccattaaacagggaggctggcttggactggtgatactttgcttatttgctgtgctcgcttggtacaccggagtgctccttcgacgttgtctggacagcaaggagggtcttgagacataccctgatattggtcatgccgcctttggcaccactggacgtatagcaatctcgataatcctgtacatcgaactgtatgcctgttgcattgagtatttgatattggagagcgacaatttgtcaaagttattccccaatgcacatctaaccattgggagcatgacactaaactctcatgtgttcttcgcaatcttgaccaccctcatagtcatgccaaccacttggctccgcgaccttagctgtctgagttatctttcagctgggggtgtcattgcatcaatccttgtagttgtctgcctatgctgggttggggttgttgaccatgttggttttgagaacaaagggactgcactgaatctcccaggaattcccatcgcaattggactgtatggttattgctactcaggacatggtgtgttcccgaacatctattcttctctgaagaatcgcaaccagtttccttctattcttttcacttgtattgggttgtcctcaattttgtttgccggtgctgctgtgatgggatataagatgtttggtgagtccactgaatctcagttcacgctgaacttaccagagaatttggtggtttcaaaggttgctgtctggaccacggtggcaaatccaataaccaaatatgcattgaccataaccccattggctatgagtttggaagaattgctgcctccaaatcagcagaagtatgcgaacataatcatgcttagatcctccctggtggtctcaaccctcctcattgctctatctgtccccttctttgggctagttatggcgttggttggttctttactcaccatgcttgtgacctacatccttccatgcgcctgtttcttggccatccttaagagaaaagtgacttggcatcagattgcagcttgctcattcatcatcgtggtaggggtttgctgcgcttgcgtggggacatactcatccctctccaagattatccagaactacacctgacctgagtggccagctgaggaacggagcactagctgcttatgtagtaataagaaaataattaatcatccttctatagccctgcacataccggaacaaagttttgcccgggaactggagtcgacttgatcaattatatatgtataatataattagtttggatcgtttgtttaatttgtggcaactccaggcatgttaatgtataattaacgataaaaacaccacagtaccacatagtggagttttgttaatgataaaaataaataatgct

SEQ ID NO: 2472 - DNA, 2120 bp, Hordeum vulgare subsp. vulgare
gaaagcaatcactcatcccatcccatcccatccctgtcttgtctgcttctcttctctgctctgcttctggtgcgggaggcgatgaagagcctgctgggggaggagcggagcttcatcatcgagagcgacgacgacgacgacgacgaggaggaccccacccacagggacggcgccggcggctcctcgtcggactcgtcgtcgtgcgccagcccgcgcggagggagcggcggcggcggcggcgacagccagcccaactcctacacaaaccaatggccgcagagttacaggcagtcgatcgacattttgagcagcgtgcagtcgccgagcctgggttttctggggaccccgacgctcagcaggctgtccaactccttcctcaacagctccttcctcaacaactcgttccgaggcaaaacccctgaggtcatctccaacctcgtcaagccgcttatacgcccgacaacaagtgacgagcaacagcaacaacaacagcatcatgaagatatcaggaagagctcgcagtaccttctaccatcgaggaaaccgtcgctgcagcagattcccgaggatcagaagccgctggtggttggtcatgaggtttctccctaccagcaatgctcttacacccagggagcgatgaacggaataaatgttctgtgtggtgtcggaatcctgtcgacgccttatgccatcaagcaagggggctggctcggactggtgatactgcttgtatttgctctgctcgcatggtacaccggtgtgctgctgcgccgttgcctggacagcaaggagggccttcagacatacccagatatcggtcatgccgcctttggcaccaccggacgcatagccatctcgataatcctgtatgtggaactatatgcctgctgtatcgagtatttgatactggaaagcgacaatttatcgaagttgttccccaacgtacacctgaacatttggggcttggcaataaactcgcatgtattcttcgcaatcttgacgactcttgtggtcatgccgaccacttggctccgtgaccttacctgcctgagctatatttcagctggaggtgttgtggcatcaatccttgtagtcatctgcttgtgctggattggggttgtcgaccatgtcggctttgagaacaaagggactgcgctaaacctcccggggattcctatcgcaattgggctgtacggttactgctactcgggccatggggtgttcccaaacatctactcttctctgaagaatcgcaaccagtttccctccattcttttcacttgcattggattctccaccattttgtttactgccgccgctgtgatgggatacaaaatgtttggtgaatccactgagtctcagttcacgctcaacttaccggagaatctggtggtttccaagattgccgtctgggctacggtggcaaatccaataaccaaatatgcattgacaataaccccactggccatgagtctggaagagttgctgccgcgaagtcagcaaaagtactccaacataatcattcttagatcagccctggtggtgtcaacgctcatcattgctctgtcagttcccttctttgcacttgtgatggctctgattggttctctattcgcgatgcttgtgacctacattctaccttgtgcctgctttctggccatccttaaggcaaaagcgacttggtatcagactgcaacatgctcattcatcatcgccgtaggggtgacctgcgcctgcgtggggacatactcatcactctctgggattgtccagaactactccacctgactgcgaagtacttcgttccctacatacatagcagagaagattgctcgatagaccggattattatacatataattaagcatatgtatgcgcgagagtggatgattcaaattttgccgaacaatggattgcatccatccatatataaatgttgtattattagatttgtattggtcttaaatttgtggcaactccatatatgcatgcatgataaatttgtattattattgttaaatttctgtgttgatggatctttgtcagttttgctagctaattacgatttacgaatactttaaactttcatataaatctataatgggagtgtaatttggccg

SEQ ID NO: 2473 - DNA, 1704 bp, Sorghum bicolor
atgaagaactcggtgacggagcggagcttcctcatggagagcgacgaggaggaggacgatgccgccgccgtggaggacgggaagcggcggggccatgggcatggtggcggcgacgagtcaggggacgacgacgacgacgggtcggactcctcgtcgccgtgcgacagcccgcgggtggtggcggcgcggtgcagccagccgagttcgtacacgcagcaatggccgcagagctacaggcaatccattgacatgtacagcagtgtgcactcacccaacctgagcttcttgggcacgccatcactgagccgcttgtccaactcgttcctgacaaactcattccgggggaagccacctgagatcatctccagcttaatcaagccattactgccaacaagcattgcttccgccagcgatgaccagcagcatcagcagcatgaggatgtctggaagagctcccattacctgccaccatcgcggaaggcatcatcactgcagaggatccctgaggaccagagacctatggttgggggccatgaggtggggccctatcggcagtgctcctatacccaaggggtcatgaacggagtgaatgtcttatgtggtgtggggatcctgtcaacaccttatgctgtcaagcaaggtggctggcttggactagtgatactggcagtgttgggtgcactggcatggtacactggcatacttctgcggcgttgcctggacagcaaggatggcctcgagacctaccctgatattggacatgctgcctttggcactgctggccgtatcatcatctcggcatgttgtgtcgagtatttgatactagagagcgacaacttatcaaagttgttcccagatgcacacctaaccataggtggcttgactctagattcacatgtgctatttgccatcctgactgctcttatcgtcatgcctactacttggcttcgcgatctcagctgcctcagcttcatttcagctggtggagtcattgcgtctatcgtcattgtctcctgcttgttctgggtgggacttgttgatcacgttggcacagttaaggttgaagggacagcactgaaccttcctggaatccccattgccatcgggttgtatgggtactgctactcaggccatggagtgttccctaacatctactcttctctgaagaaacgcaaccaattctctgctgttctcttcacctgtattgctctgtctactgttctgttcgctggtgctgcaatcatgggatacattatgttcggtgaatctacagagtcccaattcacactgaacttacccccagatcttgtggcttccaagattgcagtctggactacggtgacgaatccaataaccaaatatgcgctaaccatgactcctctcgccctgagtttggaggaactgctaccaccaaatcagcagacatacccaaacataatgatgcttagatccgctctggtggtatcttcccttattattgctctgtccgtcccattttttggacttgtcatgtcactggttgggtcttttctcaccatgtttgtggcctatattctaccatgtgcctgctttttgtctatcctcaggagtaaagtgacctggtatcaggtagtactgtgtgtgttcatcattgccgttggactttgctgtgctggtgttggcacatactcttctctttctaagataatacaacagtaccattga

SEQ ID NO: 2474 - DNA, 2089 bp, Zea mays
accgcgctctctgctcccatccccgcctcgtccgttaccataaatctagcttgggctctaatctaaccgagggaacaggtgggatatgaggaactcggtgtcggagcggagcttcctcatcgagagcgacgatgacgacgatgccgccgtggaggacgggaagcggcgcggccttggcggcggcggcggcgacgacgacgacgggtccgactcctcgtcgccgtgcgacagcccgcgggtggtggcggcgcggtgcagccagccgagttcgtacacgcagcaatggccgcagagctacaggcaatccattgacatgtacagcagtgtgcactctcccaacctgagcttcttgggcacgccatcactgagccggttgtccaactcgttcctcacaaactcattccgggggaagccacctgagatcatctccagcttaatcaagccattactgccgacaagcattgcttccgccagcgatgaccaccagcagcagcagcagcatgaggacgtccggaagagctcccattacctgccaccatcacgcaaggcgtcgtcgctgcagaggatccccgaggaccagagacctatggttgggggccatgaggtgggtccccaccggcagtgctcctatagccaaggggtcatgaacggagtgaatgtcttatgtggtgtggggatcctgtcaacaccttatgctgtcaagcagggtggctggcttggactggtgatactagcagtattgggtgcactggcttggtacactggcatacttctgcgccgttgcctggacagcaaggatgggctcgagacttaccctgacatcggacatgctgcctttggtactgctggccgtatcatcatctcgataatcctgtatatggaactatatgcatgttgcattgagtatttgatcttagagagcgataacttatcaaagttgttcccaaatgcacacctaaccatgggtaacttgactctggattcacatatgctatttgccatcttgactgctcttgtcgtcatgcctaccacttggcttcgtgatctcagctgcctcagcttcatttcagctggtggagtcattgcatctatcgtcattgtctcctgcttgttctgggtgggacttgttgatcacgttggcacagtcgagagtgaagggacggcactgaaccttcctggaatccccattgccatcgggttgtatgggtattgctactcaggccatggagtgttcccaaacatctactcttctctgaagaaaagcaaccagttccctgctgttcttttcacctgtatcgctctgtctactgttctgttcgctgctgctgcaatcatgggatacattatgttcggtgaatctacagagtcccaattcacactgaacttacccccaaatcttgtggcttccaagattgcggtctggactacggtgacgaatccaataaccaaatatgcactgaccatgactcctctagccctgagtttggaggaactgctacctccaaataagcagacatacccgaacataatgatacttagatccgctctggtggtatcttcccttattattgctctgtccgttccattttttggacttgtcatgtcactggtcgggtcttttctcaccatgtttgtggcctatattctaccatgtgcctgctttttgtctatcctcaggagtaaagtcacctggtatcaggtagtactgtgtgtgttcatcattgtcgttggactttgctgtgttggtgttggcacgtactcttctctttctaagataatacaaaagtaccaatgaatttgccctagaattatgtatgatgtgtccatgtgttttcgaatagccagttttcttttctgggatggtggcgctggtctggaagggggagggggatgtcattcgttgtaaattttttgttggcatgagaggaagtggaggaatttcataaaatagggcaggttgtgttatcgaaggagtattttgtctgaaattgttctcgtgacggtagaggctgctgggaacgaccttctgttgacgctgccattttcgtttgacccatattgtttcttgtcttaaaaaaaaaaaaaaaaa

SEQ ID NO: 2475 - DNA, 1341 bp, Zea mays
cttctgatgaactcctccttgccaagaaaactactacactgaaaaggcgtcggcacgcgggcggtgaggatagcgtagcgtagcatagcatagcatagcataccgcaggcgctgctggttgacaaatggcaagcttattcccacagctcgcgcagatggagcacggcgtagccggcgcctcccatggcgcgccgagcttcctgttctgcaatggcgcaggtgcagccacggcagactcagcctcgctagagacctcgtccggtgttctcgacacctccccacgaggcggaggcgctgattctggcggtaggaaggccccgacgaagcccagggaagacagcgccagcgccagcgccagcttcagcttcagctctgcgcactccaaggactcgagctcgaagggaagcaccaagaataggggagggaaaagaggcagaagcagcaaggaggtagacgaggaggaggagcccaaggggtacatacacgtcagggcaaggagagggcaagccacggacagccacagccttgcggagagggtgaggagggagaggatcagcgagaggatgagggtgctgcaggccctggtccctggctgtgataaggtcactggaaaagccctcgttttggacgagatcatcaactacgtgcagtccttgcagaaccaagtcgagttcctttccatgaagatcgcttcactgagccctgtgctgtatggctttggcatggacactactgacgctttcagcactgaccatactactcaaaaaatcgaagggatgctccagctccaccacgaggcgcttgcggtgcctagctctgccctgagcagacctccattcgaggctatcgcggacagtacgcacgccaccgcctctgcctcctccccccggtcctacgagctccacggcgatggcggcggcggcggcgccagcatctctttcccgcaggacggcggcggctacatggcgcaaacagtaggtgggccaaggccagagctgttcaaccaagtggtgttcagtaaccacatgtgctctttccagtagggcgagggtgatgagaagacgacaggtaatgcagcaagcaaacttgcaggacggaggagatgatgctggctgggaggatatatgatctatttgggaagcgtgtgtgtcgccggatgagtctgtgatgttggacgacgcacgtagtccatccccttgtctggtggccgtaacgggacggggcatgcagtagcttgcaatagcattatttagctgttagatttgaggtctctgtcgccatcgcttcatctaggctctggaaaatcatttgttcatacacaatgttaatctgtgcttcctg

SEQ ID NO: 2476 - DNA, 1412 bp, Zea mays
atcctgttgttgcttctgatgaactcctccttgccaagaaaactactacactgaaaaggcgtcggcacgcgggcggtgaggatagcgtagcgtagcgtagcataccgcaggcgctgctggttgacaaatggcaagcttattcccacagctcgcgcagacggagcacggcgtagccggcgcctcccatggcgcgccgagcttcctgttctgccatggcgcaggtgcagccacggcagactcagcctcgctagagacctcgtccggtgttctcgacacctccccacgaggcggaggcgctgattctggcggtaggaaggcccggacgaagcccagggaagacagcgccagcgccagcttcagcttcagctctgcgcactccaaggactcgagctcgaagggaagcaccaagaataggggagggaaaagaggcagaagcagcaaggaggtagaagacgacgaggaggagcccaaggggtacatacacgtcagggcaaggagagggcaagccacggacagccacagccttgcggagagggtgaggagggagaggatcagcgagaggatgagggtgctgcaggccctggtccctggctgtgataaggtcactggaaaagccctcgttttggacgagatcatcaactacgtgcagtccttgcagaaccaagtcgagttcctttccatgaagatcgcttcactgagccctgtgctgtatggctttggcatggacactactgacgctttcagcactgatgaccatactactcaaaaaatcgaagggatgctccagctccaccacgaggcgcttgcgatgcctcctagctctgccctgagcagacctccattcgaagctgtcgcgaacagcacgcacgccaccgcctcctccccccggtcctacgacgagctccacggcgatggcggcggcggcggcgccggcatctctttcccgcaggaggacggcggcggctacatggcgcaaacagtaggtgggccaaggccagagctgttcaaccaagtggtgttcagtaaccacatgtgctctttccagtagggcgagggttatgagaagacgacaggtaatgcagcaagcaaacttgcaggacggaggagatgatgctggctgggaggatatatgatctatttgggaagcgtgtgtgtcgccggatgagtctgtgatgttggacgacgcacgtagtccatccccttgtctggtggccgtaacgggacggggcatgcagtagcttgcaatagcattatttagctgttagatttgaggtctctgtcgccatcgcttcatctaggctctggaaaatcatctgttcatacacaatgttaatctgtgcttcctgaacttcagatgtttacgggattggaaaatgggaagcattttgtttgctcgaaaaaaaaaaaaaaaa

SEQ ID NO: 2477 - DNA, 846 bp, Sorghum bicolor
atggcaagcttcccacacttcacgcagatggagcatggcctagccggtgcctccgcccatggcacgccgagcttcttattctgccatggcgcagccacggcagattcagcctcgctggagacctcatctggtgttctcgacacctccccacaaggcactgcttctgacgacaagaagcccaggaagcccagggaagatagtgccagcttcagctctgctcactccaaggactcaaactcaaaggaaagcaccaaaaagaagggaggaaaaagagacagaagcagcaaggaggtagatgaggaggagcccaaggggtacatacatgtcagggcaaggagagggcaagccacagacagccacagccttgcagagagggtgaggagggagagaatcagtgagaggatgagggtgctgcaggccctggtccctggctgtgataaggtcactggtaaagccctcattttggatgagatcatcaattatgtgcagtccttgcagaaccaagttgagttcctttccatgaggattgcttcactgagccctgtgctgtatggttttggcatggacactgatgctttcagtgaccatactcaaaaaatcgaaggaatgctccaccatgaggctcttggaatgcctagctctgtcctgaacagacctccatctgaaactcacatggacacgcacaactccacctcctccccatcctacgaggtccacggcgatggcggcaccagcatctctttccctcaggacaatggcagctacatggtgcaaacagtaggtgagccaaggcaagagctgttcaatcaagtggtgttcagtaaccacatgtgctctttccagtag

SEQ ID NO: 2478 - DNA, 1315 bp, Zea mays
agactggaaaagcatcggcacgggcggtaggataaagtagcatagcataccacaaaaggtgctgcttgacagatggcaagcttcccacacctcacgcagatggagcatggcctagccagtggtgcctcccatggcacgccgagcttcttcttctgccatggcacagccacggcggattcagcctcgctggagacctcgtctggtgttctcgacacctccccacgaggcacttcttctggcgacaacaaggcctgcaggaagcacaaggaagatagtggtgccagcttcagctctgctcgctccaaggactcaaactcaaaggaaagcagcaaaaggagcggaggaaaaagagacagaagcagcaagaaggtggacgaggaggagcccaaggggtacatacatgtcagggcgaggagaggacaagcaacggacaaccacagccttgcagagagggtgaggagggagagaatcagtgagaggatgagggtgttgcaggccctggtccctggctgtgataaggtcactggaaaagccctcattttggacgagatcatcaattatgtgcagtccttgcagaaccaagttgagttcctttccatgaggattgcttccctgagccctgtgctgtatggttttggcatggacagtagtgatgctttcagtgaccttataactcagaagatcgaagggatggcccaccatgaggcgttcgcgatgcctagcagctctgtcctgaacggcactccgtcggaagctctcgtggacacgcacacctccagctcctccccgtcctacgaggtccacggcgacggcggcaccgccagcgtctctttccctcaggacagtggcagctacatggtgcaaacagtaggtgagccaaggcaagagctgttcagccaagtggtgttcagtaaccacatgtgccctttccagtagggagagagcgagaggatggaaggacgacaggaagcaataatgttgagatcctatggaggtggaggccaccaccagacgagtttgtgatgttggacgcaatccatcccctcgtcggtggccgtaacgggaacccctgcggtagctagcattagcagtagtaataatagtaggctgttggttacatcatcctgttagatctcaaggtctctgtcggtaccgcatcatctagtaggcattgttgctgcttagcttttgggctctcttattaccaagggttgcatgcatgccattgtattgtactctccaattggaaaaaaaagaaaaaaaatatcatttgttcataaacacagtcaatttgtgctcaaaaaaaaaaaaaaaa

SEQ ID NO: 2479 - DNA, 1266 bp, Zea mays
gcatcggcacgggcggtaggataaagtagcatagcataccacaaaaggtgctgcttgacagatggcaagcttcccacacctcacgcagatggagcatggcctagccagtggtgcctcccatggcacgccgagcttcttcttctgccatggcacagccacggcggattcagcctcgctggagacctcgtctggtgttctcgacacctccccacgaggcacttcttctgacgacaacaaggcctgcaggaagcacaaggaagatagtggtgccagcttcagctctgctcgctccaaggactcaaactcaaaggaaagcagcaaaaggagcggaggaaaaagagacagaagcagcaagaaggtggacgaggaggagcccaaggggtacatacatgtcagggcgaggagaggacaagcaacggacaaccacagccttgcagagagggtgaggagggagagaatcagtgagaggatgagggtgttgcaggccctggtccctggctgtgataaggtcactggaaaagccctcattttggacgagatcatcaattatgtgcagtccttgcagaaccaagttgagttcctttccatgaggattgcttccctgagccctgtgctgtatggttttggcatggacagtagtgatgctttcagtgaccttataactcagaagatcgaagggatggcccaccatgaggcgttcgcgatgcctagcagctctgtcctgaacggcactccgtcggaagctctcgtggacacgcacacctccagctcctccccgtcctacgaggtccacggcgacggcggcaccgccagcgtctctttccctcaggacagtggcagctacatggtgcaaacagtaggtgagccaaggcaagagctgttcagccaagtggtgttcagtaaccacatgtgccctttccagtagggagagagcgagaggatggaaggacgacaggaagcaataatgttgagatcctatggaggtggaggccaccaccagacgagtttgtgatgttggacgcaatccatcccctcgtcggtggccgtaacgggaacccctgcggtagctagcattagcagtagtaataatagtaggctgttggttacatcatcctgttagatctcaaggtctctgtcggtaccgcatcatctagtaggcattgttgctgcttagcttttgggctctcttattaccaagggttgcatgcatgccattgtattgtactctccaattggaaaaaaaagaaaaaaaatcatttgttcttt

SEQ ID NO: 2480 - DNA, 1938 bp, Oryza sativa Japonica Group
ctccgtcgccggagcaggcacgcgcgaatcccaccgacgccatgggccagtgctgcacgggtggcgggaaggccgtcgccggcgacgaggcagagccggggacctccaaggcggcgccgccgagccgcggcacctcctccaaaaatgggtccgccaagcagcagccgtgctcgccggcggccaaggcggcggcgacggaagcggcggcggcggcgtcgtcgtccaagaagccggcaggccccatcggcgaggtgctggagcggccgatggaggaggttcgcacgacgtactccatcggcaaggagctcgggcgcgggcagttcggcgtgacccacctgtgcacccacaaggccaccggcgagaagctggcgtgcaagacgatcgcgaagcggaagctggcgaacaaggaggacgtcgacgacgtccgccgcgaggtgcagatcatgcaccacctctccggccagccaaacatcgtcgacctccgcggcgcctacgaggacaagcacaacgtccacctcgtgatggagctctgcgccggcggcgagctcttcgaccgcatcatcgcgcggggccactacacggagcgcgccgcggcggcgctcctccgcgccatcgtcgggatcgtgcacacctgccactccatgggggtgatccaccgggacctcaagccggagaacttcctgctgctgagcaagggggacgacgcgccgctcaaggccaccgacttcggcctctccgtcttcttcaaggaaggcgaggtgttccgcgacatcgtcggcagcgcctactacatcgcgccggaggtgctcaagaggaagtacggccccgaggccgacatctggagcatcggcgtcatgctctacatcttcctcgccggcgtgccgcccttctgggccgagtcggagaacgccatcttcaccgccatccttcgcggacagatcgacctcgccagtgagccatggccgaagatctcctctggagccaaggacctcgtcaggaagatgctcaacatcaaccccaaggagaggcttacagcattccaagtgctcaatcacccgtggatcaaagaagatggggatgctcctgatgtaccacttgacaatgttgttctcaacaggctcaagcagttcagggccatgaaccagttcaagaaagctgcactgaggattatagccggatgcctgtcagaggaggagatcaaggggctgaaggagatgttcaagaacatcgacaaggacaatagtgggaccattacgcttgaggagctcaaaaatgggttagcaaagcagggcaccaagttttcagacaacgaaattgagcaactgatggaagcagctgatgctgatggcaatggaattatcgactatgaggagttcgtcaccgcgacagtgcacatgaacaaaatggatcgagaagagcacctttacacggcattccagtactttgacaaggataatagtgggtacatcacaaaggaagagctcgagcaagccttgaaggaacaagggttatacgacgccaacgagatcaaggatgtcatcacagatgcagactctaataatgatgggcggatagattattcagagtttgtggccatgatgaggaaaggatcaggctgtgcagaagcaacaaacccaaagaagaagaggcgagatctagttctatagcgaaacagggtagtgtgtatagtggctggtttgtgcacaatttcaaacatgatgtgcatttaccacgagtgtaatgtatacaatggaattttctttccaattgcatatttgcatttcaggttgggctcaggttcatgtttggtcttgcacattgtcctggctagttgttgggaagatggatttgttccttctttctgttcagtcatcttgtacactacatgattgaatcctacctgattagaaagcccaaaagattactggtacattcaac

SEQ ID NO: 2481 - DNA, 1437 bp, Sorghum bicolor
catagcataggggccaagaacagagacagaggagctatccatgctgctccggctgaagatcgtcggcggcgtccactcggtggtgcttccagttccaggcggcggctatgacaaccatggcggcggcgcctgctacgcggcggcagcgccctgctgctggcgtcgcagccggcgtagcgtcgtcgcgaggcggccgaggagtgggagcgccacggtggtggtgatggcgctcaaggaggagcccgacggcagccgcagcggcttcgccggcggcggcgggccgagctgggaccccgggctggagatccaagtccccttcgagcaaagaccggtgaacgagtactctgctctcaaggatagcaccctctactcgtgggcggagctgagcccaggctccttcttcctccggctcggcggcctctgcctgatcaccttcactgtcctcgcagctccaattgcagccgcaagcttcaatccaggaaaggatccactcaagtttgtgctagcagctgggattgggacgctgcttctggtgtcattggtggttctcaggatctatctgggatggagctatgttggtgataggctgttgtcagcagtggtaccgtacgaagaaaccggatggtacgacggccaaatgtgggtaaagccaccagaggtgttggctcgtgacaggctcttgggatcttacaaggtaaagccggtgatcaacctgctgaagcagacgctggtgggcaccggcgcgctgctcgtcggcgccgtgtcgctcttcgccttcgccgcgcccgtcgaggacttcctccacgccctgaaccagcctccctccgccgcgtcgtccaagccaagcttgaggaaggaggagctgctgcggctacctgtggaggtgatgcaggacgacgacctcgccgcggccgccgcggaggccgccgacggacggccggtctactgcagggaccgctactaccgggcgctcgccggcggccagtactgcaagtgggacgacctgctcaactgaaaaatacatagtacgcctagtgttgcaatacatgggcagttcgccatgttggtacgacgcggcaagacaagatgtatttgtcagaaatggaagttttgtgactgaaaatttaatggatagccgttctccgtcgtctcgcttgccacaacaagagttagggtatcacacgtatagtgagagagcggcatacagacctttctacggtccaccaaggtaccacaccaagtataacagagttcagaggtaccacattacggaagtacaacacatttttcagtagtgtttgggtattcaaattctagaatgtcagaaaatatttatggtactaaatagatctcattagatacatatgaaatgcattttcataatttatctttgtagcagttaatactctcctttacaaatatagtcgaatttatgat

SEQ ID NO: 2482 - DNA, 1370 bp, Zea mays
gacgcaccgcacaccctagcataggaggcaaagaagtacagagggaggaggcgggcagcagatacgcggcgtgacagacacccagggccaggaagggtgctgtttatccatgctgctccggctgaagatcgtcgtcggcgtccactcggtggtgctcccggttcctgttccaggcggctatggccatggcgcctgctacgcggcagtagagccctgctggcgccgcagccggaggccagctctagcggcggcgggtggcctcgtcgcgaggcggccgaggcagagcgccacggtggtgatggcgctgaaggaggagccggagggcagcagccgccgcggcttcgccggcggcggtccgagctgggaccccgggctggagatccaagtccccttcgagcaaagaccggtgaacgagtactctgctctcaagtatagcgccctctactcgtgggcggagctgagcccagggtccttcttcctccgcctcggcggcctgtgcctcgtgaccttcactgtgctcgcggctccaattgccgccgcaagcttcaatccaggaaaggatccactcaagttcgtgctagcagctgggatcgggacgctgcttctggtgtcactggcggttctcaggatatacctggggtggagctacgttggtgatcgcctgctgtcagcggtggtaccgtacgaagaaaccggatggtacgacggccagatgtgggtgaagccaccagaggtgttggcccgtgacaggctcctgggatcttacaaggtgaagccggtggtcaacctgctgaagcagacgctggtgggcaccggcgcgctgctcgtgggcgccgtgtcgctcttcgcgttcgccgcgccggtcgaggacttcctccacgccctgagccagcctccctcctccgccaccgcctcgtccaagccgagcttgaggaaggaggagctgctgcggctaccagtcgaggtgatgcaggacgacgacctcgctgcggccgcggccgaggccgccgacggccggcccgtctactgcagggaccgctactaccgggccctcgccggcggtcagtactgcaggtgggacgacctgctcaactgataaatacctagagcagtattgctgtggtacgacgcggcaggacaggacgtattttttttgtcagatgggaaatttcggactgaactgctagaaattgagttcttaatggcacacaagcataaggaacagcaagaaaaagcaacacagaatcagagaaaaaacaagagtttatatattcacttttctctctttgtttctggagttacatctggtctttccgtttcttgagttacctctgatctttttgtttcttgagttaaaaaaaaaaaaaaaa

SEQ ID NO: 2483 - DNA, 1196 bp, Oryza sativa Japonica Group
atatacacaccgggccaccggccggtagggagttctcgcggttttgtcgttcgatcgatcgatcgtgtccatgctgctccggctgaaggccgtcgccgtccatccggcggcgctccttgggcgaccgcgcagccatgacgcaccccagctcgtcggtcgcacgggcgcgtcgacgacgacggcgaggcggagggcggcgaggagcgccgtgacggtgacgatggcgctcaaggaggagccggaaggcagccgtagcggcttcgccggcggcgttccgagctgggaccccgggctggagatccaagtccctttcgagcaaagaccggtgaacgagtactccgccctcaaggatagcgtactctactcgtgggcagagctgagcccggggtcattcttcctgcgcctaggcagcctgtggctgatcaccttcacggtgctcgccgcgcccattgcagctgcaagtttcagtccaggaaaggatccactcaaattcgtgctagcagctgggattggaactctgctcctcgtctctttggtcgttctccggatttatctgggttggagctacgttggtgataggctgttgtcggcggttgtgccgtacgaagaaaccggatggtacgacggccaaatgtgggtcaagccaccagaggtattggctcgtgacaggctcttgggatcttacaaggtaaagccggtgattaacctgctgaagcagacgctggtgggcaccggcgctctgctggtcggcgcggtgtcgctgttcgcgttcgcggcccccgtcgaggacttcctgcactccgtgaacgcaccaccatccgctgcctcctccaagcccagtctcagaagggaggagctgctgcgtctgcccgtggaggtgaggcaagacgacgacctcgccgctgccgccgcggaggccgccgacggacggccggtctactgcagggaccgctactaccgggcgctcgccggcgggcagtactgcaagtgggacgacctgctcaactgacaaaatacttctgtattacccaacggatacggtgtgcagtgtgtcctgaatcctgatatatgcagattggcatgcgaagcctccgcaactgtgtaatcggaacgaaattttgtgaccattggttgcgttaatgggacagatagataaatgcttaatttattggatgcttgatcgacgcaacatttgc

SEQ ID NO: 2484 - DNA, 1154 bp, Hordeum vulgare subsp. vulgare
ggctcacgtttgtacggtaggctagaagataataggcgtgagtttttccatgttgctccgcctgaagattaccaccgtccagcctgtggcgctgcttcttgggcacgaccatggcgggacagcatccccgcggcagttcgccggagcctttccgcagggcggcagagcgtccacgaggacaaagaggctgaggggcgtggcggtggcgatggcgctaaaggaggaggagccggagagcagccgaagccgcttcgccgggggcggcctgagctgggaccccaggatggagatcggagtcccatacgagcaaagaccggttaacgagtactccgctctcaaggagagcaccttgtattcgtgggcagagctcagtccaggctccttcttcatgcgcctaggcagcctgtgcctggtcacatttacagttctggcggccccaatctcagccgcaagtttcagtcccggaaaggatccgctcaagtttgtgctggctgctgggattgggaccctgctcctcgtatctcttgtggttctcaggatttacctgggttggagctacgttggcgacaggctattgtcggcagttgtgccttatgaggaaaccggatggtacgatggccaaatgtgggtcaagccagcagaggtgctggctcgcgacaggttattgggatcttacaaggtaaagccggtgatcaacctgctcaaacagacactggtgggcacaggtgcgctgctcgtcggggcggtcgtactcttcgccttcgccgtccccgtcgaggaattcgtccactccttcaatggagccccctctaccgcctcctctaagccgatcatgaggagagaggagctcctgaagctgcctgctgaggtgaggcaagacgacgacctcgctgcggctgctgcggaggccgccaatggacgcccggtttactgcagggaccgctactaccgggcgctcgccggcggtcagtactgcacctcagacgacctgctcgactgattaaagcaaatagtaatacatacgtattctggtatatgcagtttgccacattgatatgatatgcacaagttaagcaaatgtatcttatcggaatgaaattttgggaagatcgatgttggtgattctgtaataaattgcctcataataacaactt

SEQ ID NO: 2485 - DNA, 1719 bp, Zea mays
gaaaggagaaggagagcaaataggccaggcccaaaaccctgccaaacccagtacctcagtcctcggttccccaccatggcgtccctcctcctacaccgccgccacggtgcgcacccacgcgccgccgccgcggcctgcgctcgcctcctccgcgccttctccgcgctccccgacatcgatccctcggcgtcctccaccgcaagccctagcccggccgcgcccacctccacctccgcccgcgcctccgtgctcgacctccagctcgccgtccgcgccgagtctgacccagcccgcatccactccctcgtcgcctccgcgctctccagccatgacatgccgcgcctccacacctcgcgccagctcttttccctggccacttcccgcttgatccgcctccggcgcgccgacctcgccgcctcgctcctcgacctcctccttgcctccaccccgccctccccgggtctcctagcgcgggcactctccctctacccgggacccgacgacgcgctccgggccttctcctcgtctccccccgccgcccgctccgacgtctccctctcggcgctcctttcggcgttcctccgcgccggccgcctcgatgacatcaagtccaccattaccctggcggaatcctcccacggggtcgcgcccggccgcgcctcccacaatgtgctgctccatgcattggtcaagaattctgagcttgctgctgcccggaagctgctcgacgaaatggccaacaagaagttgaagcaccgccctgccccagacatcatatcctacaacactgtcctcgctggttactccgtgcaggatgatgaggatgagtttgggaagcttttgaaggagatcagcttgagcaacctggagccaaatgttgtcacttacaactgccggatacagtggttctccaagaaaggcgagacagtcaagggggaggagctgcttgatgtgatggaatcaaaggagatagcgccaaattacgttacctacaatgctctcgtgcaggggtactgcaaggagggaaatgttggggcagctatgcgtgtgttcaagaggatgaaagtgatgaagaggcgggagggaaggagtgacttgggtgtttctgcacattcacaggtatatgtggtgctgtttaggagtttggtggagaaagagaagcttaatgacgcgctgtggatttgtaagagctgctttgcaatgaaggcagcaccaccgtttgaggctgttaaaggtttggttgagggtttggtgaaggcaggcaggtcaacagaggccaaggatgttgttgccaagatggagtttcttgtgaaaggcgatgccaaacttgcttgggggaaggttgttggtgagctttcttttgaagagggatcaccgaatttgaatccatgatttgctagaggcatctgtgttacttctcattaattcatgcattttggagtttgaatgatgatggtgaagaagataagcgttcaacgtgggatccaatgttgccttcttgttgtcactggactgcattttgcaaggtttgcggttagatcaggatgtaatggatgctccgtttacttcaaaacttgcttaattttatgtcttgtaataatattcgaaatgatgttaaagtttaacatttgttgaagtgtttagggcatcatgatagatgatacatctactatctatcattgtaacatgcttgttgtaatgtgtatttcatgcctcatc

SEQ ID NO: 2486 - DNA, 2939 bp, Sorghum bicolor
gtaccgctgcgcacccacgtccccggttccccaccatggcgtccctcctcctccgccgccgccacgctgcgcacccacgcgccgccgccgcggcctgcgctcccctcctccgcgccttctccgcgctccccgacgtcgatccctcggcgtcctccaccgcaaccccaacctctaccccggccgcgcccacctccacctccgcccgcgcccccgtgctcgacctccagctcgccgtgcgcgccgagtctgacccagcccgcatccactccctcgtcgcctccgcgctctccggcgatgacttcccgcgcatccacacctcgcgccagctcttttcgctggccacctcccgcctgacccgcctccgccgccccgacctcgccgcctcgctccttgacctcctccttgcctctaccccgccctccccgggcctccttgcgcgggcgctctctctttacccgggacccgacgacgcgctccgggccttctcctcgtctccccccgccgcccgctccgacgtctccctctcggcgctcctttcggcgttcctccgcgccggccgcctcgatgaaatcaagtccaccattaccctggcagagtcctcgcatggggtcgcgcccggccgcgcctcccacaatgtgctcctccacgcgctggtcaagaattctgagcttgctgctgcccggaagctgctcgacgaaatggctaacaagaagttgaagcaccgccctgccccagacatcatatcctacaacactgtccttgctggttgttccgtgcaggatgatgaggaggggtttgagaagcttttgaaggagatcagcttgagcaacctggagccaaatgttgtcacctacaactgccggatacagtggttctccaagaaaggcgagacagtcaagggggaggagctgcttgacgtgatggaatcgaagggtgtagcgccgaattaccttacctacaatgctctcgtgcaggggtactgcaaggagggaaatgttggggcagcgacgcgtgtcttcaagaggatgaaggtgatgaagaggcgtgagggaagaagtgacttgggtgtttctgcgcattcacaggtatatgtggtgctgtttaggagtttggtggagaaagagaagcttgatgatgcattgtggatttgtaagagctgctttgcaatgaaggcagcaccgccctttgaggctgttaagggtttggtcgagggtttggtgaaggcaggcaggtcaacagaggccaaggatgttgttgccaagatggagtttcttgtgaaaggcgatgctaaacttgcttgggggaaggttgttgctgaactttctttcaaagagggaccgccaaattcgaatccatgatttggtagaggcatctgcgtttcttctgattgattcatgcattttggacttcgaatgatgatggcgaagaagataggctttcaacatgggatccaatgttgccttcttgttgtcgctggactgtatttcgcaaggtctgtggttagatcaggatgtaatggatgctccctttactgtaagaacttgctcaattttgtgtttttcaataatacttgaaatgatgttaaagtttgacatttgtcaagtgcttaggagatcatgatagatgatacatctactatctatcattgtaacatgtttgttgtaatgtgtgtttgatgccacatcgcataattactctgtttttcctttgagaatatgatagttgcactgtaattagtgcactcgtgcatacaatcagtattgaagtaatcctgcaatcagtgcatagtacagtggaacaacaggctgtatagtgccttatttctacaatgtctaggaagcaaactcaagtaccttacactgtttgatagagaaacacataaatacagtaaaatgctagcgatgtactatgtggtgcacagctgccaccaagacatctatgctctttatgcgatgtttctgtgtatatataattaatcttcatgcttgccatgtaaattttccctccattatattagcttgtgaaggttttcttaacccctcggactagcagtccttcaaaggtgatgcctgggccaaaagccaagatcaatccccactcttcgcttattgcccctttctttagctcgtccctcaagtactccagcacatagaagattgtattgctgctcacgttcccatagttcttcaaggcttttctgctaatcttgagcttctctggctgaagttcaaggcagaactcaagcctgttcaatattgctggtcctccaggatgcacagcccaaaatacatcattgaaatcctttatccctacctggttcatgagagtcctgcagaaaccttctatgcggctttcaatcttctcaggcaaatcacgccctagtttaaaattaattccttcctctgcaatcttgccatcaattaccttatcagtcccaggcaggaactcctgtgtggagaactcaagctctaagaaaggatcttctgctggtgccatggggcctgctcctataatcacagctgaggcaccatcaccaaacagggcagcaccaacaaggtcataaggacggtcataacttggtggccggaaacctagcacagtggtctcggcagccgttactaggacacggctccctgggttgttctcagcaatgtccttggcagtgcggagggcagcagcgccaccggagcagccaaggaagagaagggaagtgcgcacggtgtttgggctaaggccaaggcgggcagccaggtgaacgtctccccctgggagacgaagctcactggatgagatgtagatgaggtgggtaatatcagctgcagggcggccccaatcgtcaagggcagcacgagctgcagctgcaccaaggtcgatcaccgcagcattgcagatgtcaaggcggggtgtcagtgttggagtaccctccatcttcagctctg

SEQ ID NO: 2487 - DNA, 1537 bp, Hordeum vulgare subsp. vulgare
gagcaaaccccgtgctcgctcactcaccaatcaccatggcgtccctcctgctccgccgccacccccacccctccgccgtctccgcccacctcctccgccgcctctccgcgcttgcggacgtcgatccttcgccagcctccgcccccgcccccggccgcgcggcggtccgcgcctccataatcgatctccagctcgccgtccgcgcggagaccgacccggaccgcgtccactccctcgtcgcctccgcgctctccagccccgactaccaccgcctccacacctcgcgcgccctcttctccctcgccgcctcccgcctcgaccgcctccgccgccccgacctcgccgcctccctcctcgaccagctcctcgcctccgccccggtctccccgggcctcctcgcacgcgccctctccctcttcccgggcccggacgacgccgtccgtgccttctcctcctccgcgcccgccgcccgctcagacgtctccctctccgccctcctctccgcgcttctccgcgccggccgcatcgacgacctcaagtcaaccttcaaatcagccgagtcctcgctcggcgtcgcccctggcagcgcctcccacaacgtgctccttcacactctggtcaagagctccgatctccccgccgcccgcaagctgctcaacgaaatggccaagaagaagttcaagcatcgcccgcccccagacatcatatcctacaatactctcctcgctgggttttccgagcaggacgatgttgaggagtttgaaaagctgctcaaggagatcaacgagaacaagctggagccgaatgtcgtcacgtacaattgccggatgcattggtttgcaaggaagggggagaccttcaagggcgaggagctgctcgatgtcatggagtcaaagggtgtgctgcccaattacgttacttacaatgcgcttgtgcaggggtactgcaaggaggggaatgtcggggccgccatgcgggtattcaagaggatgaaggtgatgaagaggcgggagggtaggagtgacttgggagtgtcggtgcactcacagacatatgtcctgctgtttaggactttggtagagaaggaaaggcttgatgatgcgctgtggctttgcaacagctgctttgctatgaaggcagccccatcatttgaggctgtcaagggtttagtcgaggggttggtgaagggagggaggtctgcagaggcgaaggctgttgttgccaagatgaactttcttgtgaaaggggatgctaaagtttcttgggagaagattgctggtgaattatctcttgaagagggagcaccaagttcaaatccatgatttgtttcagacatgcgggccagttctgatttattcaagtgttttggcctttgaataacgtagatgaagaagggcattctcatgggttctagtattatcttcatgttatcatgggccatctttcaaggtccaatggttagatcagagtgtaatgtttctataagacagaatggtcagtgccatttcataatcccttctctgtaagggcttcttct

SEQ ID NO: 2488 - DNA, 1509 bp, Hordeum vulgare subsp. vulgare
gagcaaaccccgtgctcgctcactcaccaatcacccccacccctccgccgtctccgcccacctcctccgccgcctctccgcgcttgcggacgtcgatccttcgccagcctccgcccccgcccccggccgcgcggcggtccgcgcctccataatcgatctccagctcgccgtccgcgcggagaccgacccggaccgcgtccactccctcgtcgcctccgcgctctccagccccgactaccaccgcctccacacctcgcgcgccctcttctccctcgccgcctcccgcctcgaccgcctccgccgccccgacctcgccgcctccctcctcgaccagctcctcgcctccgccccggtctccccgggcctcctcgcacgcgccctctccctcttcccgggcccggacgacgccgtccgtgccttctcctcctccgcgcccgccgcccgctcagacgtctccctctccgccctcctctccgcgcttctccgcgccggccgcatcgacgacctcaagtcaaccttcaaatcagccgagtcctcgctcggcgtcgcccctggcagcgcctcccacaacgtgctccttcacactctggtcaagagctccgatctccccgccgcccgcaagctgctcaacgaaatggccaagaagaagttcaagcatcgcccgcccccagacatcatatcctacaatactctcctcgctgggttttccgagcaggacgatgttgaggagtttgaaaagctgctcaaggagatcaacgagaacaagctggagccgaatgtcgtcacgtacaattgccggatgcattggtttgcaaggaagggggagaccttcaagggcgaggagctgctcgatgtcatggagtcaaagggtgtgctgcccaattacgttacttacaatgcgcttgtgcaggggtactgcaaggaggggaatgtcggggccgccatgcgggtattcaagaggatgaaggtgatgaagaggcgggagggtaggagtgacttgggagtgtcggtgcactcacagacatatgtcctgctgtttaggactttggtagagaaggaaaggcttgatgatgcgctgtggctttgcaacagctgctttgctatgaaggcagccccatcatttgaggctgtcaagggtttagtcgaggggttggtgaagggagggaggtctgcagaggcgaaggctgttgttgccaagatgaactttcttgtgaaaggggatgctaaagtttcttgggagaagattgctggtgaattatctcttgaagagggagcaccaagttcaaatccatgatttgtttcagacatgcgggccagttctgatttattcaagtgttttggcctttgaataacgtagatgaagaagggcattctcatgggttctagtattatcttcatgttatcatgggccatctttcaaggtccaatggttagatcagagtgtaatgtttctataagacagaatggtcagtgccatttcataatcccttctctgtaagggcttcttct

SEQ ID NO: 2489 - DNA, 1305 bp, Oryza sativa Japonica Group
atggcttccctcctccgccgccaccgccacccccacccgctccccgccgcccacctcctccgccgcttctccgcgctccccgacgtcgatcacccgccgccgcccgcctcgacccccaccacccccgcctccacgcgctcccccatcctcgacctccagctcgccgtccgcggcgaggccgacccggcccgcatccactccctcgtcgccaccgcgctctcccgccccgacgactacccgcgcctccacggctcccgcccgctcttctccctcgccgcctcccgcctcgcgcgcctccgccgcccggacctcgccgcctcgctcctccgcgccctcctcgactccgccccggcgtccccgggcctcctcgcccgcgccatctccctcttcccgggccccgacgacgccctccgcgcgttctccgactccgcgcccgccgcccgctccgacgtctccctctcggcgctcctctccgcgctcttccgcgccggccgcgtcgacgacgtcaagtccaccctcgcctccgcggagacctccttcggcgtcgcccccggacgcgcctcccacaacgtgctcctccacgctctggtgaagaactccgagctcgccgccgcccgcaagctgctcggcgaaatggccaagaagctaaagcaccgcccggcccctgacatcgtgtcgtacaacaccgtgctcgctggctattctgcgcagggcgatgaggaggggtttgagaagctactgaaggagatcagcgcaaagaagctggagccgaatgttgtgacttacaactgccggatacagtggtttgccaagaagggtgaaaccttcaagggggaggagctgcttgatgccatggagtcaaaggatgtggcgccgaattaccttacgtacaatgcgcttgtgcaggggtactgcaaggaggggaatgttgggtcagccatgcgtgtgttcaagaggatgaaagtgatgaagaggagggagggtaggagtgacttgggtgtgtcagcgcattcgcaaacatatgtggtgctgttcaggagcttggtggagaaagagaggcttgatgatgctctatggatttgtaagagctgctttgcgatgaaggcagcaccaccctttgaggcagtcaagggtttggttgagggattggtgaagggtgggaaatctgcagaggcaaaggatgttgtcgccaagatgaaccttcttgtgaaaggtgatgctaaagtggcttgggagaagattgctgatgctgtcaagacatctatgctccttatgagatgtttcaagttcatactatatacttaa

SEQ ID NO: 2490 - DNA, 1359 bp, Sorghum bicolor
ccactgcagccagccactctcatttccccttccataccctgcaggcagaagaaactttcagccatggccaccaccgcgtccagcctcctcaagtcctccttcgcgggcgccaggctcccggcgtccacgcgcacgccgtcgtcgcccgccgtcgtggccaccccgcgcggcgccggggcgatccgcgcgtcgtccatctcctcctcgaacccgccctacgacctgacgtccttccggttcagccccatcaaggagtcggtcgtctcccgcgagatgacccggcggtacatgacggacatgatcacctacgccgacacggacgtggtcatcgtgggcgccggctccgcggggctctcctgcgcgtacgagctctccaaggacccgtccgtgagcatcgccatcgtggagcagtcggtgtcaccgggcggcggcgcgtggctgggcgggcagctgttctcggccatggtggtgcgcaagccggcgcacctgttccttgacgagctgggcgtcgcctacgacgaggccgaggactacgtggtcatcaagcacgccgcgctcttcacgtccaccgtcatgagccgcctcctggcgcgccccaacgtgaagctgttcaacgccgtcgccgtggaggacctgatcgtcaagggagggcgcgtcggcggcgtcgtcaccaactgggcgctcgtgtccatgaaccacgacacgcagtcgtgcatggacccaaacgtgatggaggccaaggtggtggtcagctcctgcggccacgacgggccgttcggggccaccggcgtcaagaggctgcaggacatcggcatgatcagcgacgtgcccgggatgaaggcactcgacatgaacaccgccgaggacgagatcgtgcgcctcacgcgcgaggtcgtgccaggcatgatcgtcaccggcatggaggtcgccgagattgacggcgccccgaggatgggcccgacgttcggcgccatgatgatctccgggcagaaggcggcgcacctggcgctgaaggcgctggggaggcccaacgccgtggacgggaccatcaaggtggtgtcgccggcgttgcgtcaggagttcgtgattgcgtccaaggacgatgaggtcgtggacgcgtgagcgcggggaggagcttagcgcgcgctctggcttcgttttttggactttgccttgttgatgactttgtccgaatgaattccctttcagttagcgtacatctcgctagcgtcgtgttaataccccagcacatcatgccacccgcatgttaatagcgtcgtgttatttgttggaataataaaaccttgttgcctagcatgcaagtgcatctcaattaattccccaatggtttctgttcgt

SEQ ID NO: 2491 - DNA, 1421 bp, Zea mays
cactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcccccaacccgccctacgacctgacgtccttccggttcagccccatcaaggagtccatcgtgtcccgcgagatgacccggcgctacatgacggacatgatcacccacgccgacaccgacgtggtgatcgtgggcgccgggtccgcgggcctgtcctgcgcgtacgagctgtccaaggaccccaccgtgagcgtcgccatcgtggagcagtccgtgtccccgggcggcggcgcgtggctgggcgggcagctgttctcggccatggtggtgcgcaggccggcgcacctgttcctggacgagctgggcgtgggctacgacgaggccgaggactacgtggtggtcaagcacgcggcgctgttcacgtccaccgtgatgagccggctcctggcgcggcccaacgtgaagctgttcaacgccgtggcggtggaggacctgatcgtgcggcgggggcgcgtcggcggcgtggtcaccaactgggcgctcgtgtccatgaaccacgacacgcagtcgtgcatggaccccaacgtgatggaggccaaggtggtggtcagctcctgcggccacgacgggcccttcggcgccaccggcgtcaagaggctccaggacatcggcatgatcagcgccgtgcccgggatgaaggcgctcgacatgaacgccgccgaggacgagatcgtgcgcctcacgcgcgaggtcgtgcccggcatgatcgtcaccgggatggaggtcgccgagatcgacggcgccccgaggatgggcccgacgttcggcgccatgatgatctccggccagaaggcggcgcacctggcgctgaaggcactgggcaggcccaacgccgtggacgggaccatccccgaggtgtcgccggcgctgcgcgaggagttcgtgattgcgtccaaggacgacgaggtcgtggacgcctgagcgagcatccacgcgccagcatgcaagcagcgtcttatctgggccggcgccatcacggggtttcttcttttaatctgggactttgttgttgttggacgaatgaattcccttcgatcggttagctttaatctgtctcgttagtgtgtcgtgttcgtgtagcaccatgccacagctacgccatgccgtgtgctctgtcacgtgggggccactcgtggggtctcctgctgctgtcagaacgaataagagaagatggaattgtggtgaaacaataaaaatgcatggttt

SEQ ID NO: 2492 - DNA, 1450 bp, Zea mays
gtcctcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcctcccccaccccgccctacgacctgacgtccttccggttcagccccatcaaggagtccatcgtgtcccgcgagatgacccggcgctacatgacggacatgatcacccacgccgacaccgacgtggtgatcgtgggcgccgggtccgcgggcctgtcctgcgcgtacgagctgtccaaggaccccaccgtgagcgtggccatcgtggagcagtccgtgtccccgggcggcggcgcgtggctgggcgggcagctgttctcggccatggtggtgcgcaggccggcgcacctgttcctggacgagctgggcgtgggctacgacgaggccgaggactacgtggtggtcaagcacgcggcgctgttcacgtccaccgtgatgagccggctcctggcgcggcccaacgtgaagctgttcaacgccgtggcggtggaggacctgatcgtgcggcgggggcgcgtcggcggcgtggtcaccaactgggcgctcgtgtccatgaaccacgacacgcagtcgtgcatggaccccaacgtgatggaggccaaggtggtggtcagctcctgcggccacgacgggcccttcggcgccaccggcgtcaagaggctccaggacatcggcatgatcagcgccgtgcccgggatgaaggcgctcgacatgaacgccgccgaggacgagatcgtgcgcctcacgcgcgaggtcgtgcccggcatgatcgtcaccgggatggaggtcgccgagatcgacggcgccccgaggatgggcccgacgttcggcgccatgatgatctccggccagaaggcggcgcacctggcgctgaaggcactgggcaggcccaacgccgtggacgggaccatccccgaggtgtcgccggcgctgcgcgaggagttcgtgattgcgtccaaggacgacgaggtcgtggacgcctgagcgagcatccacgcgccagcatgcaagcagcgtcttatctgggccggcgccatcacggggtttcttcttttaatctgggactttgttgttgttggacgaatgaattcccttcgatcggttagctttaatctgtctcgttagtgtgtcgtgttcgtgtagcaccatgccacagctacgccatgccgtgtgctctgtcacgtgggggccactcgtggggtctcctgctgctgtcagaacgaataagagaagatggaattgtggtgaaacaataaaaatgcatggtttaaattgtct

SEQ ID NO: 2493 - DNA, 1289 bp, Zea mays
atggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgccgggcggcggcgcgtggctgggcgggcagctgttctcggccatggtggtgcgcaagccggcgcacctgttcctggacgagctgggcgtggcgtacgacgaggccgaggactacgtggtcatcaagcacgccgcgctcttcacgtccacggtcatgagcctgctcctggcgcgccccaacgtgaagctgttcaacgccgtggccgtggaggacctcatcgtcaggggagggcgcgtcggcggcgtcgtcaccaactgggcgctcgtgtccatgaaccacgacacgcagtcctgcatggaccccaacgtcatggaggccaaggtcgtggtcagctcctgcggccacgacgggcccttcggcgccaccggcgtcaagaggctccaggacatcggcatgatcagcgccgtgccggggatgaaggcgctcgacatgaacaccgccgaggacgagatcgtgcgcctcacgcgcgaggtcgttcccggcatgatcgtcaccggaatggaggtcgccgagattgacggcgcccccaggatgggcccgacgtttggcgccatgatgatctccggccagaaggcggcgcacctggcgctcaaggccctgggcaggcccaacgccgtggacgggaccatgtcgccgccgttgcgcgaggagttgatgattgcgtacaaggacgacgaggtcgtggacgcctgagtgcggcaagcagagaggaggatcgacgccagcagcgtcttatcttaattgccttgttgttcaatgatgaatcgatcgaattcccttgggttagctttattattgttgttgttattattaatttgactcgctatagtgtgtcgtgttcatagcaccaccaccgcgccatcgacatgccacacctgtgctctgtctgtcacgtcacgtgcgagtcctactacggg

SEQ ID NO: 2494 - DNA, 1411 bp, Oryza sativa Japonica Group
actcacacacactctcctcatcccagagcaagaagctcagctcctcctcctctcgcatggcagccatggccaccaccgcgtccagcctcctcaagacctccttcgctggcgcgcgcctccccgccgccgcccgcaaccccaccgtctccgtcgcgccgcgcaccggcggcgccatctgcaactccatctcgtcgtcgtcgtccactcccccctacgacctcaacgccatcaggttcagccccatcaaggagtccatcgtgtctcgcgagatgacccggcggtacatgaccgacatgatcacctacgccgacaccgacgtcgtcgtcgtcggcgccggctccgcggggctctcctgcgcgtacgagctctccaaggacccctccgtcagcgtcgccgtcatcgagcagtcggtgtcccccggcggcggcgcgtggctcggcgggcagctgttctccgccatggtggtgcgcaagccggcgcacctgttcctcgacgagctcggcgtcgcgtacgacgagcaggaggactacgtcgtcatcaagcacgccgcgctcttcacctccaccgtcatgagccgcctcctggcgcgccccaacgtgaagctgttcaacgccgtcgccgtcgaggacctcatcgtcaaggagggccgcgtcggcggcgtggtcaccaactgggcgctggtgtcgatgaaccacgacacgcagtcgtgcatggaccccaacgtgatggagtccagggtggtggtgagctcctgcggccacgacgggccgttcggcgccacgggcgtcaagcggctgcaggacatcggcatgatcgacgccgtgcccggcatgcgcgccctcgacatgaacaccgccgaggacgagatcgtccgcctcacccgcgaggtcgtccccggcatgatcgtcaccggcatggaggtcgccgagatcgacggcgccccgagaatgggcccgacgttcggagccatgatgatctccggccagaaggcggcgcacctggcgctgaaggcgctcggccggccgaacgccatcgacggcacgatcaagaaggcggcggcggcggcggcgcacccggagctgatcctggcgtcgaaggacgacggcgagatcgtggacgcctgagcgaatagaacagggtaaaaaaaaatccgcaagacgtggtggtgacacggaggagttggggacgagaagaagatgtggactttcccctgtgtttttttttcgggatttgcattgatccccttgtttgttttagctctggatgttgattagcgtcttgttcatagcacttccactgccaccgtgtgtgtgtgctctgcttgcctgatgagggcaagaaaacttccatggatccgtctctctgggaggaatgaataaaaaggatgaggaaataaaaatgattcagtgcc

SEQ ID NO: 2495 - DNA, 1130 bp, Oryza sativa Japonica Group
ccaccaccgcgtccagcctcctcaagacctccttcgctggcgcgcgcctccccgccgccgcccgcaaccccaccgtctccgtcgcgccgcgcaccggcggcgccatctgcaactccatctcgtcgtcgtcgtccactcccccctacgacctcaacgccatcaggttcagccccatcaaggagtccatcgtgtctcgcgagatgacccggcggtacatgaccgacatgatcacctacgccgacaccgacgtcgtcgtcgtcggcgccggctccgcggggctctcctgcgcgtacgagctctccaaggacccctccgtcagcgtcgccgtcatcgagcagtcggtgtcccccggcggcggcgcgtggctcggcgggcagctgttctccgccatggtggtgcgcaagccggcgcacctgttcctcgacgagctcggcgtcgcgtacgacgagcaggaggactacgtcgtcatcaagcacgccgcgctcttcacctccaccgtcatgagccgcctcctggcgcgccccaacgtgaagctgttcaacgccgtcgccgtcgaggacctcatcgtcaaggagggccgcgtcggcggcgtggtcaccaactgggcgctggtgtcgatgaaccacgacacgcagtcgtgcatggaccccaacgtgatggagtccagggtggtggtgagctcctgcggccacgacgggccgttcggcgccacgggcgtcaagcggctgcaggacatcggcatgatcgacgccgtgcccggcatgcgcgccctcgacatgaacaccgccgaggacgagatcgtccgcctcacccgcgaggtcgtccccggcatgatcgtcaccggcatggaggtcgccgagatcgacggcgccccgagaatggtacgcaccaaaaaaacatcaaactcttcaccataatctctcccccgttcttggatttgaacaaattcgttgttgcagggcccgacgttcggagccatgatgatctccggccagaaggcggcgcacctggcgctgaaggcgctcggccggccgaacgccatcgacggcacgatcaagaaggcggcggcggcggcggcgcacccggagctgatcctggcgtcgaaggacgacggcgagatcgtggacgcc

SEQ ID NO: 2496 - DNA, 1497 bp, Sorghum bicolor
gtccccttcttaaacctcggccgtgcaagcgcaacgcaaccagcctcctcaagtccctcacacactgctctgctgcagcaagaaaccaacaagagcttgctagccatggccaccaccgcggcgtctagcctcctcaagtcctccttcgctggctcccgtctcccgtctgccacgcgcgccccgtcgtccgtcgtcgtgtccaccggcggcgccccacgcacggccgccatctccgcgtccatctcctcctccaaccctccctacgacctgacgtccttcaagttcagccccatcaaggagtcgatcgtctcccgcgagatgacccgccgctacatgacggacatgatcacccacgccgacaccgacgtggtgatcgtgggcgccgggtccgcgggcctctcctgcgcgtacgagctctccaaggaccccacggtgcgcgtcgccatcgtggagcagtcggtgtccccgggcggcggcgcgtggctgggcgggcagctgttctcggccatggtggtgcgcaagccggcgcacctgttcctcgacgagctcggcgtcgcctacgacgaggccgccgacgactacgtggtggtcaagcacgccgcgctcttcacctccaccgtcatgagcgccgtcctggcgcggcccaacgtgaagctcttcaacgccgtcgccgtcgaggacctcatcgtcaagggagggcgcgtcggcggcgtggtcaccaactgggcgctcgtgtccatgaaccacgacacgcagtcgtgcatggaccccaacgtgatggaggccaaggtggtggtcagctcctgcggccacgacgggccgttcggggccacgggagtcaagaggctccaggacatcggcatgatcgccgccgtgccagggatgaaggcgctcgacatgaacgccgctgaggacgccatcgtgcgcctcacgcgcgaggtcgtgccaggcatgatcgtcaccggaatggaggtcgccgagattgacggcgcgccgaggatgggcccgacgttcggcgccatgatgatctccggccagaaggcggcgcacctggcgctgaaggcgctgggaaggcccaacgccgtggacgggaccatccccaaggtgtcgccggcgttgcgcgaggagttcgtgattgcgtccaaggacgacgaggtcgtggacgcctgatcgagtgatcgatcgacgccagcagcaagcagcgtctttatctgggacggacggacggggtttctttaatttgggactttcctttgccttgttgttgaatgaatgaattcccttcgatcgtgtagctttaatttctctcgtctcgttattagtgtgtcgtgttcatagcaccacctgccaccaccgcgccatgccatatgtgtgctcttcacgtgggggccactcgtggggtcctgctgccagaacgaataagagaagatggaattgatgaaacaataaaatgcacggttaatcacaattgtcttggtggtgttggtctctttctgt

SEQ ID NO: 2497 - DNA, 1134 bp, Zea mays
caagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgccgggcggcggcgcgtggctgggcgggcagctgttctcggccatggtggtgcgcaagccggcgcacctgttcctggacgagctgggcgtggcgtacgacgaggccgaggactacgtggtcatcaagcacgccgcgctcttcacgtccacggtcatgagcctgctcctggcgcgccccaacgtgaagctgttcaacgccgtggccgtggaggacctcatcgtcaggggagggcgcgtcggcggcgtcgtcaccaactgggcgctcgtgtccatgaaccacgacacgcagtcctgcatggaccccaacgtcatggaggccaaggtcgtggtcagctcctgcggccacgacgggcccttcggcgccaccggcgtcaagaggctccaggacatcggcatgatcagcgccgtgccggggatgaaggcgctcgacatgaacaccgccgaggacgagatcgtgcgcctcacgcgcgaggtcgttcccggcatgatcgtcaccggaatggaggtcgccgagattgacggcgcccccaggatgggcccgacgtttggcgccatgatgatctccggccagaaggcggcgcacctggcgctcaaggccctgggcaggcccaacgccgtggacgggaccatgtcgccgccgttgcgcgaggagttgatgattgcgtacaaggacgacgaggtcgtggacgcctgagtgcggcaagcagagaggaggatcgacgccagcagcgtcttatcttaattgccttgttgttcaatgatgaatcgatcgaattcccttgggttagcttt

SEQ ID NO: 2498 - DNA, 1980 bp, Oryza sativa Indica Group
gggctccaccactagtacccctcactacaggtagccataaaaaaaatcgatcaccaaaacccattattaggttgtgtactgatacagaaagttgggaaccaatctcccagcacagaaaacggtacggttcattagcgcgtgattaattaaatatttactattttttaaaaaaaatagatcaatatgatttttaagcaactttcgtataaatactttttcaaaaaaacacaccgttttctagtttgaaaagcgtacacgcgtgaaatgagggagaaaggttggaaacgtgggattgcaaacacagcattagtcgtcacggtacccagcaaaaaatcactgaacacagcaccactgttcccgtgagtccgtaacttagcagcacttgtcccgttctcctgaagacagtccaaaaaccctcactaaaccttcccaaaatatctcctccaatcaatccgaaacccagaggcccatactgctgacacgtggacggcactcccagatatttgcgctctcctcttcttcttatacccccgccaacccacgctctatccactcacacacacactcctcatcccagagcaagaagctcagctcctcctcctctcgcatggcagccatggccaccaccgcgtccagcctcctcaagacctccttcgccggcgtgcgcctccccgccgccgcccgcaaccccaccgtctccgtcgcgccgcgcaccggaggcgccatctgcaactccatctcgtcgtcgtcgtccactcccccctacgacctcaacgccatcaggttcagccccatcaaggagtccatcgtgtcccgcgagatgacccggcggtacatgaccgacatgatcacctacgccgacaccgacgtcgtcgtcgtcggcgccggctccgcggggctctcctgcgcgtacgagctctccaaggacccctccgtcagcgtcgccgtcatcgagcagtcggtgtcccccggcggcggcgcgtggctcggcgggcagctgttctccgccatggtggtgcgcaagccggcgcacctgttcctcgacgagctcggcgtcgcgtacgacgagcaggaggactacgtcgtcatcaagcacgccgcgctcttcacctccaccgtcatgagccgcctcctggcgcgccccaacgtgaagctgttcaacgccgtcgccgtcgaggacctcatcgtcaagaagggccgggtcggccgggtggtcaccaacttgggcgcttgtgtcaatgaccacgacacgcagccgggcatggacccaaacgtgatggagttcaaggtggtggtgagctcctgcggccacgacgggccgttcggcgccacgggcgtcaagcggctgcaggacatcggcatgatcgacgccgtgcccggcatgcgcgccctcgacatgaacaccgccgaggacgagatcgtccgcctcacccgcgaggtcgtccccggcatgatcgtcaccggcatggaggtcgccgagatcgacggcgccccgagaatggtacgcaccaaaaaaacatcaaactcttcaccataatctctcccccgttcttggatttgaacaaattcgttgttgcagggcccgacgttcggagccatgatgatctccggccagaaggcggcgcacctggcgctgaaggcgctcggccggccgaacgccatcgacggcacgatcaagaaggcggcggcggcggcggcgcacccggagctgatcctggcgtcgaaggacgacggcgagatcgtggacgcctgagcaaataaaacagggtaaaaaaaaatcccccaaacgtggtggtgacacggaggggttggggaccaaaaaaaaatgtggactttcccctgtgtttttttttcgggatttgctttgatccccttgtttgttttagctttggaggttgataagggttttgttaaaaacaattcccctcccaccgggtgtgtgtggtttgcttgcctaatgagggcaaaaaaacttccatg

SEQ ID NO: 2499 - DNA, 793 bp, Zea mays
aacaggacaacgcagcagccgctgccgttgccgctgccggctgccgctacctatgctcaagtgctcagtgctcactgctcaccgctctgcccctgcctcatcacacgcgcgcacggcgcacaaataccttttctctcctctcccgtcccactctcctcggcaatcccggcccggcatggcgagcccgtcctcgtccccctcgcggaaggctctgagcaagatcgcctgcagccgcctgcagaaggagctcgcggagtggcaggtcaacccgcccgcgggcttcaagcacagggtcaccgacgacctccagaggtgggtcatcgatgtagcgggggcagcaggcacgctctacactggcgaaacctacaagttgcaggtggatttccccgagcattatccgatggaggcacctcaggttatatttctgcatccagcatcgatgcatccacacatttacagcaatggacacatctgtttagatatactatatgactcgtggtccccagcgatgactgtcagttctatctgtatcagcatattatctatgctgtccagctcgccagaaaagcaacgcccagctgataatgatcgctatgtcaagaactgtcgcaatgggaggtctccgaaagagaccaggtggtggttccatgatgacaccgtgtgatgggtgttccgattattgttgtcctgtatgcatttagttgccagactatatgggagatggacttatttcgaacgacccatttgaccagaaattaacatgctcttgtggtttgcaaaaaaaaaaaaaaaa

SEQ ID NO: 2500 - DNA, 793 bp, Oryza sativa Japonica Group
gcacacctttccccccctctctccctccctcctccgccatccctagcagccgccccgcacccgcgcccgcaccatgacgagctcctcctccccttcccgcaaggtgctgagcaagatcgcgtgcaaccggctgcagaaggagctcgcggagtggcaggtcaaccctccctccggcttcaagcacaaggtcaccgacaatctccagaggtgggtcatcgaggtcgcgggggctgcgggcacgctctatgccggagagacataccaattgcaggtggacttccctgagcattaccccatggaggctccccaggtcatatttcttcatccagcgccaatgcatccgcacatttacagcaatgggcatatctgtttagatatattgtatgactcgtggtcaccggcgatgaccgttagttctgtttgtatcagtatcttgtccatgttgtcaagctcaccagcaaagcaacgtcctgccgacaatgatcgctatgtcaggaactgccgcaatgggaggtcgccgaaggagaccaggtggtggtttcatgatgacaaagtgtgattggttccaacttccggttggcttctcctcagcaacccttttacccgccaccctacctttacatggcgtcctccatgggagatgatttaggcatatttttaagcgatctatttgaccgcaaattaacatgcctttgtggtttgtaaatgaatgtgaacctgtatcgaatcctagacttattaattactataccttggatatatagaataattacatgtgtatcttgcttattgc

SEQ ID NO: 2501 - DNA, 844 bp, Sorghum bicolor
acaccagccaacagaatacaacacagcggccgccctctgcctctgcccctgccgctgccgcgccgcacggcgcacagatacctttcctctcctctccccctcttccgcctccgctccgcagcaatcccggcgcggcatggcgagcccgtcttcctcctcgtcgtccccgtcccgcaaggccctgagcaagatcgcgtgcagccgcctgcagaaggagctcgcggagtggcaggtcagcccgcccgccggcttcaagcacagggtcaccgacaacctccagaggtgggtcatcgatgtagccggggcaccaggcacgctctacacgggcgagacctacaagctgcaggtggatttccccgagcattatcccatggaggcacctcaggttatatttctgcatccagcaccgatgcatccacacatttacagcaacggacacatatgtttagatatattgtatgactcgtggtccccagcgatgactgtcagttctatctgtatcagcatattatctatgctgtccagctcaccagcaaagcaacgcccagccgataatgatcgctatgtcaggaactgtcgcaatgggagatcaccgaaggagaccaggtggtggttccatgacgacactgtgtgatgggtttcctgattgtcctgtgactccgcatttagttgccagactacatgggagatgattaggcttatttcaaaccgacgcatttgaccagaaattaacatgctctcgtggtttgtaaatgaatgtgcatcagcgtcaggtcctgtacttgttgatccttacaccgtccgatggtatatagaataatgtttacatcgtgtcaatttacgg

SEQ ID NO: 2502 - DNA, 486 bp, Sorghum bicolor
atgacgagctcgtcctctccttcccgaaaggcgctgagcaagatcgcttgcaatcggctgcagaaggagctcgcggagtggcagctcaacccccccgccgggttcaagcacaaggtctccgataatcttcaaaggtgggtaattgaggttaccggagcggcgggcactctttacgccggcgagacctaccagttgcaggttgactttcctgagcattaccctatggaggcacctcaggtcatttttctcaatccagcgccaatgcatccacacatttacagcaatgggcacatctgcttagatattttgtatgactcgtggtcaccagcgatgaccgtgagctctgtctgcatcagtatcctgtctatgttgtccagttcgccagcaaagcaacgcccagcggacaatgaccgctatgttaggaactgccgcaacgggaggtctccgaaggagactagatggtggttccatgacgacacagtgtaa

SEQ ID NO: 2503 - DNA, 873 bp, Zea mays
gtttcgttccctctccttggccttcgtctccgccttccgacttcctctagaattcgattccctttcccaagaaaccaagaacccagccccccaccatgacgagctcctcctctccttccagaaaggcgctgagcaagatcgcttgcaatcggctgcagaaagagctcgccgagtggcagcaaaacccccccgccgggttcaagcacaaggtctccgataacctccaaaggtgggtaattgaggtcaccggagcggcgggcaccctttacgccggcgaggcttaccagttgcaggttgacttccctgagcattatcctatggaggcacctcaggtcatttttctcaatccagcgccaatgcatccacacatttacagcaacgggcacatctgcttagatattctgtatgactcgtggtcaccagcgatgaccgtgagctctgtctgtatcagtatcctgtctatgttgtctagttcgccagcaaagcaacgcccggcggacaatgaccgctatgttaggaactgccgcaacgggaggtcgccaaaggagactagatggtggttccatgacgacacggtgtaatgatctccgtggcattgcctgtcagccttctgtactgtgaactgtgatatatctcttcaagggggagatgagatgatttaggcctatttctaagcagccctctattggattgcgaagcttaccttgctgtggtggtatgtaaatgagttgctcacatgtgtcagtctgggaatatgtgttatcaccatcaatgatataatatatagaataaagcaagattgtaccctgcctgagtcactgaaacgagctcaaaagtaatgtgcaggtttgactatgaaaaaaaaaaaaaaaa

SEQ ID NO: 2504 - DNA, 1940 bp, Oryza sativa Japonica Group
cttctcctcccgccgcgccgcgccgccccgatacctcgcttcttctacaagcttccattcctcggtcggtgccggccgcttcgggcgcgcgtggaggtggttgctgctgctgctgctgctgggggcggcagaagctagtggcggtgggtgtgggatgcccgccgcgacgccgacccgctctcgcctcctcttccccgcgttgcggccgcggccggtggtggttaaagcggacgggggaagcctcgccgctgccggtgactgactggctgactgaccgactgcgccgccgcggtgcggtgggaccacgcgcgacgccatggacgccgcctcccgccccgccgtcgtcatcgacaacggcaccgggtacacgaagatggggttcgccgggaacgtggagccctgcttcatcacccccaccgtcgtcgccgtcaacgacaccttcgccggccagaccagggccaacaccaccaaggggaactggatggcgcagcacagcgccggcgtcatggccgatctcgacttcttcatcggggaggacgccctggcccgctcccgctccagcaacacctacaacctcagctatccaattcacaatggccaggttgagaattgggacaccatggagaggttctggcagcagtgcattttcaattacctgcggtgtgatccggaggatcactattttctgctcaccgagagccccctgactcctcccgagacccgcgagtacaccggggagatcatgtttgagactttcaatgtgcctggtctgtacatagcgtgccagccggttcttgccctcgcagcaggatacaccaccacaaagtgtgaaatgacaggtgttgtagtcgatgtgggtgatggggctacccacattgttcctgttgctgatggttatgttataggaagcagcatcagatcaattccaattacaggcaaggatgttacccagtttattcagcaactcttaaaggaaagaggtgagcacattccaccagaagaatcttttgatgtggcaaggagagtgaaagaaatgtactgctatacatgttcagatattgtgaaggaatttaataagcatgacagagagcccaataagtacataaagcactggagtggcatcaaaccaaaaactggtgccaaatacacctgcgacattggatatgaacgcttcctagggcctgagattttcttccaccctgagatttacaacaatgacttcaccactcctttgcatgtagttattgacaagtgcatccaatcatccccaattgacacaagaagggctctttataagaatattgtcttgtccgggggatcaactatgtttaaggatttccacaggaggctgcagcgggacctaaaaaagatagtggatgcacgagtccttgcatctaatgctcgacttggtggagatgcaaaggcccaacctatagaagtaaatgtagttagccatcctattcaaagatatgctgtctggtttggtggttctgtgcttgcctctaccgctgaattctacgaggcttgccacacaaaagcagagtatgaagagtatggcgcaagcatctgccggacgaatcctgttttcaaagggatgtactaaaccacggcgcaaagcttctgtagacatcaccagtggcacccccaacgcgatccagctgcactgcccagcatggtacaactgacgttggggaccgagggggatcctgcagtagcctcgctgttatgagttgtacaaatctagcaggcgcatagatagatccactctttcggtaatacattccacatgttcatcagtttttgctagcctagcagcaaaaacaatatgaccgaacggcatgggcaaaatatatgtttcatgctgctgtataatctttgttggtgacggtgtagcattacgacattgttttttttgttggtgatttggttttgatctttgt

SEQ ID NO: 2505 - DNA, 1964 bp, Zea mays
gcagaaagaccgcgacccaaagcaagctcaagccgctccgctcctccagtctccagtctccaccgcccgccaaccccgagatatacctcccttcctctcgaagcttcgtctgcagacgaagtcgccggctcttccctcggcgctggtgccggtgggttgcctgtggcggtgggtgggtggccgggtggtggtgttgctgggatgcccgccgcgacggcgaccgcagcccgcctccgcgtgccgctgccaaaagccgcccaccactcgccctgctcgagccggcgccaccccgactgccgccgccgctgacgagacgagcggccacacgcttggcgcgcgccatggatgccttgtcccgccctgctgtcgtcatcgacaacggcaccgggtacacgaagatggggttcgcggggaacgtggagccctgcttcatcacccccactgtcgtcgccgtcaacgattccttctccggctccgcccagccggcggtgaggggcacccccgccagggggaactggctcgctcagcacagcgccggcgtcatggctgacctcgacttctacatcggcgacgaagcgctggcccgatcccgcgccagcagctcgcatagtttgagctatcccatccgcaacggccaggtggagaattgggataccatggagaggttctggcaacagtgcatcttcaattacctccggtgcgacccagaagatcattattttcttctaactgagagccctctgactgcccccgagacccgggagtacaccggagagatcatgttcgagacgttcaatgtgcctggcctctatattgcagtccaacctgtccttgcgctggctgctgggtacactacaaccaagtgtgaaatgacaggtgttgtagttgatgtgggtgatggggctacccatatcgttccggttgctgatggttatgtcattgggagcagtatcagatctattccaattacaggcaaggatgttacccagtttattcatcaacttctaaaggaaagaggtgagaacattccagcagaagaatcttttgatgtagcaagaaggattaaagaaatgtactgctatacttcttcggacattgtgaaggaattcaataaacatgacaaggagccatcaaagtacattaaacactggacgggcaccaaaccgaagactggtgcaaaatacacatgtgacattggatatgagcgattcctagggcctgagatcttcttcaacccagagatatataacaacgacttcaccactcctttgcaagttgttattgacaagtgcatccaatcatctccaatcgacacaaggagggctctttataagaatattgtcctgtctggaggctcgactatgttcaaagatttccataggaggttacagcgggacctaaagaagatagtggatgcacgggtccgtgcatctaatagccggcttattagtggggatgctaaggcccagcctatagaagtgaacgtggtcagtcatccgatccagagatatgcggtatggtttggtggctctgtgcttgcttcaaccgccgaattctacgaggcttgccacacaaaggcagagtacgaggagtacggtgccagcatctgccgaacgaatcctgtcttcaaagggatgtactgactcagagcggttccctgtggctgacgtcgtggatgatatccactcaaagcttaaatggggagaagtgacagtggtcgtggagacaggactgtcgagagggatcctgatcgtggggaagcatagccgtacgagctgtacaaaagagaagcgcaaatagataggtttatgtttcaccatacaatttagatgctggtaggcctgacaggatgggtttgccacccctgctgaattgggtggcattgtaatttgtagcgtcaacacttctggcggtgcgagattgctccttgtatacatgttgattcggcagcgatgttttctctc

SEQ ID NO: 2506 - DNA, 1784 bp, Vitis vinifera
atggattcagccgcttctcgtcccgccgtggtcatcgacaacggcaccgggtatactaaaatgggttttgccggtaacgtggagccgtgcttcattgccccgacagttgttgctgtcaacgagtcgttcttgaatcaaaatcggagctccaccaaaggcaattggcttgcgcaacatagcgctggcgtgatggccgatcttgatttctttataggagatgaggctattgcgagatctcggaatagtagtacttacaatctaagctatccgattgttcacggtcaggttgataattgggatgccatggagagattttggcagcagtgtatatttaattatttgagatgtgatccggaggatcactactttcttttgacggaaagtccactcactgccccggagagccgtgaatacactggtgaaattatgtttgaaaccttcaacgttcctggtctttatattgcggtgcagccggtgctcgcccttgcggcaggatacactacatctaagtgtgagatgacaggggttgtagtggatgttggggatggggctactcatgttgtacctgttgcagatggttatgttattgggagcagcattaagtcaattcctattgctgggaaagatgttactctttttgtccaacagctcatgcgggaaagaggagagcatgtgccgcctgaagactcttttgaagtagctcgaaaagtgaaggaaatgtattgctatacatcttctgatatcgtcaaggagttcaataagcatgacaaagagcctgggaagtacataaagcattggaggggcatcaaaccgaagacaggagcaccatactcttgtgatgttggctatgaacgatttctaggccctgagattttcttcaatcctgagatctacagcagcgattttgcaacccctttaccagctgtaatagacaagtgtattcagtctgcaccaattgacacaagaagggctttgtataagaatatagttttatcaggaggatcaaccatgttcaaggacttccacagaaggttgcagcgtgatgtaaaaaaaattgtggatgctcgggttcttgcttctgattctcggcttgatggagaagtaaaatcacaaccagtggaagtcaatgtagtcagccatcctatccagaggtatgcggtttggtttggaggctctgtacttgcatcaacacccgaattttttgcggcttgtcatacaaaagctgagtatgaggaatacggggcaagcatatgccgaacaaatcctgtcttcaaggggatgtattgatgtgaagattcttttgggcataattttgagggcagttgctgacagaaatgattgaaggaatggcttgtcatttccttctccaatgtgcacctcaattcacatctggcttctgatattcactcagctttcatgtgcatttataggttagcttgtgacaggtggtgtaaaataggcttttggtctcgtctgtaagaaaatggatttcttgtattctttcattagggagttacaggttcttctctttgcagctaatgggactcttaccacttgtggtgctgaggagcccccagctaacagttcacaatcagataaaaagagtcattatttaggttgacattaactaagctgaattgcatttttagtgttcagcttagttggagattgataaaagccttttcttttgttggagtgattgttccattgatttatattttcaggtggtaggttcaatttatttggattgaagtcgaggagctatagaagaaacattttgaatt

SEQ ID NO: 2507 - DNA, 2003 bp, Zea mays
gctcagctcctccagtctccagtctccaccgcccgccaaccccgagatatacctcccttcttctcgaagcttcgtctgcagacgaagtcgccggctcttccctcggcgctggtgccggtgggttgccagtggcggtgggtgggtggccgggtggtggtgttgctgggatgcccgccgcgacggcgaccgcagcccgcctccgcgtgccgctgccaaaagccccccaccactcgccctgctcgagccggcgccaccccgactgccgccgccgctgacgaggcgagcagccacacgcttggcgcgcgccatggacgccttgtcccgccctgctgtcgtcatcgacaacggcaccgggtacacgaagatggggttcgcggggaacgtggagccctgcttcatcacccccactgtcgtcgccgtcaacgattccttctccggctccgcccagccggcggcgaggggcacccccgccagggggaactggctcgctcagcacagcgccggcgtcatggctgacctcgacttctacatcggcgacgaagcgctggcccgatcccgcgccagcagctcgcatagtttgagctatcccatccgcaacggccaggtggagaattgggataccatggagaggttctggcaacagtgcatcttcaattacctccggtgcgacccagaagatcattattttcttctaactgagagccctctgactgcccctgagacccgggagtacaccggagagatcatgttcgagacgttcaatgtgcctggcctctatattgcagtccaacctgtccttgcgctggctgctgggtacactacaaccaagtgtgaaatgacaggtgttgtagttgatgtgggtgatggggctacccatattgttccggttgctgatggttatgtcattgggagcagtatcagatctattccaattacaggcaaggatgttacccagtttattcatcaacttctaaaggaaagaggtgagaacattccagcagaagaatcttttgatgtagcaagaaggattaaagaaatgtactgctatacttcttcggacattgtgaaggaattcaataaacatgacaaggagccatcaaagtacattaaacactggacgggcactaaaccgaagactggtgcaaaatacacatgtgacattggatatgagcgattcctagggcctgagatcttcttcaacccagagatatataacaacgacttcaccactcctttgcaagttgttattgacaagtgcatccaatcatctccaatcgacacaaggagggctctttataaggttcttatgatccgagcatcattatttattctaaggcattacatcgagtctgaagaatttccaatggcacagaatattgtcctgtctggaggctcgactatgttcaaagatttccacaggaggttacagcgggacctaaagaagatagtggatgcacgggtccgtgcatctaatagccggcttattagtggggatgctaaggcccagcctatagaagtgaacgtggtcagtcatccgatccagagatatgcggtatggtttggtggctctgtgcttgcttcaactgccgaattctacgaggcttgccacacaaaggcagagtacgaggagtacggtgccagcatctgccgaacgaatcctgtcttcaaagggatgtactgactcagagcggttccctgtggctgacgtcgtggatgatatccactcaaagcttaaatggggagaagtgacagtggtcgtggagacaggactgtcgagagggatcctgatcgtggggaagcatagccgtacgagctgtacaaaagagaagcgcaaatagataggtttatgtttcaccatacaatttagatgctggtaggcctgacaggatgggtttgccacccctgctgaattgggtggcattgtaatttgtagcgtcaacacttctggcggtgcgagattgctccttgtatacatgttgattcggcaaaaaaaaaaaaaaaaa

SEQ ID NO: 2508 - DNA, 1909 bp, Zea mays
ccgagatatacctcccttcctctcgaagcttcgtctccagagtccagacgacgtcgccggctcttcactcggcgctggtgctggtggttgccagtggcggtggctgggtggccgggtggcggtgttgctgggatgcccgccgcgacggcgaccgccgcccgcctccgactgccgctgccaaaagcagcccaccgctcgccctgctcgagccggcgcctctccaattgccaccgccactgacgagcgaccacacgcttggcgcccgccatggacgccttgtcccgccccgctgttgtcatcgacaacggcaccgggtacacgaagatggggttcgcggggaacgtggagccctgcttcatcacccccactgtcgtcgccgtcaacgattccttttccggttcaggccagccggcggcgaggggcgcccctgccagggggaactggctcgctcagcacagtgccggcgtcatggctgacctcgacttctacatcggccaggaggcgctggcccgatcccgcgccagcagctcgcacagcttgagctatcccatccgcaacggccaggtggaaaattgggattctatggagaggttttggcaacagtgcatcttcaattacctccggtgcgacccagaagatcattattttcttctaactgagagccctctgactgcccctgagatccgggagtataccggggagatcatgttcgagacgttcaatgtgcccggcctctatattgctgtccaacctgtccttgctctagctgctgggtacactacaaccaagtgtgaaatgacaggtgttgtagttgatgtgggtgatggggctacccacatcgttccagttgctgatggttatgtcattgggagcagtatcagatctattccaattacaggcaaggatgttacccaatttattcatcaacttctaaaggaaagaggtgagaacattccaccagaagaatcttttgatgtagcaaggaggatcaaagaaatgtactgttatacttcttcagacgttgtgaaggaattcaataaacatgacagggaaccatcaaagtatgttaaacactggacgggcatcaaaccaaaaactggtgcgaaatacacatgtgacattggatacgagcggttcctggggcctgagatcttcttcaacccagagatgtataacaatgacttcaccactcccttgcaagttgttatcgacaggtgcatccaatcatccccaattgacacaaggagggctctttataagaatattgtcttgtctggaggctcgactatgtttaaagatttccataggaggttacagcgggacctcaaaaagatagtggatgcacgggtccgtgcatctaatagtcggcttcttagtggagatgctaagtttttcagtgacaacatcatatatgattttcaggcccagcctatagaagtgaatgtggtcagtcatcctattcagagatatgcggtatggtttggtggatctgtgcttgcttcaactgccgaattctacgaggcttgccgcacaaaagcagagtatgaagagtacggtgcgagcatctgccgatcgaaccctgttttcaaagggatgtactgactcagcctatcatagtcctgttctcaagggtatatatgtatttaaaccgagatctgttccctgtggctgacgtcgtgaatggcgtccactcaagcgtaaatggggagatctgacagcggaaacggactgccaagagggatcctggagaatcctagccgtaggagctgtacaaaagtaaagtgcaaatataggttcattttttatcatacaatttagatgctggtaggcctgacgggatgggtttgccacctctgctgaactgggtggcattgtaatttgtagcgtcaacattggtgcttgtataaac

SEQ ID NO: 2509 - DNA, 1287 bp, Populus trichocarpa
atggacgcttcctctcgtcctgccgtcgtcattgacaacggctcagggtatactaagatgggatttgcgggaaatgtagagccgtgttttattttaccatcagtagtagcagtaaacgaatcgtttttaaatcaatcgcgaacttcttcttcgaaagcaaattggctagcgcagcatagtgcaggggttatggccgatctagatttctttataggagacgaggcgcttgccaaatcgagatctagtaatacttataatcttagctatccaatcaaacatggtcaagttgctaactgggatgccatggaaaggtactggcagcagtgtatttttaattatttgcgttgcgatccagaggatcattactttttattgactgaaagcccgcttactgcaccggagagtcgtgagtataccggtgagattatgttcgagacctttaatgttcctgggctttatattgccgtcaattctgtgctcgctcttgcagctggttacacaacatccaagtgtgagatgacaggggttgttgtggatgctggagatggagctacttatgttgtacctgtcgcagatggttatgttattgggagcagcattaagtcaatccctattgctggcaaagatgttactctatttatccagcagctcatgcgggaaagaggagagaatgtacccccggaagattcatttgaagtagctcggaaagcgaaggaaatgcattgctatacttgttccgatattgtcaaggagttcaacaagcatgacaaggaaccggcaaagtatatcaagcaatggagaggtattaaaccaaaaacaggagcaccatattcctgtgacattggatatgaacgatttcttggtcctgaggtattctttaatcctgagatttatagcagtgactttaccactcctttaccagctgtgatagataagtgtattcagtctgcaccaattgacacaaggagggctttgtataagaatatagtgttatctggaggatcaaccatgttcaaagactttggtagaagattgcaacgggatttgaagaagattgtggatacacgtgttcttgcatctgaagctagacttggtgggggagtaaaatcacaaccagtggaagtgaatgtagtcagccatcctatccagagatttgcagtctggttcggcggttcagtgttagcatcaacacctgagttttttgctgcttgccatacaaaagcagaatatgaagaatatggagcaagcatatgccgcacaaatcctgttttcaagggcatgtattga

SEQ ID NO: 2510 - DNA, 1714 bp, Ricinus communis
ggaagagaagggagtcctttttgtttgctttgcgtttagcctcaattgccaagaaaagtatccaaatcgacgaacaacacagaaatcgattgatttatattttataggtatagaagaagacgaagacgaagacgaagaagaagaagaacagagtgttaagttttcggtgctatgaccttgaatttgatgatgaggagaccttgttttatgtcttattgttgttgaaatgggtagatttttgttatacgtattcaccaacttgaagctaccattaccgttgagtggctgctttcacttgcgatccaagtcttctttcattgctaattcacctccttttttgcgcttctctaagcgctcttctctaccatgaccttctcctttatacccactttctgctttgtcctccacaagcgtttcctcttccattcccatggaccccaccaatcgtcctgccgtcgtcatcgacaacggcactgggtatactaaaatgggtttcgcgggaaacgtagaaccttgttttattttaccaacagttgtagctgtaaacgaatcatttctaaatcaatctagaacaacttcaaaagcgaattggttatcacagcataacgctggtgttatggccgatctagatttctttattggagaagaggcgattactaaatcaagatctagtaatacttataaccttagttatccaattaaacacggccaggttgataattgggatgctatggaaaggtactggcagcaatgtatatttaattatttgaggtgtgatccagaggatcattattttcttttgactgagagcccacttactgcaccggagactcgtgaatacaccggtgagattatgtttgagacgtttaatgttcctgggctttatattgcggtcaactccgtgcttgctttagctgctgggtacacaacatccaagtgtgagatgacaggggttgtggtggatgttggagatggggcaactcatgttgtaccagttgctgatggttatgtcattgggagcagcattaaatcaatccctatagctggaaaagatgttactctctttatccagcagctcatgcgggaaagaggagagaatatcccgctggaagattcatttgatgtagctcgaaaagttaaggaaatgcactgctacacttgttctgacattgttaaggagttcaacaagcatgacaaagaacccggcaagtacattaagcattggagaggtattaaacccaaaacaggggcaccatactcttgtgatattggctatgaacgatttctaggccctgaggtcttttttaatcctgagatttatagcagcgacttcaccactcctttacctgctttgatagacaagtgcattcagtctgcaccaattgatacaaggagggctttgtacaagaatattgtgttgtctggaggttcaaccatgttcaaggactttggcagaaggttgcaacgggatttgaagaagattgtagatgcgcgggttcttgcatctgaagctagattaaatggcgaaattaaatcacaaccagtggaagtaaatgtagtcagccatcctattcaaagatttgctgtttggttcggtggttcagtacttgcatcaacacctgaattttttgcggcttgccatacaaaagcagaatatgaggaatatggagcaagtatttgccgcacaaatcctgttttcaagggaatgtattag

SEQ ID NO: 2511 - DNA, 1287 bp, Populus trichocarpa
atggaccccacatctcgtcctgccgtcgtcatcgactacggtaccgggtatactaagatgggttttgcgggaaatgtagagccgtgttttattttaccaacagcagtagcagtaaacgagtcgtttctaaatcaatctcgaacttcttcttcgaaagcgaattggcaagcgcagcacagtgcaggggttatggcggatctagatttttttataggagaggaggcgcttgccaaatcgagatctagtaatacttatagtcttagctatccaatcaaacatggtcaagttgataactgggacgccatggaaaggtactggcagcagtgtatatttaattatttgcgttgcgatccagaggatcattactttttattgactgaaagcccgcttactgcaccggagagtcgtgagtataccggtgagattatgttcgagacctttaatgttcctgggctttatattgccgtcaattctgtgcttgctcttgcagctggttacacgacatccaagtgtgagatgacaggggttgttgtggatgttggagatggtgctgctcatgttgtgcctgttgcagatggttatgttattgggagcagcatcaagtcaatccctattgctggcaaagatgttactctatttatccagcagctcatgcgggaaagaggagagaatgtacccccagaagattcatttgaagtagctcggaaagtgaaggaaacacattgctatacttgttccgatattgtcaaggagttcaacaagcatgacaaagaaccagcaaagtatattaagcactggagaggtattaaaccaaaaacaggggcaccatattcctgtgacattggatatgagcgatttcttggccctgaggtattctttaatcctgagatttatagcagtgactttaccactcctttaccagctgtgatagacaagtgtattcagtctgcaccaattgacacaaggagggctttgtataagaatatagtgttgtctggaggatcaaccatgttcaaggactttggtagaagattgcaaagggatttgaagaagattgtggatacacgtgttctcacatctgaagctagacttggcgggaaaataaaatcacaaccagtggaagtgaatgtagtcagtcatcctatccagagatttgcggtttggtttggtggttcagtactagcatcaacgcctgagttttttgcggcttgccatacaaaagcagaatatgaagaatatggagcaagcatatgccgtacaaatcctgttttcaagggcatgtattga

SEQ ID NO: 2512 - DNA, 1287 bp, Nicotiana tabacum
atggacccttctacctctcgcccagctgtagtcattgacaatggaaccgggtatacaaaaatgggttttgctggaaatgttgaaccatctttcatactgcctacagttgtcgctgttaacgaatcatttatcaatcagcctcgagctttgactaagagcagcaacttagctcagtacagtgcaggagttatggctgatcttgatttctttattggggaagaggcattgagtagatctaaatctagtagcacttacaatcttagctatcctattaaacatggacaggttgataactgggatgcaatggagcggttctggcagcagtgtgtattcaattatctgcgctgtgaccctgaggatcactattttctgttgactgaaagccctatgactgcaccagagaaccgagaatatactggtgaaattatgtttgagactttcaatgttccgggactttatatagctgtgcagccggttcttgctctggcagctgggtacacagcatctaagtgtgagatgactggagtcgtagtggatgttggagatggtgctacccatgttgtacctgttgctgaaggttatgttattgggagtagcattaagtcaatccctgttgctgggaaagatgttactcttttcattcaacagctcatgaaggaaaggggagagcatgttccagcagaggattccttagaagtagcacgaaaagtgaaggaaatgtattgctatacttgttctgacattgtgaaggagtctaataagcatgataaagagccagggaagtacatcaagcaatggagaggtacaaaaccaaagacaggagcaccatattcatgtgatgttggctatgagcgatttcttggtcctgaggttttcttcaatcctgagatctataatagtgattttacgacccctttacctgatgtgattgacaaatgtatccagtctgcaccaattgacacaagaagagctttatataagaatattgttctatccggaggatcaaccatgttcaaagacttccatagaagattgcagcgagatctcaagaagattgtggatgaccgtgttcctgcatcagatgctcggttaggtggaaatgtcaaagcacaaccagttgaagtgaatgttgtcagcaatcctatccagagatatgcagtttggtttggaggttctgtactagcttcaactccggaattttttgcggcttgccatacaaagacagaatacgaggaatatggagctagcatatgccgcacaaaccctgtattcaagggaatgtattga

SEQ ID NO: 2513 - DNA, 1915 bp, Arabidopsis thaliana
atcggaaaaatctcacacgataaagtaccagtcgacgacggcgactttctctatgatctgaccgtttcgctgaatctcacgtgaatctctgattttccgggaaaatcaattttctctcattgtctctctccctacattgtttctcatagcctacgagaaattacgtggtagcttgtcggaaactcaacttccgttgacggaaggcgcgagaaagaagcaagcttaggttcgatcggaaaattctagggttctctagtgtttaaacggtagagataatcgatctctaatcggatactgttttggatctccattcacaccctctggtgagctgattttgctttagagatcgccggcttagtttctctaatggatccgacttctcgacccgctattgtcatcgacaatggaactgggtatactaaaatgggatttgcgggtaatgtagagccatgttttatcttaccaacagtagttgcagtaaacgagtcgtttttgaatcaatccaagagttcttctaaggcaacttggcaaactcagcacaacgctggagttgctgcggatctcgatttctatattggagatgaagctcttgcgaaatcgcggtctagtagtactcataatcttcattatccaattgagcatggtcaagttgaggattgggatgctatggagagatattggcagcagtgtatatttaactatttgagatgtgatcctgaggatcattattttcttcttactgaaagtcctcttactcctcctgaaagtcgagaatatactggagaaattttgtttgagacttttaatgttcctgggctttacattgctgttaattcagttcttgcacttgctgctggctacacaacatcaaagtgtgagatgacaggggttgtagtagatgttggagatggggcaactcatgttgtacctgttgcagaaggttatgtcatcgggagctgtatcaaatcgattccaattgctggcaaagatgtcaccctctttatccagcaactcatgcgggaaagaggtgagaatataccaccagaagattcattcgatgtagcccgtaaagtgaaggaaatgtactgctacacttgttctgacatcgtaaaggagtttaataaacatgacaaagaaccagcaaagtatattaaacaatggaaaggtgtaaagccaaagactggtgcaccatacacttgcgacgtgggatatgaacgattccttggacccgaggtgttctttaatccagagatatacagcaatgacttcacaactactttaccagctgtgatagacaaatgtattcagtctgcaccaattgacacacgaagagctttatataagaatatagtgttgtccggaggttcaactatgttcaaagatttcggaagaaggttacaaagggacctcaagaagattgttgatgctcgtgttcttgctaataacgctcgtactggtggtgaaattacgtctcaaccggtggaggttaatgtcgtgagccatcctgtccagaggtttgcagtttggtttggaggctctgtgctttcatcaactcctgagtttttcgcgagttgcagaacgaaagaggagtatgaggaatatggagcaagcatatgccgcacgaatccggtgttcaagggaatgtattgaagctgcttcataaataattcaccagcagattctgtgaatgtttgtctgctttactccatttctattactgactttagggttcttgagtacacacagtgtaagctaggcttgatgtagaagtcatattattattcagacaaattaaagaaaaaaagtatgtagaagtttgatttttttttcatattattttctgttaactcaagcattaaattccacagaaaagttccggattatcaatcgtctaattgtcaagttatcatttttt

SEQ ID NO: 2514 - DNA, 1363 bp, Zea mays
tgattatctgctcgatcttgcacaggtagatttgagtagcttagtggacattgacttgcctgaagcggacgcggcggagctcgcgggtgccatcgccgaactcgcggatggtgatggacacgccgggctcgtcctgctccacccactccgtggcctccaggtcgctcgcgttgctcacggacacggacgcctcgtccagggacgacgtggtagcgcgcgacgggtcgaggtgcggagcggccggtgccggcgccggcgcggagttgagcaggttgaagtggtgcgcccacacgtggtccgacgggtccggcaccgcactggacgatgggttgcacgcggctcgggccgtggaagccgccgcggccgtggccctgcacgaggtggcgcgggcgatcggctgctccctgcccacggctgtcggcggcaggatcaccgggctgtccctcgtcgagccggcgcgggagtagaacgacgagtctctctgcatgccaacaaccgtttcagttgggtggcctgatccacgacgacagcacagaaacgtacgtgcgtgcggcatacgctgcaccggcgccggtggtcgagacggctacgcacctgcgtggcatcgtcgatggaggacgtcggcgtcgagacgccctgctgccggctgaacgtctgcacgttgtagagctccaccacgcggtcgtagttctctccccaccaccgctgcgcctcccacttgttgaacatgtcgcggctgcacgccagacacgttcgatgctccgttacgttagctgagcacgcgcgcacttgatgcagcagtcgcgcgcaaagctagctgttggcgatagataataagcacctgaagcggattcgctttatgtcgttgccagcgccgccggcggtggagacgaaggtgatctggacgccgggctccacctgggccgtccactcccgcggcacgcggtcctcttcaacgacgacaacctcttcatcctcctcatcgtcctcctccccgatgctcggtatccagctcgcgctcgggctcctgacgtgctgcgggaagccacggccgaccttggttcccgcggtggcgccggtcgcgtgcgtcgtcgtcctcatgtagccgtagccctcggtggccccgtccgacgtgaagcccgagtcgtcaatgacgcccgtgtacgcggccaggcggctgttgcggtggaagcggttgccccggaacgacgggctcgccgccgcggccttgtactgcctgccggagccggagaacttgagcaccatgtccttgagctagaaagcacatttgcggaaatgcttccttttgtcagatggtcgaaggtgcagaaatttatgacatggcacatggtatttttgcatg

SEQ ID NO: 2515 - DNA, 1779 bp, Rattus norvegicus
gcctgctggaaggggagctggccggtgggccatggccggctgcaggctctgggtttcgctgctgctggcggcggcgttggcttgcttggccacggcgctgtggccctggccccagtacatccaaacctcccaccggcgctacaccctgtaccccaacaacttccagttccggtaccatgccggttcggccgcgcaggcgggctgcgttgtcctcgacgaggcctttcgacgctaccgtagcctgctcttcggttccggctcttggccccgacccagcttctcaaaaaaacagcagccgttggggaagaacattctgatggtctctgtcgtcacagccgaatgtaatgagtttcctaatttggagtccgtagaaaattacaccctaaccattaatgatgaccagtgtttactctcctctgagactgtctggggcgctctgcgaggtctggagactttcagtcagcttgtttggaagtcagctgagggcacgttctttatcaacaagacaaagattacagactttcctcgattccctcaccggggcatactgctggatacatctcgccattacctgccgttatctagcatcctgaacacactggatgtcatggcgtacaataaattcaacgtgttccactggcacttggtggacgactcttccttcccatacgagagcttcaccttcccagagctcaccagaaaggggtccttcaaccctgttacccacatctacacagcacaggatgtgaaggaggtcattgaatatgcaaggcttcggggtatccgagtgctggccgaatttgacactcctggccacactttgtcctggggggcaggtgtccctggattattaacaccttgctactctgggtcccgtctctctggcacctatggacctgtgaaccccagcctcaacagcacctacgacttcatgagcacattcttcctggagatcagctctgtcttccctgacttttatctccacctgggaggagatgaagttgacttcacctgctggaagtccaaccccaacatccaggccttcatgaagaaaaagggctttactgactacaagcagctggagtcattctacatccagacgctgctggacatcgtctctgattatgacaagggctatgtggtgtggcaggaagtatttgataataaagtgaaggttcggccagacacaatcatacaggtgtggcgggaagagatgccggtccagtacatgaaggagatagaggccatcacccaggctggcttccgggccctgctgtctgctccctggtacctgaaccgggtgaagtatggccctgactggaaggaaatgtacaaagtggagcccctggcatttcgtggtacacctgcacaaaaggctctggtcattggaggggaagcctgtatgtggggagagtatgtggacagcacaaaccttgtccccaggctctggcccagagcaggtgccattgccgaaagactgtggagcagtaacctgacgactaatatggactttgcctttaaacgtctgtcccatttccgctgtgagctgctgaggagaggaatccaggcccagcccatcagcgtgggctactgtgagcaggagtttgagcatacttgagccagcagtactgagcacccaggaggccttaagagagcagttcccgggttaggcttccactgcctccctgcagggggagaaagcccctggcccatgtgctcctgtgactagagaggaggaggctggtgctggcactggtgttcaataaagatctatgtggc

SEQ ID NO: 2516 - DNA, 1865 bp, Mus musculus
agctgaccggggctcacgtgggctcagcctgctggaaggggagctggccggtgggccatggccggctgcaggctctgggtttcgctgctgctggcggcggcgttggcttgcttggccacggcactgtggccgtggccccagtacatccaaacctaccaccggcgctacaccctgtaccccaacaacttccagttccggtaccatgtcagttcggccgcgcaggcgggctgcgtcgtcctcgacgaggcctttcgacgctaccgtaacctgctcttcggttccggctcttggccccgacccagcttctcaaataaacagcaaacgttggggaagaacattctggtggtctccgtcgtcacagctgaatgtaatgaatttcctaatttggagtcggtagaaaattacaccctaaccattaatgatgaccagtgtttactcgcctctgagactgtctggggcgctctccgaggtctggagactttcagtcagcttgtttggaaatcagctgagggcacgttctttatcaacaagacaaagattaaagactttcctcgattccctcaccggggcgtactgctggatacatctcgccattacctgccattgtctagcatcctggatacactggatgtcatggcatacaataaattcaacgtgttccactggcacttggtggacgactcttccttcccatatgagagcttcactttcccagagctcaccagaaaggggtccttcaaccctgtcactcacatctacacagcacaggatgtgaaggaggtcattgaatacgcaaggcttcggggtatccgtgtgctggcagaatttgacactcctggccacactttgtcctgggggccaggtgcccctgggttattaacaccttgctactctgggtctcatctctctggcacatttggaccggtgaaccccagtctcaacagcacctatgacttcatgagcacactcttcctggagatcagctcagtcttcccggacttttatctccacctgggaggggatgaagtcgacttcacctgctggaagtccaaccccaacatccaggccttcatgaagaaaaagggctttactgacttcaagcagctggagtccttctacatccagacgctgctggacatcgtctctgattatgacaagggctatgtggtgtggcaggaggtatttgataataaagtgaaggttcggccagatacaatcatacaggtgtggcgggaagaaatgccagtagagtacatgttggagatgcaagatatcaccagggctggcttccgggccctgctgtctgctccctggtacctgaaccgtgtaaagtatggccctgactggaaggacatgtacaaagtggagcccctggcgtttcatggtacgcctgaacagaaggctctggtcattggaggggaggcctgtatgtggggagagtatgtggacagcaccaacctggtccccagactctggcccagagcgggtgccgtcgctgagagactgtggagcagtaacctgacaactaatatagactttgcctttaaacgtttgtcgcatttccgttgtgagctggtgaggagaggaatccaggcccagcccatcagtgtaggctactgtgagcaggagtttgagcagacttgagccaccagtgctgaacacccaggaggttgctgtcctttgagtcagctgcgctgagcacccaggagggtgctggccttaagagagcaggtcccggggcagggctaatctttcactgcctcccggccaggggagagcaccccttgcccgtgtgcccctgtgactacagagaaggaggctggtgctggcactggtgttcaataaagatctatgtggcattttct

SEQ ID NO: 2517 - DNA, 1824 bp, Mus musculus
gagctggccggtgggccatggccggctgcaggctctgggtttcgctgctgctggcggcggcgttggcttgcttggccacggcactgtggccgtggccccagtacatccaaacctaccaccggcgctacaccctgtaccccaacaacttccagttccggtaccatgtcagttcggccgcgcaggcgggctgcgtcgtcctcgacgaggcctttcgacgctaccgtaacctgctcttcggttccggctcttggccccgacccagcttctcaaataaacagcaaacgttggggaagaacattctggtggtctccgtcgtcacagctgaatgtaatgaatttcctaatttggagtcggtagaaaattacaccctaaccattaatgatgaccagtgtttactcgcctctgagactgtctggggcgctctccgaggtctggagactttcagtcagcttgtttggaaatcagctgagggcacgttctttatcaacaagacaaagattaaagactttcctcgattccctcaccggggcgtactgctggatacatctcgccattacctgccattgtctagcatcctggatacactggatgtcatggcatacaataaattcaacgtgttccactggcacttggtggacgactcttccttcccatatgagagcttcactttcccagagctcaccagaaaggggtccttcaaccctgtcactcacatctacacagcacaggatgtgaaggaggtcattgaatacgcaaggcttcggggtatccgtgtgctggcagaatttgacactcctggccacactttgtcctgggggccaggtgcccctgggttattaacaccttgctactctgggtctcatctctctggcacatttggaccggtgaaccccagtctcaacagcacctatgacttcatgagcacactcttcctggagatcagctcagtcttcccggacttttatctccacctgggaggggatgaagtcgacttcacctgctggaagtccaaccccaacatccaggccttcatgaagaaaaagggctttactgacttcaagcagctggagtccttctacatccagacgctgctggacatcgtctctgattatgacaagggctatgtggtgtggcaggaggtatttgataataaagtgaaggttcggccagatacaatcatacaggtgtggcgggaagaaatgccagtagagtacatgttggagatgcaagatatcaccagggctggcttccgggccctgctgtctgctccctggtacctgaaccgtgtaaagtatggccctgactggaaggacatgtacaaagtggagcccctggcgtttcatggtacgcctgaacagaaggctctggtcattggaggggaggcctgtatgtggggagagtatgtggacagcaccaacctggtccccagactctggcccagagcgggtgccgtcgctgagagactgtggagcagtaacctgacaactaatatagactttgcctttaaacgtttgtcgcatttccgttgtgagctggtgaggagaggaatccaggcccagcccatcagtgtaggctactgtgagcaggagtttgagcaggcttgagccaccagtgctgaacacccaggaggttgctgtcctttgagtcagctgcgctgagcacccaggagggtgctggccttaagagagcaggtcccggggcagggctaatctttcactgcctcccggccaggggagagcaccccttgcccgtgtgcccctgtgactacagagaaggaggctggtgctggcactggtgttcaataaagatctatgtggcattttc

SEQ ID NO: 2518 - DNA, 1838 bp, Mus musculus
ggctggaaggggagctggccggtgggccatggccggctgcaggctctgggtttcgctgctgctggcggcggcgttggcttgcttggccacggcactgtggccgtggccccagtacatccaaacctaccaccggcgctacaccctgtaccccaacaacttccagttccggtaccatgtcagttcggccgcgcaggcgggctgcgtcgtcctcgacgaggcctttcgacgctaccgtaacctgctcttcggttccggctcttggccccgacccagcttctcaaataaacagcaaacgttggggaagaacattctggtggtctccgtcgtcacagctgaatgtaatgaatttcctaatttggagtcggtagaaaattacaccctaaccattaatgatgaccagtgtttactcgcctctgagactgtctggggcgctctccgaggtctggagactttcagtcagcttgtttggaaatcagctgagggcacgttctttatcaacaagacaaagattaaagactttcctcgattccctcaccggggcgtactgctggatacatctcgccattacctgccattgtctagcatcctggatacactggatgtcatggcatacaataaattcaacgtgttccactggcacttggtggacgactcttccttcccatatgagagcttcactttcccagagctcaccagaaaggggtccttcaaccctgtcactcacatctacacagcacaggatgtgaaggaggtcattgaatacgcaaggcttcggggtatccgtgtgctggcagaatttgacactcctggccacactttgtcctgggggccaggtgcccctgggttattaacaccttgctactctgggtctcatctctctggcacatttggaccggtgaaccccagtctcaacagcacctatgacttcatgagcacactcttcctggagatcagctcagtcttcccggacttttatctccacctgggaggggatgaagtcgacttcacctgctggaagtccaaccccaacatccaggccttcatgaagaaaaagggctttactgacttcaagcagctggagtccttctacatccagacgctgctggacatcgtctctgattatgacaagggctatgtggtgtggcaggaggtatttgataataaagtgaaggttcggccagatacaatcatacaggtgtggcgggaagaaatgccagtagagtacatgttggagatgcaagatatcaccagggctggcttccgggccctgctgtctgctccctggtacctgaaccgtgtaaagtatggccctgactggaaggacatgtacaaagtggagcccctggcgtttcatggtacgcctgaacagaaggctctggtcattggaggggaggcctgtatgtggggagagtatgtggacagcaccaacctggtccccagactctggcccagagcgggtgccgtcgctgagagactgtggagcagtaacctgacaactaatatagactttgcctttaaacgtttgtcgcatttccgttgtgagctggtgaggagaggaatccaggcccagcccatcagagtaggctactgtgagcaggagtttgagcagacttgagccaccagtgctgaacacccaggaggttgctgtcctttgagtcagctgcgctgagcacccaggagggtgctggccttaagagagcaggtcccggggcagggctaatctttcactgcctcccggccaggggagagcaccccttgcccgtgtgcccctgtgactacagagaaggaggctggtgctggcactggtgttcaataaagatctatgtggcattttctct

SEQ ID NO: 2519 - DNA, 1842 bp, Mus musculus
ggcctgctggaaggggagctggccggtgggccatggccggctgcaggctctgggtttcgctgctgctggcggcggcgttggcttgcttggccacggcactgtggccgtggccccagtacatccaaacctaccaccggcgctacaccctgtaccccaacaacttccagttccggtaccatgtcagttcggccgcgcaggcgggctgcgtcgtcctcgacgaggcctttcgacgctaccgtaacctgctcttcggttccggctcttggccccgacccagcttctcaaataaacagcaaacgttggggaagaacattctggtggtctccgtcgtcacagctgaatgtaatgaatttcctaatttggagtcggtagaaaattacaccctaaccattaatgatgaccagtgtttactcgcctctgagactgtctggggcgctctccgaggtctggagactttcagtcagcttgtttggaaatcagctgagggcacgttctttatcaacaagacaaagattaaagactttcctcgattccctcaccggggcgtactgctggatacatctcgccattacctgccattgtctagcatcctggatacactggatgtcatggcatacaataaattcaacgtgttccactggcacttggtggacgactcttccttcccatatgagagcttcactttcccagagctcaccagaaaggggtccttcaaccctgtcactcacatctacacagcacaggatgtgaaggaggtcattgaatacgcaaggcttcggggtatccgtgtgctggcagaatttgacactcctggccacactttgtcctgggggccaggtgcccctgggttattaacaccttgctactctgggtctcatctctctggcacatttggaccggtgaaccccagtctcaacagcacctatgacttcatgagcacactcttcctggagatcagctcagtcttcccggacttttatctccacctgggaggggatgaagtcgacttcacctgctggaagtccaaccccaacatccaggccttcatgaagaaaaaaggctttactgacttcaagcagctggagtccttctacatccagacgctgctggacatcgtctctgattatgacaagggctatgtggtgtggcaggaggtatttgataataaagtgaaggttcggccagatacaatcatacaggtgtggcgggaagaaatgccagtagagtacatgttggagatgcaagatatcaccagggctggcttccgggccctgctgtctgctccctggtacctgaaccgtgtaaagtatggccctgactggaaggacatgtacaaagtggagcccctggcgtttcatggtacgcctgaacagaaggctctggtcattggaggggaggcctgtatgtggggagagtatgtggacagcaccaacctggtccccagactctggcccagagcgggtgccgtcgctgagagactgtggagcagtaacctgacaactaatatagactttgcctttaaacgtttgtcgcatttccgttgtgagctggtgaggagaggaatccaggcccagcccatcagtgtaggctactgtgagcaggagattgagcagacttgagccaccagtgctgaacacccaggaggttgctgtcctttgagtcagctgcgctgagcacccaggagggtgctggccttaagagagcaggtcccggggcagggctaatctttcactgcctcccggccaggggagagcaccccttgcccgtgtgcccctgtgactacagagaaggaggctggtgctggcactggtgttcaataaagatctatgtggcattttctct

SEQ ID NO: 2520 - DNA, 1840 bp, Mus musculus
gctgctggaaggggagctggccggtgggccatggccggctgcaggctctgggtttcgctgctgctggcggcggcgttggcttgcttggccacggcactgtggccgtggccccagtacatccaaacctaccaccggcgctacaccctgtaccccaacaacttccagttccggtaccatgtcagttcggccgcgcaggcgggctgcgtcgtcctcgacgaggcctttcgacgctaccgtaacctgctcttcggttccggctcttggccccgacccagcttctcaaataaacagcaaacgttggggaagaacattctggtggtctccgtcgtcacagctgaatgtaatgaatttcctaatttggagtcggtagaaaattacaccctaaccattaatgatgaccagtgtttactcgcctctgagactgtctggggcgctctccgaggtctggagactttcagtcagcttgtttggaaatcagctgagggcacgttctttatcaacaagacaaagattaaagactttcctcgattccctcaccggggcgtactgctggatacatctcgccattacctgccattgtctagcatcctggatacactggatgtcatggcatacaataaattcaacgtgttccactggcacttggtggacgactcttccttcccatatgagagcttcactttcccagagctcaccagaaaggggtccttcaaccctgtcactcacatctacacagcacaggatgtgaaggaggtcattgaatacgcaaggcttcggggtatccgtgtgctggcagaatttgacactcctggccacactttgtcctgggggccaggtgcccctgggttattaacaccttgctactctgggtctcatctctctggcacatttggaccggtgaaccccagtctcaacagcacctatgacttcatgagcacactcttcctggagatcagctcagtcttcccggacttttatctccacctgggaggggatgaagtcgacttcacctgctggaagtccaaccccaacatccaggccttcatgaagaaaaagggctttactgacttcaagcagctggagtccctctacatccagacgctgctggacatcgtctctgattatgacaagggctatgtggtgtggcaggaggtatttgataataaagtgaaggttcggccagatacaatcatacaggtgtggcgggaagaaatgccagtagagtacatgttggagatgcaagatatcaccagggctggcttccgggccctgctgtctgctccctggtacctgaaccgtgtaaagtatggccctgactggaaggacatgtacaaagtggagcccctggcgtttcatggtacgcctgaacagaaggctctggtcattggaggggaggcctgtatgtggggagagtatgtggacagcaccaacctggtccccagactctggcccagagcgggtgccgtcgctgagagactgtggagcagtaacctgacaactaatatagactttgcctttaaacgtttgtcgcatttccgttgtgagctggtgaggagaggaatccaggcccagcccatcagtgtaggctactgtgagcaggagtttgagcagacttgagccaccagtgctgaacacccaggaggttgctgtcctttgagtcagctgcgctgagcacccaggagggtgctggccttaagagagcaggtcccggggcagggctaatctttcactgcctcccggccaggggagagcaccccttgcccgtgtgcccctgtgactacagagaaggaggctggtgctggcactggtgttcaataaagatctatgtggcattttctct

SEQ ID NO: 2521 - DNA, 1839 bp, Mus musculus
gctgctggaaggggagctggccggtgggccatggccggctgcaggctctgggtttcgctgctgctggcggcggcgttggcttgcttggccacggcactgtggccgtggccccagtacatccaaacctaccaccggcgctacaccctgtaccccaacaacttccagttccggtaccatgtcagttcggccgcgcaggcgggctgcgtcgtcctcgacgaggcctttcgacgctaccgtaacctgctcttcggttccggctcttggccccgacccagcttctcaaataaacagcaaacgttggggaagaacattctggtggtctccgtcgtcacagctgaatgtaatgaatttcctaatttggagtcggtagaaaattacaccctaaccattaatgatgaccagtgtttactcgcctctgagactgtctggggcgctctccgaggtctggagactttcagtcagcttgtttggaaatcagctgagggcacgttctttatcaacaagacaaagattaaagactttcctcgattccctcaccggggcgtactgctggatacatctcgccattacctgccattgtctagcatcctggatacactggatgtcatggcatacaataaattcaacgtgttccactggcacttggtggacgactcttccttcccatatgagagcttcactttcccagagctcaccagaaaggggtccttcaaccctgtcactcacatctacacagcacaggatgtgaaggaggtcattgaatacgcaaggcttcggggtatccgtgtgctggcagaatttgacactcctggccacactttgtcctgggggccaggtgcccctgggttattaacaccttgctactctgggtctcatctctctggcacatttggaccggtgaaccccagtctcaacagcacctatgacttcatgagcacactcttcctggagatcagctcagtcttcccggacttttatctccacctgggaggggatgaagtcgacttcacctgctggaagtccaaccccaacatccaggccttcatgaagaaaaagggctttactgacttcaagcagctggagtccttctacatccagacgctgctggacatcgtctctgattatgacaagggctatgtggtgtggcaggaggtatttgataataaagtgaaggttcggccagatacaatcatacaggtgtggcgggaagaaatgccagtagagtacatgttggagatgcaagatatcaccagggctggcttccgggccctgctgtctgctccctggtacctgaaccgtgtaaagtatggccctgactggaaggacatgtacaaagtggagcccctggcgtttcatggtacgcctgaacagaaggctctggtcattggaggggaggcctgtatgtggggagagtatgtggacagcaccaacctggtccccagactctggcccagagcgggtgccgtcgctgagagactgtggagcagtaacctgacaactaatatagactttgcctttaaacgtttgtcgcatttccgttgtgagctggtgaggagaggaatccaggcccagcccatcagtgtaggctgctgtgagcaggagtttgagcagacttgagccaccagtgctgaacacccaggaggttgctgtcctttgagtcagctgcgctgagcacccaggagggtgctggccttaagagagcaggtcccggggcagggctaatctttcactgcctcccggccaggggagagcaccccttgcccgtgtgcccctgtgactacagagaaggaggctggtgctggcactggtgttcaataaagatctatgtggcattttctc

SEQ ID NO: 2522 - DNA, 1852 bp, Mus musculus
gacgtgggctcagcctgctggaaggggagctggccggtgggccatggccggctgcaggctctgggtttcgctgctgctggcggcggcgttggcttgcttggccacggcactgtggccgtggccccagtacatccaaacctaccaccggcgctacaccctgtaccccaacaacttccagttccggtaccatgtcagttcggccgcgcaggcgggcagcgtcgtcctcgacgaggcctttcgacgctaccgtaacctgctcttcggttccggctcttggccccgacccagcttctcaaataaacagcaaacgttggggaagaacattctggtggtctccgtcgtcacagctgaatgtaatgaatttcctaatttggagtcggtagaaaattacaccctaaccattaatgatgaccagtgtttactcgcctctgagactgtctggggcgctctccgaggtctggagactttcagtcagcttgtttggaaatcagctgagggcacgttctttatcaacaagacaaagattaaagactttcctcgattccctcaccggggcgtactgctggatacatctcgccattacctgccattgtctagcatcctggatacactggatgtcatggcatacaataaattcaacgtgttccactggcacttggtggacgactcttccttcccatatgagagcttcactttcccagagctcaccagaaaggggtccttcaaccctgtcactcacatctacacagcacaggatgtgaaggaggtcattgaatacgcaaggcttcggggtatccgtgtgctggcagaatttgacactcctggccacactttgtcctgggggccaggtgcccctgggttattaacaccttgctactctgggtctcatctctctggcacatttggaccggtgaaccccagtctcaacagcacctatgacttcatgagcacactcttcctggagatcagctcagtcttcccggacttttatctccacctgggaggggatgaagtcgacttcacctgctggaagtccaaccccaacatccaggccttcatgaagaaaaagggctttactgacttcaagcagctggagtccttctacatccagacgctgctggacatcgtctctgattatgacaagggctatgtggtgtggcaggaggtatttgataataaagtgaaggttcggccagatacaatcatacaggtgtggcgggaagaaatgccagtagagtacatgttggagatgcaagatatcaccagggctggcttccgggccctgctgtctgctccctggtacctgaaccgtgtaaagtatggccctgactggaaggacatgtacaaagtggagcccctggcgtttcatggtacgcctgaacagaaggctctggtcattggaggggaggcctgtatgtggggagagtatgtggacagcaccaacctggtccccagactctggcccagagcgggtgccgtcgctgagagactgtggagcagtaacctggcaactaatatagactttgcctttaaacgtttgtcgcatttccgttgtgagctggtgaggagaggaatccaggcccagcccatcagtgtaggctactgtgagcaggagtttgagcagacttgagccaccagtgctgaacacccaggaggttgctgtcctttgagtcagctgcgctgagcacccaggagggtgctggccttaagagagcaggtcccggggcagggctaatctttcactgcctcccggccaggggagagcaccccttgcccgtgtgcccctgtgactacagagaaggaggctggtgctggcactggtgttcaataaagatctatgtggcattttctc

SEQ ID NO: 2523 - DNA, 1858 bp, Mus musculus
gggtgaccggggctcacgtgggctcagcctgctggaaggggagctggccggtgggccatggccggctgcgggctctgggtttcgctgctgctggcggcggcgttggcttgcttggccacggcactgtggccgtggccccagtacatccaaacctaccaccggcgctacaccatgtacaccaacaacttccagttccggtaccatgtcagttcggccgcgcaggcgggctgcgtcgtcctcgacgaggcctttcgacgctaccgtaacctgctcttcggttccggctcttggccccgacccagcttctcaaataaacagcaaacgttggggaagaacattctggtggtctccgtcgtcacagccgaatgtaatgaatttcctaatttggagtcggtagaaaattacaccctaaccattaatgatgaccagtgtttactcgcctctgagactgtctggggcgctctccgaggtctggagactttcagtcagcttgtttggaaatcagctgagggcacgttctttatcaacaagacaaagattaaagactttcctcgattccctcaccggggcgtactgctggatacatctcgccattacctgccattgtctagcatcctggatacactggatgtcatggcatacaataaattcaacgtgttccactggcacttggtggacgactcttccttcccatatgagagcttcactttcccagagctcaccagaaaggggtccttcaaccctgtcactcacatctacacagcacaggatgtgaaggaggtcattgaatacgcaaggcttcggggtatccgtgtgctggcagaatttgacactcctggccacactttgtcctgggggccaggtgcccctgggttattaacaccttgctactctgggtctcatctctctggcacatttggaccggtgaaccccagtctcaacagcacctatgacttcatgagcacactcttcctggagatcagctcagtcttcccggacttttatctccacctgggaggggatgaagtcgacttcacctgctggaagtccaaccccaacatccaggccttcatgaagaaaaagggctttactgacttcaagcagctggagtccttctacatccagacgctgctggacatcgtctctgattatgacaagggctatgtggtgtggcaggaggtatttgataataaagtgaaggttcggccagatacaatcatacaggtgtggcgggaagaaatgccagtagagtacatgttggagatgcaagatatcaccagggctggcttccgggccctgctgtctgctccctggtacctgaaccgtgtaaagtatggccctgactggaaggacatgtacaaagtggagcccctggcgtttcatggtacgcctgaacagaaggctctggtcattggaggggaggcctgtatgtggggagagtatgtggacagcaccaacctggtccccagactctggcccagagcgggtgccgtcgctgagagactgtggagcagtaacctgacaactaatatagactttgcctttaaacgtttgtcgcatttccgttgtgagctggtgaggagaggaatccaggcccagcccatcagtgtaggctactgtgagcaggagtttgagcagacttgagccaccagtgctgaacacccaggaggttgctgtcctttgagtcagctgcgctgagcacccaggagggtgctggccttaagagagcaggtcccggggcagggctaatctttcactgcctcccggccaggggagagcaccccttgcccgtgtgcccctgtgactacagagaaggaggctggtgctggcactggtgttgaataaagatctatgtgcc

SEQ ID NO: 2524 - DNA, 2520 bp, Ricinus communis
ttctctataagcccaaaaccctttcttttctctttctcttatcttctttatagcagcctctctatctaaccacaaactctactaaatttaggttttttttaacaaattcactctctttttgagttgggtttttgttaaattaatctctgtcgtcaagttattgcttaaagtttcaatcgtgacactttaatttcttaaaaaaccctaaaaaaatggcatcatcaacagctcagattcatgttttaggtggaattgggtttccttcatcaaaatcaagaaaacccagtttttcttttccaaaaaagactgtatttttaggttctaatctaaagtctcatcaaacggcggcgtttttaagacaaagcaatactaatgcaaggagaaagtatggacctttgagagtagtgaatgagaaagttgtgggtattgatttgggtactactaattcagcagttgcagctatggaaggtgggaagccaacaatagtgacaaatgctgaagggcaaagaacgacaccgtctgttgtggcttatactaaaaatggcgataggcttgttggacagattgcaaagaggcaggctgttgtgaaccctgaaaatactttcttttctgtgaagaggtttattgggagaaagatgtctgaggttgatgaggagtctaaacaggtttcttatagagttgttcgagatgagaatggaaacgttaagttggattgtcctgctattggtaaacaatttgctgctgaggagatttcagctcaggttttaaggaagcttgtagatgatgcttcaaaatttttgaatgataaagtgactaaagctgtagttacagttcctgcttacttcaatgattctcaaaggacagcaacaaaggatgctggtcgaattgctggcttggaagttcttcgcataatcaatgagcctactgctgcttcattggcatatgggtttgaaaagaagaacaatgaaaccatcctagtctttgaccttggtggtggtacatttgatgtttcagtgcttgaagttggtgatggagtttttgaagtgctctctacttcaggagatacacatttgggtggtgatgactttgataagagaattgttgattggcttgctggtaactttaagagagatgaaggcattgatcttttgaaggacaaacaagcacttcagcgtttgactgagacggctgagaaagctaagatggagctgtcatctttgactcagactaatattagtttgcctttcatcactgctactgctgatggccccaagcacatcgagaccacaatcacaagagctaagtttgaggaattgtgttctgacctgcttgacaggcttaaaacaccagttgagaactctttgagagatgctaaactatcctttaaagatattgatgaagtgatacttgttggtggatcaactcgtataccagctgtacaggaacttgtaaagaaaatgactggaaaggacccaaatgtcactgtgaaccctgatgaagtggttgccctaggtgctgcagttcaggctggagtcttgtctggagatgttagtgatattgtgctgttggatgtcacaccgctgtcccttggtctggagactcttggtggggttatgacaaaaatcattcccagaaatactactctgcccacatccaaatcagaggtgttctcaactgctgcagatggacagacaagtgttgaaattaatgtccttcagggtgagagagagtttgttagagataataaatcccttggtagcttccgccttgatggtattcctccagcaccacgtggagttcctcaaattgaagttaaatttgacattgatgccaatggtattctctctgttactgccattgacaagggcactggaaagaagcaagacatcaccattactggtgctagcaccttacccagtgatgaggttgagaggatggtgagcgaagctgagaggtttgctaaggaggacaaggagaagagagatgccattgacacgaagaaccaggcagattctgttgtctaccagacagaaaagcagctgaaggagctgggagacaaggttccagcccctgtcaaagagaaggtagaggcaaaactgaaggagctcaaggatgcaattgagggtggatcaacccaagggatgaaagacgccatggctgccctgaaccaagaagtcatgcagcttggccagtcactgtacaatcaaccaggtgctgggggagctggtcccgcaccgggcggtgaagctggaccttcttctgactcatcaagcaagggacctgaaggagatgttattgatgcagatttcactgacagcaagtgagaaggcaagatgaatttttctaattttgtagccccttcctggtaatgtgtataagaaaattgattctgtctggatcaagggataatgacatttccagacatttttgctctctggggagtgagaaacaattatttctaggaatatatagaggaacaagcacctaatagcaacccataatagttaaaaccgtgggtgt

SEQ ID NO: 2525 - DNA, 2191 bp, Populus trichocarpa
atggcttcctcagctgcccagattcatggtcttggtgttggtggtgggattggtagcacatcttcaagaaaacccaccttttcttttgcaccaagatcagtgttttttggccaaaaccttagaaaaaccacagttacgttcttaaaacatacgaataacacttcaagaagaaggtatagtaccgggccggttaggatagtgaatgagaaagttgtagggattgatctgggaacaaccaattcggcggtggcggcgatggaaggagggaaacccacgatagttacaaacgcggaggggcagaggactaccccatctgttgtggcgtatacaaaaaatggggataggcttgtggggcagattgccaaaaggcaagcggtggtgaaccctgagaataccttcttttcggtgaagaggtttattgggaggaagatgagtgaagtagatgaagagtctaaacaggtttcgtataaggttgtgagggatgagaatggaaatgtaaaattggagtgtcctgctattgggaaacagtttgctgctgaagagatttcagctcaggttttgaggaaacttgtggatgatgcttcaaaattcttgaatgacaaagtgaccaaagcagttgttacagtgcctgcgtacttcaatgattcccaaaggacagccacaaaggatgctggtcgcattgctgggttggaagttcttcgaatcatcaatgaacctactgctgcatcgttagcatatggatttgaaaggaagagcaacgaaaccatcctagtatttgaccttggtggtggtacttttgatgtttcagtgcttgaggttggtgatggagtgtttgaagttctttctacttcaggagatacacatttggggggtgatgatttcgacaagagagttgttgattggcttgctggtagctttaaaagagacgaaggtattgatcttttgaaggataaacaagcacttcagcggctaactgagacagccgagaaagctaagatggagctgtcttctttgacccagacaaacatcagtttacctttcatcactgctactgcagatggccccaagcacattgagaccaccctgacaagggccaagttcgaggaattatgttctgatctgcttgacaggcttaaaactccagttgagaattccttgagggatgccaaactgtcctttaaggatctagatgaagtgatccttgttggtggatcaacacgtattccagctgtacaggagcttgtaaagaagttgactggaaaagaccccaatgtcactgtcaatccagatgaagttgttgcccttggtgctgcagttcaggctggtgtcttggctggagatgtcagtgacatcgtgctgctggatgtgtctccgttatctcttggtctggagactctaggaggggttatgacaaaaatcatcccaagaaacactactcttccaacctccaaatcagaggtgttctcaactgctgctgatggacagacaagtgtagaaattaatgttctccagggtgaaagagagtttgtgagggacaacaaatctcttggcagcttccgcctagatggtatcccaccagctccacgaggagttcctcaaatcgaagtgaaatttgatattgatgccaatggtattctctccgtcgctgctattgacaagggcacagggaagaagcaagacatcaccattactggtgctagcaccttacccagtgatgaggttgggaggatggtcagcgaagctgagaagtttgcaaaggaggacaaggagaagagagatgccattgacacaaagaaccaggccgattctgttgtctaccagaccgagaagcagcttaaagagctaggggagaaggttccagcccctgtcaaggagaaggttgaggcaaaactccaagagctcaaggatgcagttgcaggtggatcaactcaagggatgaaggatgccatggctgcccttaatcaagaagtcatgcaacttggccagtccctttacaatcagccaggtgcagcgcccggcgctggccctgcccctggcagtgaagctggaccctcagattcatcaaacaagggacctgacggggatgtcatcgatgcagatttcacagatagcaaatgagatggagaaactgttggctggtttttcccttctataccatgaaaatgtgtataagaaattgattttgtaggga

SEQ ID NO: 2526 - DNA, 2431 bp, Populus trichocarpa
ctctgcaaaccacacatatcaacacctccttagggttttgcctctccttctctttcaaccttttcggttcatttccaagagataatcagagtaaaatggcttcttcaactgcccagattcacgttcttggcggcggcggcggaattggtggaacatcttcgataaaacccaggttttcttttgcgccaagatcatcagtattctttggtcagaaccttagaggaaccacagctacttccttaaaacatacaaataatacttcaagaagaaggtatagtacaggccccgttagggtagtgaatgagaaagtagttgggattgatctggggaccaccaattcggcggtggcggcgatggaaggagggaaacccacgatagttacaaacgcggaggggcagaggactacgccatcggttgtggcgtatacaaaaaatggggataggctcgtggggcagattgcaaaaaggcaggcggtggtgaacccggaaaacaccttcttttcggtgaagaggtttattgggaggaagatgagtgaagtagatgaggagtctaaacaagtttcgtatagggttgtgagggatgagaatggaaatgtgaaattggagtgtcctgctattgggaaacagtttgctgctgaggagatttcagctcaggttttgagaaagcttgtggatgatgcttcaaagtttttgaatgacaaagtgaccaaagcagttgttaccgtgcctgcttacttcaacgattcccaaaggacagcaacaaaggatgctggccgcattgctggcctggaggttcttcgaatcatcaatgaaccgactgctgcatcattagcatatggatttgaaaggaagaacaatgaaaccattctagtatttgaccttggtggtggtacttttgatgtttcagtgctggaggttggtgatggagtcttcgaagtgctttctacttcaggagatacacatttgggtggtgatgattttgacaagagagttgttgattggcttgctggtgactttaagagagatgaaggtattgatctcttgaaagataaacaagcacttcagcggctaactgagacagctgagaaagctaagatggagctgtcttctttgactcagacaaacatcagtttgcctttcatcactgctactgcagatggccccaagcacattgagaccaccctgacaagggccaagtttgaggagttatgctctgatctgcttgacaggcttaaaaccccagttgagaactccttgagggatgccaaactgtcctttaaggatctagatgaagtgatccttgtcggtggatcaacacgaattccagctgtacaggggcttgtaaagaagttgaccgggaaggaccccaatgtcactgtcaatccagatgaagttgttgccctaggtgctgcagttcaggctggtgtcttgtctggagatgtcagtgacattgtgctgctggatgtgactccattatctattggtctggaaactctaggaggtgttatgacaaaaatcatcccaagaaacaccactcttccaacctccaagtcagaggtgttctcaactgctgctgatggacagactagtgtagaaatcaatgttctccagggtgaaagagagtttgtgagggacaacaaatctcttggcagcttccgcctggatggtatcccaccagctccgagaggggttcctcagattgaagtgaagttcgacattgatgccaatggtattctctccgtcactgccatcgacaaaggcacagggaagaagcaagacatcaccattactggtgctagcaccttacctagtgatgaggttgagaggatggtcagcgaagctgataagtttgcaaaggaagacaaggagaagagagatgccattgacacaaagaaccaggcagattctgttgtctaccagactgagaagcagcttaaggagctaggggagaaggttccagcccctgtcaaagagaaggttgaggcaaagctccaagagctcaaggatgcaattgcaggtggatcaactcaagtgatgaaagatgccatgactgccctcaatcaagaagtcatgcaacttggccaatccctttacaaccaaccaggtgcagcgcccggtgccggccctgcccctggcggtgaagctggacccacagattcatcaagcaagggacctgatggagatgtcattgatgcagatttcacagacagcaaatgagatggcagaactgtttgctgtgttttttccccttctatgtcattgaaatgtgtataataaattttgtggggattgggtctggtgcaaaggcagtcaagtttccagacatttttgctacatcgaactgagaacagattgtttctagtagtatagaggattaaacaccaacagcaatattttactagccagaaatttttgggtgcatagaccctgca

SEQ ID NO: 2527 - DNA, 2584 bp, Vitis vinifera
ttcgttcctgaattctaggtttagggtttttctctcaaactctcacacctctgggaccctaaatttctagggttggggtcagggcttttgtgttcagtcttcggattcgaatcgttaaaccctaggaaaatggcttcatcgacggctcagattcacggtcttggaactactgggttcgcctcatcgtcagcgaagccaaagcgtacatcatctagaacggtgttctttgggcagagattgagccctagtacagcgtcttttggtctaccgaagaccgcgttcttgaagctcaaaaggaactcgagacgagactactcgacgggacctgttcgtgtggtaaatgagaaagtggtgggaatcgatcttggcaccacgaactcggcggtggcggctatggagggagggaagccgacgatagtgacgaatgccgaggggcagcgaacaacgccgtcggtggtggcttacaccaagaacggcgataggcttgttggtcagattgctaaaaggcaggccgtggttaatcccgagaacaccttcttctccgtgaagcgattcattgggaggaagatgtcggaggtcgatgaagaatccaagcaggtgtcgtatcgggtggtaagagatgaaaatgggaatgtcaaactcgagtgcccagcgatcgggaagcagttcgcggccgaagaaatttcggcccaggtactaagaaagcttgttgatgatgcctcgaagtttctgaatgataaagtcacaaaagctgtggtcacagtgcctgcttacttcaatgactcccagaggacagcaacaaaggatgctggtcgcattgctggattagaagttcttaggatcatcaatgaacctactgctgcttcactggcatatgggtttgaaaagaaaaacaatgaaaccattctggtatttgaccttgggggtggtacttttgatgtctcagttctcgaggttggcgacggagtgtttgaggtgctttccacttcaggagatacacatttgggtggtgacgactttgacaagagagttgtggattggttggctgcaagttttaagaaagatgagggtatagatcttctcaaggacaaacaagctcttcagcgtctaacagagacagctgagaaggcaaaaatggagctatcatccttgacacagacaaatattagcttgccgttcattactgccactgcagatggacccaaacacatcgagactacccttacaagggccaaatttgaggaattatgttctgacttacttgataggcttaaaacaccagttgaaaattctttgagggatgcaaaactgtccttcaaagatcttgatgaggtgatccttgttggtggatcaacacgtatccctgctgttcaggagcttgtaaagaaaatgacaggaaaggaccccaatgtcacagtcaatccggatgaagtcgtcgccctaggggctgctgtgcaggctggtgttttgtctggagatgtcagtgacattgtgctcttggatgtgtctccattgtctctgggtctagagacattgggtggtgtaatgacaaaaatcatcccaagaaacacaacattgcccacctccaaatcagaggtgttctcaacagcagcagatggacagactagtgttgagatcaatgtacttcaaggtgagagagagtttgtaagagacaataagtctctaggcagcttccgactggatggtatccctcctgcaccgcggggagttcctcagattgaagtcaaatttgacattgatgccaacggcattctttctgtcactgctattgacaaaggcacagggaagaaacaagacatcaccattacaggtgctagcaccttgcccactgatgaggtggagaggatggttagcgaagcagagaggtttgcaaaggaggacaaggagaagagagatgccatagatacaaagaatcaagctgattctgtggtctaccagacagaaaaacagctgaaggagctgggagataaggttcctgcccaagttaaagagaaggttgaggcaaaacttggggagctgaaggatgcaatctcaggagggtcgacccaggtcatgaaggatgccatggctgccctgaaccaggaagttatgcagctgggtcagtccctttataaccagccaggtgctcctggtgccggacctgcacctggaagtgaggctgggccatcagagtcatcaggaaagggaccggatggtgatgtgattgatgcagatttcactgacagcaagtgagttataaagggaaagcaaaattgttattgatctcacaaactttttttttccttttttattggaaatgtgcataagaaatgatttatcggggactcgatttagtgttggggctacatttcctgtcatttttgttctgtgggttatgagaaagttattttattagaaaaagagaggattaaactgtcttaaagatgcccacgatagtgaaatatttgggtggtcaacccgtgcgctctgtttgaaccataatgctagaatgattgaatggggtttcccatgagaatatgcattttcatttttccatctatggttgattatgtgttcttttttt

SEQ ID NO: 2528 - DNA, 2437 bp, Ipomoea nil
ggccagggttagggtttttctcttttcccctcaacccccatatctctacctctcttctctctctctacggagtaacaccactacagtgctctgcctatacagattgatggcgtcgtctacagctcaaattcacgctcttggagctacgcatttctcaactaaaccgtcctccttgagtaagaagccgccaggtacggtgttttttgggcagagattaaacaaggcacctttcggaatcaatctgaagaagagcgcctgcaatcggagaaatgcgccgtttcgggtcgtggctgagaaagtggtcgggattgacctcgggacgactaactctgccgtcgcggccatggaaggagggaagccgaccattgtgacgaatgccgagggacagaggactactccctcggtggtggcgtacaccaagaatggggataggctcgttggacagattgcgaagcgccaggcggtggttaatccggagaacactttcttctctgtcaagaggtttattgggaggaagatggctgaagtcgatgaggagtctaagcaggtttcctacaatgttattagagatgaaaatggaaacgtcaagctcgactgtcctgcaattggaaagcaatttgctgctgaagaaatctctgctcaggtcttgagaaagcttgtggatgatgcatcaaagtttttgaatgacaaagttaccaaggctgttgttacagttcctgcatactttaatgattctcaaagaacagcaactaaggatgctggccggattgctggtttagaggttctacgtattataaatgaacctactgctgcttcactggcctatggatttgaaaagaaaaacaatgaaacaatattggtgtttgatcttggaggtggaacctttgatgtatcagttcttgaggttggtgatggtgtatttgaggtgttgtctacttctggagatacccatcttggtggtgatgattttgataagagaattgtcgattggcttgcttcaagtttcaagaaggatgaaggcatagatcttctcaaggacaaacaagctcttcagcgtctgactgagacagctgagaaagctaagatggagctgtcatcattaacacagactaacatcagcttgcccttcattactgctacatcagatggtcctaagcatattgaaaccactattactcgagctaagttcgaggagctgtgctcagacttgcttgacaggctgaaaacaccagttcaaaattccttgagagatgcaaagctctcatttagtgatattgatgaagtgatccttgttgggggctcaactcggattcctgctgttcaggaattagtcaagaaactgactggaaaggaccctaatgtcactgttaaccctgatgaagttgttgcacttggggctgcagttcaggctggtgttttgtctggagatgtaagtgatattgttctcttggatgtgactccattatccattggtttggaaactctgggtggtgtcatgacaaagatcatccccagaaatacgaccctgcctacatccaaatcagaggtattttcaacagctgctgatggtcagacaagtgtagaaattaatgtcctccaaggtgagagagaatttgtgagggacaacaagtctctaggtagcttccgtctcgatggaattcctcccgctcctcgaggtgttcctcaaattgaggtcaaatttgacattgatgcaaatggtattctctctgttactgctgttgacaagggcactgggaagaagcaggacatcaccattacaggagccagcacattacccagcgatgaggtagagaggatggttagtgaggctgaaagatttgcccaggaggacaaggagaagagagatgcgatagacacaaagaaccaggcagactctgttgtttaccagacggagaagcagctgaaggaactcggagagaaagtaccaggccccgtgaaagagaaagtcgaggctaagcttggagaacttagagatgcaatctcgggagggtcaactcaagccatgaaggatgcaatggccgcacttaaccaggaagtcatgcagctgggtcagtcactctacaatcagcccagtgcatcacctggcgctggtccaacacccggtggtgggtcagcagggccatcagaatcatcagggaagggacccgatggagatgtcattgatgccgatttcactgacagcaagtaagactccccccacccaccccaaggtaaattttgagccattcctcttttcaacttccctcatctagtgcatgcatacaaggagatgaagcttctaattttcatgcaacaaccttctctagtcaaggtttgagaaagtttgagcataatcgggagctagaagtgaggtgaaaaacatggagagcttttgatatagaattcaataattgttttcgatgagtgaatggagcga

SEQ ID NO: 2529 - DNA, 4056 bp, Cucumis sativus
tcaatttcccagcgacttcttcctttttcattcttaattcaatccatttctcttctctttccctcctttctctgcaatttcttccttaatgggtgcatctaccgctcagatccatggcctcggagctccttcctttgctgcggcctccatgcgcaaatctaacaacgtttcttcacgctctgtcttcttcggccagaaactcggcaactcttctgcttttcctgccgccgcttttttgaatttgagaagtaatactagccgtaggaattccagtgtcaggccattgaggattgttaacgagaaagttgtgggaattgatcttggaactactaactctgctgttgccgccatggaaggtgggaagcccactattgtaactaatgctgaaggacagagaacgacgccatcggtggtggcttacacgaaaaatggagataggcttgtgggtcaaattgccaaacggcaggcagttgtaaatcccgagaatactttcttttcggtgaagaggttcattggtagaaagatgtcggaggtggatgaggagtctaagcaggtctcctaccgagtagtacgcgatgagaatggaaatgtgaagctggaatgtcccgcgattggaaaacaatttgccgctgaagaaatttcagctcaggtatgacttaattcttcttcttatcttcgtacattcatgttggtttctgacggtgtggttgagtttaatagtgaaatgaagatattatcatttgaaactgcttaagatgactgtagaatactggatttggttattgaatttaacttcatagatggattatatggaaggcactccgttactcaagcatgctgattgctgacgttactttctttttgtttcgtttggcgtttgttcaggtcttaaggaagctagtggatgatgcttcgaagtttttgaatgataaagtaacgaaggctgtggtgacagtgcctgcctactttaatgattctcaaagaacggccacgaaggatgctggtcgtattgctggtcttgaagttttgcgtattatcaatgaacccactgccgcttcattagcttatggatttgagaagaagagcaatgaaacgatcttggtgtttgatcttggtggtggtacttttgatgtttcaggtatatacctgctgccaagactttatggcttcctgttcatttccatatcctatcccactttctattacataaggcacagcaataattctggaatttctttgtttatagtgcttgaagtgggcgatggagtgtttgaagtgctttctacatcaggggatacacatttgggtggtgatgacttcgacaaggtttgattgctgttggactaatagattgctaaacatctcttcttcatcattatctggttgaaaaatttgaacctctttgtgtaatctgcagagaattgttgactggcttgctgcaaatttcaaaagggatgaaggcattgatttgttgaaagacaagcaggcccttcagcggctaactgagacagctgagaaagccaaaatggagctgtcatctttgacccaggccaacattaggtatataacatgccatatatcctagttgtccattgttgacctgaattctgctgttctctgtttatttaatttaattttgatattacacattggtaatgggagtcctttttcagtttgcctttcatcactgccacggcagatggccccaagcacattgagaccacaattacaagggccaagtttgaggaattgtgttcagatcttcttgataggtacctaccgtcactacattttatcatttatttagttttaattgtaaagcattgacaaagtcactgagggataactttttattttttttatttttcatagttttagataaaggaataaagtggcacaggcgtctaattatatcttattttgttttaattgactaattaggctgaagactccagttgaaaactccttaagggatgcaaaactctccttcaaggatattgatgaggtgattcttgtcggtggatcaacccgtattcctgccgttcaggaactcgtcaagaagatgactgggaaggaaccaaatgtgactgtcaatcctgatgaagttgttgcattaggtgctgctgttcaggtaggtctggggatatccctatctgtccgtcattgtgaatatccttctaggttaatttcactttcttgccatacatttctttgtagatatgtacgggcacgggcatgtttggaagataaattcactgttgtcatattcaaaataactggagaatatgtatctaatcaatctaatcaatcaaatcaatttaatgatttgttttacacttttaaacactatttccataaactaattgattttgaaatattaagcacatgtcttatagagattttaaatatgacaagtaattttaaacattccaaaatcattactaagcatactatttgtcaaaatactgggaagatcatatttaatatattattytctgctgtttagcccaagaaatataattacagagtctgttaattactgaaatgaacgagtaattattatttttttctttaaataaccaggtatataatttaacagtagtagcattatctattattttaatttttcatttggataatagaagaaccctgttacttcttcttggcacatgaatccttttccaagtttaaataatgaatgtggagtataattttaacctacacacaccacacataatataacaattttgtttcgaaattgaggtagtaattttcggttagtaagtatggggatattagtttaaaataaagttgtgctgtaggtggtcgacatttatttatgtaggataaacattggattattgttgattgaatataactttttacttgtaggctggtgttttggctggagacgttagtgacattgtgctattggatgtgagtccgctatctttgggtcttgagactcttggtggtgtaatgaccaaaattatccccagaaacactacacttcctacctcaaagtccgaggtcttctcgacagctgctgatggtcagacaagtgtcgagattaatgttcttcaaggagaacgagaatttgtgagggacaacaaatcacttggtagcttccgactagacggcattccccctgcaccacgtggggtgcctcagattgaagtcaaattcgatatcgatgccaatggaatcctctcggttactgcaattgacaaaggcacaggcaagaagcaagatatcaccattactggtgctagcacattgcctagtgatgaggtacggtttgtgaaaccatgaagtaaaattaattgattgacttgttaaggaacattgaaaaaattgtattgccccacaggtggagcggatggttagcgaagctgataagtttgccaaggaggacaaggagaagagagatgccatcgatacgaagaaccaggctgattctgttgtgtatcagacagagaagcaactgaaggagcttggagacaaagtgcctgggccagtgaaggagaaggtggaatcaaaacttggggaattgaaggaggcaatttcaggtggctcaaccgaggccattaaggaagcaatggctgctctaaatcaagaggtgatgcaactgggacaatccttgtacaatcagcctggtgctggtgctgctcctggaccgggtgctagcagcgaatcagggccatcggaatcaacaggcaaaggacccgaaggagatgtcattgatgccgattttagtgacagcaaatgaaaagattaaaatttgttttcccccctattctgaatagaaaattttgctctcaacgggctcggatttgtattccgatttgatttttctggggcaggattggattggggtgttggtttgagaaaattgttggtagccactgtcccattgatattagcttttataaaataggtgatctctataagagtaaaatgctttacatggacactataagtagaatttgaggcggcagctgtaacttccaaaatttttccatacggttgtgtttcatgtttactgctactactgca

SEQ ID NO: 2530 - DNA, 2870 bp, Medicago truncatula
cttcctcaagtgctgcccaaatacatggtctaggtttctccccactccgaaaaccttcttcttccacttccaattcttcttcctattccaaaacccttttcttcggtcaccgtctcaattctaatcacgccaccttccctcgcgccgcattccccaaattatccaccaataggaagcctttcaccttccgtgtcgtcaatgagaaagtcgtcggtatcgatttgggtactaccaattccgccgtcgccgccatggaaggtggcaaacctaccatcatcaccaacgccgaaggtcagcgtaccactccctctgtcgttgcttacaccaagaacggtgatagactcgtcggtcagattgccaagcgtcaggccgtcgttaatcccgagaacaccttcttctctgtgaagagattcattggtaggaagatgtctgaggttgacgaagagtctaagcaagtctcttacagagtcattagagacgataacggcaacgtcaaactcgattgtccagctattggaaaatcatttgctgctgaagaaatttctgctcaggtactttttcaattactcaattattattctatgttcttaggttaattaattaatcaagtatctcatataatataatataatataggtgttgaggaagcttgtagatgatgcttcaaagtttttgaatgataaagtaactaaggctgtagtcactgtacctgcatacttcaatgattcacaaaggactgctaccaaggatgcaggcaggattgctggtcttgaagttcttcgaattatcaatgaaccaactgctgcatccttggcttatggtttcgaaaggaaaaacaatgaaaccattttggtctttgaccttggaggtggtacttttgatgtctcagtgcttgaggttggtgatggagtctttgaagtgctctctacttctggtgatacacacttgggtggtgatgattttgataaggttccacctattcttccttactctctagcactattaattatatggtgattgatgaacatatatctttacgactgtttcttattttcatatgttgactatagagagttgttgattggttggctggagacttcaagagagacgaaggtatagaccttttgaaggacaaacaagctcttcagcgtcttaccgagacagctgagaaagctaaaatggagctttcatccctcactcaaacaaatatcaggtatttgctttctcatggaccaatctttaaccaattctgatagtttacgagtttgcctttcaagctttgtacaaattactaagctattaatacacatgttttcagtttgccgttcataactgccacagcagatggccccaaacatattgagaccactcttacaagggctaaatttgaggaattatgttcagatcttcttgacaggtaaaatcataatttactgaaattttttgttaccctctaattttgaactgctctgcccctgatattgaacgtcacaaactgattttgttgcttccttgaagctttattgcaaaagctgaataaactagtaatgcttgtattgtgtttcagactcaggacaccagtggaaaattcattgagggatgcaaaactctcaatcaaggatattgatgaggtgattcttgttggtggatcaacacgtatccctgctgttcaggagcttgtaaagaagatgactggaaaagatccaaatgtcactgtcaatccagatgaagtggttgcccttggggctgcagttcaggtcggtttaactgttctcatcaaggaataaattgattttttttaatttttttttcttctaattttgacaagttacactgaagtgggagagaatgatgtttctttgggtactatattatatttgttgattattattatcagtatcctcatgtgtattttttgattgatttaggctggtgtcttggctggagatgtcagcgacattgtgctgttagatgtttctccattgtccttgggtttggaaactctaggtggggtgatgacaaaaattattcccagaaacactacccttcccacctcaaaatcagaggttttctctaccgctgctgatggacaaaccagtgtagaaattaatgtccttcagggtgagagagaatttgttagggacaataaatctcttggtagcttccgcttggacggtattcctcctgctccccgtggggttccgcagattgaagtgaagttcgacattgatgcaaatggcattctgtcagttgctgccatagacaagggcacagggaagaaacaagatattaccattactggtgccagcaccttgcctggtgatgaggtatatcttccaatcattcatttgtataaattgtttgtaatccttatctgcttgctacttctggaggattttttttgttactccagcattgatgtgggaagctgttccggtgtttataattatctcttggatgatgtacaggttgagaggatggtcaatgaggctgagagattttcaaaggaggacaaggagaagagggatgcaatagacacaaagaatcaggcggactctgttgtctaccagactgaaaagcaattgaaagagctaggagaaaaggtacctggccctgtgaaagaaaaggttgaagcaaagttggtagagcttaaagatgctatttctggtggttcaacccaaactatgaaagatgccatggctgccctcaatcaggaagttatgcagcttggacagtctctatataaccaacccggagctgcagatgcagcaggacctacaccacctggtagcgagtctggccccacagactcatcatcaggcaagggagcagatggagatgtgattgatgctgattttactgactctaaa

SEQ ID NO: 2531 - DNA, 2511 bp, Cucumis sativus
aactcttctctctcaatttcccagcgacttcttcctttttcattcttaattcaatccatttctcttctctttccctcctttctctgcaatttcttccttaatgggtgcatctaccgctcagatccatggcctcggagctccttcctttgctgcggcctccatgcgcaaatctaacaacgtttcttcacgctctgtcttcttcggccagaaactcggcaactcttctgcttttcctgccgccgcttttttgaatttgagaagtaatactagccgtaggaattccagtgtcaggccattgaggattgttaacgagaaagttgtgggaattgatcttggaactactaactctgctgttgccgccatggaaggtgggaagcccactattgtaactaatgctgaaggacagagaacgacgccatcggtggtggcttacacgaaaaatggagataggcttgtgggtcaaattgccaaacggcaggcagttgtaaatcccgagaatactttcttttcggtgaagaggttcattggtagaaagatgtcggaggtggatgaggagtctaagcaggtctcctaccgagtagagcgcgatgagaatggaaatgtgaagctggaatgtcccgcgattggaaaacaatttgccgctgaagaaatttcagctcaggtcttaaggaagctagtggatgatgcttcgaagtttttgaatgataaagtaacgaaggctgtggtgacagtgcctgcctactttaatgattctcaaagaacggccacgaaggatgctggtcgtattgctggtcttgaagttttgcgtattatcaatgaacccactgccgcttcattagcttatggatttgagaagaagagcaatgaaacgatcttggtgtttgatcttggtggtggtacttttgatgtttcagtgcttgaagtgggcgatggagtgtttgaagtgctttctacatcaggggatacacatttgggtggtgatgacttcgacaagagaattgttgactggcttgctgcaaatttcaaaagggatgaaggcattgatttgttgaaagacaagcaggcccttcagcggctaactgagacagctgagaaagccaaaatggagctgtcatctttgacccaggccaacattagtttgcctttcatcactgccacggcagatggccccaagcacattgagaccacaattacaagggccaagtttgaggaattgtgttcagatcttcttgataggctgaagactccagttgaaaactccttaagggatgcaaaactctccttcaaggatattgatgaggtgattcttgtcggtggatcaacccgtattcctgccgttcaggaactcgtcaagaagatgactgggaaggaaccaaatgtgactgtcaatcctgatgaagttgttgcattaggtgctgctgttcaggctggtgttttggctggagacgttagtgacattgtgctattggatgtgagtccgctatctttgggtcttgagactcttggtggtgtaatgaccaaaattatccccagaaacactacacttcctacctcaaagtccgaggtcttctcgacagctgctgatggtcagacaagtgtcgagattaatgttcttcaaggagaacgagaatttgtgagggacaacaaatcacttggtagcttccgactagacggcattccccctgcaccacgtggggtgcctcagattgaagtcaaattcgatatcgatgccaatggaatcctctcggttactgcaattgacaaaggctctggcaagaagcaagatatcaccattactggtgctagcacattgcctagtgatgaggtggagcggatggttagcgaagctgataagtttgccaaggaggacaaggagaagagagatgccatcgatacgaagaaccaggctgattctgttgtgtatcagacagagaagcaactgaaggagcttggagacaaagtgcctgggccagtgaaggagaaggtggaatcaaaacttggggaattgaaggaggcaatttcaggtggctcaaccgaggccattaaggaagcaatggctgctctaaatcaagaggtgatgcaactgggacaatccttgtacaatcagcctggtgctggtgctgctcctggaccgggtgctagcagcgaatcagggccatcggaatcaacaggcaaaggacccgaaggagatgtcattgatgccgattttagtgacagcaaatgaaaagattaaaatttgttttcccccctattctgaatagaaaattttgctctcaacgggctcggatttgtattccgatttgatttttctggggcaggattggattggggtgttggtttgagaaaattgttggtagccactgtcccattgatattagcttttataaaataggtgatctctataagagtaaaatgctttacatggacactataagtagaatttgaggcggcagctgtaacttccaaaatttttccatacggttgtgtttcatgtttactgctactactgca

SEQ ID NO: 2532 - DNA, 4120 bp, Vitis vinifera
atggcttcatcgacggctcagattcacggtcttggaactactgggttcgcctcatcgtcagcgaagccaaagcgtacatcatctagaacggtgttctttgggcagagattgagccctagtacagcgtcttttggtctaccgaagaccgcgttcttgaagctcaaaaggaactcgagacgagactactcgacgggacctgttcgtgtggtaaatgagaaagtggtgggaatcgatcttggcaccacgaactcggcggtggcggctatggagggagggaagccgacgatagtgacgaatgccgaggggcagcgaacaacgccgtcggtggtggcttacaccaagaacggcgataggcttgttggtcagattgctaaaaggcaggccgtggttaatcccgagaacaccttcttctccgtgaagcgattcattgggaggaagatgtcggaggtcgatgaagaatccaagcaggtgtcgtatcgggtggtaagagatgaaaatgggaatgtcaaactcgagtgcccagcgatcgggaagcagttcgcggccgaagaaatttcggcccaggtaatcattttctttggtttggtgcagttgaattatatttggtacatatttgatgttatttgagtgtgaggatatttgttttctttgggggcattttgaaataaaaaaaaaaggacgagaaacgaaagggaagatttggtttttaattgaatgctaatccaaaatgttatatctatattgattagctgggagaattaatggaaattcagattgagttcatggctgtattccagcaattagttgcctgttgrcaacaatatcttgaattggacagtgtttttttctgatgagtttattgcgttacgttttaatgagaaacaataattgatgaaagaacmagacaatttcaaattycattgaagtttgttttgctcaacaaatcccaaggagcacaaattccttccacccccttccccccgccctctaaaaaatgagtgaaaattttgacatttataactagttgttgtgttgtaagattcttgattctcttcgttcctccacttttttagtgattgaaaagtttggcttattatataatgtttttatttttgggttagctaataattggtctctgtttcttattaggtactaagaaagcttgttgatgatgcctcgaagtttctgaatgataaagtcacaaaagctgtggtcacagtgcctgcgtacttcaatgactcccagaggacagcaacaaaggatgctggtcgcattgctggattagaagttcttaggatcatcaatgaacctactgctgcttcactggcatatgggtttgaaaagaaaaacaatgaaaccattctggtatttgaccttgggggtggtacttttgatgtctcaggtaccaagattgttttagaactcattttatattctaaacttgccattatgagtttgacatgtttcataatcctttccatttctcaacctgttactctttggaatccctttgctatttttttgcagttgatgatcatgcattgtggcacttcttccctaggcaatatgtggcactgttgtctaactatattgttgtcttcactttactattttatactgttttttgtaaatatacacgatcataaatgcatgtacatattgatgggcaatgtgcatgcatcattagttcacaatgttgcattcccacatgcatcttcctccttttaagatcggtgttaaacatagcatgtatttaatcagcaaatggcagaaaacagagttggaatgtggtgacatatttggcttctttttcattttaatttgtgggaaaatgctttatgatgacagaagccaatggcattatgcttgctggtgaaagatgattgaagctttgcatttaatcttatttcttttctttttttttcccctctagttctcgaggttggcgacggagtgtttgaggtgctttccacttcaggagatacacatttgggtggtgacgactttgacaaggttgagaatatttgaatagcctgcaatgaacaatgttatgtcacattttgtcttctttagttctctctctttctctctatccacatctaatattaggttttgattggttagagcaaatcatttatcatttgtcttaccattcaaacagagagttgtggattggttggctgcaagttttaagaaagatgagggtatagatcttctcaaggacaaacaagctcttcagcgtctaacagagacagctgagaaggcaaaaatggagctatcatccttgacacagacaaatattaggtatgttgattgtctgtctactgcctattgatgataaaaktctttctcatacctattttaactgatagaaatttctgtttttccagcttgccgttcattactgccactgcagatggacccaaacacatcgagactacccttacaagggccaaatttgaggaattatgttctgacttacttgataggtaaagaattttgttccaaccatgcttctcactagctgcttcatgttattaaactggttggtgctatacaattagtggttgtttactctaggcacaaaacttgaagttgttattttccttgtggtccttgcactgttgtgactgtgttggttttyaagttttatgtctcatgtctgagaattattttttcaggcttaaaacaccagttgaaaattctttgagggatgcaaaactgtccttcaaagatcttgatgaggtgatccttgttggtggatcaacacgtatccctgctgttcaggagcttgtaaagaaaatgacaggaaaggaccccaatgtcacagtcaatccggatgaagtrgtcgccctaggggctgctgtgcaggtgtgttatactcttgttttgcagggagcatttctctgtagtctgcatgttgctctgtgactttcattggcatcatcttttgaggtggtccttgtgaagttcatgctgaatgactgtgttgtaaatgtagtttttgggtagtttctggagaaatggtatgatgtacagaacctcactgtgaactaatcgtctatgtgttttccggttgatgctaggctggtgttttgtctggagatgtcagtgarattgtgctcttggatgtgtctccattgtctctgggtctagagacattgggtggtgtaatgacaaaaatcatcccaagaaacacaacattgcccacctccaaatcagaggtgttctcaacagcagcagatggacagactagtgttgagatcaatgtacttcaaggtgagagagagtttgtaagagacaataagtctctaggcagcttccgactggatggtatccctcctgcaccgcggggagttcctcagattgaagtcaaatttgacattgatgccaacggcattctttctgtcactgctattgacaaaggcacagggaagaaacaagacatcaccattacaggtgctagcaccttgcccactgatgaggtatgttttcctagatacmcaactgccagaacaactcatgctttggcttagagtgaatcgcttcacacaccatccaccaccccctaaacccttttgtttggtaacatcaagcaaaagctatgagcccattacttgtttgcttagggtttcttggggagtcgacatagttcttactcaacttctaatttgcacctataatgggacagctctgacagaaaatgtgttgtgggaaatatgcaggtggagaggatggttagcgaagcagagaggtttgcaaaggaggacaaggagaagagagatgccatagatacaaagaatcaagctgattctgtggtctaccagacagaaaaacagctgaaggagctgggagataaggttcctgcccaagttaaagagaaggttgaggcaaaacttggggagctgaaggatgcaatcttcaggagggtcgacccaggtcatgaaggatgccatggctgccctgaaccaggaagttatgcagctgggtcagtccctttataaccagccaggtgctcctggtgccggacctgcacctggaagtgaggctgggccatcagagtcatcaggaaagggaccggatggtgatgtgattgatgcagatttcactgacagcaagt

SEQ ID NO: 2533 - DNA, 1424 bp, Saccharum hybrid cultivar SP-80-3280
caccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatctacgaattccccctgcttatgtaaaaactttccaaggtccgcctcacggtatccaagttgaaagggataagttgaacaagtacggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgttttgtcttttgtgccgaagcaatttataaagcacaagccgaaaccggtgaaatcaaggggcattacttgaatgcgactgcaggtacatgcgaagaaatgattaagagagctgtatttgcaaaggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatgcatttccgtgtattagctaaagcattgcgtatgtcggggggagatcatatccactccggtacagtagtaggtaagttagaaggggaacgcgaaataactttaggttttgttgatttattgcgcgatgattttattgaaaaagatcgttctcgcggtatctttttcactcaggactgggtatccatgccaggtgttataccggtggcttcagggggtattcatgtttggcatatgccagctctgaccgaaatctttggagatgattccgtattacaatttggtggaggaactttaggacatccttggggaaatgcacctggtgcagcagctaatcgtgtggctttagaagcctgtgtacaagctcgtaacgaagggcgcgatcttgctcgtgaaggtaatgaaattatcaaagcagcttgcaaatggagtgctgaactagccgcagcttgtgaaatatggaaggagatcaaatttgatactttcaaagcgatggatacctta

SEQ ID NO: 2534 - DNA, 1424 bp, Zea mays
caccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatctacgaattccccctgcttattcaaaaactttccaaggtccgcctcacggtatccaagttgaaagggataagttgaacaagtacggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgtttcgtcttttgtgccgaagcaatttataaagcacaagccgaaactggtgaaatcaaggggcattacttgaatgcgactgcaggtacatgcgaagaaatgattaagagagctgtatttgcaagggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatgcatttccgtgtattagctaaagcattgcgtatgtcggggggagatcatatccactccggtacagtagtaggtaagttagaaggggaacgcgaaataactttaggttttgttgatttattgcgcgatgattttattgaaaaagatcgttctcgcggtatctttttcactcaggactgggtatccatgccaggtgttataccggtggcttctgggggtattcatgtttggcatatgccagctctgaccgaaatctttggagatgattccgtattacaatttggtggaggaactttaggacatccttggggaaatgcacctggtgcagcagctaatcgtgtggctttagaagcctgtgtacaagctcgtaacgaagggcgcgatcttgctcgtgaaggtaatgaaattatcaaagcagcttgcaaatggagtgctgaactagccgcagcttgtgaaatatggaaggagatcaaatttgatggtttcaaagcgatggataccata

SEQ ID NO: 2535 - DNA, 1445 bp, Sorghastrum nutans
caaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatctacgaattccccccgcttatgcaaaaactttccaaggtccgcctcacggtatccaagttgaaagggataagttgaacaagtacggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgttttgtcttttgtgccgaagcaatttataaagcacaagccgaaaccggtgaaatcaaggggcattacttgaatgcgactgcaggtacatgcgaagaaatgattaagagagctgtatttgcaaaggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatgcatttccgtgtattagctaaagcattgcgtatgtcggggggagatcatatccactccggtacagtagtaggtaagttagaaggggaacgcgaaataactttaggttttgttgatttattgcgcgatgattttattgaaaaagatcgttctcgcggtatctttttcactcaggactgggtatccatgccaggtgttataccggtggcttcagggggtattcatgtttggcatatgccagctctgaccgaaatctttggagatgattccgtattacaatttggtggaggaactttaggacatccttggggaaatgcacctggtgcagcagctaatcgtgtggctttagaagcctgtgtacaagctcgtaacgaagggcgcgatcttgctcgtgaaggtaatgaaattatcaaagcagcttgcaaatggagtgctgaactagccgcagcttgtgaaatatggaaggagatcaaatttgatggtttcaaagcgatggataccttatagatataagtagataaaactagata

SEQ ID NO: 2536 - DNA, 1424 bp, Coix lacryma-jobi
caccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatctacgaattccccctgcttatgcaaaaactttccaaggtccgcctcacggtatccaagttgaaagggataagttgaacaagtacggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgttttgtcttttgtgccgaagcaatttataaagcacaagccgaaaccggtgaaatcaagggacattacttgaatgcgactgcaggtacatgcgaagaaatgattaagagagctgtatttgcaagggaattaggggttcctattgtaatgcatgactacttaacaggaggattcaccgcaaatacgactttgtctcattattgccgcgacaacggcctacttcttcacattcaccgagcaatgcatgcagttattgatagacagaaaaatcatggtatgcatttccgtgtattagctaaagcattgcgtatgtcggggggagatcatatccactccggtacagtagtaggtaagttagaaggggaacgcgaaataactttaggttttgttgatttattgcgcgatgattttattgaaaaagatcgttctcgcggtatctttttcactcaggactgggtatccatgccaggtgttataccggtggcttcagggggtattcatgtttggcatatgccagctctgaccgaaatctttggagatgattccgtattacaatttggtggaggaactttaggacatccttggggaaatgcacctggtgcagcagctaatcgtgtggctttagaagcctgtgtacaagctcgtaacgaagggcgcgatcttgctcgtgaaggtaatgaaattatcaaagaagcttgcaaatggagtgttgaactagccgcagcttgtgaaatatggaaggagatcaaatttgatactttcgttacggtggataccata

SEQ ID NO: 2537 - DNA, 1432 bp, Cymbopogon citratus
gaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatctacgaattccccctgcttatgcaaaaactttccaaggtccgcctcacggtatccaagttgaaagggataagttgaacaagtacggtcgtcctttattgggatgtactattaaaccaaaattgggattatccgcaaaaaattatggtagagcgtgttatgagtgtctacgcggtggacttgattttaccaaagatgatgaaaacgtaaactcacaaccatttatgcgctggagagaccgttttgtcttttgtgccgaagcaatttataaagcacaagccgaaaccggtgaaatcaaggggcattacttgaatgcgactgcaggtacatgcgaagaaatgattaagagagctgtatttgcaaaggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatacatttccgtgtattagctaaagcattgcgtatgtcggggggagatcatatccactccggtacagtagtaggtaagttagaaggggaacgcgaaataactttaggttttgttgatttattgcgcgatgattttattgaaaaagatcgttctcgcggtatctttttcactcaggactgggtatccctgccaggtgttataccggtggcttcagggggtattcatgtttggcatatgccagctctgaccgaaatctttggagatgattccgtattacaatttggtggaggaactttaggacatccttggggaaatgcaccaggtgcagcagctaatcgtgtggctttagaagcctgtgtacaagctcgtaacgaagggcgcgatcttgctcgtgaaggtaatgaaattatcaaagcagcttgcaaatggagtgctgaactagccgcagcttgtgaaatatggaaggagatcaaatttgatggtttcaaagcgatggataccttatagatataagtagataaaac

SEQ ID NO: 2538 - DNA, 1473 bp, Pogonatherum sp. Hodkinson 21
gcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttccgttactaacatgtttacttccattgtgggtaacgtatttggtttcaaagccttacgcgctctacgtttggaggatctacgaattccccctgcttatgtaaaaactttccagggtccgcctcacggtatccaagttgaaagggataagttaaacaagtatggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgttttgtcttttgtgccgaagcaatttataaagcacaagccgaaaccggtgaaatcaaggggcattacttgaatgcgactgcaggtacatgcgaagaaatgattaagagagctgtatttgcaaaggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatgcattttcgtgtattagctaaagcattgcgtatgtcggggggagatcatatccactccggtacagtagtaggtaagttagaaggggaacgcgaaataactttaggttttgttgatttattgcgcgatgattttattgaaaaagatcgttctcgcggtatctttttcactcaggactgggtatccatgccaggtgttataccggtggcttcagggggtattcatgtttggcatatgccagctctgaccgaaatctttggagatgattccgtattacaatttggtggaggaactttaggacatccttggggaaatgcacctggtgcagcagctaatcgtgtggctttagaagcctgtgtacaagctcgtaacgaagggcgcgatcttgctcgtgaaggtaatgaaattatcaaagcagcttgcaaatggagtgctgaactagccgcagcttgtgaaatatggaaggagatcaaatttgataatttccaagcgcaggataccttatagatataagtagataaaactagatataaagaaggtctaaataaaataaaaaagaagaaaaatagaaag

SEQ ID NO: 2539 - DNA, 1414 bp, Coix lacryma-jobi
aaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatctacgaattccccctgcttatgcaaaaactttccaaggtccgcctcacggtatccaagttgaaagggataagttgaacaagtacggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgttttgtcttttgtgccgaagcaatttataaagcacaagccgaaaccggtgaaatcaagggacattacttgaatgcgactgcaggtacatgcgaagaaatgattaagagagctgtatttgcaagggaattaggggttcctattgtaatgcatgactacttaacaggaggattcaccgcaaatacgactttgtctcattattgccgcgacaacggcctacttcttcacattcaccgagcaatgcatgcagttattgatagacagaaaaatcatggtatgcatttccgtgtattagctaaagcattgcgtatgtcggggggagatcatatccactccggtacagtagtaggtaagttagaaggggaacgcgaaataactttaggttttgttgatttattgcgcgatgattttattgaaaaagatcgttctcgcggtatctttttcactcaggactgggtatccatgccaggtgttataccggtggcttcagggggtattcatgtttggcatatgccagctctgaccgaaatctttggagatgattccgtattacaatttggtggaggaactttaggacatccttggggaaatgcacctggtgcagcagctaatcgtgtggctttagaagcctgtgtacaagctcgtaacgaagggcgcgatcttgctcgtgaaggtaatgaaattatcaaagaagcttgcaaatggagtgctgaactagccgcagcttgtgaaatatggaaggagatcaaatttgatactttcgttacggtggataccatatagatag

SEQ ID NO: 2540 - DNA, 1374 bp, Sorghum halepense
atgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatctacgaattccccctgcttatgtaaaaactttccaaggtccgcctcacggtatccaagttgaaagggataagttgaacaagtacggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgttttgtcttttgtgccgaagcaatttataaagcacaagccgaaaccggtgaaatcaaggggcattacttgaatgcgactgcaggtacatgcgaagaaatgattaagagagctgtatttgcaaaggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatgcatttccgtgtattagctaaagcattgcgtatgtcggggggagatcatatccactccggtacagtagtaggtaagttagaaggggaacgcgaaataactttaggttttgttgatttattgcgcgatgattttattgaaaaagatcgttctcgcggtatctttttcactcaggactgggtatccatgccaggtgttataccggtggcttcagggggtattcatgtttggcatatgccagctctgaccgaaatctttggagatgattccgtattacaatttggtggaggaactttaggacatccttggggaaatgcacctggtgcagcagctaatcgtgtggctttagaagcctgtgtacaagctcgtaacgaagggcgcgatcttgctcgtgaaggtaatggaattatcaaagcagcttgtaaatggagtgckgaactagctgctgct

SEQ ID NO: 2541 - DNA, 1391 bp, Arthraxon sp. Hodkinson 111
cagaaactaaagcaagtgttggatttaaagctggtgttaaggattataaattgacttactacaccccggagtacgaaaccaaggatactgatatcttggcagcattccgagtaactcctcagcccggggttccgcctgaagaagcaggggctgcagtagctgcggaatcttctactggtacatggacaactgtttggactgatggacttaccagtcttgatcgttacaaaggacgatgctatcacatcgagcccgttcctggggaggcagatcaatatatctgttatatagcttatccattagacctatttgaagagggttctgttactaacatgtttacttccattgtgggtaacgtatttggtttcaaagccctacgcgctctacgtttggaggatctacgaattccccctgcttattcaaaaactttccaaggtccgcctcacggtatccaagttgaaagggataagttgaacaagtatggtcgccctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgttttgtcttttgtgccgaagcaatttataaagcacaagccgaaaccggtgaaatcaaggggcattacttgaatgcgactgcaggtacatgcgaagaaatgatgaagagagctgtatttgcaaaggaattaggggttcctattgtaatgcatgactacttaacaggaggatttaccgcaaatactactttgtctcattattgccgcgacaacggcctacttcttcacattcaccgagcaatgcatgcagttattgatagacagaaaaatcatggtatacatttccgtgtattagctaaagcattgcgtatgtcggggggagatcatatccactccggtacagtagtaggtaagttagaaggggaacgcgaaataactttaggttttgttgatttattgcgcgatgattttattgaaaaagatcgttctcgcggtatctttttcactcaggactgggtatccatgccaggtgttgtaccagtggcttcagggggtattcatgtttggcatatgccagctctgaccgaaatctttggagatgattccgtattacaatttggtggaggaactttaggacatccttggggaaatgcacctggtgcagcagctaatcgtgtggctttagaagcctgtgtacaagctcgtaacgaagggcgcgatcttgctcgtgaaggtaatgaaattatcaaagcagcttgcaaatggagtgctgaactagccgcagcttgtgaaatatggaaggagatcaaatttgat

SEQ ID NO: 2542 - DNA, 1510 bp, Cenchrus setiger
atgtcaccacaaacagaaactaaagcaagtgttggatttaaagctggtgttaaggattataaattgacttactacaccccggagtacgaaaccaaggatactgatatcttggcagcattccgagtaactcctcagcccggggttccgcctgaagaagcaggggctgcagtagctgcggaatcttctactggtacatggacaaccgtttggactgatggacttaccagtcttgatcgttacaaaggacgatgctatcacattgagcccgttcctggggaggcagatcaatatatctgttatatagcttatccattagacctatttgaagagggttctgttactaacatgtttacttccattgtgggtaacgtgtttggtttcaaagccctacgcgctctacgtttggaggatctacgaattccccctagttattcaaaaactttccaaggtccgcctcacggtatccaagttgaaagggataagttgaacaagtatggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgttttgtcttttgtgctgaagcaatttataaagcacaagcagaaactggtgaaatcaaggggcattacttgaatgcgactgcaggtacatgcgaagaaatgattaagagagctgtatttgcaagggaattaggggttcctattgtaatgcatgactacttaactggaggattcaccgcaaatactagtttgtctcattattgccgcgacaacggcctacttcttcacattcaccgagcaatgcatgcagttattgatagacagaaaaatcatggtatacatttccgtgtattagctaaagcattgcgtatgtcggggggagatcatatccactccggtacagtagtaggtaagttagaaggggaacgcgaaataactttaggttttgttgatttattgcgcgatgattttattgaaaaagatcgttctcgcggtatctttttcactcaggactgggtatccatgccaggtgttataccggtggcttcagggggtattcatgtttggcatatgccagctctgaccgaaatctttggagacgattctgtattacaatttggtggaggaactttaggacatccttggggaaatgcacctggtgcagcagctaatcgtgtggctttagaagcctgtgtacaagcccgtaacgaagggcgcgatcttgctcgtgaaggtaatgaaattatcaaagcagcttgcaaatggagtcctgaactagccgcagcttgtgaagtatggaaggagatcaaatttgagttcgaagcgatggataccctatagaaagaggaaaaaataagttacgaaatgcagtaattcttctttatttttctaattgattgcaattaaattcgctcatcttttt

SEQ ID NO: 2543 - DNA, 1378 bp, Trachypogon spicatus
caccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatctacgaattccccccgcttatgcaaaaactttccaaggtccgcctcatggtatccaagttgaaagggataagttgaacaagtacggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgttttgtcttttgtgccgaagcaatttataaagcacaagccgaaaccggtgaaatcaaggggcattacttgaatgcgactgcaggtacatgcgaagaaatgattaagagagctgtatttgcaaaggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatgcatttccgtgtattagctaaagcattgcgtatgtcggggggagatcatatccactccggtacagtagtaggtaagttagaaggggaacgcgaaataactttaggttttgttgatttattgcgcgatgattttattgaaaaagatcgttctcgcggtatctttttcactcaggactgggtatccatgccaggtgttataccggtggcttcagggggtattcatgtttggcatatgccagctctgaccgaaatctttggagatgattccgtattacaatttggtggaggaactttaggacatccttggggaaatgcacctggtgcagcagctaatcgtgtggctttagaagcctgtgtacaagctcgtaacgaagggcgcgatcttgctcgtgaaggtaatgaaattatcaaagcagcttgcaaatggagtgctgaactagccgcagcttgtgaaatatggaaggagatcaaatttgatggtttcaaagcgatggataccttatagatataagtagataaactagat

SEQ ID NO: 2544 - DNA, 1445 bp, Sorghastrum nutans; identical to SEQ ID NO: 2535

SEQ ID NO: 2545 - DNA, 1424 bp, Zea mays; identical to SEQ ID NO: 2534

SEQ ID NO: 2546 - DNA, 1424 bp, Saccharum hybrid cultivar SP-80-3280; identical to SEQ ID NO: 2533

SEQ ID NO: 2547 - DNA, 1432 bp, Cymbopogon citratus; identical to SEQ ID NO: 2537

SEQ ID NO: 2548 - DNA, 1473 bp, Pogonatherum sp. Hodkinson 21; identical to SEQ ID NO: 2538

SEQ ID NO: 2549 - DNA, 1414 bp, Coix lacryma-jobi; identical to SEQ ID NO: 2539

SEQ ID NO: 2550 - DNA, 1424 bp, Coix lacryma-jobi; identical to SEQ ID NO: 2536

SEQ ID NO: 2551 - DNA, 1336 bp, Bothriochloa ischaemum
atactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatctacgaattccccctgcttatgcaaaaactttccaaggtccgcctcatggtatccaagttgaaagggataagttgaacaagtacggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgttttgtcttttgtgccgaagcaatttataaagcacaagccgaaaccggtgaaatcaaggggcattacttgaatgcgactgcaggtacatgcgaagaaatgatgaagagagctgtatttgcaaaggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatacatttccgtgtattagctaaagcattgcgtatgtcgggaggagatcatatccactccggtacagtagtaggtaagttagaaggggaacgcgaaataactttaggttttgttgatttattgcgcgatgattttattgaaaaagatcgttctcgcggtatctttttcactcaggactgggtatccctgccaggtgttataccggtggcttcagggggtattcatgtttggcatatgccagctctgaccgaaatctttggagatgattccgtattacaatttggtggaggaactttaggacatccttggggaaatgcacctggtgcagcagctaatcgtgtggctttagaagcctgtgtacaagctcgtaacgaagggcgcgatcttgctcgtgaaggtaatgaaattatcaaagcagcttgcaaatggagtgctgaactagccgcagcttgtgaaatatggaaggagatcaaatttgatggtttcaaagcgatggataccttatagat

SEQ ID NO: 2552 - DNA, 1391 bp, Arthraxon sp. Hodkinson 111; identical to SEQ ID NO: 2541

SEQ ID NO: 2553 - DNA, 2316 bp, Sorghum bicolor
attcccaccgccgcctcttccgcctccgccggcaaaatgccggtctaccgcatccgcggcgtcgacgtcgacttccccttcgacgcctacgactgccagatcacctacatggaccgcgtcatcgagtccctgcaacagggaaagaacgcgctgctagagagtcctacggggacggggaagacactgtgcctgctgtgtgcgtcgctcgcgtggcgccgcaccttcggcgagttcctgcgggtcgggcgcgggggcggcggcggcgggactcagcagttgccctacgggagccagccgtccgttagccagcagtcagaggattccacgtctcagcagcagcagtcgcggtacccagtcatcatctacgcctcacggacccacagccagcttcggcaggttatcaaggagctcaaggccaccagctacaggccgaagatggctgtgctgggttcccgtgaacagatgtgcatccacaacgaagtgagcaaactccgcggaagagcacagaacaatgcctgccacttcctctgcaagaaacgacggtgccctcataataaccatgtttctgagttcatgaaaaacaaacctgagcttgggaatgagccttttgacatagaagatttgattaatattgggcggcgtaagggcccgtgcccatattacatctcccgggaactttcaaagtcggttgatatcttgtttgctccttacaactatcttattgacccgggaaaccgtcgttccttgaatggcataccatgggacaatgcagttcttatatttgacgaagcacacaacttggagagtatatgtgcagatgcagcctcttttgatttatttccgaataacctcacagcttgtatagcggaagctcatgaatgcatcaaactgtgtgcagcaaagaggtccatcgaaaaatctgctgataaacaatttgatcctgaaaattatgcaatactcaaagctctcttaatggcacttgagaaaaaaattggtgagctgttaattgcatccaaggagttgggctacacaaaagctgggagttacatatatgattttctttctgaactgaacattacatcagacacatccaaaaaactgattgagacaattgatggtgcttctctgctactagaggaaggaaattctgctgaaactgggcgaggggtccaggcaaaggccacagtgtctagattggagtcaattagggacatgttagacataatttttaggggtggtggtcaaaaccatgcaaaatattatcgatttcatgtgaacgaatctcaacaaacatctggagatgcattgaaagttctgggtaagtcttcaaggacccttagttggtggtgtttcaacccggggctggcaatggaagaatttctcaagttgggtgtgcgctccattatattaacctcaggcaccttgtctcccttggattcactagccatggaactaaaccttgaattcccagttagactagaaaatccgcatgtcatttcctcagaccaaatctgggttggagttgtgcctgtcggcccttctggacatgctcttaattcttcttatcgcatgcgtaatactatacagtataaacaagagttgggcactgcaatagtaaacttcgcacgcattgtgccagatggactccttgttttctttccttcatattctatgatggatatgtgtgttgaattctggaaaaataggaaccattcaaattcagcgtctgagaacacaatttggcagcggatctgtaagcacaagcagccagttatagagcctaggcagtcatcaaactttcaaagtgcaattgaggattatagagccaaattacatgattcttcttctggggcaatattttttgcagtgtgtcgtggcaaagttagtgagggtcttgattttgctgatcgtgctgggagggcagtgatagttacgggaatgccctttgctactccaactgatgccaaggttcggctcaagcgtgagtatttggataagcaggggacaccatctaataaaaacacaaagacattgacaggagaagaatggtatgtgcaacaagcagcaagagctgtcaatcaggctgttggacgtgttatcagacatcgccatgactatggagctattctttattgtgatgaaaggtttgcgtggccaaattatcaatctcagatgtcatattggcttcgacctcatataaagtgctactcaaagtatggggaagtagtccaaggattgacccgtttttttcgagataaagcttcttcagatcctttgtcgctagagccaacagattgtaataaaatatatcattaa

SEQ ID NO: 2554 - DNA, 2173 bp, Zea mays
agacaagaagcccctccggccctcgccctccctagtccctattcgccgcgcccgcgcccgcgccgtctcgaggtccgccggtctccttccgccgcaagctttgctccattccaccgccgcctcttccgcctccgtcggcaaaatgccggtctacagcatccgcggcgtcaacgtcgacttccccttcgacgcctacgactgccagatcacctacatggaccgcgtcatcgagtccctgcaacaggggaagaacgcgctgctggagagtcctacgggtacggggaagacactgtgcctgctgtgtgcgtcgctcgcgtggcgccgcactttcggcgagttcctgcgggtcgggcgtgggggcggtgggactatgcagttgccctacgggagtcagccgtccgctagccagcagtcagaggactctacgtctcagaagcagcagcagtcgcggtacccagtcatcatctacgcctcacggacccacagccagcttcggcaggttatcaaggagctcaaggctaccagctacaggccgaagatggcagtgctaggttcccgtgagcagatgtgcatccacgacgaagtgagcaaactccatggaagagcacagaacaatgcctgtcacttcctctgcaagaaacgacggtgccctcataataaccatgttgctgagttcataaaaaacaaacctgagcttgggaatgagccttttgatatagaagatttgataaatattgggaggcataagggcccgtgcccatattacatctcccgggaactttcaaagtcggttgatattttgtttgccccttacaactatcttattgatccgggaaaccgtcgttccctaaatggcataccatgggacaatgcagtacttatatttgacgaagcacacaacttggagagtatatgtgcagatgcagcctcttttgatttatttccgaataacctcacagcttgcatagcggaagctcatgaatgcatcaaactgtgttcagcaaagaggtccattaaaaattctgctgataaacaatttgatcctgaaaactatgcaatcctcaaagctcttttaatggcacttgagaaaaaaattgctgagctgttaattggatccgagttgggctacacaaaagctgggagttacatatacgattttctctctgaactgaacattacatcagacacatccaaaaaactgattgagacaattgattgtgcttctttgctactagaggaaggaaattctgctcaaactgggccaggggtccaggcaaaggctgcagtgtctagattggagtcaattagggacatgttagacataatttttaggggtggtggtcaaaaccatgcaaaatattatcgatttcatgtgaacgaatctcaacaaacacatggagatgcattgaaatttttgggtaagtcttcaaggacccttagttggtggtgtttcaacccggggctggcgatggaagaatttctcaagttgggtgtgcgctctatcatattaacctcaggcaccttgtctccgttggattcactagccatggaactaaaccttgaattcccagttagactagaaaatccgcatgtcatttcttcagaccaagtctgggttggagttgtgcctgtcggcccttcgggacatgctcttaattcttcttatcgtacgcgtaatactatacaatataaacaagagttgggcactgcaatagtaaatttcgcacgcattgtgccagacggactccttgttttcttcccttcatattctatgatggacatgtgtgttgacttctggaaaaataggaaccattcaaattcagcgtctgagaacacaatttggcagcggatctgtaagcacaagcagccagttatagagcctaggcagtcatcaaactttcagagtgcaattgaggattatagagccaaattacacgattcttcttctggggcaatattttttgcagtttgtcgtggcaaagtttgttcctgttctttgtaacctttgctatctattatcaccactttttttatatccagtctcaatgatcttgagctaaatgcttcttttgccaggtctgtaacatgctaatcaatttattaaccattatgtgtacccttttttgcgctgaaagataaaacatgcttagtggcgaaaaaaaaaaaaaaaaaa

SEQ ID NO: 2555 - DNA, 3675 bp, Oryza sativa Japonica Group
agggcgccgcctcctcttcttccctcgcaagcttcccccccccccccccccccccaaaatccccgatttcccgcccactccgtcccctccccctccgcctccggcggccgccgccgccgcaatgccggtgtacaggatccgcggcgtcgacgtcgacttcccctacgacgcctacgactgccagatcacatacatggaccgcgtcctcgaatccctccagcaggtaaccccccaatcccctccgattcccccccgtcggcgcggaatcggaaacccttcgattccattcgatttgagtgatgggggcgagctcgccggatcgatccgacagggggcgggggcgggggcgggggcgggggcgggagccagcagccgccgtatgggagccagccttctgggagccagcactcggggggttcggcgtcgcagtcgtctcggtaccccgtgatcatctacgcctcacggactcacagccagctccggcaggtcatcaaggagctcaaggccaccagttacaggccaaaaatggcagtactgggctcccgcgagcagatgtgcatccacgaggaagtgagcaaactccggggaaggcaacaaaacaacgcctgccactacctctgcaagaaacggtggtgccgccatcacaactctgtcgctgaattcatgaggaacaacagtgagcttgggagtgaggcttgcgacattgaagacttggttaatattgggagaactaagggcccgtgtccatattacatctcccgggaactttccaagtcggttgatattctttttgctccatacaactatcttattgatccaggaaatcgacgttctttaaatggaataccatgggataatgcagtacttatatttgatgaagcacacaacttggagagtatatgtgcagatgctgcatcttttgacttgcttcccaataacctctcttcttgcattgcggaagctcaggaatgcatccaattgtgttcagcaaagaggacctttgaaaattctgctgataaacaatttgaccctgaaaattatgctattctcaaagcccttttaatggcacttgaaaagaaaattagtgaggtggtgattgattccaaggagctgggccatacaaaacctggcaattacatatatgagttcctctctgaactgaatattacttctgaaacatccaaaaagctaattgacacaattgatggtgcttctctattacttgaggaaggaaattctgctgaaactggacctgggatgaaggcgaaggctactgtctgtagattggaaacaatcagggacattcttgacataatttttagaggtggtggtcaaagccatgcaaagtattatcgttttcatgtgaatgaatgccaacaaaattctggagatgctcttaaagttttgggtaaggtatcaaggactcttagttggtggtgttttaacccagggcttgctatggaagagtttctcaagttgggtgtgcgctcgattatattaacatctggcactttatctcccttggattcacttgccctggaactaaacctggaatttccagttaggctagagaacccacatgtcattgcttcagatcaaatctgggttggagttgtgcctgtaggcccatcaggacatccacttaattcttcttaccggacgcgtgagactctgaaatacaaacaagaattgggtataactattgttaatttcgcccgcattgtaccagatggtctgcttgttttctttccgtcatattctatgatggataagtgtatcaactgctggaaagataggaaccatgaaaattcaagtgatgagcacacaatttggcaacgaatctgcaagcacaagcagccagttatagagcctaggcagtcatcgaactttccaaatgcaatcgaggattatgcagccaagctacgtgattcttctacaaccggggcaatattttttgcagtttgtcggggcaaagttagtgagggtcttgattttgctgaccgtgctggaagagctgtaatagttactggaatgcccttcgctaccccaactgatcctaaggttcggctcaagcgtgattatttggataagctgggttcagcatctaacaagaactcaaaggctttgacaggggaggaatggtatgtacaacaagcggcaagagctgtcaatcaggctgttggacgtgtcattagacatcgccatgactatggagcaattatttattgtgatgaaaggtttgtttggcaaaattatcaatctcagatgtcatattggctgcgaccttacataaaatgctataaaaagtatggggaagtagtccaagggttaacaagatttttccgagataaagtgtctattgattcttcaaagccaaatgagacagattttaatgataatattgtactgcttgcagacaaacataaacctcaggagactatatctgctttggctgtcaccacagcaaatgagaaccagagaactgcattatctgtgaatccaaccaccaaaagaagtaactatatcaagtttgcccagatcactcctgccaatcgctctaccctttctatgaaacatggctgttcatctacttcgcagctcttatactcaggagacaaactgtctacggatgctcaggttattgatttggctgctgatgtggcaacaagtcatcttgcaggatatagatttaagtccttaggacctaaaaaggctaaagtaatggttggatccaaagatgtttgttttgatgatggatctccaaaattgcaacataatgttgagtcaagagctttggctgggtgcttgggtgagcaatctacagcttcatcaaagaagagtaatattacacatgcacctggaaacagtggggctattcatgagaaatctggaggccaggaatctaatgcagggccagccttcttgaagctggctcgagaaaagctcagtactgcagagtacagagattttgttgaatatatgaaggccttaaaattgaaaaccatgcacataaaggactcacttgatgcaatagcaaaactgttttcgtctccagagcgactcccacttcttgaagggtttagggtttttgttcctaagaatcatctttcattatatgagcagcttgttcaaagctatactgtgccaaatacatgatttgctgcactatttaaagatcaatttctggaaacttctgtggtaaaatgcaacccgtgcttctcatatcataattgtgccctcgaggctttaatggtcaattcaaatagttctgttgaatttgttcccatcatctgggacagggggggcattgaagaagaaatgtaaagcctttagagttaactgatgtcatagttttctaagtgactaatgccctggcagttttgttaactaatatacattatccgattccactaggtatcatgccagccagtgcgttgcagatagtggagtatgtgtaccctactaggttaactaaaacatgtattttcttcatcgcgagtgaaactgcattattagctaaactagagtggattgacgggaattgcccacgcgtctctatatataggtccgtgtaaattactaaatcaataacttgaatgtaattatcttttgatattttttatgggaaacctgagcttaatacacatttggaatacttcgttatggcagaaattg

SEQ ID NO: 2556 - DNA, 1635 bp, Zea mays
tttggagctcgcgccgcccgccgcccgccgccgcgcccgaacgcagccatcgattccccatttctttcccgcctcctcactcccgcctcttctactcccaaaatcccaaaaccctagctcgctaacgaccccaggcagacgcgccgtcctcccctcccccatggcgctcaagcagaaggacaccgacgccgccgccaccgccaccggtaccaagaagcgccgccgcgtcttcttctccgacaccgatgctggtgttgaggcaaatgagtgtatgaaagtgtttctagtatggaatccaggcgagggagggaaaggaataacagatctaaagcctgttcttcagaacatttttggagaaaacttggtagaaaaagaggaattcctgcatacattttcgaaggaatgtgaatatatcagaactgcagtgacaaatggtagtgccattaagcatgatggctcatatgaatcagatcctgcagttgagattgttcgagttgaactccaaggtgctgctgcatttctttattctcgtctggtacctcttgttcttcttctggttgaaggttccacgcctatagatattggagaacatggatgggaaatgcttctggtagtaaagaaggcaacacaagaggctggttcaaaatttgaactgctaggttttgcagctgtgcataacttctatcattatcctgagagtattcgcttacgaatcagccagatacttgtgttgccaccttatcagggtgaaggccatggtcttggtcttcttgaagcaatcaattatattgcacagtctgagaacatttacgatgttacaatagaaagcccttctgattacctgcagtatgtgcgatcatccattgactgcctccgtttgctcatgtttgatccgatcaaacctgcactcggtgctattgtcttgtctctgaaggagaccaacctgtcaaaaagggcccaaagtttgagaatggttccaccagctgacctgatggagactgtccgtcagaagctgaagataaacaagaaacagttcctccggtgctgggaaattctgatcttcctaagcctcgactctcaggatcataagagcatggacaacttcagggcctgcatatatgaccgcatgaagggggagatccttggcagtgcctctggaactaacaggaagcgtctgttgcagatgccaaccagtttcaataaggaggcatcttttgctgtgtattggacacaggagattgaggatgaggatgaacaaactgttgagcagcagccagaggatctcaagacgcaggagcaacagctcaatgagctcgtggacatccaaatcgaggagattgctggggtcgccaagaacgtcacttcacgttgcaaggataagatgacagagctggtggttcaatgaatctgggtgaggttcctacttcaaacgatgttaaaatgctgtcgtagcttatctggtgaggtctcttttatgggttggcttcttggtagaaagggaatgtttggttattgcactgtcatcgtagtgttagaaccaacacaagcataggcactgagtagattgtcacggcagattattatgtacttcaattctggaatatttgatgggaatgctattttagattgcttggt

SEQ ID NO: 2557 - DNA, 1757 bp, Zea mays
ccaaaaccctagctcgctaacgaccccaggcagacgcgccgtcctcccctcccccatggcgctcaagcagaaggacaccgacgccgccgccaccgccaccggtaccaagaagcgccgccgcgtcttcttctccgacaccgatgctggtgttgaggcaaatgagtgtatgaaagtgtttctagtatggaatccaggcgaggtgagctctgtagactgcactgctattcagccatttgacctaaaccatttttttggtgaagatggaaaaatatatggttacaaaaatcttaagataaatgtgtggataagtgcgaaatctttccatggatatgctgatgtttcatttgacgaaacatctgatggagggaaaggaataacagatctaaagcctgttcttcagaacatttttggagaaaacttggtagaaaaagaggaattcctgcatacattttcgaaggaatgtgaatatatcagaactgcagtgacaaatggtagtgccattaagcatgatggctcatatgaatcagatcctgcagttgagattgttcgagttgaactccaaggtgctgctgcatttctttattctcgtctggtacctcttgttcttcttctggttgaaggttccacgcctatagatattggagaacatggatgggaaatgcttctggtagtaaagaaggcaacacaagaggctggttcaaaatttgaactgctaggttttgcagctgtgcataacttctatcattatcctgagagtattcgcttacgaatcagccagatacttgtgttgccaccttatcagggtgaaggccatggtcttggtcttcttgaagcaatcaattatattgcacagtctgagaacatttacgatgttacaatagaaagcccttctgattacctgcagtatgtgcgatcatccattgactgcctccgtttgctcatgtttgatccgatcaaacctgcactcggtgctattgtcttgtctctgaaggagaccaacctgtcaaaaagggcccaaagtttgagaatggttccaccagctgacctgatggagactgtccgtcagaagctgaagataaacaagaaacagttcctccggtgctgggaaattctgatcttcctaagcctcgactctcaggatcataagagcatggacaacttcagggcctgcatatatgaccgcatgaagggggagatccttggcagtgcctctggaactaacaggaagcgtctgttgcagatgccaaccagtttcaataaggaggcatcttttgctgtgtattggacacaggagattgaggatgaggatgaacaaactgttgagcagcagccagaggatctcaagacgcaggagcaacagctcaatgagctcgtggacatccaaatcgaggagattgctggggtcgccaagaacgtcacttcacgttgcaaggataagatgacagagctggtggttcaatgaatctgggtgaggttcctacttcaaacgatgttaaaatgctgtcgtagcttatctggtgaggtctcttttatgggttggcttcttggtagaaagggaatgtttggttattgcactgtcatcgtagtgttagaaccaacacaagcataggcactgagtagattgtcacggcagattattatgtacttcaattctggaatatttgatgggaatgctattttagattgcttggtaagtggtaaccgcctcaaatcacagaagtagaaccagcttctgattcagccggaaccatttattg

SEQ ID NO: 2558 - DNA, 1398 bp, Sorghum bicolor
atggcgctcaagcagaagggcaccgatgccgccgctaccgacaccaagaagcgccgccgcgtcggcttctccggcaccgatgctggtgttgaggcaaatgagtgcatgaaagtatttctagtaaggaatccagatgaggtgggctctgtagactgcacttctattgagccgttcgatctaaaccatttttttggtgaagatggaaagatatatggttacaaaaatcttaagataaatgtgtggataagtgcaaaatcattccatggatatgctgatatttcatttgacgaaacgtctgatggagggaaaggaataacagatctaaagcctgttcttcagaacatttttggagaaaacttggtagaaaaagaagaatttctgcatacattttcgaaggaatgtgaatgtatcagaactgccgtgacaaatggtagtgccatcaagcttgatggctcatatgaatcagacccagcagttgagattgttcgagttgaactccaaggtgctgctgcatttctttattctcgtctggtaccgcttgttcttcttctggttgaaggttccacgcctatagatattggagaacatggatgggaaatggttttggtagtaaagaagacaacacaagaggctgtttcgaaatttgaactgctaggttttgcagctgtccataacttctatcattatcctgagagtactcgcttgcgaatcagccagatacttgtcttgccaccttatcagggtgagggccatggtcttcgtcttcttgaagcaatcaattatattgcacagtctgagaacatatatgatgtaaccatagaagacccttctgactacctgcagtatgtgcgctcatccattgactgcctccgtctcctcacgtttgatccgatcaaatctgcactcagtgctattgtctcgtctctgaaggagaccaacctgtcaaaaaggactcacagtttgagaatggttccaccagctgagctgatggagactgtccgtcagaagctgaagatcaacaagaaacagtttctccgatgctgggaaattctaatcttcctaagccttgactctcaggagcataagagcatggacaacttcagggcctgcatatatgaccgcatcaagggggagatccttggcagtgcctctggaactaatgggaagcgtctattgcagatggtaagcagttcaaatgaggagtcttttgctgtgtattggacacaggagagtggggacgcagatgaccaaactgttgagcagcagccagaagatctcaagactcaggagcagcagctcaatgagctcgtagacaaccaaatggaggagattattggggttgctaagaacgtcacctcacgtggcaaggacaagctggtagagctggtggcccaatga

SEQ ID NO: 2559 - DNA, 1650 bp, Oryza sativa Japonica Group
ccgcgcgcctccaccaccaccacctcctcctcctccccctccgcaccagccatggcgctcaagcagaaggggaccgacgccgccgccgaccccaagaagcgccgccgcgtcggcttctccggcatcgatgctggcgttgaggctaacgagtgcatgaaagtgtttattgcaagaaaccctgacgaggcaggctcagcaaatagcacttctcttcaaccatttgacctaaatcatttttttggtgaagatggcaagatatatggctacaaaaatttgaagatcaatgtgtggatcagtgcaatatcatttcatgcatatgctgatatctcatttgaggaaacatctgatggaggaaaaggaatcacagatctcaagcctgttcttcagaatatttttggggaaaacttggtagaaaaagatgaatttctgaagacattttcaaaggaatgtgaatatctcagcaatgtggtgacagatggcaatgtcattaaacatgatgcttcaattgatgaagattcagcagttgagattgttcgagttgaactacaaggtgctgctgcttttctttattgtcgtctggtgccacttattctgcttttggttgaaggttcgacgcctatagatataactgagcatggatgggaaatgctcctggtagtaaagaagtcagcacaggcgtcatccagctctaactttctagtgctagggtttgcagctgttcatcatttttatcactaccctgagagcactcgcctgcggatcagccagatactggtcttgccaccttatcaaggtgaaggccatggacttcgtcttcttgagacgatcaattctatttctgagtctgagaacatatacgatgtgaccatagaagatccttccgattaccttcagtacatacgttcatccattgactgtctccgccttctcaccttcgatccaatcaagccagcgctctgttccatggtctcatctctgaaggataccaacctttcgaaaaggaccagcagcttgaaaatggttccaccttccgaccttgctgagacggtccgacagaagctgaagatcaacaagaagcagttcctccggtgctgggagattctgatctacctaaaccttgacgctgaggaccgcaagagcatggacaacttcagggcctgcatctacgaccgcatcaaaggcgagatacttggcacttccactggccccaacgggaagcggctcgtccaaatgccgagcaatttcgacgaggagacatgctttgctgtgtactggacacaggacggtggggatgcagatgaccaaactgttgagcagcagcctgaggatctcaagacccaggagcagcagctgaatgaggtggttgacagccaaatggaagagatcgtcgagatagccaagaacgtcacctcacgcggcaaggataaactgagcgtttcttgctccgtatgacggtacgagtggtaacttggaaaaaactgaatgctgcattgcagccacagctcgcctgatgtctctttgtagctcaagacttcagggtagaaactagaggctagaaaattttcaggtctgagaattatgttctgcgtattctacttgagcttttccgagatgaacttccttcagcgtagtaatcttagttatcattcg

SEQ ID NO: 2560 - DNA, 1719 bp, Hordeum vulgare subsp. vulgare
gaattccccatttcccgcctcccccttccaccaatctcccgcgtcttctcctcccccaaatcccaaaccctagaggagccccccatcctccctcctctcgaacccccgcctccgccaccggatcggcagccacccatggcgcccaagcagaaggggagtgacgcttccgccgctgacaccagcaagcgccggcgcgtcggcttcgccggcatcgatgctggaactgaagcgaatgaatgcatgcaagtgtttcttgcaagaaaccctgacgaggtgggctcagcagacagcactcccattgagccatttgacctaaaccatttctttggtgaaggtggtaagatatatggctacacaaatctcaagatcaatgtgtggataagtgctatatcatttcacgcatatgccgatatttcattcaaggaaacatctgatggagggagagggatcacagatctaaagcctgtccttcagaacatttttggggaaaatctagtagaaaaagatgaatttctggagtcattctcaaagggatgccagtatatcagtgatgtcgtgacgaatggtaaatccattaaatatgatgcctcagatgaagatgatttggaagttgagattgttcgagttgaactccaaggtgctgctgcatacctttattcacgtttggtatcacttgttctgcttctggttgaaggttccacacctgtagatatcacagaacatggatgggaaatgcttgtagtagtgaagaaggcagagcttgagccatctgattcaaaatttcagttgctaggctttgcagctgtccaccatttctatcattaccctgagagcactcgcttgcgtatcagtcagatactggtcttaccatcttatcagggtgaagggcacggccgtcgtcttcttgaggcaatcaattcgatcgcagaatccgagaacatgtatgacttaactattgaagacccttctgattacctgcagtatgtacgttcctccatggactgtcttcgtcttctcacctttgagccaatcaagcctgcgcttggtgctatggtcttgtctctagagcagaccaacctgtcgaaaagaactcacagtttgataatggttccgccggctgacctggccgagactgtgcggctgaagctgaagatcaacaagaaacagttcctgcggtgctgggaaattctgatctatctacaccttgatgccgaaaatcccaagtgcatcggtaacttcagggcctgcatctacgaccgcaccaaaggtgaactactcggcgccgcctctggaaccaacgggaagcgccttgtccaagtgcccactagttttgacgaggacacgtcatttgctgtgttctggacaaaggagggcggggacgaagataatcagacagtccagcagcagccggaagatctcgctactcaggaggagcagctaaatgagttggtggacaaccaaatggaagagattgccgaggtcgccaagaacgttacctcacgcggcaaggataaattggctgcttgatggcgtgagatcttgcagctcgagggtagaaagttacaaaaattcttgaatggaggttatcctcgacgtggagaactatgtaatgcaaatttttttccgagaatgttacattgttatactgtttcaacttagtaaccttaccagcttatgttattctcgggtgaaaacaaataggaaaaacgccagaactgc

SEQ ID NO: 2561 - DNA, 1398 bp, Sorghum bicolor; identical to SEQ ID NO: 2558

SEQ ID NO: 2562 - DNA, 1757 bp, Zea mays; identical to SEQ ID NO: 2557

SEQ ID NO: 2563 - DNA, 1650 bp, Oryza sativa Japonica Group; identical to SEQ ID NO: 2559

SEQ ID NO: 2564 - DNA, 1719 bp, Hordeum vulgare subsp. vulgare; identical to SEQ ID NO: 2560

SEQ ID NO: 2565 - DNA, 1635 bp, Zea mays; identical to SEQ ID NO: 2556

SEQ ID NO: 2566 - DNA, 2298 bp, Sorghum bicolor
atggccatggctgcgcaccatcaccacctgcgcccctacctcgccactgccaccgcgctcttcctcgcattcacctccgcgcctctcgacgccggggacccgctgggccagttctgcggtaccggcttcaactacacgctcaacagcacctaccagggcaacatccagcgcctcgccgccacgctgccccggaacacctccgcctccccgacgctcttcgccaaggacaccgtcggcgcggtcccggacatcgtctatgcgctcgcgctctgccgcggggacaccaacgcctccgcctgcagcgactgcgtcgccaccgcgttccaggacgcgcagcagctgtgcgcctacaacaaggacgccaccgtcttctacgacccctgcctcctccgcttctccaaccagaacttcatcgcctcgccctccaacagcgacgacaaggtgctcatcctcatgaacacgcagaacgtcaccgcgccgttcaaggtgttcgacgccgccgtcgccgtgctcctcaacgccaccgccgcctacgcggccgccaattcgtccaagaggttcggcaccggggtggagcggttccagaccttcgacagcaagaacccgaccatttacggtctggcgcagtgcacgccggacatgtcgccggccgactgccggaggtgcctctcgggtattattcagatggcccccaagtatttcaacggcaagccgggtggcaggattcttggtctgcggtgcaattacaggtatgagcagtactcgttcttcacaagcaccccgctgcttcagctgccggagcctaccgtgggggcgccggcgcccgcgcccgcggtggtgaacggaacgccaacggtgccgacgaacggaggagcacgaggaacaacaggaaaaaaaactggtagagttttagccattgcactgcctatagttgctgctgcaatactagctactatagtactttgttcatgcctctggaggaggaagaggaaaccagggaagtcaacactaccagatacaactaacccagaggacatacaaagtattgattctctcattattgatatatcaactttgcgagctgcaacagaaaactttgatgaagccaataagctcggtgaaggaggttttggttcagtatataagggaatcctccctgatgaccaggaaatagcagtgaaaaggctctcacagacttctagacaagggatggaggagctcaaaaatgagcttgtattggttgctaagctgcaacacaagaatttagtgaggcttgttggggtttgcttggaggaccatgaaaaattgcttgtctatgaatacatgcccaacaaaagccttgacactattctattcaatcatgagagatgtggtgagctagattgggggaagaggtttaagatagttaatgggattgcccgtggcttgcagtatcttcatgaagattctcaagtgaagataatccaccgggatcttaaagcgagcaatgttttattagactatgacttcaatcctaagatctcagattttggcttagcaaggttatttggaagtgaccaatcacaagatgtcaccaatcgcgtcgtcggaacctatggatacatggcccctgagtacgccatgcgtgggcattactctatcaagtcggacgtgttcagcttcggtgttttgatcctagaaatcgtcaccggaagaagaaatggtggctcctatagctctgatgaatatgctgatctccttagtttggtgtgggagcactggacgacaggaacattgatagacatcatggattcatccttgagcagccttgctccgcgagaccagatgttgaagtgtatccacatcgggctcctttgtgttcaagatgaccccgcagataggccgatgatgtcaacagtgaatgtcatgcttagtagtagtacggtgaccctccaagctccatctagaccggcgttttgcatcccaaagagtggcttctcagagatgaactcagaagggtacccgccaggagcttcacagtccgcgagcagatcgcctatgtcgctgaatgacgtttcaatcactgagcttgagcccagatgatgatgattctctttgaagcagtggcggaacagtaggtatattgagggtacgtcgtccttattgaatattgtgttttacctgggccgagcacgtaagtgtgatcggtatacaaaactagtaaattaccaatatggtgaaatataacgtctattattagttctacaattacttatgtatctatatggcattgcctttcaatgtagaggtgtgtaaaaa

SEQ ID NO: 2567 - DNA, 2373 bp, Zea mays
gcacggccggctctccgctccgccagacccggaccggcaccacgccacggctccggccatcacgcgccgcgcacaccatgaccacggttgcgcaccatcaccacctcgccgctgctaccgtgctcttcttcgtcgcattcaccatggcgcctctcgccgccggggaccccgtgggccagctctgcggtaccagcggcaactacacgctcaacagcacctaccagggcaacatccgccgcctcgccgccacgctgccgaagaacacctccacctcggcgacgctcttcgccacggacaccttcggcgccgtcccggacatcgtctacgcgctcgcgctctgccgcggcgacaccaacgcctccgcctgcagcggctgcgtcgccgccgcgttcctggacgcgcagcagctgtgcgcctacaacaaggacgccaccatgttctacgacccctgcctcctccgctactccaaccagaacttcctcgccgaccccagcagcgatggccgcgggaccgcgctcatcctcatgaacacgcagaacgtcaccgcgcggttcaaggtgttcgacgccgccgtcgccgcgctcctcaacgccaccgccgcctacgcggccgccaattcgtccaaaaggttcggcaccggggtcgaggcgttccagaacttcgacagcaaccgcccgaggatctacgggctggcgcagtgcacgccggacatgacgccggccgactgccagagctgcctctcgggtattatccagacggggcccaagtatttcagcgggaagcagggtggcaggattcttagtgtgcggtgcaactacaggtatgagcagtacccgttctttacaagcaccccactgcttcagctggcggagcctaccgtgggggccccggcgcccgcgcccgcggtggtcaacggaactccaacgccaccgacgaccggaggagcacgaggaacaacaggaaataaaactggtagagttttagccattacactgcctatagttgctgcagtgctagctactatagtactttgttcatgcctctggaggaagaggaaaacaccagggaagtcggcactaccagatacaactaaccctgaggacatacaaagtatcgattctctcattattgacgtgtcaactctacgagctgcaacagaaaactttgctgaagccaataagctcggtgaaggaggttttggttcagtatataagggaatcctccctgatgaccaggaaatagcagtgaaaaggctctcgcagacttctagacaagggatggaggagctgaaaaacgagctcgtgttggttgctaaactgcaacacaagaatttagtgaggcttgtcggggtttgcttggaggaccatgaaaaattgcttgtctatgaatacatgcccaacaaaagcctcgacaccattctatttaatcacgagagatgtggagagctggattgggggaagaggtttaagatagttaacgggatcgcccgtggcttgcagtaccttcatgaagattctcaggtgaagataatccacagggatcttaaagcgagcaatgttctgttagacaatgacttcaaccctaagatctcggattttggcttagcaaggctattcggaagtgagcaatcacgagatgtcaccaaccgcgtcgtcggaacctatggatacatggcccctgagtacgccatgcgtgggcactactctgtcaagtccgacgtgttcagcttcggcgttttaatcctagaaatcgtcaccggaaggcgaaatggtggctcctatagctctgaagaatcggccgatctccttagtctggtgtgggagcactggacgacggggacattggtggagatcatggatccatccttgagcagccttgctccgcgagacctgatgttgaagtgcatccacatcggcctcctctgcgttcaagatgaccatgaggacaggccgatgatgtcgacagtgaatgtcatgcttagtagcagcacggtgaccctccaagctccatcgaggccggcgttttgcttcccgaagagtggcttcaactcagagatcaactcagaagtgtacccgccaggagcttatcagtccgcgagcaggtcgcccatgtcgctcaacgacgtctcaatcactgagctcgagcccagatgatgcatgcatgcatggcgatgaattgatgattgtcttcttcgaaggagtttctgttgagtgtttgtgttttaccgcctgggccgagcacgtaagtgtgagtgtgacccgtagtatacgaaactagtagactaccaatatatatggcgaaatataacgcctattagttgtccaaaaaaaaaaaaaaaaaaaaaaaaaaaaaaaataaaaaaaaaaaaaaaaa

SEQ ID NO: 2568 - DNA, 2268 bp, Hordeum vulgare subsp. vulgare
gacggctaaaaacaccatggcctcgcatcacggcggccacatcccctcctacctcgcccccgccgccgccctcctctttgccttcataatcgcgtttccagcatccggtgaccccctccaacagttctgcggcagcagtggcaacttcaccgcgaacagcacctaccaggccaacatccggcgcctctccgcaaccctccccaagaacacctcctcctcaccgacgctcttcgccaccgacaccttcggaaccctcccggacatcgtctacgcgctcgcgttctgccgcggggacaccagcgcggccaactgcagcgaatgcgttgccacggccttcctggacgcgcagcagcgctgcccgtacaaccaggatgccaccatcttctacgacccctgcgcactccgcttctccaaccagaacttcctatcctccaccaatggcgacaacagattattcatccttctgaacacccagaacatgtccgtaccggccaaggtgttcgacaccgccgtgggcgtcctcgtgaacgccaccgccgattacgcggctgcgaattcctccaggaggttcggcactggagaggcggggttcgagacggtcgacgaggctaatccaaagatttacggtctggcgcagtgcacgccggacatggcaccggccgattgccggacctgcctccagggtatcatcgcgatgatgccgcaatacttcagtgggaggaagggtggccggattcaacaattgcggtgcaattacaggtatgagctgtatcgcttcttcaatgggccttccctgctgcagctccgggcgccatccgtggggttggctccagctccagcgccggcgaacgtgaagccaccgctagccggaggaggaagcacagggaacggaacagctagaattttagctattacactgccgatagttgctgcagtactggctgctgttgtaatttgcctttatctatggagaaggaagagcacacccgcgcgaaagacatcactatcgtatccaaccattccagaggacatacagagcattgattcactcattctcgatctatcaactctacgagtcgcaacagataactttgatgaaaggaataaacttggtgaaggagggtttggtgtggtttataagggaatccttcctgacaatgaagaaattgcagttaaaaggctctctcaaagttctcgccaagggatagaggagctgaaaaatgagcttgttttggttgctaagcttcaacacaagaatttagtgagacttcttggtgtttgcttggaggaacaagaaaagttacttgcgtatgaatacatgcccaacaaaagccttgacaccattctttttgatcctgataggagcagtcagctagattgggggatgagatttaggatagtcaatggaattgctcgaggcttacaatatcttcatgaagattctcagctgaagataattcaccgggacctcaaagcgagcaacgttcttttagactctgactttaatcctaagatttcagattttggcttagcaaggctatttggaagtgaccaatcccatgatgtcaccaaccgtgtcgtcggaacctacggatacatggcccccgagtatgctatgcgtgggagttactctatcaagtcggacgtattcagcttcggcgtcttgattttggagatcgttactggaaaaagaaacagcgtcgcatatgattccgagcaagctgtagatctcttaagtttggtctgggagcactggacgatgggaacaattgtagagatcatggattcgtccatgactagccattctcctggagaccagatgctgaagtgcatgcacatcggacttctgtgtgttcaagaagacccagctgatagaccgatgatgtcggttgtgactgtcatgctaagcagcagcactgtgtctctccaagctccatccaggccagcattttgcatccaaaagagtgacatgaactactcaggcatgcacacggatccatatccaggagtttcacactctaccagcagatcacctatgtcaccaaacgaagtttcgattactgaacttgagccgagataagtctgagactgatgatgtattcattatatatgccattcttgccaaaataacctattttgatgcagggaaagaccctacgtcatatgtataataaactcggcccccttggtggtagaaattttactgaacaatggcataatacgccagtgtaattgtattgtttgggttttctatttattggattaccg

SEQ ID NO: 2569 - DNA, 910 bp, Zea mays
cctctctcccctcctcacacaggcacacacgcactttctgtcagcttcctcccctgcgccgataagcaagcccgtgagccaacagtggtgccagcggcccgagcggcgaggatgcacagcggagcgaggaagctcatgtgggggaccagcccggacaggcccgacgaccacgacgtggtcatcgtgctcgcctcgctgctgtgcgcgctcatcaccgtcctcggcatcggcctcgtggcgcggtgcgcgtgcgcgcgcgggcccagcgcgcaggcggcggctgccgccaacaggggcgtcaagaagtcggtgctgcgcaggatccccaccgtgccctacgccgcctgcagccaaggggaaggggacgacgcggacgagtgcgccatctgcctggcggagttcgaggagggcgagcccacgcgcgtgctgccccagtgcggccacgccttccacgccgcctgcgtcgacaggtggctgcgcgcccactcgtcctgcccctcctgccgccgcatcctctccctccagctgccgcccggcgagcggtgccgccgctgcggcgcgcggcccctggacgacggggacgctgggtggaagcccacctactacagcgccatgccgccgttcctggcgtaagcggcggaggaatcgcccgatccggaagcaaaggaaagcaaagcaaagcaaaccttcgggttaagttcctcggctgcagatttcggtactgcctgtatgtggttggtagtgcgtagcaatctgggaatgaggaaaattaggggatcaattaggttgtttgttgcagctgaaaacactgcactgcagcgtgcgtagtagtagtactagtaccaggctggcgtgtacagtacagtttgtaaatactcaagtaattaatatgcatgcgatgagctttggt

SEQ ID NO: 2570 - DNA, 865 bp, Zea mays
atccctcgtggcctctctcccctcctcacacaggcacacacgcactttctgtcagcttcctcccctgcgccgataagcaagcccgtgagccaacagtggtgccagcggcccgagcggcgaggatgcacagcggagcgaggaagctcatgtgggggaccagcccggacaggcccgacgaccacgacgtggtcatcgtgctcgcctcgctgctgtgcgcgctcatcaccgtcctcggcatcggcctcgtggcgcggtgcgcgtgcgcgcgcgggcccagcgcgcaggcggcggccgccgccaacaggggcgtcaagaagtcggtgctgcgcaggatccccaccgtgccctacgccgcctccgccgccgcctgcagccaaggggaaggggacgacgcggacgagtgcgccatctgcctggcggagttcgaggagggcgagcccacccgcgtgctgccccagtgcggccacgccttccacgccgcctgcgtcgacaggtggctgcgcgcccactcgtcctgcccctcctgccgccggatcctctccctccagctgccgcccggcgagcggtgccgccgctgcggcgcgcggcccctggacgacggggacgctgggtggaagcccacctactacagcgccatgccgccgttcctggcgtaagcggcggaggaatcgcccgatccggaagcaaagcaaagcaaacctgtatcaattaggggatcaattaggttgtttgttgcagctgaaaacactgcactgcagcgtgcgtagtagtagtactagtaccaggctggcgtgtacagtacagtttgtaaatactcaagtaattaatatgcatgcgatgagttttggtaaaaaaaaaaaaaaaa

SEQ ID NO: 2571 - DNA, 945 bp, Sorghum bicolor
atgcacggcgcggcgaggaagctgctgatgtgggggagcagcccggtgggggcggcggggtcggacaggcccgacgaccacgacgtcgtgatcgtgctcgcctcgctgctgtgcgcgctcatcacggtcctcggcatcggcctcgtggcgcggtgcgcgtgcggccgcggcgggccccgcgcgcgggcggcggcggcggccaacaggggcgtcaagaagtcggtgctccgcaagatccccaccgtgccgtacgtcgcgccggcacccgcctgcgccgcaggaggaggggacgtggagtcaggggagccggcggcggaggcaggggaggcggaggcggcggagtgcgccatctgcctggcggagttcgaggagggcgagtcgatgcgcgtgctgccccagtgcggccacgccttccacgccgcctgcatcgacaagtggctgcggggccactcgtcctgcccttcctgccgccggatcctgtccctccagcagctgccgcccggcgagcggtgccgccgctgcggcgcgcggccccaggacggggacactgctgggtggaagcccacctactacagcgccatgccgccgttcctggcataggctgggcggcagaggaattgctccaatccgaaagcgaagcaaacctttcggttaaattccatcctcgcctcttctggtttcgttttactgatcgcagtggtagatttcagtagtgcctgctgtctggttgtggttggtacttggtagtgagttgcgtaggcgtaggcgtagcaatctgggaatgaggaagttgggggggatcaattcatggcctctcaattggggtgatagagtgtttgttgcagctgaaacagaaacactgcagcatagtagtagttccagctatgtacaatttgtaaatactactctagtaattaattaatatgcatgcaatgagctttggtg

SEQ ID NO: 2572 - DNA, 1718 bp, Zea mays
cccgcaccgcatcccattccgtgccaccgccgccgcgctgcgtctgcgtgcgtcgcccgcccgcccgcccgcagtgtccgcagccagagccagcgcacgcgctgctccgccgacgccgaagcctcgtccgcgagcgcgtggctaagcaagcacycgagtcgagctccctccagcggcgggcgcagtgcagccaggccgcgcgcgccgcagcatgaaacggcgtcggcgacgcgcacgccgggccgtggccgcggccgccatggtgcagcagacgctggggatgtcgctgccgatggcggcgttcgtgcccgagcattgcagcgccaataagctggccaggccgccggggctgccgccgctgccgcaggcgttcgtggcccagcagcgcggggacgtgtgcatggaggccgccgaccccgccgctggcccgcgcaaggcgcaccggcgctcccgcagcgacgtcccgttcggctacttcccgccggcgggccaccaccagctcccgccgcccaaggtggaggccggctggggcggccacctccccgccggcggcggcgacgacgacctgttcaacgcgtacctcaacctggaggggctggacgggctcaactcctccgacgaccgcctggacgacggggacagccgcggcagcagcatgaggaccaacggcgccgacagcagcgagaacgagtcggaggagtgcgccgccgacagccgcgccgggatccgcctctgcgccgccgctgccgacaggcgggaggggctcaagagggccgccgctgcgcccgtgccgcgccacgccaggagcctgtccatggacagcctcatcggcaagctcaacttctccgccggcgcgacgggcgccgccagcggcgtcattccggggcccaacaggttcagcctcgagttcggcagtgccgagttttcgccggtcgagatgaagaagatcatggccgacgagaagctggccgagatggcgctcgccgaccccaagcgcgtcaagagggtgctggccaacaggcagtcggcggcgcggtccaaggagcgcaagatgcgatacattggcgagctggagcacaaggtgcagatcctgcagacggaggccaccactctctccgcccagctcacgcttcttcagcgggactccgcggggatcgcgacgcagaacaacgagctcaagttccggctgcaggccatggagcagcaggcgcagctgcgtgacgcattgaatgaggcactgacagccgaggtccaacgcctgaagctcgcgaccgcagagctcggggattcttgctcgtccagcaacctagctcagcagatccaaatcagcgttcaggaccagatgtttcaactgcatcagcagcaggcaacgcctataccgttctaccagctgcagcaggcgcagcagaatggcgcagggaagaagcatgagccgacggaatgatctcagagctgccattatccaccgctgcgtgagcagggggaaaaaaggatcggtttcgawsgactgaaagcatttcttttcctaactcattggttttaagtgtcgttaataagcaccgtgcatttttttttccaggtgatgaacctgctgcttgtacctgtttatttattctttggatgattcagttgcttgagttgccaaactgatcaaattgtagccggttaatattcttttatagttgtagtgcaaaaaaaaaaaaaaaaaacggcacggg

SEQ ID NO: 2573 - DNA, 1269 bp, Sorghum bicolor
atgatgcagcaggcgctggggatgtcgctgccgatggcgcagttcctgcccgaccagggcagcgccaagctgaccaggccgccggggctgccgccgacgccgccacaggcgttcgcggcgctgcagcgcggggacgtgtgcatggaggccgtcgtcgaccccgcggcgcagcagcagggcccgcgcaaggcgcaccggcgctcccgcagcgacgtcccgttcgggtacttcccgccggcgtcgggcggcggcggccacggacaccaccagctcccgccgcccaaggtggaggccggctggggcggcggccacctccacggcggcggaggcggcgacgaggacctgttcaacgcgtaccttaacctggaggggctggacgggctcaactcctccgacgaccgccacgacgacggggacagccgtgggagcagcatgaagaccaacggcgccgacagcagcgagaacgagtcggacgagtgcgccgccgacagccgcgccgggatccgcctctggagcgaggctgccgttgccgccgccgccgacaggcgggaggggctcaagaggaccgccgcgggggagccggccgccgcacccttgccgcgccacgccaggagcctgtccatggacagcctcatcggcaagctcaacttctccgccggcgcgacgggcgccgccagcggcgtcattccggggcccaacatgttcaagctcgagttcggcagcggcgagttcacccccggcgagatgaagaagatcatggccgacgacaagctggccgagatggcgcttgccgaccccaagcgcgtcaagagggtgctcgccaacaggcagtcggcggcgcggtccaaggagcggaagatgcgatacattgcggagctggagcagaaggtgcagatcctgcagacggaggccaccactctctccgcccagctcacgcttctccagcgtgactccgcggggatcgcgacgcagaacaacgagctcaagttccggctgcaggccatggagcagcaggcgcagctgcgtgacgcattgaatgaggcactgacaggcgagctccaacgcctgaaagtcgcgactgcagagctcggggattcttgctcgtccaacaatctagcccagcagatccaaatcagcgttcaggagcagatgtttcaactgcatcagcatcagcagcagcagcaacagcaggcgacgccgataccgttctaccagctgcagcaggcgcagcagaatggcgcagggatgaagcatgaatccaaggaatga

SEQ ID NO: 2574 - DNA, 1281 bp, Oryza sativa Japonica Group
atgaacggtggcattggcgacgcgctgatgcagccgcagcacgtgcaggtcatgtcgtcgtcgttgccgatggtggcgtcgacgttcgtggcggagccggcggcggcggccaacaagccgagggccgcggggctgccgcccacgccgccgcaggtgttcgccgcccagcgcgcggcggcggcggcgggcggcgacgtgtgcatggaggagtcggcgcaggggggtggtggcgggctgccgccgcgcaaggcgcaccgccgctccagcagcgacgtgccgttcgggtacctggccgggcagcaccagctcctgccgcccaaggtggaggccgggtggggccacctcggcgccggcgccggcggcgcggcggccgccgatgacctgttcaacgcgtacctgaacctggaggggctggacgggctcaactcctccgacgaccgccacgacgaaggggacagccgcgggagcagcatcaagaccaacggcgccgacagcagcgagaacgagtcggaggagtgcgccgacgacacccgcggcgggatccgcctctggtccgccgacggcggcgagaggagggagggcgtcaagaggaacgccgcgggggagccggccaccgcgccgctggcccgtcacgccaggagcctctccatggacagcctcatcgggaagttcaacttcacggcggggacggcggcggctgcggggaacggtgtcgcgttggggccgaacaggttcagcctggaattcggcagcggcgagttcaccccctccgagatgaagaagatcatggccgacgagaagctggccgagatggcgctcgccgacccaaagcgcgtcaagagggtgctggcgaacaggcagtcggcggcgaggtccaaggagaggaagatgaggtacattgcggagctggagcagaaggtgcagatcctgcagtcggaggcgaccaatctgtccgcgcagctcacgatgatgcagcgcgactcggcggggctcgcgacgcagaacaacgagctcaagttcaggctgcatgccatggagcagcaggcgcagctgcgcgacgcgctgaatgaggccctgacaaccgaagtccaacgcctaaaactcgccaccgctgagctcggcgattcttgctcgtccagcagtctagctcagcagatccaactcaatgctcagaatcagatgtttcaactgcagcagcagcaggctacgcagataccattctatcaactgcagcagtcacaacagaacggtgcagcgaagaacaatgaatcaaaagaatga

SEQ ID NO: 2575 - DNA, 2172 bp, Sorghum bicolor
atggcgacgggcaccgccgccgccagcgcttccggcggcccagccgtccacgcgggagccgacgccttggagtcaggcgccagcctgctgcggcgacgccacgccgacggccttgcggttgctggtgcggacgacggcgacgacgggggcggcaatgccgaggaggaggtggtggcctcggtggagcaggcgttcgaggacaagcccgtgccgtcgtggcgggagcagctgacggtgcgcgccttcgtggtggggttcatcctctccatcttgttcagcgtcatcgtgatgaagctgaatctcaccaccggcatcatcccctcgctcaacgtctccgccagccttctcggcttcttcctcgtccgcctctggacgaaggcaatcgagagcatgggcttgctcaagcagcccttcacgcgacaggagaacaccgtcatccagacctgcgtcgtctccgcctatggcctcgcctttagtggtgggtttggcagttacctatttggtatgagtcgaagcattgctgagcaagcaacagaggccaatgatgcccagaatatcaaggatcctcacctcggatggatgatagggtttatgttcctcgtcagttttgttggacttttcgttctggttcctctgagaaaggttatgattgtcgattacaaactgacctaccctagtggaactgcaacggcttacctcatcaacggattccacacaccccagggtgccgaacgttcaaagaagcaagttcgaaccttgggcaagtacttctcactcagtttcctttgggccttcttccagtggttctacacagctggggacgattgtggattcacctccttcccatcactcggccttgaagcttacaaaaacaagttctattttgatttctcagctacttatgttggtgttggaatgatatgtccatatatcgtaaatgtatctcttctccttggaggtatcatttcgtggggagtaatgtggccacttatcagcacaaagaaaggaagttggtaccccgaatctcttcctgatagcagtctacacggacttaatggttacaaggtgtttataaccatatccgtaattcttggggatggcctgtacaacttcttgaaagtattcggtaacacaataagggcattcatatcaatgtattggaagaaacatgcaaacacacttcctgtgtccgacaatgggggccctcccgccacaactgaaaccgagtcatttgacgacaagcgtcgcattgagctattcgttaaggatcagattcccaagtcagttgcattgggtggttatgtctgtctggcagctataacgatcggctgcctccctctcatcatctcccagatcaagtggtaccacattttggtggcatacatctttgcacctatactagccttctgcaatgcctatggatgcggcctaacagattggtccctcgccagcacctatggcaagcttgcaatctttgtcattggtgcatgggcaggggcttcacatggcggagtgcttgttggattagctgcatgcggtgtcatgatgagcattgtgggaacagcttctgatctgatgcaagacttcaagactgggtacctgactctagcctcaccaaggtccatgttcatcagccaggtgataggcactgccattggatgtgtagtagcaccatgtgtcttctggttgttttacaagtccttcgacattggtgtgagtggtggcgcttatccagcaccttacgccatcatgtaccgtaatatgtcaatcctgggcgtggatggcctgtccttgctcccaaagaactgcctcacgctatgctacattttctttgctgtttctttcgccatcaatttgatcaaggatctgttgccacagaaggttgcaaagttcatccccatccccatggcagctgcaattcctttctaccttggaccatactttgctattgacatgttcttgggcagtgtgatactcttcttttgggaatggaagaacaaagctgaagcagacacgttcacaccagctgttgcatcaggcttgatgtgtggtgatgggctctgggcactgccccaggctgttctttctctggccaatgtgaaccctcccatttgcatgaagtttttgtcgaggtctgtgaatgccaaagtggacaccttccttgggaactag

SEQ ID NO: 2576 - DNA, 2366 bp, Zea mays
taacaaattgacaatcaccatggcgactggcaccgccgccgccagcgcttccggcgtgggagccgactccttggagtcaggtgctatgctgctgcggcgacgccacgccggcggcctcgcgggcgcgggcgacgacgacggggtcggcaatgccgaagaggtggcggcctcagtggagcaggcgttcgcggacgagcccgtgccgtcgtggagggagcagctcacggtgcgcgccttcgtggtggggttcatcctcgccgtcttgttcagcgtcatcgtcatgaagctgaatctcaccaccggcgtcatcccctcgctcaacgtctccgccagccttctcggctacttcctcgtccgcctctggacgaaggcgatcgagagcgtgggcttgctgaagcaccccttcacgcgacaggagaacaccgtcatccagacctgcgtcgtctccgcctatggcctcgcctttagtggtgggtttggcagttacctgtttggtatgagtcgaaccattgctatacaagcaacagaggccaatgatgcccagaatatcaaggatccgcaactcggatggatgatagggtttatgttcctcgtcagttttgttggacttttcgttctggttcctctgagaaaggttatgattgtcgactacaaactgacctaccctagtggaactgcaaccgcttatctcatcaatggattccacacaccccagggtgccgaacgtgcaaagaagcaagttcgaactttgggcaagtacttctcactcagtttcctttgggccttcttccagtggttctacacagctggtgacgactgtggatttgcctccttcccaacactcggccttgaagcttacaaaaacaagttctattttgatttctcagctacttatgttggtgttggaatgatatgcccatatatcgtaaatgtctctcttcttcttggaggcatcatttcgtggggattaatgtggccacttatcagcacaaagaaaggaagttggtaccccgaatctcttcctgatagcagtctacatggactaaatggttacaaggtgtttataaccatagccgtaattcttggggacggcctgtacaacttcttgaaagtattcggtcacacaataggcgcattaatatcaatgtattggaagaaacatgcaaacagacttcctgtgtctgacaatatgacccctcctgccacagttgaaaccgagtcatttgacgacaagcgtcgcattgagctgttcgttaaggatcagattcccaagacagttgcattgggtggctatgtcgttctggcagctacatcgatcggctgcctccctctcatcatccctcagatcaagtggtaccagatttttgtggcatacatcttcgcacctatactagccttctgcaatgcctatgggtctggcctaacagattggtccctcgccagcacctatggcaagcttgcaatctttgtcatcggtgcatgggcaggggcttcacatggcggagtgcttgttgggttagctgcatgcggtgtcatgatgagcattgtgggaacagcttctgatctgatgcaagacttcaagaccgggtacctgactctagcctcgccaaggtccatgttcatcagccaggtgataggcactgccattggatgtgttactgcaccatgtgtcttctggttgttttacaagtccttcgacattggtgcgagtggtggcgcttatccagcaccttacgccatcatgtaccgtaatatgtcaatcctgggcgtggatggcctgtccttgcttccaaagaactgcctcacgctatgctacatcttctttgctgtttccttcaccatcaatttgatcaaggatcttgtgccaaagaaggttgccaagttcatccccatccccatggcagcagcaattcctttctaccttggaccatactttgctattgatatgttcttgggcagtgtgatactcttcttttgggaatggaagaacaaagctgaagcagactcgttcggaccagctgttgcgtcaggcttgatgtgtggcgatgggctctgggcactgccccaggctgttctttctctagccaatgtgaaacctcctatttgcatgaagtttttgtcgaggtctttgaatgccaaagtggacaccttccttgggaactagacgagtgatagtttgatcggagtataattctcctttgtatgctaagatgaaagtggttaaataattctagtcttgtaaatttatattggtctattgtgtagtggtctatttagtttaggctggtgccaatggggcgacagcgttgaatgtactttctttcgatggttgctcctccattaaatcataatatactttggagact

SEQ ID NO: 2577 - DNA, 2139 bp, Oryza sativa Japonica Group
atggcgtcggccgccgccaacaacagtagctcggccgcctacgatgcggcggagacaggcggcctcctccgccgccgcaacaccaccgccgccgcccgcggcaatgcgggggaggaggaggaggaggcggaggcggtggcgccgtccgtggagcaggcgttcgcggacaagcccgtgccgtcgtggagggagcagctgacggtgcgcgccttcgtggtcgggttcctcctctccatcatgttcaacatcatcgtcatgaagctgtccctcaccaccggcgtcatcccctcgctcaacgtctccgccagcctcctcggcttcttcctcgtccgcctctggacggcggccatcgagagggtgggcttcctcaagcagcccttaacccgccaggagaacaccgtcatccagacctgcgtcgtctccgcctacggcgtcgccttcagcggtgggtttggcagttacttgtttggtatgagcgagaccatagctaagcaagcaacagaggctaatgatccgatgaatatcaagaatcctcaccttggatggatcatcgggttcatgttcctcgtcagttttgttgggctatttgcactggtgcccatgcgaaaggtgatgattgtggactataaactgacctacccaagtggcactgcaactgcttaccttattaacggattccacacacctgagggtgctgatcttgcaaagaaacaagtccggacattaggcaagtacttttcgattagcttcctctgggctttcttccagtggttctacactgctggggacaactgcgggtttagctccttcccgacatttggccttgaggcttttaagaacaggttctattttgatttctcacctacctatgttggtgttggaatgatctgcccctatatcgtgaatgtgtctcttctcattggtggcatcatctcatggggcataatgtggccactcataagcaagaagaaaggaagttggtaccccgagacacttccagaaagtagtctacttggactgcaggcttacaaggtgttcataaccatagcagtaattcttggggatggcctttacaactttgtgaaggtcttcggctacacaatcaaaggcttcatagttatgtataagaacaaaaactcaaacacgcttcctatctccgacaatggcactcctgccaacgccactgaagaggagtcatttgatgacaagcgtcgcaatgaactattcctgaaggatcaaattcccaagacagttgcgattgggggctatgttgttcttgcagttataacgagtggttgcctccctctcattatcccacagctcaagtggtactatatattgattgcatatatatttgcacctataatggccttctgcaatgcctatggaagtggcctgacagattggtccctcgccaccacctacggtaagcttgcaatatttgtgtttggtgcgtgggcaggcgcttcgcatggtggtgtgcttgtaggactggctgcctgtggtgtcatgatgaacattgtgggaacagcttctgatcttatgcaagacttcaagactggatatatgactttagcctcgccaagatccatgtttgtcagccaggtgataggtactgccatggggtgtgttattgcaccctgcgtcttctggctgttctacaaatcctttaatatcggtgcaagtgatggtgcttacccagcaccttacaccattatgtaccgtaacatggcgattctgggtgtcaatggattatcctcattgccaaagtactgccttacactatgctacatagcctttgttgctgccttcatcatcaatctgataaaagacctggtaccagagagagtggcaaagtacatcccgatccccatggcagcagcaattcctttctatcttggaccatacttcgccattgatatgttcatgggcagcgtaattctctatttctgggaatggaggaacaaagatgaagcgcagtcgttcggtccagcagttgcgtcgggcttgatgtgcggtgatgggctatgggccctacctcaggctgttctttctcttgtcaacgtgaatcctccgctttgcatgaagttcttatcaagggctgccaatgccaaagtggatacattcctcggtaactaa

SEQ ID NO: 2578 - DNA, 2471 bp, Zea mays
tcacagcctacggcctgctctggctctgcctgtagagggctagagctacaagctacaactctgaaagtctgaacagtgcgccgcccaaccagagatggcgccgcataccaccgcagccgccggcggcggcggcggcgaggaggcgctggaggaggccagcactctccggcaccgccacagcgctgccaaggacggcggcgaggagggccaggccaacaacggggtcgccgccgccgccgacgacgacggggaggggaacgcgctgtcggtggagcgcgcgttcgcggaccaggcggttccgtcgtggcgggagcagctgacggtgcgcgccttcgtggtcagcttcttcctggccatcatgttcagcgtcatcgtgatgaagctcaacctcaccacggggatcatcccctcgctcaacgtctccgcggggctcctcggcttcttcttcgtacgcctctggaccgccgccatcgagagggttggcctcctcaggcagcccttcacgcgccaggagaacaccgtcatccagacctgcgtcgtcgcagcctacgacatcgccttcagcggtgggtttggtacatacttgtttggcatgagcgaaaccatcgccaagcaagcaacagaggctgacaatcctcagaatgtcaaaaaccctcacatcggatggatgatagggtttctcttccttgtcagtttcattggcctatttgctcttgtgcctctgagaaaggttatgatcgtcgactacaaacttacgtatcctagtggcacggcgactgcttatctcatcaacggtttccacacgccagagggtgccaagcttgcaaagaaacaagtgaagactctggggaaattcttcttgatgagcttcctctggggcttcttccagtggttctacactggtggagataattgtggattccagaacttccctacattaggccttcaagcttataagaacaagttttacttcgatttctctcctacctatgttggagttgggatgatctgcccccacattgtgaacgtttctgttctactgggaggcatactttcctggggaataatgtggcctctaattggcaaccagaaggggaattggtacgacgccagtctcccagaaagcagtctccatggactgcagggttacagggtttttatatccatcgcaataattcttggagacggcctgtacaacttcgtgaaggtgctcattcgcaccaccgcggggttcatatcgatgatgaagaaaaacagcacgcttccggtttcaaacaatggcagccccatcactgaaggtgtttccttcgatgacgaacgccgcagggacctgttcctgaaagaccagatccccagatcagttgcctacggagggtacgtggctgtcgctgccatctcaatcggcacccttcctcaggtcttcccgcagctcaagtggtactacatcctggtggcgtacatcttcgcgcctgtgctggccttctgcaacgcgtacgggactggccttaccgactggtccctcgcgtccacctacggcaagctcgccatcttcatcttcggcgcgtgggccggcgcgtcgaacggcggcgtcctcgtcgggctagctgcctgcggcgtgatgatgagcatcgtgtcgacggccgccgacctgatgcaggacttgaagaccgggtacctgacgctggcatcgcccaggtccatgttcatcagccaggtgatcggcacggcgatgggctgcgtcatcgcgccctgtgtcttctggctcttctacaaggccttcgccgacatcggcctcagcggcagcgagtacccggcgccctacgccatcgtgtaccggaacatggccatcctcggcgtggacggcttctcgtcgctccccaagaactgcctcaccctctgctacatcttcttcgcggcggccatcgtcgtcaacctggtcagggacctggtgccgaagaaggtcgccaggttcatcccgctcccgatggccatggcgatcccgttctacctcgggtcattcttcgccatcgacatgttcatcggcaccgtgatcctcttcgcgtgggagacgatcaacaaggccaaagccaacgccttcgcgccagcggttgcgtcggggctgatctgcggcgacggcatctggaccctgccgcagtccattcttgcgcttgccaaggtgaagccgcccatctgcatgaagttcttgtccaggtcggtgaatgcccaggtggacggcttcctcggaagttgaaaactgttgaaatcgtgacgtgcatgtatattgtgttgatgcaccatgcgtgctgtaaaacgtaccgggtaatgttgtgtcgacacgttctggttttgatgtacatgagtaagtacactagtcgtagggattgctaaattaatgtttggcgtatacgcgtcagcattagtaatgtacatgagtaagtaccaacatctgtatgttacctgggttcaaattt

SEQ ID NO: 2579 - DNA, 2187 bp, Sorghum bicolor
atggcgccgcacaccaccgcggcgggaggcggggacgggggcgaggaggaggtgtcggaggcggcggccgcatccccagccgcgctgcggcaccgccacgcgggcggcaagggcgacggcgacggcgacgggctgggcggcaatggcggcggcgctggggccgacggcggcggccaggcggcggcgtccgtggagcgggtgttcgcggacaaggcgttgccgtcgtggcgggagcagctgacgctgcgggcgttcgtcgtcagcgcgctgctcgccgtcatgttcagcgtcatcgtcatgaagctcaacctcaccacggggatcatcccttccctcaacgtctccgcggggctgctcggcttcttcttcgtccgcatgtggaccgccgccgtcgagcggatgggattcctccgccagcccttcaccaggcaggagaacaccgtcatccagacctgcgtcgtctccgcctacggcatcgccttcagcggtggctttggcagctatctatttggaatgagtgacaaaatagctaatcaagcaacagaggctaaagatgctaataacataaaggatcctcaccttggatggatgatagggttcctattccttgtcagttttattggtctctttgcgcttgtgcccctaagaaagattatgattgttgactacaagctgacctatccaagtggcacagccactgcatatctcatcaacggttttcacacacctgagggagccaagcttgcaaagaagcaagtaaagacgttgggcaagtacttcgtgttcagctttttctggggcctttttcagtggttctacactgcaggggatgagtgtggattcaaaaatttcccaacattgggccttgaagcttataacaataggttctactttgacttctctcctacgtacgttggagttggcatgatctgcccgtacatcgttaatgtgtctgttctactgggtggtattctctcatggggtgtaatgtggcctctcattgccaagaagaaggggagttggtacccggctaacctcgaagactcaagtctacatgggctgcaggcttacagggttttcatttccattgctttgatccttggggatggtttatacaacttcattaaggtgctgatccgcacaattgcgggcttcatatcaatggtgcagcaaaattcaaaaatcatgcttcctgtttcagacaatggcagttccatgtccagtaccgaagctgtatcctttgacgatgaacgtcgcattgagatttttctgaaagatcaaattcccaagtcagttgcatatgggggctatgttgcagttgccgcaatatctatcggcacccttcctcagatcttcccgcagcttaagtggtactacattttggttgcctatgtcgtggcacctgtcctggccttctgcaacgcttatggaagtggcctcactgattggtctctcgcctccacctacggcaagctcgccatcttcgtgttcggtgcatgggccgggctctcgcaaggtggcgtgctcgttgggctcgctgcttgtggtgtcatgatgagcatcgtgtcgaccgcctcagacctgatgcaagacttcaagactgggtacctgacactggcgtcaccgaggtctatgttcatcagccaggtgatcggcaccgggatggggtgtgttatcggcccctgcgtcttctggctcttctacaaggcgttcggtgacattggcgagagtggcaccgagtacccggcaccctacgccatcgtgtaccgcaacatggccatcctcggcgtggatggcttccgctccctcccggaaaactgcctcaccctctgctacattttctttgcggcagcgatcgtcatcaaccttgtgagggacctgaccccacagagggtgtcgaggttcatcccgctgccaatggcgatggcaatcccgttctacatcggatcctacttcgccatcgacatgtttctgggctgcgtgatcctcttcgtgtgggagcagctgaacaaggcgaaagcggacgcgtttggacctgcggtcgcgtcgggactgatctgcggagatggcatctggaccctgccgcagtccattctggccctcgccaaggtgcagcctcccatttgcatgaagtttttgtccagatcgaccaatgccaaggtggacagcttcctcgggttgtcatga

SEQ ID NO: 2580 - DNA, 2151 bp, Oryza sativa Japonica Group
atggcgtcgcacgcgaacgcctccggcggcggcggcgacgaggagatggtggaggcgagcacgctccgccaccggcacggcgccggcaaggatgccaacggcgtcggaactgagcggcagctggcggcggcggcggcggaaggggagraggaggggcctcgtcggtggagcgcgcgttctggacagggcgtgccgtcgtggcgggagcagctgacggtgcgcgcgttcgtggtgagcttcttcctctccatcatgttcagcatcatcgtgatgaagctgaacctcaccaccgggatcatcccgtcgctcaacgtctccgccggcctcctcggcttcttcttcgtccgcctgtggacggcggccatcgagcgggtggggctcctccggcagccgttcacgcgccaggagaacacggtcatccagacctgcgtcgtcgccgcctacggcatcgccttcagcggtgggtttggcacatacttgtttggtatgagtgaaacaattgctaagcaagcaacagaggctaataatgctcagaatgtcaagaaccctcacatcgggtggatgattggattcctcttcctcgtcagttttattgggctacttgctcttgtgcctctgagaaaaattatgattgtcgactacaaactgacctatccaagtggcacggcaacagcttatcttatcaatggcttccacaccccagagggtgcaaagcttgctaagaagcaagtaaaggaactggggaaattctttttgttcagcttcgtttggggcttctttcagtggttctatactgccggagatggttgtggattccagagcttccctacattaggccttcaagcctataaaaacaggttttactttgatttctcccctacctatgttggagtagggatgatttgcccccacattgtgaacgtatctgttctattgggaggcatcctctcatggggaatcatgtggcccctgataagaaacaagaaagggagttggtatgctgcctctctctcagaaactagtcttcatggactgcaaggctacagggtgttcatatccattgccttgattcttggaaacggcctgtacaacttcgtgaaggtgctcatccgaaaaaccgctggcttcgtcgtgatgatgaagaagaacagcacgcttccggtctccaacaatggcagcccgatggtggccactgaagccatctccttcgacgacgagcgccgcaccgagctcttcctcaaggaccagatccccaagacggtcgcgttcggggggtacgtcgccgtcgccgccgtatcgatcggcacgctcccgcagatcttcccgcagctcaagtggtactacatcctggtcgcctacgtcttcgcgcccgtgctggccttctgcaacgcctacggcgccgggctgacggactggtcgctcgcgtccacgtacggcaagctcgccatcttcatcttcggcgcgtgggccggcgcgtcgaacggcggcgtgctggtcgggctcgccgcctgcggggtgatgatgagcatcgtgtcgacggcgtccgacctgatgcaggacttcaagacggggtacctgacgctggcgtcgccgaggtccatgttcgtcagccaggtgatcggcacggcgatggggtgcgtcatcgcgccgtgcgtcttctggctcttctacaaggccttcgccgacatcggcgtgagcggcaccgagtacccggcgccgtacgccatcgtgtaccggaacatggccatcctcggcgtcgacggcttctcctcgctgcccaagcactgcctcacgctgtgctacatcttcttcgccgcggcgatcgccatcaacctggcaagggacctggcgccaagcaaggtggcgaggttcatcccgctgcccatggcgatggcgatcccgttctacatcggctcctacttcgccatcgacatgttcatcggcaccgtcatcctcttcgtgtgggagatggtgaacaaggccaaggcggaagcgttcgcgccggcggtcgcctccggcttgatctgcggcgacggcatctggacattgccgcagtccatccttgccctcgccaaggtgaagccgccgatctgcatgaagtttctgtcgcgatcggtgaatgcgcaagtggatggtttcctgggtaactag

SEQ ID NO: 2581 - DNA, 2534 bp, Sorghum bicolor
accagtcagtccacacagaaacagccagcctacagaggctagaactctgaacagtgcgccgcccaaccagagatggcgccgcaaaccaccgcagccgccggcggaggaggagaggaggcggtggaggaggccagcactctccggcaccgccccaacgctgccaagaacggcggcgaggaggaccaggccaacaacggggtcgcctcctcccagctgccgctgccgaccgccgagggggaggggaacgcggcgctgtcggtggagcgcgtgttcgcggagcaggcggtgccgtcgtggcgggagcagctgacggtgcgcgccttcgtggtgagcttcttcctggccgtcatgttcagcatcatcgtgatgaagctgggactcaccacggggatcatcccgtcgctcaacgtctccgcggggctcctcggcttctttttcgtccgcctctggaccgccgccatcgagagggtcggcctcctcaagcagcccttcacgcgccaggagaacaccgtcatccagacctgcgtcgtcgccgcctacgacatcgccttcagcggtggatttggcacttacttgtttggcatgagcgaaaccatcgccaagcaagcgacagaggctgacgatcctcaaaatgtcaagaatcctcacatcggatggatgatagggtttctcttccttgctagtttcattggcctgtttgctcttgtgcctctaagaaaggttatgattgtcgactacaagcttacatatcctagcggcacagcaactgcttatcttatcaatggtttccacacgccagagggtgccaagcttgcaaagaaacaagtaaaaactctgggaaaattcttcttgtttagcttcctttgggggtttttccagtggttctacactggtggagataattgtggattccagaacttccctacattaggccttcaagcttataagaacaggttttacttcgatttctctcctacctatgttggagttgggatgatctgcccgcacatcgtgaacgtgtctgttctactgggaggcatactttcctggggaataatgtggcctctaattcgcaacaagaagggtagttggtacccagccagtctctcagaaagcagtcttcatggactgcaaggttacagggtttttatatccatcgctataattcttggagatggcctgtacaactttgtgaaggtgctcattcgcactaccataaggtttatatccatgatgaagaaaaacagcacccttccggtgtcaaacaacggcagccccatcgctgaagctgtttccttcgacgacgaacgccgcacggagctgttcctgaaagatcagatccccagatcagttgcctatggaggttacgtggttgtcgctgccatctcaatcggcactcttcctcaggtcttcccgaacctcaagtggtactacatcctggtcgcgtacatctttgcgcccgtgctcgccttctgcaacgcctacgggactggcctcaccgactggtccctcgcgtccacctacggcaagctcgccatcttcatcttcggcgcgtgggctggcgcgtccaacggcggcgtcctcgtggggctcgccgcctgcggcgtgatgatgagcatcgtgtcgacggccgccgacctgatgcaagacttcaagaccgggtacctgacgctggcgtcgcccaggtcgatgttcatcagccaggtgatcggcacggccatgggctgcgtcatcgcgccctgcgtcttctggctcttctacaaggccttcaccgacatcggcatgagcggcagcgagtacccggcgccctacgccatcgtgtaccggaacatggccatcctcggcgtggacggcttctcgtcgctccccaagaactgcctcaccctctgctacatcttcttcgcggcggccatcgtcgtcaacctgatcagggacctggtgccgaagaaggtcgccgggttcatcccgctgccgatggccatggcgatcccgttctacctcgggtcctacttcgccatcgacatgttcatcggcaccgtgatcctcttcgcgtggcagatgatcaacagggccaaagccgacgccttcgggcctgccgttgcgtcggggctgatctgcggcgacggcatctggaccctgccgcagtccattcttgcgctcgccaaggtgaagccgcccatctgcatgaagttcctgtccaggtcggtgaacgcccaagtggacggcttcctcggaaattaaactgtgaaattacgatctgtcagcagtcagcatgaatcacaagtgtatattgtgttgatgctccatgctgtaaaatgtaccgggacgggtaaatgttgcttcgtcacgatctgcttttgctgtacatgagtaagtacactagtcgtaggaatttgccaaactaatgtttgccgtacacgcgtcagcattatggtaccaacagctgtatgttaactatatactgtaagacgttttgactcgaaattgttttcactgtgacgagtcaaaacccataattagcagatacagctgtt

SEQ ID NO: 2582 - DNA, 2096 bp, Sorghum bicolor
atgaagtacatgaagcttggatcaaagccggatgtctttcagacagagggcagcaatatcaggtttgttgcaacagagctggcaacagacattgttatatccattggggatgtcaagttttatcttcacaagttccctcttctatcaaagagttcacgcctgcaaaggttagttgcttcaagcaatgaggagaaaaatgatgaagtggatatctctgacatccctggtggaccttcagcatttgaaatatgtgctaagttctgctatggcatgattgtaacactcaatgcatataatgtcctcgctgcccgctgtgcagctgagtacctagaaatgtttgagaccattgagaaaggaaaccttatatacaagattgatgtttttctaacatcaagtgtatttcgcacctggaaggactcgatcatagttttacagagcacaaagtcactactgccttggtgtgaaaatttgaaggtaattaaccactgcattgactctatcgcgtcgaaggcgtcaattgatccatcagaggttgaatggtcatacacttacaacagaaagaaactcccatctgagaatggtattgattcacattggaatggtgtcaggaagcaacctatggtccctagtgactggtgggttgaggacctttgtgagcttgaagtggatttgtacaagcgggtgatcatgaccgtcaaagcaaagggaagcacaccagctgttgtcattggagaagcattgagggcctacgcataccgacggctgcttggctcccttgaagatgctgtgagcaatggagtcgattgcacaaaacgtcgtgcagctcttgatgctattctatttctcttgcccgctgaggaaggctcagtgtcatgtggttttcttcttaagctgctaagagctgcatgtttgctgggatctggggagtcccatcggattaacttgatcaagagaataggcacacaattggatggtgcttcagtttcagaccttcttataccaccaaatactgatgaaaacaatacatacaacatagatctgatcatgccaatagtggaagaattcatgttacagaatagtgatagtggtaaggaaaaatttcaagatgatgaagaaatcgtggagattgagaacgtgacatctgtttccagcacgtcaaaactggcagttgcaaagctgatcgatggatatcttgctgagattgccaaagatcccaaccttcctcttccaaagttgatcgcacttgctgaaatggtgtcttctctaccccggccaacacatgacgggctctatcgtgccattgacatgtatctgaaggagcaccccggcctatcaaagagcgaaaagaagaaattatgcggactgatggactgcaagcagctgtcacaggatgcgtgcatgcacgccgtgcagaatgagcgtctccccttacgcgtggttgtgcaagttctcttctttgagcaagtccgggcatcagttgcttctgcaaggagcgacccttcatctgagctcccatctgttgttcgctcacttcttcccagagagaatggcaactctattggcagctccaggtcagctgcgaccacgacaaccgaggaggaatgtggggtcccgacatcgagtgacatcaactctttgaggtcaatgaggctcgccaacaacagcggtggaagtgagaggagcagtggcagcagtgacatcaacaagaacagcgatgacaagagcaccgcagggaaggcaaaggggatgctgatgccgaagaagatattgagcaagctctggtctgggaaaacgaacgccggtgagaacagcagctcagacacgtcggagagccctgggtccgtgaacccggaggaggtgaagtccacgcagtcacggatcacaaggcgctcagtatcctagtcgcagggggttaacggtgtcacagcctagttttgttcttgctcttgatttgccttcactagagagtagtagcaatctcaaaatgtggagtactactactgtcctcacttgtcatgtcgccaatggctctcttcttcttcttcttcttttttttttttttggcatgggattgcttgtagctggagtaggtttgg

SEQ ID NO: 2583 - DNA, 2598 bp, Zea mays
gaactaacgagctaagattcctcccctcaccggcgcttgttcccatggtctcccaacaccgagccgccaattattcccactgtcccctcaccacgagatgctgcccttgtgctctgcatgcagatgcaggtgctgccgaggaagaggaggcgctccgggtcctggcttctagacgttgtgaaccagatcttggtgcggttgcccgagtagtttactcgtctagaggaggggtttggttctcgacccgattcggtgggggcttcgccactgggatagggggacagtttggcctgctggatctttatcgccagttgttggttctgtcctttccattgggctggtactttcttgacggattggttaagcgctgtctgtggggttgttgtgctgctcctcccttcatctcgttttgtggtgattggtggggggaggaggaagagctaggaggattctctctcttgttcttgggtcagttcttggcacggcaggatgaagtatatgaagcttggatcaaagccggatgtccttcagacggaggggagcaatatcaggtttgtcgcgacagatttggcaacagacgttgttatattgattggggatgtcaagttttaccttcacaagttccctcttctatcaaagagttcacgcctgcaaagattagttgcttcaatcaatgaggagaaaaatgacgaagtggatatctctgacatccctggtgggccttcagcatttgaaatatgtgctaagttctgctatggcatgattgtgacactcaatgcgtataatgtcctcgccgcccggtgcgcagccgagtacctagagatgttcgagaccattgacaaaggaaacctcatatacaagatcgatgtgtttctgacatcaagtgtgttccgcacctggaaggactcgatcatagttctacagagcacaaggtcactggtaccttggtgtgaggatttgaaagtgatcagccactgcatcgactctatcgcgtcgaaggcgtcgattgatccatcagaggttgagtggtcatacacttacaacagaaagaaactcccgtctgagaacggtatcgattcgcattggaatggtgtcaggatgcaacctatggtccctactgactggtgggtagaggacctctgtgagcttgaagtggactcgtacaagcgggtgatcatgagcatcaaggcaaagggaagcacgccagctgttgtcgtcggagaagcattgagggcctacgcgtaccgacggctgcttggctccctggaagacgctgtgagcaatggagttgattgcgcaaagcctcgtgcagttcttgacgctattgtatctctcttgcccgctgaggaaggctcggtgtcatgtggttttcttcttaagctgctgggagctgcatgtttgctggaatctggtgagtcgtcccatcgcagtaacttgatcaagagaataggcgcacagttggacggtgcttcagtttcagaccttctcattataccaccaaatactgatgaaaacgatacatacagcatagatctggtcatggcaatagtggaggaattcatgtcgttacagaatagcgacagtggcaaggagaaatttcaagatgatgaagagatcgtggagactgagaacgtggcatcggtttccagcacgtcaaagctggcagttgcaaagctgatcgatggatatcttgctgaggttgccaaggatcccaaccttcctcttccgaagctgaccgcgcttgctgaaatggtgtcttccctaccccggccaacgcatgacggcctctaccgtgccattgacatgtatctgaaggagcaccccagcctgtcgaagagcgagaagaagaaactatgcgggctgatggactgcaagcagctgtcgcacgatgcgtgcatgcacgccgtgcagaacgagcgtctccccttgcgtgtggtcgtgcaggttctcttcttcgagcaggtccgggcgtctgtcgcctctgcgaggagtgacccttcttcagctgagcttccatctgccgttcgctcgcttcttcccagagagaacggtaactctgttggcagctccaggtcagctgccacgacgacaacggaggaggacggatgtggggtcccgacgtcgagtgacgtcaactcgttgaggtcaacaaggctcgccaacaacagcggcggaagcgagaggagcagtggcagcagcgacatcaacaggagcgccgcggggaggggggcaagggggattctgatgccgaagaagatgctgagcaagctctggtctgggaaaacgaacgccggtgagaacagcagctcagacacgtcgcagagccctgggtccgtcaacaacccggaggaggtgaagtccacgcagtcaaggatcacaaggcgctcggtatcctagtcgcggaggggtaaccgcggtcacagcctagttttgttcttgctcttgatttttgccttcactggagagtagtggcaatctaaaaaatgtggagttactggagtaggtttggtcattgatgatgttttcagccatgttccatgggaactttttacatacaaagaaagtataggttgttataattgatgtatttttgctggc

SEQ ID NO: 2584 - DNA, 2728 bp, Zea mays
cccctcaccacgagatgctgcccttgtgctctgcaggtgctgctgctccccctgccgcccgcgtcctgtgactgagatccatccagctcggaggaggaggaagaggaggcgctcctggtcctggcttctagacgttgtaacccagatcttgacgcagctgcccaagtagtttactcatctagaggagaggaggggttggatccttgacccgatttggtgggggctttgccactgggatagggggacagtttggcctgctggatctttatcgccagttgttggtcctgtcctttccgttgggctgggacgcattcacatgccagtggctgccggtttggtacttactcgacggattggttaagctctgtctgtggggttgttgtgctgctccttctttcatcttattttgtggtgattggtgggcggaggaggaagagctaggaagattgtctctcttattcttcttgcgtcatttttcggtgcggcaagatgaagtatatgaagcttggatcaaagcctgatgtctttcagacagagggcagcaatatcaggtttgttgcaacagaactggcaacagacattgttatatccgttggggatgccaagttttatcttcataagttccctcttctatcaaagagttcactcctgcaaaggttagttgcttcaagcaatgatgagaaaaatgatgaagtggatatctctgacatccctggtggaccttcagcatttgaaatatgtgctaagttctgctatggcgtgattgtaacactcaatgcatataacgtcctcgctgcccgctgtgcagctgagtacctagaaatgtttgagagcatcgacaaaggaaacctcatatacaagatcgatgtgtttctgacatcaagcgtatttcgcacctggaaggactcgatcatagttttacagagcacaaagtcactgcaaccttggtgtgaaaatctgaaggtaatcaaccactgcattgactgtatcgcgtcgaaggcgtcaattgatccatcagaggttgaatggtcatacacttacaacagaaaaaagctcccatctgagaatggtatcgattcacattggaacggtgtcaggaagcaacctatggtccctagtgactggtgggttgaggacctttgtgagctcgaagtggatttgtacaagcgtgtgatcatgaccatcaaggcaaagggaagcacaccagctgctgtcattggagaagcattgagggcctacgcataccgacggctgcttggctcccttgaagatgctgtgagcaatggagtcgattgcacaaaacgccgtgcagctcttgatgccattgtatttctgttgccagctgaggaaggctcggtgtcatgtggttttcttcttaagctgctaggggctgcatgtttgcttgaatctggggagtcccatcgcgttaacttgatcaagagaataggcacgcagttggatggtgcttcagttccagaccttcttataccgctaaatactaatgaagacaatatatccagcatagatctgatcatggcaatagtggaagagttcatgtcacggaatggtgatagtggtacggagaaatttcaagacgatgaaggaatcgtggacatcgagaagtcgacatctgtttccagcgcgtcaaagcttgcagttgcaaagctgatcgatggatatcttgccgagatcgccaaagatcccaaccttcctcttccaaagttgatcgcactcgccgaaatggtgtcttctctaccccggccaacgcatgacgggctctatcgtgccattgacatgtatctgaaggagcaccccagcctatcaaagagcgagaagaagaaactgtgcgggctgatggactgcaagcagctgtcgcaggacgcgtgcatgcacgccgtgcagaacgagcgtctccccctacgcgtggtcgtgcaggttctcttcttcgagcaagtccgggcatcgtcgtcggttgcttctgcaaggagcgacgctaattcgacgtcggggctcccgtctgccgttcgctcgcttcttcccagagagaacggcaactccattggcagctccaggtcagccgcgacgacgatgacgacggaggaagaggagagtggggtcccgacgtcgagcgacatcaactctctgaggtcgatgaggctggccaacaacagcggtgggagcgagaggagcagcggcagcagtgacgtgaacaacaagagcagcgacgacaggagcgccgccgccacggggaaggcgaaggggacgatgctgatgccgaagaagatgctgagcaagctctggtccgggaaaacgaacgccggcgagagcagcagctcggacacgtcggatagccctgggtccgccaacccggaggaggcgaagtccacgcagtcgcggatcacatggcgctcggtatcctagtcgcgcgcgcgcggcgggggttcagcggggtcacaagctcacagccttagttttgttcttggtcttgattttgccttcgcctagcgagtacagcagtagcgatctcataacatatggagttactgctactggtttcacttgtcatgtcgccgatgacgttttctttttggcatgggattgcttgtagctggagtggagtaggtttggtcattggtgatgtttccagcgaagttccatgggatatttattatgtgacctttttttcatggtaggaatacaaagaaagtagtacagtccgttataattg

SEQ ID NO: 2585 - DNA, 2706 bp, Oryza sativa Japonica Group
gttcttgcgccatctcgcggctggacaggggaggggcgccgatctccatctggcgagcagagcagggcaggggaaggggatcctggttctcagcgtgtgtgatgtgatccagcttgggggaggaagagcttgttggcctcttggcattgcggtctcctggacccagatcttgatgcaactgccgactactttttttttttttactgatagaggtggtctggttgggttcttgacctgattttgtgggggctttgccaccacgcaagggaggcagtttggcctggatctttatcactagctgttggtcatgtcctttgagctagcaagcattcacatggcagtggccgccggtttggtacattcttgatgggttaagtgctgtgggtttgttgtggagttctcttcctggttcccatttggggtggacggtatgtgttgaagggaaaggggcagagatagaaagagcaaaaagaagataggagttcttcggttaattgtttttttcagtacggcgcaatgaagcatatgaaacttggatcaaagccagacctcttccagacagaaggcggcaatatcaggtttgttgcaacggaactggcaacagacattgttatttccataggagatgtcaagttttgtcttcacaagtttcctcttttgtcaaagagttcctgcctgcaaagattagctgcttcaagcaatgtggaaggcaatgaagagttggatatttctgacatccctggtggaccttcagcatttgaaatctgtgctaagttctgctatggaatgattgtaacactcaatgcgtataacgttcttgctgctcgctgtgcagctgagtatctagaaatgtttgaaaccattgagaaaggaaacctcatttacaaaattgatgtcttcttgacatcaagcatatttcgtgcctggaaggattcaatcatagtactgcagagcacaaagtcattgctaccttggtctgaaaatttgaaagtaatcaaccattgcattgactcaattgcatcgaaggcattaattgatccatcagaggtcgagtggtcatacacatacaacagaaagaaactgccatcagagaatggccacgattctcattggaatggtgtcaggaagcaattgatagtccctaaggactggtgggttgaggacctttgtgatctcgagatggatttgtacaagcgggtgatcatgatgataaaagcaaagggaagaacatcgcctatagtgattggtgaggcgctgagagcctatgcataccgcaggctgctgggttccctagaagacgctgtgagcaatggagttgattgcactaaacgccgtgccgtgcttgaaaccatcatatttctgcttcccactgagaaaggctccgtgtcatgtggttttcttcttaagcttctcaaagctgcatgcttgctggaggctggggagtcttgtcatgatatcttgatcaagagaataggcacacaattggatggtgcttctgtttcggacctccttataccggcaaacactagcgaaaacacgttatataatgtaaacctgatcattgcaatagtggaggagtttgtttcgcgacaaagtgatactggcaagatgaaatttcaagatgatgatgagattgtggaggttgagaaccttactcctgtttccagcacctcaaatctggctgttgcaaatcttattgatgggtatcttgctgagattgctaaagacaccaatcttcccctttcaaagttcatcgcaattgctgaaatggtgccccctgcatcccgcaaaaatcacgatggtctatatcgtgccattgacatgtatctcaaggagcaccccagcctatcaaagagcgaaaagaaagcattatgcagattgatggattgcaagaaactgtcccaggatgcgtgcctgcacgccgtgcagaacgagcgccttcctctgcgtgtggttgtgcaggttctcttctttgagcaaattcgggcatcagccgcttcggggcggaccgatgccgcagcagagctcacctctgctgtacactcactactccccagagagaatggaaactcctatggcagctccaggtcagcggccaccacgacaaccgaggaggacgggaccggggtcccgacctccagcgacatcaactcgttcagttcactgaggctggccaacaacagcgggggcagcgagaggagcagtggcagcagcgacatcaacaacaagagctgtgacgacaagagctccagcaagtccaagggatcgctcatgcccaagaagatcctgagcaagctctggtccgggaaaacaaacgccagcgagaacagtagctcggacacgtcggagagccctgggtcactcaacccggaggaggtgaagtccacaacgtccaggaatacaaggcgtttggtaacctagtgtcaacagagccagccatggtttttgtttttgtttcttttttggctttgatttgccttcagatgagataaaaaaaagtagtactagcaatctttagaatgtggaatactactgactggcagtccctccgatggcagatagtgttttttatagcattgttattatgctggcatttgctataggtttggtcatcggtaaatttgttcaggaacgtttcatgatatagtcttgtaatttttttggtggaaatataaagataaaggaaggaaagatcttttattgacc

SEQ ID NO: 2586 - DNA, 3054 bp, Oryza sativa Japonica Group
cttcttgcattggagtagcagcaaagcaagctgaacaagctgtccctcccgggaaaaacacacaggagctgaggtgcaagatgtctgcttgattgcctcctgcttcacttcactgcttctcttccttctccctctcctctctgcaatcttcttgtatttttctccctagctctcctgcatcagcatcagttcttgcctgtggctaaggatcttttgatcttcaaagggagagaaaaggatcttgcctgagcttcagtttcttgtgctgcctcctcctctgtgtttgtgtgatccaatttccaacttggaggagttcttggtttcctggcattgtgctttcttggacccagagcttgacaagattgggtcaatagtttgccaatctagagagagagagagaatacttggtttcttggcaagggggacaccagggcatagatctttgtagttaatagttgctcttgccctctggactgaggagtaaatagttgtgtgccagtggtctcttgcttcatcttggtcttgtggttctgattttctggtgattgttggagacttggaggagtaaagtaaagggtgaaaaaaagaagggaaataagaagaaaaaaaggtgacagattgaggttgttcttagtgtgtcaagatgaagtatatgaagcttggatcaaagccagatgtgtttcagacagagggaaacaatatcaggtttgtcgcaactgagttggcaacggacatcgtaatcattgtaggggaagtgaagttttatcttcacaagttccctcttttgtcgaagagttcgcgattgcaaacattggtggcatcgacaaacgaagagagcaacgacgaaatagacatctccgacatcccggggggacctgcagcattcgagatctgtgccaagttctgctatggcatgatcgtcaccctcaacgcgtacaacgtcctcgcagcccgctgcgcagccgagtatcttgagatgttcgagacgatcgacaaggggaacctcatctacaagatcgatgtgttcctgtcctcaagcatattcagaacctggaaggactccatcatcgttcttcagacaaccaagtcactgctgccatggtcggagaacctcaaggtgatcaaccactgcgtcgattcgatcgcgacgaaggcctccatcgatccgtcagaggttgagtggtcatacacctacaacaggaggaagctaccgtcggagaacggcctcgactcgcactggaacggcgtaaggaagcagcagatggtgcccagagactggtgggtagaggatctctgtgaccttgagatgtgcctgtacaagaaggtcatcatggccatcaaggccaaggggagaatcagcagtgaggtgattggtgaggcactgagggcttatgctcacaggaggctgttcagctcactggaaagtgctgtcagcaatgggcttgactgcacaaggcactctgcagctcttgagaccatcatctccctgcttccatctgaggaaggttcagtcccatgctctttcctccttaagcttctcagagcctcatgcttgttgggatcagatgaggcgtgccgcgacaatcttacgaagaggatcggcgcgaagctggatgaggcttcggtctcggacctccttatccccgctaactccgacgaggccgccatgtacaatgtggacatgatctcggcgatgctggaggagttcatggcgcagcaccgcgaggacgatgatggcgccaagctacaagaggatgatgatcaggaagccatggatggtgatgatgacaacctgaatggtgtctcccgcagctcgaagctcgcgatcgcgaagctggttgatgggtatctggctgagattgcgaaggaccccaacctcccactctcgaagttcatcgccctcactgagatggttcccctcgcaactcggcccgtgcacgacgggctataccgcgccatcgacatgtatctcaaggagcatccgggtttaacgaagggggagaagaagaggctgtgcgggctgatggactgcaagaagctgtcgccggaggcgagcatgcacgccgtgcagaacgagcgcctcccgctccgcgtcgtcgtgcaggtcctcttcttcgagcaggtccgggcggcgtcgtcggcgtcggcggcggcggccgccgacatgccgccggcagcgcgctccctcctccccagggagcaggacggcaactcgtacggcagctcgaggtcgacggcgaccgaggacgaccagtgggcgccgccgccgacgacgacgtccgtcgacgtcacctccttccggtcgatgagcctcgccaacaacaagaacggcggcgtctccggcggcggcggcgatcaggccgcctgcaagaagccgccgccgtcgtcggcgtcagcgaaggggagcggcggcggcgggctgatgccgaagaagatactgagcaagctgtggtctggcaaggcgagcagcggcgagaacagcagctccgacacgtcggagagccccggcgaggagacgaggtcgacgccgtcgcggaacacgaggcattcggtgtcctagctgaccatctctccttcttcttcctcctctcgctcttgggagaagtacacgctgtacgcgacgacgccatggatatggtctactccctccgtccaaaaagtgaatctagctctgtatgtgacacattatagtacaacgaatctggatagaaatatgtctagattcgtagtactaggatgtgtcgcatcgagtgttggttttttatgggacggagggagtggtaattactggcaaaatcatcatcatcttctggttaatcttgagccctaacagttgatctacttagtgtgatggcttggttattattagggataggttttgtaaaatttttggtggcaatataaaggagaattaatgtatgtttcaaaatggggaagaattgaagtaggtttcatccgccaagttgtgtacacacacacttgcatttccattgtacagctgttatttatatcattgttatatgtgtttcctatacaatcaattattcaacagcg

SEQ ID NO: 2587 - DNA, 2587 bp, Hordeum vulgare subsp. vulgare
ggagccttgtcccgggaaccacacacagaacctgaatcacgcagatgtctgcttgattgcctctcccatttacgccccgtgcggcgactgcgatcttgggcgcttccggcctgcctcccctggagcggttcttgcggccctcccccaggaaattcggcggagcggttgatatccctggccacaggtgccgtttgtgtggtgtgatccagctttggaggagttcttggattcctggcattgtgctttcttggacccagagctagcttggcaagatttgttgatatagtttgccaatctagagagagtgtgtgtgagagagagagatcctactgaattggtttcttggccttggcaatgccatggagaaagaggaacaccaagacctagatcttcagagttaatcattgctttatagtttagggatcttgtcacttggtgcttcttggttctgatctgtgctgattggattggagacaaggagaaaacagtgaggggattcaggttattctcagtgtgtgaagatgaagtatatgaagcttggagcaaagccagatgtctttcagacagaggggaatatcaggtttgtggcaactgaactagcgacagatattgttatcactgtaggagatgtcaagttttatcttcacaagtttccacttttgtccaagagttcccggttgcaaacattggttgcttccacagacgaggaaggcaacgatgaagtagacatttctgacatccctggtggaccttcatcatttgaaatctgtgcaaagttctgctatggtatgaccgtcacgctgaacgcgtacaacgtcctcgcggcccgctgcgcggctgagtttctcgaaatgttcgagacgatcgacaaagggaacctcatctacaagattgatgtgttcctctcctcaagcatattccgcacctggaaggactcgatcatcgtgttgcagacaacaaagtcactccttccctggtcagagaacctgaaggtgatcaaccactgcgtggattccatcgcggccaaggcttccatcgacccatcggaggtcgactggtcatacacatacaaccggaagaagctgccatcggagagcgaccccgactcgcactggaacggcgtgaggaagcagctgacggtgcccagagactggtgggtggaggacatctgcgacctcgagatgagcttgtacaagaaggtgatcctggccatcaaggccaagggcagaactgccggcgcggtggtcggagaagcgctgcgagcctacgcgtaccggaggctgttcagcaccttggacagtgctgcaagcaatgggcttgactgcacacggcaccgtgcagcccttgacaccatcatttctctgctgccacctgaaaggggctcggtctcctgtggcttcctgctgaagttggtgagagcggcgtgcttactggggtcagacgaggccttgcggggcgacctgatcaagaggatcggctcgcagctggacagagcttcagtctctgatcttctcatacccgcgagctccgacgagaacgctctgtacaatgttgaccttgtgtcgtcgatactggatgagttcatggtgcagcgcaacgccgatgaagaagcgttggaggacggtgagagctacccggcctctttggtctccggcggtgagtcggagctcgcgttggtgaggctgatcgacgggtatctggccgagatcggcaaagaccccaatctccctctccaaaagttcatcgccatcgctgaaatggcgcccctcgcagctcggtcgacccacgatgggctgtaccgcgccattgacatgtatctcaaggagcatccgagcctatccaagagcgagaagaagaggctgtgcgggctcatggactgcaagaagctgaccgcggaggcgagctcccacgcggtgcagaacgagcgcctccctctgcgcttggtcgtgcaggtcctcttcttcgagcagctccgagcatcggcggcggccgacgcggcagcgtctgatcagcacccgtcctcggccctgcgctccctccttcccagagagaacggcaactcgtacggcagctccaggtcggccgccacgaccgcgacgaccaccgaggatgaccagtggggtggtggcggtggcggggcgccggcgtccggcgacaccagctccttccggtccatgagcggcctgggcaacaacaagagcggaggtgacggcggcaagaacggcggcggcaaggcggcagccaaggggccgctacagatgccgaggaagatgctgagcaagctgtggtccagcaaggcgagcagcggggagaacagcggcggctccgacacgtcggagagccccggttccgtcaacctcgacgctgagaccaagtccacgcattcacggaacaccaggcattccgtctcctaggctgccttggcgttcttccctttcttctttcttccatcggggtgcgcgagccatggaggtctcgatcgctgctgaatttgtgtggtttcacctgataaggatgatcatcctgaaagttagtgtatcgtttggttgatttttggtgtctctagaaataaaatctggttttgggt

SEQ ID NO: 2588 - DNA, 2471 bp, Zea mays; identical to SEQ ID NO: 2578

SEQ ID NO: 2589 - DNA, 2534 bp, Sorghum bicolor; identical to SEQ ID NO: 2581

SEQ ID NO: 2590 - DNA, 2151 bp, Oryza sativa Japonica Group; identical to SEQ ID NO: 2580

SEQ ID NO: 2591 - DNA, 2187 bp, Sorghum bicolor; identical to SEQ ID NO: 2579

SEQ ID NO: 2592 - DNA, 2184 bp, Oryza sativa Japonica Group
atggcgcagcacagcgccgcggcggcgggcggggacgaggaggtggcggaggctgaggcggcggcggcggcggcggcsgggagcacgctccggcaccgccacgcgggcaagggcgcggaagagcacgaggcggcgggccgaggccgcggcgggcgcaatggcggcgccgacgacccggacgcgacgtcggtggagcgggtgttcgcggacaaggcggtgccgtcgtggagggagcagctgacgctgcgggcgttcgtggtgagcgcgctgctcgccgtcatgttcagcgtgatcgtcatgaagctgaacctcaccacggggatcatcccgtcgctcaacgtctccgcgggcttgcttggcttcttcttcgtccgcctctggacctccgccgtcgagcggattggcctcctcaagcagccgttcacgcgccaggagaacaccgtcatccagacctgcgtcgtctccgcctacggcatcgccttcagcggtgggtttggcagttatttatttggaatgagtgaaacaatagccaagcaagcaacagaggctaaagatgctcaaaatatcaaggatcctcaccttggatggatgattggttttcttttccttgtcagttttattgggctatttgcacttgtgcccctaagaaaaattatgattgttgattacaagctcacctatccaagtggcacagcaactgcttatctcatcaatggttttcacacaccagagggtgccaaactagcaaagaaacaagtaaagacattgggcaagtactttctgtttagcttcttctggggttttttccagtggttctacactgctggtgatgactgtggattcaagaacttcccaacattgggccttgaagcttacaacaacaggtttttctttgatttctctcctacatatgttggagttggcatgatctgcccatatatcgtgaatgtgtcggttcttcttggcggtatcctctcatggggtgtgatgtggcctctcattgccaagaagaaaggaagttggtaccctgctgatatctcagacaacagtctccatgggctgcaggcttacagggttttcatatccattgctttgatccttggggatggtttatacaacttcctcaaggtgcttatccgcacaattgcaggctttatatcaatggttcagaacaattcaaaaggcatgcttcctgtttcagacaatggcatgtccatgtccactgctgaagaggtatccttcgatgatgagcgtcgcactgaaatcttcctgaaagatcaaattcctaagtcagttgcatatggaggctacgtcgtagttgctgctctatcgattggcacccttcctgagatcttcccgcagctcaagtggtactacattttggttgcctacatcgttgcacctgtgctggccttctgcaatgcctacggaagtggtctcactgattggtctcttgcctccacctatggcaagcttgctatcttcgtgttcggagcgtgggcgggcctttctcacggtggtgtgctcgtaggacttgccgcttgcggtgtcatgatgagcatcgtgtcgactgcctctgacctgatgcaagacttcaagactggatacttgactctggcatcaccgaggtccatgtttatcagccaggtgatcggcaccgggatgggctgtgtcatagctccctgtgtcttctggctcttctacaaggccttcagcaatattggcacaagcggcaccgagtacccggcgccatatgccatcgtgtaccgcaacatggccatcctgggtgtcgatggcttcaactcgcttccggagaactgcctcactctctgctacatcttcttcgccgcggcgatcgccatcaacctgatcagagacctggcgccgcacaaggtctccaggttcatcccgctccccatggcaatggcgatccctttctacattggatcgtacttcgcgatcgatatgttcctgggcagcgtgatcctctttgtgtgggagaagctgaacaaggccaaggcggatgcgtttggacctgcggtggcgtcagggttgatctgcggtgatgggatctggactcttccccagtccattcttgcccttgccaaggtgaagccccccatttgcatgaaatttttgtcgagggcagccaatgccaaagtggatagcttccttgccggttag

SEQ ID NO: 2593 - DNA, 2709 bp, Hordeum vulgare subsp. vulgare
gacgcctgacgccggggccgggccgtagccatcgcccaagcatttttctctccaccaccaccaccacgccaacggaacgagcaccactgcgagacgccgagtccaagcgccaatggccacgcgcaccacccacggcgccgccggggacgacgacgtggcggaggcggcggggaccacgggccccacgctccgccaccgccacgcgggcaagggcgcggaggaggccggcaatggcggagccagccccgaggacgcctcggtggagcaggtgttcgcggacaaggcggtgccgtcgtggagggagcagctcacgctgcgggccttggtcgtcagcgcgctgctcgccgtcatgttcagcgtcatcgtcatgaagctcaacctcaccacggggatcatcccctcgctcaacgtctccgcgggactgctcggcttcttcttcgttcgcctttggacctccgccttcgagcggatgggcctcatcggccagcccttcaccaggcaggagaacaccgtcatccagacctgcgtcgtctccgcctacggcatcgccttcagcggtgggtttggcagttatctgttcggaatgagtgacacaatagctaagcaagcaacagaggctaatgatgcttggaacatcaaggaacctcacctcggatggatgataggctttcttttcctcgtcagctttattgggatttttgcacttgtgcccatgagaaaaatcatgattgtcgactacaaactgacctatccaagtggcacagcaactgcttatctcatcaatggttttcacacacctgagggtgccaagcttgcaaagaagcaagtgaagatattgggcaggtactttatggttagctttttctggggctttttccaatggttcttcagtggtggcgatgactgcggtttcaagaacttcccaacattaggccttgaagcttacaagaataggttctactttgatttctctcctacatatattggggttggcatgatctgcccacacatcgtgaatgtgtctgttattctaggaggtatcatctcgtggggtatcatgtggcctctcattggcaagaaaaaagggagttggtaccctgcttctctcccagaatctagtcttcatgggctgcaggcttacagggtttttatatccattgctttgattcttggggatggattatataacttcgtcaaggtgcttatccgcacaattgccggcttcatatcaatggttcagaaaaattcgaaagccatgcttcctgtttcagacaatggcagtcccaccgctgaagctatgtccttcgatgatgagcgtcgcactgaactattcctgaaagatcaaatccccatggcggttgcatatggaggctatgccgcggttgcttctatatctatcggaactcttcctcagatcttcccgcagctcaagtggtactacattttagttgcctatgtggtagcacctgtcctggccttctgcaatgcctacggaaatgggcttactgattggtcgcttgcctccacctatggcaagcttgctatcttcgtcttcggtgcatgggctggccttgccaatggcggtgtgcttgtaggacttgctgcatgtggtgtgatgatgagcatcgtgtcaactgcctctgacctgatgcaagacttcaagactggttacttgactttggcatcaccaaagtccatgtttatcagccaggtgataggcacatcaatgggttgtgtcatttccccctgtgtcttctggctgttctacaaggctttcagcgacatcggtacaagcggcaccgaatacccagcaccgtatgccattgtgtaccgaaacatggcgatattgggtgtggatggcttcaacacgcttccagcgaactgcatgactctctgctacatcttcttcgctgcagctattgccatcaacctgataagagacttgacaccgcacaagttttcgaggttcatcccgctccctatggcaatggctatacctttctacataggatcgtacttcgcaatcgacatgttcctgggcagcttcatactctttgtgtgggagaaggtgaacaaggcaaaagcagatgccttcggacctgctgttgcttcagggttgatctgcggagatgggatttggaccctgcctcagtcaattcttgcccttgccaaggtgaacccccccatttgcatgaagttcttgacaagaggagacaatgtcaaagtggacaaattccttggtggctagtcatggtcagtcgtggtcttctatggaggacaagggacaaccgcaagccacggccacgcatcagcatcagaatgtaattacagccacttcccaggacacttgttttgtaggccagaagttaggtccatgcaagcgagaattatccgtatgaatccaatttctgaaacgattgtagctgttcctttacaatgtaaaaaaaggaagaggaaaagactcaagaggcagaacaacagattaggtgtagcagaatttcacatttttgtctgtcttgtgtaactatggcatgttgttctgcccggtaggctgcaagttgtgtacttgtgagttgtgtgacatgttcctacagaaagcgggtgcttccattactgaggttacaatgcaactgtttgtcacgcctgtagacgcagacacagcggactgaagaaatgcaggttcaggttcagaaccctgaattcgcaacg

SEQ ID NO: 2594 - DNA, 2435 bp, Hordeum vulgare subsp. vulgare
ggtgcaccactgcgagacgccgagtccaagcgccaatggccacgcgcaccacccacggcgccgccggggacgacgacgtggcggaggcggcggggaccacgggccccacgctccgccaccgccacgcgggcaagggcgcggaggaggccggcaatggcggagccagccccgaggacgcctcggtggagcaggtgttcgcggacaaggcggtgccgtcgtggagggagcagctcacgctgcgggccttggtcgtcagcgcgctgctcgccgtcatgttcagcgtcatcgtcatgaagctcaacctcaccacggggatcatcccctcgctcaacgtctccgcgggactgctcggcttcttcttcgttcgcctttggacctccgccttcgagcggatgggcctcatcggccagcccttcaccaggcaggagaacaccgtcatccagacctgcgtcgtctccgcctacggcatcgccttcagcggtgggtttggcagttatctgttcggaatgagtgacacaatagctaagcaagcaacagaggctaatgatgcttggaacatcaaggaacctcacctcggatggatgataggctttcttttcctcgtcagctttattgggatttttgcacttgtgcccatgagaaaaatcatgattgtcgactacaaactgacctatccaagtggcacagcaactgcttatctcatcaatggttttcacacacctgagggtgccaagcttgcaaagaagcaagtgaagatattgggcaggtactttatggttagctttttctggggctttttccaatggttcttcagtggtggcgatgactgcggtttcaagaacttcccaacattaggccttgaagcttacaagaataggttctactttgatttctctcctacatatattggggttggcatgatctgcccacacatcgtgaatgtgtctgttattctaggaggtatcatctcgtggggtatcatgtggcctctcattggcaagaaaaaagggagttggtaccctgcttctctcccagaatctagtcttcatgggctgcaggcttacagggtttttatatccattgctttgattcttggggatggattatataacttcgtcaaggtgcttatccgcacaattgccggcttcatatcaatggttcagaaaaattcgaaagccatgcttcctgtttcagacaatggcagtcccaccgctgaagctatgtccttcgatgatgagcgtcgcactgaactattcctgaaagatcaaatccccatggcggttgcatatggaggctatgccgtggttgcttctatatctatcggaactcttcctcagatcttcccgcagctcaagtggtactacattttagttgcctatgtggtagcacctgtcctggccttctgcaatgcctacggaagtgggcttactgattggtcgcttgcctccacctatggcaagcttgctatcttcgtcttcggtgcatgggctggccttgccaatggcggtgtgcttgtaggacttgctgcatgtggtgtgatgatgagcatcgtgtcaactgcctctgacctgatgcaagacttcaagactggttacttgactttggcatcaccaaagtccatgtttatcagccaggtgataggcacatcaatgggttgtgtcatttccccctgtgtcttctggctgttctacaaggctttcagcgacatcggtacaagcggcaccgaatacccagcaccgtatgccattgtgtaccgaaacatggcgatattgggtgtggatggcttcaacacgcttccagcgaactgcatgactctctgctacatcttcttcgctgcagctattgccatcaacctgataagagacttgacaccgcacaagttttcgaggttcatcccgctccctatggcaatggctatacctttctacataggatcgtacttcgcaatcgacatgttcctgggcagcttcatactctttgtgtgggagaaggtgaacaaggcaaaagcagatgccttcggacctgctgttgcttcagggttgatctgcggagatgggatttggaccctgcctcagtcaattcttgcccttgccaaggtgaacccccccatttgcatgaagttcttgacaagaggagacaatgtcaaagtggacaaattccttggtggctagtcatggtcagtcgtggtcttctatggaggacaagggacaaccgcaagccacggccacgcatcagcatcagaatgtaattacagccacttcccaggacacttgttttgtaggccagaagttaggtccatgcaagcgagaattatccgtatgaatccaatttctgaaacgattgtagctgttcctttacaatgtaaaaaaaggaagaggaaaagactcaagaggcagaacaacagattaggtgtagcagaatttcacatttttgcc

SEQ ID NO: 2595 - DNA, 2357 bp, Zea mays
caaatggcgccgcacaccaccgctggaggcgggggcggagccgaggatgaggtgtccgaggcggcggctgcatcccccgccctgcggcaccgccacgcgggcaagggcgaggggctgggcggcaatggcggcgctggggccgacggccaggcgtccgtggagcgggtgttcgcggacaaggcggtgccgtcgtggcgggagcagctcacgctgcgggcattcgtcgtcagcgcgctgctggccgtcatgttcagcgtcatagtcatgaagctcaacctcaccacggggatcatcccctccctcaatgtctccgcggggctgctcggcttcttcttcgtccgcatgtggaccgccgccgccgagaggatgggcttcctccgccagcccttcaccaggcaggagaacaccgtcatccagacctgcgttgtctctgcctacggcatcgccttcagcggtggctttggcagttatctatttggaatgagtgacaaaatagctaaacaagcaacagaggctaaagatgctaataacataaaggatcctcaccttggatggatgatagggttcctattccttgtcagttttattggtctctttgcacttgtacccctaagaaagattatgattgttgactacaagttgacctatccaagtggcacagccactgcatatctcatcaacggttttcacacacctgagggagccaagcttgcaaagaagcaagtaaagacgttgggcaagtactttgtgtttagctttttctggggcttttttcagtggttctacactgcaggggatgagtgtggattcaaaaattttccaacattgggccttgaagcttataacaataggttcttctttgacttctctcctacatacgttggagttggcatgatctgcccatacatcgtgaatgtgtctgttctgctgggtggtatcctctcatggggtttaatgtggcctctcattgccaagaagaaggggagttggtacccagctaacctggaagactcaagtttacatgggttgcaggcttacagggttttcatttccatcgctttgatccttggggacggtttatacaacttcattaaggtgctgatccgcacaattgcgggtttcatatcaatggtgcagcaaaattcaaaaagcatgcttcctgtttcggacaatggcagttccatgtccagtatggaggctgtatcctttgacgatgaacgtcgcattgagaattttctgaaagatcagattcccaagtcagttgcatacgggggctatgttgcagttgctgctatatctattggcacccttcctcagatcttcccgcagctcaagtggtactacattttagtagcctacgtcgtggcacctgtgctggccttctgcaatgcttatggaagtggcctcactgactggtctctcgcctccacctacggcaagctcgctatcttcgtgttcggtgcatgggctggcctctcacacggtggcgtgctcgttgggctcgcagcttgtggtgtcatgatgagcatcgtgtcgaccgcctcagacctgatgcaagacttcaagaccgggtacctgacgctggcgtcaccgaggtctatgttcatcagccaggtgattggcaccggaatggggtgtgtcatcgggccctgcatcttctggctcttctacaaggcgttcggtgacattggcgagagcggcaccgagtacccggcgccctatgccatcgtgtaccgcaacatggccatcctcggcgtggatggcttcggctcgctcccgaaaaactgcctcaccctctgctacattttctttgcggcagcgatcactatcaaccttgtcagggacctgaccccctacaaggtgtcgaggttcatcccgctgccaatggcaatggcgattccgttctacatcgggtcctacttcgccattgacatgtttctgggcagcgcgatcctcttcgtgtgggagcggctgaacaaggcgaaagcggacgcattcggacctgcggtcgcgtcggggctgatctgcggagacggcatctggaccctgccgcagtccattctggccctcgccaaggtgcagccccccatttgcatgaagtttttgtccagatcgaccaatgccaaggtggacagcttcctcggcttgtcatgattttacacagaatggcaagtagacacgccctcatcctgtaattattggtgcaagatgcaatcaccaggctacagctctgtaaaagagaagaggttttgctgtggagtgaccaaagctttgtccgtgtagtctgtgtcaagaggaaaatactcaatggccctctgcctttttttgtgcaattattaactagcgtattcacagtt

SEQ ID NO: 2596 - DNA, 1990 bp, Sorghum bicolor
atcaacccttaacccagcgagcccagggtagccgaggaggaccgcactccgccatttgccaccgccgcctccgcctccgcctccttttccttgcagcacaagaagaagagagggaagattcgccgcccgccgccgccgccgtcaggatgcattccaccaatctcctcctcgaggagcccatccggatggcgtccatcctcgagccctccaagcctagcttcttcccggcgatgaccaagatcgtcggcacgcttggacccaagtcccgctccgtcgacaccatctccgcctgcctcaaggccggcatgtccgtcgcgcggttcgatttctcgtggggggacgccgcgtaccaccaggagacgctggagaacctcaagctcgccatcaagtccaccaagaagctttgcgctgtcatgctcgacaccgtgggccctgagctgcaggtggtgaacaagaaggagaccacgatctccctcgaggagaatggcacggttgttctcacccctcaccgcggccaagaagcctcctccagcttgttgcccatcaacttctctggactcgccaaggctgtgacaccgggggcaacaatattcgtgggacaatacttgttcactggcagtgagactacttcagtttggttggaggtttctgaagtgaaaggagatgatgtggtctgtataatcaagaacacagccaccttggctgggtcactgttcacactgcattgctcccagattcacattgacttgcccaccctgtctgatgaggataaggatgttatcagaaaatggggtactccgaataagattgacttcctttctctgtcttacacaaggcatgcagaggatgtgcggcaggcacgggagttcctgtcaaaattgggcgatctaagccaaactctgatttttgccaaaattgagaatgttgagggcctgaaccattttgatgaaatactggctgaggcagatggtatcattttgtcaagagggaatctgggaattgatcttccacctgagaaggtctttctgtttcaaaaatctgctcttcacaagtgcaacatggctggaaagcctgctgttgtcactcgtgttgttgacagtatgactgacaacctcaggcctactcgggcggaggcaactgatgtggcaaatgcagtacttgatgggagcgatgccattctccttggtgctgagactctccgaggtttatatccagtcgagactatttcaacagtgggcagaatttgtgctgaggctgagaaggtattcaaccaagatttatacttcaagcgaactgtgaaatatgtgggagaacccatgacccacttggagtccattgcttcctcagcagtgcgagctgctatcaaagttaaggcttcagtgatcatttgcttcacctcttctggacgggctgcaaggctcatcgccaagtacaggcccagcatgcctgttctttctgttgtcattcctcgtctgaagacaaaccaactgaaatggagcttcactggtgcttttgaggcaagacaatcactgatagttagaggcctctttccgatgcttgctgatcctcggcatccagctgaatcaaccaactctacaaatgagtcagttctgaaggttgctctagaccatggcaaagcctctggtgtgatcaagtcccatgaccgtgtcgttgtttgccagaaagtgggagattcgtcagttgtgaagatcattgagctggatgactagatccttgtctactagggcatttgccgatttttgactaggccgaaaattgttggctatgtataatcctatagctttgccaaatgagcagtttttcctatggtgctatcataggacttgcttagcaatttaaaactcctgcgatgcagttgggagttgtcatattatatgccactcaaatgggcagatgggataatgaaatcatactgtaccctctatccgttgctattgtttatctgagcctgtttttcgttttgtttctt

SEQ ID NO: 2597 - DNA, 1863 bp, Zea mays
ttcgcatctgcctccttttccttggagccgaagaagagggaaaggaagggaggacagccgccgccgccgccgccgccgccaccgtcaggatgcattccacgaacctcctgctcgaggagcccatccggatggcctccatcctcgagccctccaagcccagctacttcccggcgatgaccaagatcgtcggcactctcggccccaagtcgcgctccgtcgacacgatctccgcctgcctcaaggccggcatgtccgtcgcccggttcgatttctcgtggggggacgccgcgtaccaccaggagacgctggagaacctcaagctctccatcaagtccaccaagaagctctgcgctgtcatgctcgacaccgtgggcccggagctgcaggtggtgaacaagagcgagaccccgatctccctcgaggagaatggcacggtcgttctcacccctcaccggggccaagacgcctcctccagcttgctgcccatcaacttctctggactcgccaaggcggtgacaccaggggcaacaatattcgtgggacaatacttgttcactggcagtgagaccacctcagtttggttggaggtttctgaagtgaaaggagatgatgtggtgtgtataatcaagaacacagccaccttggctgggtcactgttcacgctgcattgctcccagattcacattgacttgcccaccctgtctgatgaggataaggatgtcattagaaaatggggtactcccaataagattgacttcctttctctgtcctacacaagacatgcagaggatgtgcgccaggcacgggaattcctgtcaaaattgggcgatctaagccagactctgatttttgccaaaattgagaatgtcgagggcttgaaccaatttgatgaaatactggctgaggcagatggtatcattttatcaagagggaacctgggaattgatcttccacctgagaaggtctttttgtttcaaaaatctgctcttcacaagtgcaacatggctggaaagcctgctgttgtcactcgtgttgtggacagtatgactgacaacctcaggcctactcgagcggaggcaactgatgtggcaaatgcagtacttgatgggagtgatgccattctccttggtgctgagactctccgaggtttatatccagttgagactatttcgacagtgggcagaatttgtgctgaggctgagaaggtattcaaccaagatttatacttcaagcaaactgtgaaatatgtcggagaacccatgacccatttggagtccattgcttcctcagctgtgcgagctgctatcaaagttaaggcttcggtgatcatttgcttcacctcttctgggagggctgcaaggctcatcgccaagtacaggcccaccatgcctgttctttctgttgtcattcctcgtctgaagacaaaccaactgagatggagtttcactggtgcttttgaggcaagacagtcgctgatagttagaggcctctttccgatgcttgcagatcctcggcatccagccgaatcaaccagtaatacaaatgagtcagttctgaaggttgctctagaccatggcaaggcatgtggtgtgatcaagtcccatgaccgtgttgtcgtttgccagaaggtgggagattcatcggttgtgaagatcattgagctggacgactagggcatactttgccgattttttttttgacgaggccggaatttgttggctatatgtataatcctatagctttctttacaaatgagcagtttttccctatggtgccatcataggacttgcttagcgatttaaaactcgattatgtgccacctaaaatgggcagatggaacaatgaaatcatactgtgcccttt

SEQ ID NO: 2598 - DNA, 2091 bp, Zea mays
atctccatcccgcatcgcgcatcgcatccaccgccgagctttctttctttctttctttcttttttctgggagaagaggaagaagaggggaggcgcgacaaaaagggcgccgcgccacgcatcgcccccgacgccggcatctctccctcgctctccttctcccgatctgatccgaagcgcggcgtcgacgacgacgacctaagggcacgatgcattcgaccaacctgctgctggaggagcccatccggatggcctccatcctggagccatccaagaccagcttcttcccggcgatgaccaagatcgtcggcacgctcggccccaagtcgcgctccgtcgacaccatctcctcctgcctcaaggccggcatgtccgtcgcgcggttcgatttctcgtggggagacgccgcctaccaccaggagacgctcgagaacctcaagctcgccatcaagtccaccaagaagctgtgcgctgttatgcttgacacggttggaccggagctgcaggtggtcaacaagagtgaaacccccatctccctcgaggagaacgggactgtcgtgctcacgccgcatcagggccaagaagcctcctccaccttgctgcccatcaacttcgatggactcgccaaggctttgacaccaggtgcaacgatatttgtgggccaatacttgttcactggtagcgagactacttcagtttggttggaggtttctgaagttaaaggagatgatgtggtttgtatcatcaagaacacagctaccttggctgggtcgctcttcacgctgcattgttcccagattcatattgacttgcccacgctgtctgatgaggataaggatgttatcaaaaaatggggtgctccaaataagattgacttcctctctctgtcttacacaagacatgcagaagatgtgcggcaggcacgtgagttcctctcgaaattgggtgatcttagccaaactcagatctttgccaaaattgagaatgttgagggcttgaaccattttgatgaaatactggcagaggcagatggtatcattctgtcaagaggaaaccttggaattgaccttccacctgagaaggtctttttgtttcaaaagtctgcgcttcacaagtgcaacatggctggaaagcctgctgttgttactcgtgtcgtggacagcatgactgacaacctcagacctactcgtgcagaggcaactgatgtggcaaatgcagttcttgatgggagtgacgccattctccttggtgctgagactctccgtggtttatatccggtggagactatttcaacagtgggcagaatttgtgccgaggctgagaaggtattcaaccaagatttatactacaagcggactgtgaagtatgtgggagaacctatgacccacttggagtctattgcttcttcagcggtgcgagctgcaatcaaagttaaggcatcagtcatcatttgcttcacctcttctggacgagctgcaaggctcattgctaagtacaggcccagcatgcctgttctatctgttgtcattcctcgtctaaagacaaaccaactgaagtggagtttcacaggtgcttttgaggcaagacaatcactcatagttagaggcctcttccctatgcttgctgatccacgacacccagctgaatctaccagtgctacaaatgagtctgtgttgaaggttgctcttgaccatggcaaagcctcgggcgtgatcaagtcccacgaccgcgtcgtcgtttgccagaaagtgggtgattcctctgtggtgaagatcattgagctggatgattagacaatcaggctatgatgttgtctactagggcacgtttttgccaatttttttgcctaggccgaaacttattggctatgtataatcctatagcgcttgaaaactgagcagtttttcctatggtgccatcataggatttgcttttacagttccaattatggtgtagttcaaaaattgctcgactaaactgcggtgtaacagttaaatgggcagatggaataatgtaatcatactgttccctcgttaggttgtcacttgaattgataatctggccttttttttggttaaaaaaaaaaaaaaaa

SEQ ID NO: 2599 - DNA, 1988 bp, Hordeum vulgare subsp. vulgare
tgaggaggaggagcatcctgcaccgcatcgcactaggtctcgaacattcctctttctcttcattgccttgcttggggaagaagaagaagaagagggcaagcgcccccgcctcccgtcgccgtcgccacccctcgccgccgatctgaactcaggagccagccaagatgcattccaccaatctgctcctcgaggagcccatccggatggtctccatcctcgagccgtccaaaccgaacttcttcccggcgatgacgaagatcgtggggacgctgggtcccaagtcccggtccgttgaggccatctccgcctgcctgaaggccggcatgtctgtggcacgtttcgatttctcgtggggggatgccgcgtaccaccaggagacactcgagaacctcaagatcgccatcaaggccaccaagaagctatgcgctgttatgcttgacactgttggccccgagttgcaagtggtgaacaagagtgaggtcacaatctcgcttgaagagaacgagtctgttgttctcacccctcacaaaggccaggaggcctcttccaaattgctccctatcaacttctctggactcgccaaggctgtgaagcccggagccacaatatttgttgggcaatatttgttcacgggcagtgagactacatcagtttggctggaggtttctgaagttcaaggggatgacgtggtttgtgtgatcaagaactcagctaccctggctgggtcactcttcacattgcactgctcccagatccatatcgacatgcccacgctgtctgatgaggataaagatgttatgaagaaatggggtgctccaaacaaaattgacttcctctctctttcttatacaaggcatgcagaagatgtgcggcaagcacgggagttcctctcaaagttaggtgatcttagccaaactctgatttttgccaaaattgagaatgtggagggcttgaaccattttgatgagatcctggaagaagcagatggtataattctgtcaagagggaaccttggaattgatcttccacctgaaaaggtgtttttatttcagaagtctgctctgcacaagtgcaacatggctggaaagcctgctgttgttactcgtgttgtggacagtatgacagacaacctaaggcctactcgtgcggaggcaactgatgtggcaaatgcagtgctggatggcagtgatgccattctccttggtgctgagactctccgtgggctgtatccagttgagactatttcaacagtgggcagaatttgtgctgaggctgagaaggtcttcaaccaagatttgtacttcaagcgaaccgtgaaatacgttggagaacccatgacccacttggagtctattgcttcctctgcagtgcgggcggctatcaaagttaaggcttcggtcatcatttgcttcacctcatctggacgagctgcaaggctaattgccaagtacaggcccaccatgcctgtcctgtctgttgtcattcctcgtctaaaaacaaatcaattgaagtggagcttcacaggcgcatttgaagcaagacaatcactcatagttagaggcctctttcccatgcttgctgatccacgtcaccccgctgaatctactagtactacaaatgaatctgtgttgaaggttgctcttgaccatggcaaagcatccggtgtgatcaaatcgcatgaccgtgttgttgtgtgccagaaagtgggagattcctctgtcgtgaagatcattgagctggacgactaggcaaaattagcctttgctcagggcttgccagatttttgactaggccaaaacgatgcttggtggctatgtataattctatctatagttttgcaaaacgagctgtttttcctatggtgccatcataggatccgcgttacaattctgaaacttacgctagttattatggatatgtcctcaggttttactgcagtgtagcgagtaaaagatctgatggaataatgatatcaaaactttgcgacc

SEQ ID NO: 2600 - DNA, 2091 bp, Hordeum vulgare subsp. vulgare
ggcggagcatcctgcaccgcatcgcactaggtctcgaacattcctctttctcttcattgccttgcttggggaagaagaagaagaagagggcaagcgcccccgcctcccgtcgccgtcgccacccctcgccgccgatctgaactcaggagccagccaagatgcattccaccaatctgctcctcgaggagcccatccggatggtctccatcctcgagccgtccaaaccgaacttcttcccggcgatgacgaagatcgtggggacgctgggtcccaagtcccggtccgttgaggccatctccgcctgcctgaaggccggcatgtctgtggcacgtttcgatttctcgtggggggatgccgcgtaccaccaggagacactcgagaacctcaagatcgccatcaaggccaccaagaagctatgcgctgttatgcttgacactgttggccccgagttgcaagtggtgaacaagagtgaggtcacaatctcgcttgaagagaacgagtctgttgttctcacccctcacaaaggccaggaggcctcttccaaattgctccctatcaacttctctggactcgccaaggctgtgaagcccggagccacaatatttgttgggcaatatttgttcacgggcagtgagactacatcagtttggctggaggtttctgaagttcaaggggatgacgtggtttgtgtgatcaagaactcagctaccctggctgggtcactcttcacattgcactgctcccagatccatatcgacatgcccacgctgtctgatgaggataaagatgttatgaagaaatggggtgctccaaacaaaattgacttcctctttctttcttatacaaggcatgcagaagatgtgcggcaagcacgggagttcctctcaaagttaggtgatcttagccaaactctgatttttgccaaaattgagaatgtggagggcttgaaccattttgatgagatcctggaagaagcagatggtataattctgtcaagagggaaccttggaattgatcttccacctgaaaaggtgtttttatttcagaagtctgctctgcacaagtgcaacatggctggaaagcctgctgttgttactcgtgttgtggacagtatgacagacaacctaaggcctactcgtgcggaggcaactgatgtggcaaatgcagtgctggatggcagtgatgccattctccttggtgctgagactctccgtgggctgtatccagttgagactatttcaacagtgggcagaatttgtgctgaggctgagaaggtcttcaaccaagatttgtacttcaagcgaaccgtgaaatacgttggagaacccatgacccacttggagtctattgcttcctctgcagtgcgggcggctatcaaagttaaggcttcggtcatcatttgcttcacctcatctggacgagctgcaaggctaattgccaagtacaggcccaccatgcctgtcctgtctgttgtcattcctcgtctaaaaacaaatcaattgaagtggagcttcacaggcgcatttgaagcaagacaatcactcatagttagaggcctctttcccatgcttgctgatccacgtcaccccgctgaatctactagtactacaaatgaatctgtgttgaaggttgctcttgaccatggcaaagcatccggtgtgatcaaatcgcatgaccgtgttgttgtgtgccagaaagtgggagattcctctgtcgtgaagatcattgagctggacgactaggcaaaattagcctttgctcagggcttgccagatttttgactaggccaaaacgatgcttggtggctatgtataattctatctatagttttgcaaaacgagctgtttttcctatggtgccatcataggatccgcgttacaattctgaaacttacgctagttattatggatatgtcctcaggttttactgcagtgtagcgagtaaaagatctgatggaataatgatatcaaaactttgcgacccttgctattgttgtcgctaagctatgttcagttgcatttgttttacagattttgggtgtgatcctaatgttataggatcccattatctcaagagactgttagttgagag

SEQ ID NO: 2601 - DNA, 1971 bp, Oryza sativa Japonica Group
gctgcctcgattgattgattgattccttggagaagaagaaggaggaggaggagatcgagcagccgctgacgctcgtcgtctacctcccgatctgatccgaggagcgaagcgaacaggggcaagatgcattcgacgaatctgctgctggaggagcccatcaggatggcatccatcctggagccatccaagccgagctttttcccggcgatgaccaagatcgtggggacgctgggtcccaagtcgcgcgccgtcgacaccatctcctcctgcctcaaggccggcatgtcggttgccaggttcgatttctcgtggggagacgctgagtaccaccaggaaaccctcgaaaacctcaagctcgccatcaagtccaccaagaagctctgtgctgtcatgctcgacactgtcggcccggagttgcaggtggtgaacaagagtgaggctgcaatctcccttgaagcgaatggcactgttgttctcacccctgaccaggggcaggaggcctcctccgaattgctgcccatcaacttctccgggcttgctaaggctctgaaaccaggtgctacaatttttgtggggcaatacttgttcactggcagtgagactacttcagtttggttagaggtttctgaagttaaaggagatgatgtggtttgtgtgataaaaaattcggctactctggctggttcactgttcaccctgcattgttctcagattcatatcgacttacctacactgtctgatgaggacaaggaggttatcagaagatggggagctccaaacaagattgacttcctctctctgtcttatacaagacacgcggaagatgtgcgacaggcacgtgagttcctctcaaagttaggcgaccttagccaaactcagatttttgccaaaattgagaatgttgagggtttgaatcattttgatgaaatcctgcaagaggcggatggtatcattctgtcaagaggaaaccttggaattgatcttccacctgaaaaggtgtttttgtttcaaaagtctgctctgcacaagtgcaacatggctggaaagcctgctgttgttactcgtgttgtggacagtatgactgacaacctcaggcctactcgtgcggaggctactgatgtggcaaatgctgtacttgacgggagtgatgccattctccttggtgctgagactctccgtggtctgtacccagttgagactatctcaattgtgggcaaaatttgcgctgaggcagagaaggtattcaaccaagatttatacttcaagcggactgtgaaatatgttggggagcccatgacccacttggagtctatcgcttcttctgcggtgcgagctgctatcaaagtgaaggcttctgtcattatttgcttcacatcatctggacgcgctgcaagactaattgccaagtacaggcccaccatgcctgttctatctgttgtcattcctcgtctgaaaacaaaccaactgaggtggagtttcactggcgcatttgaagcaagacaatcactcatagttagaggtctctttccgatgcttgctgatcctcgccatccagctgaatcgaccagcgctaccaatgagtcagttttgaaggttgctcttgaccatggcaaagcttccggtgtgatcaagtcgcatgatcgcgttgttgtctgccagaaagtgggtgattcctcggttgtgaagatcattgagctggacgattagacgaccagcttgtgcttgttgatgatactacggcaagtcatggtttgccagattttgactaggccaaaaacgatgcttcttggctatatgtataattcctatataggctttccaatgagcagtttttcctatggtgtaatcataggatttgccttactatttgaaacaactacgttttagttatgtaagttatcagatttcaatgcatcatatcacttcgatgggcaaatggaataatgaaatcggtactgtaccctttggtct

SEQ ID NO: 2602 - DNA, 1965 bp, Oryza sativa Japonica Group
ttggaggcgccacgtttaaagggcggagtcgctgtaattagagaagaggatttaaagagagagaaggccattctctcttgattgcttggagaggaagaagaacaagagccgccaccgccgccgttaggtttttatttattttttttctcgatctgatccgaggaggagcgaagcgaagaagggcaagatgcattcgacgaatctgctgctggaggagcccatcaggatggcatccatcctggagccatccaagcccagcttcttcccggcgatgaccaagatcgtggggacgctggggccaaagtcgcgctccgtcgacaccatctcctcctgcctcaaggccggcatgtcggtggcccgatttgatttctcgtggggagacgccgagtaccaccaggaaacccttgagaacctcaaggtcgccatcaagtccaccaagaagctctgcgcggtcatgcttgacacggtcggcccagagttgcaggtggtgaacaagagcgaagcctccatctccctcgaggagaacggcactgttattctcacccctgaccaggggcaggaggcctcctcacaagtgctgccaattaacttcgctgggcttgctaaggctgtgaagccaggtgacacaatatttgttgggcaatacttgttcacaggcagtgagactacttcagtttggttagaggtttctcaaattaaaggagatgatgtggtctgtgtgataaaaaacacagcaactctggctgggtcgctcttcacattgcattgctcgcagattcacatcgacttacctaccctatctgatgaggacaaggaggttatcagaaaatggggtgccccaaacaagattgacttcctctctctttcttatacaagacatgtagaagatgtgcgacaggcacgtgaattcctctcaaagttaggtgaccttagccagacccagatttttgcaaaaatcgagaatgtggaggggttgaataattttgatgaaatcctccaagaagctgatggtatcatcctgtcaagaggaaaccttggaattgatcttccacctgaaaaggtgtttttatttcaaaagtctgctctgcacaagtgcaacatggctggaaagcctgctgttgttactcgtgttgtagacagtatgactgacaacctcaggcctactcgtgcagaggctacggatgtggcaaatgcagtgcttgacgggagtgatgccattctccttggtgctgagactctgcgtggtttatacccagttgagactatttcaatagtgggtaaaatttgtgctgaggctgagaaggtcttcaaccaagatttatacttcaagagaactgtgaaacatgtgggggagcccatgacccacttggagtctattgcttcctctgcggtgcgagctgctattaaagtgaaggcgtctgtcataatttgcttcacatcatctggacgtgctgcaaggctaattgccaagtataggccaaccatgcctgttctatctgttgtcattcctcgtctaaaaacaaatcaactgaggtggagtttcactggcgcatttgaagcaagacaatcgctcatagttagaggcctctttccgatgcttgctgatccgaggcatccagctgaatcaaccaacgctacaaatgaatccgttttgaaggttgctcttgaccacggtaaagtttctggtgtgataaagtcgcatgatcgcgttgttgtctgccagaaggtgggagattcctcggttgtgaagatcattgagctggacgattagacaagcagcttgtgctcgtcgtcgatgatactatggcatgttttgccagattttgactaggccaaaaacgttgcttcttggctatgtataatcctatagcttcaaatgagcagtttttcctatggtgtattcataggatttgccttacagcttgaaaccattatgatttagttaaggaaattaaatttgcgcag

SEQ ID NO: 2603 - DNA, 2296 bp, Vitis vinifera
gcgataaatttgaggaattggaagagaaaaagaaattttgtaaaaacaaaggagattgggtttgagatattttgaaagtgaataagagaatttgacaagcaatagaacaaggtttataggacaaaaaaacagcgtgcaggactgaaagaaaagcagagaagaagcgcatatccggaggataaatattcaaaattgaaacccttcgctcaattcacgctgcttccgatcgaagcactttatctctctaaacctctatctgcgtctccgctgttcccttccattcttagccgttgaagatgcatgccaatcacctccttctcgaggagcccatccgtatggcttccatcctcgagccatcgaaggccagtttctttcccgcaatgacaaagatcgtgggtacccttgggcccaagtctcgatccgtggaggttatctccggttgcctcaaagttgggatgtctgttgctcgctttgatttttcatggggagaccccgattatcaccaagagactttagagaatttgaaggcggctgtgaagagtactaagaagctgtgtgctgttatgctagacacggtaggagctgaattgcaggttgttaataaatgtgagaagtctatttcacttctggctgatggttttgttgttctgacaccctatcaagatcaagaagcctcctcggagctattgccaatcaattttaatggcttggcgaaggcagtaaagaagggagacaccatttttgttggtcaatacctatttacaggaagtgaaactacttctgtttggttggaggtatctgaagtgaaaggagatgatgtagtttgtatgattaaaaattctgcaactttggctgggtcgttattcactttgcatgtttctcaaattcatattgatctgcctactctatctgataaagataaggaggttataagtacatggggtgttaaaaacaaaattgacttcctttcactgtcatataccaggcatgcagaggatgttcgccatgcccgtgaccatctatctaagttgggtgacctccatcagactcaaatttttgcaaagattgaaaatgtggagggtttaaaccattttgatgagatcctgcaagaggctgatggtataatcctttcacgtggaaacttgggaatagatcttccacctgagaaggttttcttatttcaaaaggctgctgtttacaagtgtaatatggctgggaagcctgcagttattactcgtgttgtggacagtatgactgacaaccttagacccactcgtgctgaagccactgatgttgcaaatgctgtattggatggaagtgatgccattcttcttggggctgagactttgcgaggattgtatcctgttgagactatttccatcgttggtaaaatatgtgccgaggcagagaaggttttcaatcaagatctctacttcaagaaaactgtcaaatatgttggagagccaatgacccacttggaatccattgcttcctctgcggtacgggcagcaattaaggtcaaggcatctgttattatttgcttcacttcatctggaagggctgcaagattgattgctaaatataggccaacaatgccagttctttcagttgtcatccctcgactcaagacaaaccaactaaagtggagtttcagtggtgcctttgaggcaaggcaatcgcttatagtcagaggacttttccccatgcttgctgatcccaggcatcctgccgagtctacaagtgcaacaaatgagtcagttctgaaggttgcacttgatcatgggaaggcctcaggagttataaagtcacatgaccgagttgttgtttgccagaaggttggggatgcatctgtggtcaagattatagagcttgaagattagaattgcatagtaaaacatttttggtttttctttcttttttggctccaaattttttggaaatggtgatgaactttgttaatatcaccctaagttataagaggttttggagatgagcatatgattttatttagtaagaatatatgctggggcaatttgtgttgtttagccaaaactaaagtcatggaaacttgtacatgacatgtctggtcaaagcattgaagtcatctgcaggttcatgcccttgaaatgggctcttcatggtattgagccaataaaaccttcaacttttgttgaatctttggacttgctcatgaaatgggcttcatccgtcatggtactgttttctgagttactggtttccagtgcttcaaaattgtaatgctcctgtttggaattttatctagaaattacttaca

SEQ ID NO: 2604 - DNA, 1730 bp, Deschampsia antarctica
ggtcccaagtcgcgctccgtggaggccatctccgcctgcctcaaggccggcatgtctgttgcccgtttcgatttctcgtggggcgatgccgcctaccaccaggagacgctcgagaacctcaagctcgccatcaaggccaccaagaagctatgcgccgttatgcttggcactgtcggcccggagctgcaagtggtgaacaagagtgaagtcactatctcgcttgaagagaatgaatctgttgttctcacccctcatcagggccaggaggcctcctccaaattgctacccatcaacttctctggactcgccaaggctctgaagccaggggacacaatatttgttgggcagtatttgttcacaggcagtgagactacttcagtttggttagaggtttctgaagttcaaggggatgacgtggtttgtgtgatcaagaactcagctaccctggctgggtcactcttcacattgcactgctcccagatccatatcgacttaccaacactttctgatgaggataaggatgttatcaaaaaatggggtgccccaaacaagattgactttctctcgctttcttatacaaggcatgcggaagatgtgcgacaagcacgggaatatctctcaaagttaggtgatcttagccaaactctgatttttgccaaaatagagaatgtggagggcttaaaccattttgatgaaatcctggaagaagctgatggtatatttctgtcaaggggaaacctgggaattgatcttccacccgaaaaggtgtttttatttcaaaaatctgctctccacaagtgcaacatggctggaaagcctgctgttgttactcgtgttgtggacagtatgactgacaacctcaggcctactcgagcagaggcaactgatgtggcaaatgcagtactggatggtagtgatgccattctccttggtgctgagactctccgtgggttatacccagttgagactatttcaacagtaggcagaatttgtgctgaggctgagaaggtcttcaaccaagatttatacttcaagcgaaccgtgaaatacgtgggagaacccatgactcacttggagtctattgcttcctctgcagtgcgggctgctatcaaagtgaaggcttctgttatcatttgttttacctcatctggaagggctgcaaggctaattgccaagtacaggcccacaatgcctgttctgtctgttgtcattcctcgtctgaaaacaaaccaactgaagtggagcttcacgggtgcattcgaagcaagacaatcactcatagttagaggcctctttcccatgcttgccgatccacgtcaccctgctgaatctactagcactacaaatgagtcagttttgaaggttgctcttgaccacggcaaaacgtccggtgtgatcaaatcgcacgaccgtgttgtcgtctgccagaaggtgggggattcctcggttgtgaagatcattgagctggacgactaggctactagccttggtcatgggtttgccagatttttgactaggccaaaacgttgcttggtggctatgtataatcctatagttttgctaaacgagctcctttctcctatggtggtgtcaacacaggatccgccttacaattctgaaacctacgttctagctatggaaatttgctcaggatttactgcctgcagtggatcacttaaatgatcaggtggaataatgaaatcgggactccctttggctttggttgaaca

SEQ ID NO: 2605 - DNA, 1401 bp, Oryza sativa Japonica Group
atacaacgatttcctcttgtcaccctgaatctacttctgctgcaaaagcaataagcaaggagcagttagccaggtaaagctctagctagctagcttaggcagcaatggagcagcatcagggccaggcaggcatggacttgccccctggcttccgcttccacccgaccgacgaggagctgatcacgcactacctcgccaagaaggtcgccgacgcccgcttcgccgccctcgccgtcgccgaggccgacctcaacaagtgcgagccctgggacctgccatctctggcgaagatgggggagaaggagtggtacttcttctgcctcaaggacaggaagtacccgacggggctgaggacgaacagggcgacggagtccgggtactggaaggccacggggaaggacaaggacatcttcagacggaaggccctcgtcggcatgaagaagacgctcgttttctacacggggcgcgctcccaagggggagaagtctggctgggtcatgcacgagtaccgcctccacggcaagctccacgccgccgccctcggcttcctccacggcaagcccgcgtcgtccaagaacgagtgggtgttgtgcagggtgttcaagaagagcctcgtggaggtgggcgcggcgggagggaagaaggcggccgtggtgacgatggagatggcgaggggagggtcgacgtcgtcgtccgtggcggacgagatcgccatgtcgtccgtcgtcctccctccgctgatggacatgtccggagccggcgccggcgccgtcgacccggcgacgacggcgcacgtgacctgcttctccaacgcgctggagggccagttctttaacccgacggcagtacacgggcacggcggcggcgactcctcgccgttcatggcgagcttcacgcagtacgggcagctgcaccacggcgtgagcctggtgcaactcctggagagctgcaacggctacggcggcctcgtcgacatggcagcgtccggcagccagctgcagccggcggcgtgcggcggcgagcgggagaggcttagcgcgtcgcaggacaccggcctcacctccgacgtgaacccggagatctcgtcatcctccggccaaaaattcgaccacgaggccgcgctatggggctactaaggtttgatatgatcagcgccgtgtacgttaatcgcgggcgattagcgaagtagcgattactgtaaataaaaccatgagatcgcgatcgaggcatctaccaaggttcgcttaatttgcttgtacctataggtgtagattatttggtgatttgggagatgtaattagcattgtttgtttgtaattcgtatcagaatgatcgatgcagtattgtttggagggttagttaagcaattggccactcctcagttgccagttaattagttag

SEQ ID NO: 2606 - DNA, 1377 bp, Oryza sativa
acgatttcctcttgtcaccctgaatctacttctgctgcaaaagcaataagcaaggagcagttagccaggtaaagctctagctagctagcttaggcagcaatggagcagcatcagggccaggcaggcatggacttgccccctggcttccgcttccacccgaccgacgaggagctgatcacgcactacctcgccaagaaggtcgccgacgcccgcttcgccgccctcgccgtcgccgaggccgacctcaacaagtgcgagccctgggacctgccatctctggcgaagatgggggagaaggagtggtacttcttctgcctcaaggacaggaagtacccgacggggctgaggacgaacagggcgacggagtccgggtactggaaggccacggggaaggacaaggacatcttcagacggaaggccctcgtcggcatgaagaagacgctcgttttctacacggggcgcgctcccaagggggagaagtctggctgggtcatgcacgagtaccgcctccacggcaagctccacgccgccgccctcggcttcctccacggcaagcccgcgtcgtccaagaacgagtgggtgttgtgcagggtgttcaagaagagcctcgtggaggtgggcgcggcgggagggaagaaggcggccgtggtgacgatggagatggcgaggggagggtcgacgtcgtcgtccgtggcggacgagatcgccatgtcgtccgtcgtcctccctccgctgatggacatgtccggagccggcgccggcgccgtcgacccggcgacgacggcgcacgtgacctgcttctccaacgcgctggagggccagttctttaacccgacggcagtacacgggcacggcggcggcgactcctcgccgttcatggcgagcttcacgcagtacgggcagctgcaccacggcgtgagcctggtgcaactcctggagagctgcaacggctacggcggcctcgtcgacatggcagcgtccggcagccagctgcagccggcggcgtgcggcggcgagcgggagaggcttagcgcgtcgcaggacaccggcctcacctccgacgtgaacccggagatctcgtcatcctccggccaaaaattcgaccacgaggccgcgctatggggctactaaggtttgatatgatcagcgccgtgtacgttaatcgcgggcgattagcgaagtagcgattactgtaaataaaaccatgagatcgcgatcgaggcatctaccaaggttcgcttaatttgcttgtacctataggtgtagattatttggtgatttgggagatgtaattagcattgtttgtttgtaattcgtatcagaatgatcgatgcagtattgtttggagggttagttaaaaaaaaaaaaaaaaaaaaa

SEQ ID NO: 2607 - DNA, 1148 bp, Sorghum bicolor
atggagcaggagctgcaccggcccatggagctgcccccgggcttccgcttccacccgacggacgaggagctcatcacgcactacctcgcccgcaaggtcgccgacgcccgcttcgccgcgctcgccgtcggcgaggctgacctcaacaagtgcgagccctgggacctgccatcgctggcgaagatgggggagaaggagtggtacttcttctgcctcaaggaccgcaagtacccgacggggctgaggacgaacagggccacggaggccgggtactggaaggccacgggcaaggacaaggatatcttcaggggcaacggcggcaaggtgctcgtcggctccaagaagacgctcgtcttctacacggggagggcgcccaagggcgagaagtccggctgggtcatgcacgagtaccgcctccacggcaagctccatggcgccatcgtcccccccaaggccgccgccggctccaagaacgagtgggtgctgtgcagggtgttcaagaagagccttgtcgtaggcggtgcagcagcagcagcaccagccgcaggcaaaaggggcgccatggagatgtccaagatgaacgacgacatggcggccatctctcacctccctccgctgatggacgtgtccggcgccggcgccaacgtcaaccccgcggcggcggcacacgtgacctgcttctccgacgcactggagggccaccagttcttcaaccagcagcagacgccgccagaagccgacgccacggaccacctcggcctcgccgcctcctcgccgttcctgctgtccggcttcgcgcattacgggccgctgcaccacggcgcgacgagcctggtgcagctcctggagggcagcgtcgtgtacgctgccgccggcggtggcggcctcccggacatgtccaacaagcagcaacagcagcccgtgccggcgccgccgtgcaaggtgggcggcgagcgggagcggctgagcttgtcgcaggacacggggctcacctccgacgtgaaccccgagatctcctcctcctccggcgcccaacggttcgaccacgaccacctctgctggggctactgatcgagccgcacatcatcgcgtacgtcatcgctagcgattagtatagcactgctgtaaataagcacatctacatctgt

SEQ ID NO: 2608 - DNA, 2310 bp, Zea mays
tcccttctctcgccttctgcggcactgcagtgctctgctgcctcggcgtctccacctcctcccggcgacggcagggcatccgatacgacgccgcgcttccttccgaatcccaagccgcaccccgcaccctcccggtcgccattcccgatgctggtgttctcgagcgacgacgactgctgcggctcctcgtactaggggggcaggatcgatcggcagactcgcagaactataggatatcacagaacagttcttgaggtacttattgcagcctaatagtacatggagcgatattcagatatgagaccaaaggcagaagtttcatatctcggaaggggttccagattctcttctagaaatcaaagttcagaagagaggactaaccatagcagcgataaaccgggaagcagcacaagattcaatcctacgaaagcgagaattggcggtaatcaagggaggccaagatatgtatgcgattcatttaaatctccaagctcaaaggtgtcgcctgcaggctcttccaaatttccacttagcaagtttgaggagaggcgaagacagccttttgtgccagggtttgacattgctgaaagtagtagaagaaaggctgatgccaagcagctacagggtagtaagaaaattgctgcagagaacgacagttcagacaatctgcgaggtgaatcagaaggttttactactgaacaagtagtaaaaccagaaggctctcatgttgtcggtcattcaggtgtttctgcgtatacagtcgggtccctggtccaaactgcttcactaggttctaggacacacagacagaaacacaaagaagtgaatttgggtactccaggagcatcgtcttcaactctgactaacaggtctactatacctggaaattctaccatgggtgtgaggccagcttatggtcatgttaatggagggcagatacatggtcttaaaaaccttggttgttcttcggtacctgatgctcagccatcaggttgcccatctgagtctgttattagtaggaggaggtttgagttcatgagaaagagggcctttgaccaggaaagctcttccagatcagtgaacttaagcttaggtcattcaactcctacagatattcgcagaatcagaatgaatgaacaatcactttgtcaacaaataccacgaagcagcagcagaagccatcaggaatcggcaggttcagttaggacaagacgaccttctcctcatgccactaggatgagtgttcctgatggaagagcagatggcgtgctttctctgcacgagtcatccacaaaggatgtacagccagctcaggaacatctttcattggaagaagtctccactgagagttcaataaggccattctttgtggaatttgataataacattttctcgtctagtcatcttcgtcgctcgagtactcgagctgaaaggggaagaccaagctccctttttgaagaaagtcctcgacaaatgttccatagtctcatgggggagagggacagacatagacacataaccatggaaggaattacagaggttttggctgcattggagaggattgaacagcaagcagagctgacctatgatcaattgctaatgctggaggctaatctattttttggcgcctttgcctcctatgatcggcatagagacatgcggatggatattgatgatatgtcctatgaggaattattggccctggaggagagaataggctctgtgagcacagctctttcagaggagcagttcacaaaatgcctcaaaagaagcatatatagtcaggtcgctctagaagtgaacaaatcaaccgttgatgacatgaaatgcatcatctgtcaggaagagtacgcggagggcgaagaggttgggaggctgccatgcgagcaccggtaccatgtgtgctgcataggccagtggcttgggcagaagaactggtgtccagtatgcaaagcgtctgccgtgccttccaagggctgaagcattggggatgctggaaaccccgttccggattacaaaccatccttgcttttgtctacgtacattgttcttttccctatatgcattagatatagatcatgtctagatgtatgacgctagaacagcttgcgatttgggaggaagctaagagagtaatagttagctggttaataatagttcatagctaatatttgctagataactattacttggctacctattagctgtgcctttcacattgtggtacaggacaaatgcttgtcagatcgtgaacaaccttataacttgatgaatggcctaagtcaaagaggaatatgttgtgccaatctc

SEQ ID NO: 2609 - DNA, 1557 bp, Sorghum bicolor
atggaggagtattcagataggggatcaaaagcagaaattgcatatctcaggaggggttccagattctcttctagaaatcaaagttcagaagagaggactaataatcacagcagcgacaaaccgggaagcagcactagattcaatcctatgaaagcaagaattggcgataatcaagaaagaccaagatatgtgcgtgattcatttaaatcttcaagctcaaaggtggcacctgcaagctcttccaaatttccacttagcaagtttgaggaaaggcgaaggcaacctttcttgccagggtttgacaatgctggaagtagtagaagaaaggttgatgccaagcggctagtgggtagtaagaaaattgctgtagacaatgagagttcagacactctgcaaggtgaatcggaaggttttactaccgaacaagtaccttatccagaaggctctcattttactggtcattcaggtgtttcttcatatacagtcaagtccttggtccaaactgcttcactaagttctaggacacagagacagaaacacaaagaagtgaatatgggtactccaggagcatgttcttcgtctctgactaatgggtcttctatacctggaaattctaccatgggtgtgaggccagcttatggtcatgttagtggagggcaggtacgtggtcttaaaaaccttggttgtacgtcagtgcctgatgctcagccatcaggttgcccatctgagtctgttagtagtaggaggttcgagttcatgagaaagagggcttttgaccaggaaaactcttccagatcaaggagcttaagtttaggtctttcacctcctacagatattcacaatactggtcacagaatcagaatgaatgaacaatcactttctcaacaaataccacaaagaagcagcagaaaccatcaggaaccagcagtttcagttaggacgagacggccttctcctcatgccactaggatgagtgttcctgatgaaagagcagatggtatgctttctctgcatgagtcacccacaagaaatgtacagccagctcaggaacatctttcattggaagaagtctccactgagagttcaataaggccattctttgtggaatttgataataacattttctcatctagtcgtcgccgttgctcgaatactcgagctgaaaggcaattgctggtgctggagactaatctattttttggtgcttttgcctcctatgatcggcatagagacatgcggatggatattgataatatgtcctatgaggaattattggccctggaagagagaataggctctgtaagcacagctctttcggaagagcagttcacgaaatgcctcagaagaagcatatatagtcaagtcgcttcagaagtgagcaaatcaaccgttgatgacatgaaatgcagcatatgtcaggaagagtacatggagggcgaagaagttgggaggctgccgtgcgagcactggtaccatgtgtgctgcattggccagtggcttaggcagaagaactggtgtccagtgtgcaaagcgtcggcagtgccttccaagggttaa

SEQ ID NO: 2610 - DNA, 371 bp, Agrostis stolonifera
atgattcaacctcagacccttttaaatgtagcagataatagtggagctcgaaaattgatgtgtattcgagtcataggagctgctggtaatcagcgatatgctcgtattggtgatgttattgttgctgtaatcaaagacgcattgccccaaatgcccctagaaagatccgaagtaattagagctgtaattgtacgtacatgtaaagagttcaaatgtgaagacggtataataatccgctatgatgacaatgcagcggttataattgatcaaaaaggaaatccaaaaggaactcgagtttttggcgcgattgctgaggaattgagagaattgaattttaccaaaatagtttcattagctcctgaagtattata

SEQ ID NO: 2611 - DNA, 369 bp, Festuca arundinacea
atgattcaacctcagacccttttaaatgtagcagataatagtggagctcgaaaattgatgtgtattcgagtcataggagccgctggtaatcagcgatatgctcgtatgggtgatgttattgttgctgtaattaaagacgcattgccgcaaatgcccctagaaagatccgaagtaattcgagctgtaattgtacgtacatgtaaagagttcaaatgtgaagatggtataataatccgctatgatgacaatgcagcggttataattgatcaaaaaggaaatccaaaaggaactcgagtttttggcgcgattgccgaagaattgagagaattgaattttaccaaaatagtttcattagctcctgaagtatta

SEQ ID NO: 2612 - DNA, 371 bp, Triticum aestivum
atgattcaacctcagacccttttaaatgtagccgataatagtggagctcgaaaattgatgtgtattcgagtcataggagctgctggtaatcagcgatatgctcgtattggtgatgttattgttgctgtaatcaaagacgcattgccccaaatgcctctagaaagatccgaagtaattcgagctgtaattgtacgtacatgtaaagagttcaaatgcgaagacggtataataatccgctatgatgacaatgctgcggttataattgatcaaaaaggcaatccaaaaggaactcgagtttttggcgcgattgccgaggaattgagaggattgaattttaccaaaatagtttcattagctcctgaagtattata

SEQ ID NO: 2613 - DNA, 371 bp, Oryza sativa Japonica Group
atgattcaacctcagacccttttaaatgtagcagataacagtggagctcgaaaattgatgtgtattcgagtcataggagctgctagtaatcagcgatatgctcgtattggtgatgttattgttgctgtaatcaaagacgcagtgccccaaatgcctctagaaagatccgaagtaattcgagctgtaattgtacgtacatgtaaagagttcaaatgcgaagacggtataataatacgctatgacgacaatgcagcggttatcattgatcaaaaaggaaatccaaaaggaactcgcgtttttggcgcgatcgccgaggaattgagagaattgaattttactaaaatagtttcattagctcctgaagtattata

SEQ ID NO: 2614 - DNA, 371 bp, Brachypodium distachyon
atgattcaacctcagacccttttaaatgtagcagataatagtggagctcgaaaattgatgtgtattcgagtcataggaactgctggtaatcagcgatatgctcgtattggtgatgttattgttgctgtaatcaaagacgcagtgccccaaatgcctctagaaagatccgaagtaattcgagctgtaattgtacgtacatgtaaagagttcaaatgtgaagacggtataataatccgctatgatgacaatgcagcggttataattgatcaaaaaggaaatccaaaaggaactcgagtttttggggcgatcaccgaggaattgagagaattgaattttaccaaaatagtttcattagctcctgaagtattata

SEQ ID NO: 2615 - DNA, 365 bp, Phyllostachys edulis
atgattcaacctcagacccttttaaatgtagcagataacagtggagctcgaaaattgatgtgtattcgagtcataggagctgctagtaatcagcgatatgctcgtattggtgatgttattgttgctgtaatcaaagacgcagtgccccaaatgcctctagaaagatccgaagtaattcgagctgtaattgtacgtacatgtaaagagttcaaatgcgaagacggtataataatacgctatgatgacaatgcagcggttatcattgatcaaaaaggaaatccaaaaggaactcgagtttttggcgcgatcgccgaggaattgagagagttgaattttactaaaatagtttcattagctcctgaagt

SEQ ID NO: 2616 - DNA, 371 bp, Oryza sativa Japonica Group
atgattcaacctcagacccttttaaatgtagcagataacagtggagctcaaaaattgatgtgtattcgagtcataggagctgctagtaatcagcgatatgctcgtattggtgatgttattgttgctgtaatcaaagacgcagtgccccaaatgcctctagaaagatccgaagtaattcgagctgtaattgtacgtacatgtaaagagttcaaatgcgaagacggtataataatacgctatgacgacaatgcagcggttatcattgatcaaaaaggaaatccaaaaggaactcgcgtttttggcgcgatcgccgaggaattgagagaattgaattttactaaaatagtttcattagctcctgaagtattata

SEQ ID NO: 2617 - DNA, 370 bp, Anomochloa marantoidea
atgattcaacctcagacccttttaaatgtagcagacaatagtggagctcgaaaattgatgtgtattcgagtcataggagctgctggtaatcagcgatatgctcgtattggtgatgttattgttgctgtaatcaaagacgcactgcccaaaatgcctctagaaaaatccgaaatagtgcgagctgtaattgtacgtacatgtaaagaattcaaatgcgaagacggtataataatacgctatgatgacaatgcagcggttatcattgatcaaaaaggaaatccaaaaggaactcgagtttttggtgcgatcgccgaggaattgagagaattgcactttaataaaatagtttcattagctcctgaagtattat

SEQ ID NO: 2618 - DNA, 366 bp, Oryza sativa Japonica Group
attcaacctcagacccttttaaatgtagcagataacactggagctcgaaaattaatgtgtattcgagtcataggagctgctagtagtcagcgatatgctcgtattggtgatgttattgttgctgtaatcaaagacgtagtgccccaaatgcctctagaaagatccgaagtaattcgagctgtaattgtacgtacatgtaaagagttcaaatgcgaagacggtataataatacgctatgacgacaatgcagcggttatcattgatcaaaaaggaaatccaaaaggaactcgcgtttttggcgcgatcgccgaggaattgagagaattgaattttactaaaatagtttcattagctcctgaagtatta

SEQ ID NO: 2619 - DNA, 367 bp, Oryza sativa Japonica Group
gattcaacctcagacccttttaaatgtagcagataacagtggagctcgaaaattgatgtgtattcgagtcataggagctgctagtaatcagcaatatgctcgtattggtgatgttattgttgctgtaatcaaagacgcagtgccccaaatgcctctagaaagatctcaagtaattcgagctgtaattgtacgtacatgtaaagagttcaaatgcgaagacggtataataatacgctatgacgacaatgcagcggttatcattgatcaaaaaggaaatccaaaaggaactcgcgtttttggcacgatcgtcgaggaattgagagaattgaattttactaaactagtttcattagctcctgaagtatta

SEQ ID NO: 2620 - DNA, 1299 bp, Sorghum bicolor
atggcgacctgcagggagagcggcgggttggtggcggtgcggtgcgccggaaggatcggggtggtggcctcggtggccatgaacctcgcgtggatcgccatgtacatccgccgccgctacttcggcgccggcggcggcggatctgacaacaacggccgcggcgtcaccacggtggagccgtccaaagggaaaccgccggtcactgaggactcaattgttaacctggaccatggtgacccgactatgtatgaggagttctggcgtgggacaggagatagcgcctccattttcatccctggttggcaaacaatgagctacttctccgacctcggcggcatttgttggttcgtcgagcccggcttcgagcgcgaggtccggcgtctccaccggctcgtcggaaatgccatggtcgacgggtaccatgtgctcgtcgggacaggctccacgcagctctttcaggccgtgctgtacgcactctcacctgcaagcgacggcacgcccatgaacgtcgtctcaccggcaccatactactcgtcatacccatctgtgaccaactttctgaactctgggctttaccgttggggtggtgatgccaatacatttgatggtgacacctgtattgagctcgtctgctcgccaaacaaccctgatggtagcatcagaaaagctgtcatcaaatccaagtctagcaaggctgtttatgacttcgcctactactggccacagtacgcacccatcaccgaggcagctggacatgatatcatgttattcactgtatccaaatgcaccggccatgccggcactagactggggtgggcattggtgaaggatactgaggtggcccagaaaatgattaagtttatagagctcaacacaattggcgtatccaaggactcccaacttcgtgccgctaagattattggggcaatctgtaacggctatgagctatcatctgctggtaaaacaagccacctcttccattttgctaaggaaaaaatggcggaacgttggattagactccgtgcagctgtggcagcctcagacatttttactctcccaaatgagctatcaggctattgtagtttttccaaggaggcagtcaccgccaatcctccatttgcatggcttcgctgcaagaaggatgatattgaagatttggagggctttctgcgtgggaaaaagataatcactcgaggtggcacaaagtttggagtggatgggagggttgtcagggttagtatggttgacacagaccaagccttcaatgtgttcatcaatcgtctcgccacaatgaagtga

SEQ ID NO: 2621 - DNA, 1757 bp, Zea mays
cgtcctctcctcgataacccaggccacatcgtccttccgcgccgcgccgccggcgacctaacaacccagaggcctcagcaccgcacgcttgcacgtacgtccaggcgcgctcgccgttacgcccacggggatccaggctttccttcgctgccgttgctggtcgagtgcgccacgccgaaaggtgatcgagctgacgagcgctagacgccaccggccggcgcggcgtggcaagtgcaggggcaggccggtgaggtctgggagaggaggaggaggaggaggaggaggaggaggaggagatggccggtagggagagcggcgggatggcggcggcgctgcgctgcgctggaaggatcgggatcctggccaccgtcgcagtgaacctcgcgtggatcgcgacgtacatccgccggcgctacttcggcggcgggaaccgatccgacaacaacggtggcggcggggaggtggagccgtcaagagggaagccgccggtcacttcggactccatcgtcaacctcgatcatggcgacccgactatgtacgaggagttctggcgcggcacaggagatagcgcctcgatcttcatccctggttggcaaacaatgagctacttctccgacctcggcggcatctgttggttcctggagcctggattcgagcgcgaggtgcggcgtctccacaggctcgtggggaatgccgttgtagacgggtaccatgtgctcgtcgggacaggctccactcagctctttcaggccgtgctgtacgcgctctcacctgcaagtgacggcacacccatgaacgtcgtctcaccggcaccgtactactcgtcttacccatctgtgaccaactatctaaactctgcgctctaccgttgggctggtgatgccaatacatttgatggcgacacatgtattgagctcgtctgctccccaaacaaccctgatggtggcctccggaagcctgtcatcaaatccaagtctagcaagcctgtttatgacttcgcctactactggccgcagtacacacccatcaccgaggcagctgcccatgacatcatgctgttcaccgtctccaaatgcaccggccatgccggcaccaggctggggtgggcattggtgaaggatactaaggtggctcagaagatgatcaagtttatagagctcaacacaatcggtgtatccaaggactctcaacttcgtgccgctaagattatcggggcaatatgtaatggctatgagccggtaccatcctctggtaaaacaagccaactcttccatttcgccaaggaaaaaatggcggctcgctgggctagacttcgtgcagctgtggcagcctcagacatctttactctcccttatgagctatctggctattgtagcttttccaatgagactgtcaccgccaatcctccatttgcatggcttcgctacaacaaggatgatattgaagatctggaggccttcctactcgagaaaaagattatcactcgaggtggcacaaggtttggagtggatgcaagggctgtcagagttagtatggttgacacagaccaagccttcaatgtgttcatcaatcgtctggccacaatgaagtgaaatttcagtgcaaattaataaagcactttgtggctactacaaggatgaccgcgttctagatggaacaatcgatgctttggaaagcttaataatgttttatgttgttgaataattccgtgtgttttcgggtatgttgtgtaatactcaatgtcaaatcctatgctt

SEQ ID NO: 2622 - DNA, 1353 bp, Zea mays
gaggaggaggaggaggagatggccggtagggagagcggcgggatggcggcggcgctgcgctgcgctggaaggatcgggatcctggccaccgtcgcagtgaacctcgcgtggatcgcgacgtacatccgccggcgctacttcggcggcgggaaccgatccgacaacaacggtggcggcggggaggtggagccgtcaagagggaagccgccggtcacttcggactccatcgtcaacctcgatcatggcgacccgactatgtacgaggagttctggcgcggcacaggagatagcgcctccatcttcatccctggttggcaaacaatgagctacttctccgacctcggcggcatctgttggttcctggagcctggattcgagcgcgaggtgcggcgtctccaccggctcgtggggaatgccgttgtagacggataccatgtgctcgtcgggacaggctccactcagctctttcaggccgtgctgtacgcgctctcacctgcaactgacggcacacccatgaacgtcgtctcaccggcaccgtactactcgtcttacccatctgtgaccaactatctaaactctgcgctctaccgttgggctggtgatgccaatacatttgatggcgacacatgtattgagctcgtctgctccccaaacaaccctgatggtggcctccggaagcctgtcatcaaatccaagtctagcaagcctgtttatgacttcgcctactactggccgcagtactcacccatcaccgaggcagctgcccatgatatcatgctgttcactgtctccaaatgcaccggccatgccggcaccaggctggggtgggcattggtgaaggatactaaggtggctcagaagatgatcaagtttatagagctcaacacaatcggtgtatccaaggactctcaacttcgtgccgctaagattatcggggcaatatgtaatggctatgagccggtaccatcctctggtaaaacaagccaactcttccatttcgccaaggaaaaaatggcggctcgctgggctagacttcgtgcagctgtggcagcctcagacatctttactctcccttatgagctatctggctattgtagcttttccaatgagactgtcaccgccaatcctccatttgcatggcttcgctacaacaaggatgatattgaagatctggaggccttcctactcgagaaaaagattatcactcgaggtggcacaaggtttggagtggatgcaagggctgtcagagttagtatggttgacacagaccaagccttcaatgtgttcatcaatcgtctggccacaatgaagtgaaatttcagtgcaaattaataaagcactttgtggctacta

SEQ ID NO: 2623 - DNA, 1628 bp, Zea mays
cgcccgccgctatcatatccatccccgttctcctcctcgccgtcgccactctctttgcgcgcgccacgccgaaaggtgagctgccgggcgtcgtctatagacgtagagcggggcagagggccgtgagctttgggagaggaggagataattaatggcggctaaggagagtagtaggacgatgaaggcggcgcgctctgcgggaaggatcggggtcgtggcctctgtggcgatgaacctcgcgtggcttgcgatgtacatccgccagcgctacggggagatcaccacggtggaggcgtcccgaggcaagccgccggtcactcaggactccgtcgtcatcctcgatcacggcgacccggtcatgtacgaggagttctggcgccgcgagggagacagcgcctcgatcctgatccccgcgtggcagacgatgagctacttctccaacctcggcggcatctgctgcttcctggagcctggcctggagcgcgaggtgcggcgcctccaccggctcgtcggaaacgccgtggtcgatggataccatgtgatcgtcgggactgggtccacgcagctgttccaggccgtgctatacgcgatctcgcctgcaagtgacggcacgcccatcgacgtcgtctcgccggcgccttactactcgtgttacccagttgcgtcgagctttctaaactctgggctctaccgttggggtggtgacgccaatacatttgccggcgacgacaccagctgtgttgaggtcgtctgctcgccaaacaaccctgacggtggcatccgacatgccgtcgtcaagtccaaatccagcaaggcgatctatgacttcgcctactactggccgcagtacacgcccatcaccgaggcggctgcccatgatgtcatgctgttcaccttctccaaatgctccggccatgccggtactaggctggggtgggcactggtgaaggacactgaagtggccaagaagatgaccaagttcatggagctcaccacgattggcgtgtccaaggactctcagcttcgtgccgctaagattcttggggcgatctgtaacggctatgagcagctgccatcccccgcgggccaaacaagaagccacctcttccattttgctcgggagaaaatggcggcacgatggactaggctccgcgcagctttggcggcctcggacatctttactctcccagatgagctatctgagtactgtggtttcttcaagaagactgtcaccgccaatcctgcgttcgcatggcttcgctgcaagaaggatggtattgaagatctggagagctttctacgcgagaacaagatagtcactcgaggtggcacaaagtttggagtggacgggagggttgtcagggtcagtatggttgacacagaccaagccttcaacgtgttcctggatcgtctagccacgatgaagtgagatactactagtgcaaataaacactttgtcgctgcatggatggatgacattgttctaagtttagtgcaaggatgatccttcggaaaacttaataatgttctatttgttctataattagatcatgttttctagtatagtagaatattcactgtcaaatgctatatataattgaggttgtgatctaaaaaaaaaaaaaaaa

SEQ ID NO: 2624 - DNA, 1757 bp, Zea mays; identical to SEQ ID NO: 2621

SEQ ID NO: 2625 - DNA, 1353 bp, Zea mays; identical to SEQ ID NO: 2622

SEQ ID NO: 2626 - DNA, 1299 bp, Sorghum bicolor; identical to SEQ ID NO: 2620

SEQ ID NO: 2627 - DNA, 1628 bp, Zea mays; identical to SEQ ID NO: 2623

SEQ ID NO: 2628 - DNA, 918 bp, Sorghum bicolor
atggacccgtcgtcccatggcggcggcgccgccgatggaagtgccgacggccatagccaaattctgtgggattggacagcagagcattgtgaacctaatggttcaagtcatgcagatgctaccaaattcgtgtgggattgcctcaatcaagatgatgatgagctgttgggattgcttggaaatcaaaccccattgagagactgccgcaatttctttgctgaccttggtgatatcacatgcaaggagaccttggacctggaggaatctcgggaatcaaagcggcgacgcacattggagtacccttcagagtctagtcagtcagaagttgggactcatggtactggttcacctttcgttacacctgaggtagcagaaatttcattgctctgcgctgataaaccacagagcttaaattgtgatatgcacaacacttcaaataatttagatgaagcaccctaccaccaagaagataatcttttggaacattgctcttatgaaactcctgtgtacctcgagcctgatcaaacgccttgtagccaggagagcattgcatgtataaatgatcaagctggtatttcaggaacaactgagattgcaccaatgacagaaagtttcataatgcaggaaactaggaagctttctacactcaaggtctccaaaggaccaagctcatcactagttagggtgaaggaaaacttaactatctcagtagcatatccttttactctcatcaaaccatcttgggaggaaggtgatgttaccttacaggatataaatcagcgaatccgtgctcctcctaagaaggccccggagatccttggaacttcagcgttctctggcaagccagtgattggcaagacaagaatcagaacagaaggggggaaaggaagcatcacaatactaagaacaaagggctga

SEQ ID NO: 2629 - DNA, 1459 bp, Zea mays
cgtcttcatccctcggactacaaatgcggcgcaaccgtgggcgtatcagcacccgagcagtttgtagcaggatcctctcgctctcgccatcgcatcgcgcacagtagacactcaaaatccgattgccgagggggagaaggcggagaccgttgcaacggctagttgcggcggcccgatggacccgtcgtacgatggcagcgcccccgccgccggtggaagcgccgacgaccatggccaaactctctgggattggacagtagagcattgtgaacccaacgattcaagtcatgcagatgctactaaattcgtgtgggattgcctcaatcaagatgacgatgagctaatgggattgcttggaaatcaaaccccgttgagagactgccgtgatttctttgctgaccttggtgatttcacatgcaaggagaccttggacctggaggaatctcgggaatcaaagcggcggcgcacattagagtacccttcagagtctagtcagtcagaagttgggactcatgatgctgcttcaccttttgtcacatctgaggcagcagaaatttcattgctctgcactgataaaccacagagcttaaattgggatatgcaccacacttcaaataatttagatgaagcaccctaccggcaagaagatattctttctgaacattgctcttatggaactccagtgtacctcgagcctgatcaaacgccttgtagtcaggagagcattgcatgtataaatgatcaatctggtatttcaggaacaagtgagactggaccaatgacagaaagtttcataatgcaggaaactagaaagctttgtacactcaaagtgtccaaaggatcaagctcaacactagttaaggtgaaggaaaacttaactacctcagtagcatatccttttactcttatcaaaccatcttgggaggaaggcgatgttaccttgcaggatataaatcagcgaattcgtgctcctcctaagaaggcccccgagatccttggaacttcagcattctctggcaagccagtgattggcaagacaagaatcagaacagaaggggggaaaggaagcatcacaatactaagaacaaagggctgagaaccggaaaataccttcgatccttatttatctgctagtctctccatttatcagatgagaaaggggagaaggcagctccttggtggtcaattgtgcaagtctgagcacctgaaacttccattgattcacagttcaaggctgagcctgaggatgccattgattcttatttatctgccattctctcgattgcttttggcactttggtcaatgtgcagacctctgtagctttccatcatttttttgttttagttttgcaccgtgggtgtcttgtgaattaatgtagacgcaaaacaacaactttcggcattcttctggtgtatttatgacatgtggtcaatgatatatatacatcaaactgaagtc

SEQ ID NO: 2630 - DNA, 1421 bp, Zea mays
gtcttcatccctcggactacaaatgcggcgcaaccgtgggcgtatcagcacccgagcagtttgtagcaggatcctctcgctcccgccatcgcatcgcgcacagtagacactcaaaatccgattgccgagggggagaaggcggagaccgttgcaacggctagttgcggcggcccgatggacccgtcgtacgatggcagcgcccccgccgccggtggaagcgccgacgaccatggccaaacgtgggtgagggggccccgagtcgttctctgggattggacagtagagcattgtgaacccaacgattcaagtcatgatgctactaaattcgtgtgggattgcctcaatcaagatgacgatgagctaatgggattgcttggaaatcaaaccccgttgagagactgccgtgatttctttgctgaccttggtgatttcacatgcaaggagaccttggacctggaggaatctcgggaatcaaagcggcggcgcacattagagtacccttcagagtctagtcagtcagaagttgggactcatgatgctgcttcaccttttgtcacatctgaggcagcagaaatttcattgctctgcactgataaaccacagagcttaaattgggatatgcaccacacttcaaataatttagatgaagcaccctaccggcaagaagatattctttctgaacattgctcttatggaactccagtgtacctcgagcctgatcaaacgccttgtagtcaggagagcattgcatgtataaatgatcaatctggtatttcaggaacaagtgagactggaccaatgacagaaagtttcataatgcaggaaactagaaagctttgtacactcaaagtgtccaaaggatcaagctcaacactagttaaggtgaaggaaaacttaactacctcagtagcatatccttttactcttatcaaaccatcttgggaggaaggcgatgttaccttgcaggatataaatcagcgaattcgtgctcctcctaagaaggcccccgagatccttggaacttcagcattctctggcaagccagtgattggcaagacaagaatcagaacagaaggggggaaaggaagcatcacaatactaagaacaaagggctgagaaccggaaaataccttcgatccttatttatctgctagtctctccatttatcagatgagaaaggggagaaggcagctccttggtggtcaattgtgcaagtctgagcacctgaaacttccattgattcacagttcaaggctgagcctgaggatgccattgattcttatttatctgccattctctcgattgcttttggcactttggtcaatgtgcagacctctgtagctttccatcatttttttgttttagttttgcaccgtgggtgtcttgtgaattaatgtagacgcaaaacaacaactttcggc

SEQ ID NO: 2631 - DNA, 1437 bp, Zea mays
agttggggagtgtgcagcagtatgttctcggtctcgccatcgcatctcgcagagtagacactcaaatccgattgtcgagggggagaaggtggagatcgttgtaacggctagttgcgtcggcccgatggacccgtcgtaccatggcggcggcgccgccggtggaagcgccgacgaccatggccaaattctttgggattggacagaacagcattgtgaacctaacgattcaagtcatgatgctactaaatttgtgtgggattgcctcaatcaagatgacaatgagctgttgggattgcttggaaatcaaaccccattgagatactgccgtgatttcttcgctgaccttgatgatatcacatgcaaggagaccctggacctggaggaatctcgggaatcaaagcggcggcgcacattggagtaccctttggagtctagtcagtcagaagttgggactcatgaaaccggttcacctttcgtcacacctgaggtagcagaaatttcattgctctgcactgataaaccacagagcttaaattgtggtatgcaccacactttaaataatctagatacaataaattccttgtcagatgaagcaccctaccagcaagaagatatccttttggaacattgctcttatggaacggcagtgtaccttgagccagatcaaacaccttgtagccagcagagcattgcatgtacaaatgatcaagctggtatttcaggaacaagtgagattgcaccaatgacagaaagtttcataatgcaggaaactaggaagctttctacactcaaagtctccaatggagcaagctcgtcactagttacgaaggacaacttaactacctcagtagcatatccttttactctcatcaaaccatcctggcaagaaggcgatgttaccttgcaggatataaatcggcgaatccgtcctcctcctaagaaggccccagagatccttggaacttcagcattctctggcaagccagtgattaacaagacaagaatcagaacagaaggagggaaaggaagcatcacaatactaagaacaaagggctgagaaccggaaaatacctttgatccttatttatctgctcctttgtggtcaattgtacaggtctgagcacttgaggctgccattgattcacagttcatggaacagagggstkagagcttgaggatgccattgattcttatttatctgccattctctcgattgcttttggcactctggtcaatgtgcaggcctcttagctttccagctgttactttttttctttcagttttgtaccgtgactttgtcttgtgaatagtattatgacatgtggatgtggtcaacgatatatacaaaaaaaaaaaaaaaaaaaaaaaaaaaaaaaaaaaaaaaaaaaaaaaaaaaaaaaaaaaaaaaaaaaaaaaaagggaaaaaaaaaaaaaaaa

SEQ ID NO: 2632 - DNA, 1350 bp, Zea mays
gtgcagcagtatgttctcggtctcgccatcgcatctcgcagagtagacactcaaatccgattgtcgagggggagaaggtggagatcgttgtaacggctagttgcgtcggcccgatggacccgtcgtaccatggcggcggcgccgccggtggaagcgccgacgaccatggccaaattctttgggattggacagaacagcattgtgaacctaacgattcaagtcatgatgctactaaatttgtgtgggattgcctcaatcaagatgacaatgagctgttgggattgcttggaaatcaaaccccattgagatactgccgtgatttcttcgctgaccttgatgatatcacatgcaaggagaccctggacctggaggaatctcgggaatcaaagcggcggcgcacattggagtaccctttggagtctagtcagtcagaagttgggactcatgaaaccggttcacctttcgtcacacctgaggtagcagaaatttcattgctctgcactgataaaccacagagcttaaattgtggtatgcaccacactttaaataatctagatacaataaattccttgtcagatgaagcaccctaccagcaagaagatatccttttggaacattgctcttatggaacggcagtgtaccttgagccagatcaaacaccttgtagccagcagagcattgcatgtacaaatgatcaagctggtatttcaggaacaagtgagattgcaccaatgacagaaagtttcataatgcaggaaactaggaagctttctacactcaaagtctccaatggagcaagctcgtcactagttacgaaggacaacttaactacctcagtagcatatccttttactctcatcaaaccatcctggcaagaaggcgatgttaccttgcaggatataaatcggcgaatccgtcctcctaagaaggccccagagatccttggaacttcagcattctctggcaagccagtgattaacaagacaagaatcagaacagaaggagggaaaggaagcatcacaatactaagaacaaagggctgagaaccggaaaatacctttgatccttatttatctgctcctttgtggtcaattgtacaggtctgagcacttgaggctgccattgattcacagttcatggaacagagggcttagagcttgaggatgccattgattcttatttatctgccattctctcgattgcttttggcactctggtcaatgtgcaggcctcttagctttccagctgttactttttttctttcagttttgtaccgtgactttgtcttgtgaatagtattatgacatgtggatgtggtcaacgatatatacaaagcactaaagttaatgg

SEQ ID NO: 2633 - DNA, 1396 bp, Sorghum bicolor
agtcgggtacagtaggatacctcggtcgcatcgcgcacagtagacactcaaatccgattgccgagggtgcgaggagggttgcaacggctagttgcggcggcttgatggaccagtcgtaccatggcggcgccgccgccgccgccgccggtggaagcgatggccaaattctctgggattggcaaacaggagagcactgcgaacctagcgatggaagtcatgatgctactaaattcttgtgggattgcctcaatcaagatgacaatgagctgctgggattgcttggaaatcgaaccccactgagagactgctgtgatttcttcgccgaccttggtgacatcacctgcaaggagaccctggacctggaggaatctcgggagtcaaagcggcggcgcatattggagtacccttcagagtctagtcagtcagaagttgcaagtcatgaaactggttctccttttgtcacatctgaggtagcagaggtttcattgctctgcactgatgaaccagagagcttaaattgtgatatgcagtacacttcaaataatttagatacgaattcaaatgaagcaccctatgagcaagaagataaccattttgaacattgctcttatggaaccccagtgtacatcgagcctgatcaagtgccttgtagctgggagagcattgcaaatattgatgatcaagctggtatttcaggaacaagcgagattgcaccgttgacagaaagtttcataatgcaggaaactaggaagctttctacactcaaagtctctaaaggtgcttcaacagttaaggtgaagcaaaacttaactacatcagtagcatacccttttactctcatcaaaccatcttgggaggaaggtgatgttactcttcaggatataaacaagcgaatccatgctcccccaaagaaggccccggagatcctgggaacttcagctttctctggcaagccagtgatcggcaagacaagaatcagaacagaaggggggagaggcagcatcacaattctaaggacaaagggctgaccggttctctggaagcctgagaatgcttttgatcccttatttatctgctactctccatttatcagaagtgaggggtgcagctccttggtagtcaattgtgcaggcctgagaacctgagggtgccattgatccacagctccttggtggtcaattgtgcaggcctgagaacctgtgggtgccattgatccacagttgaaggaacagagaggcctgagaaactatgattgccattgattctttgtaactttccaattattacttttattccttccagttttggtgttgaatcactgtagatgcaaactctttcttcaaaggttcagcattcttccggtgtatttatgacatgtggctaaatgataatatat

SEQ ID NO: 2634 - DNA, 2037 bp, Sorghum bicolor
atggtccagtcgcggcggcgcggcggcaactacccgtgcccgcgccgcgccgcactgccggcggcggggctcctgctcttcctcctcgccgccgtcgcgctgctctacgtctccccgccgccgctcgccgaccaccccgtgctcgcctcctcccgccgccgccggccgccccataccctgctgaacagctccggcagcggtgcaatggaggagaccgagcgccgcgagatttctcatgctccgacgaatggttcgaccgtcagggatgacctttggggttcaaagcttgctagcaaattttatgggtgcagcaattcaagcagcaagttccttgattcaaatattactacccaaccagaccgctatttgatgattgttacaagtggaggcctgaatcaacagagaacagggataattgatgctgttgttgctgcacgtattctaaatgccacacttgttgttcccaaactagaccaagcatccttctggaaagattccagcaatttttcggatatttttgacgccaactggttcatctcatccctatcaaaggatgtaaagattgtgaaagagcttccacatataggaggtaaacttcgggctcctcacaggatgcgtgttccccgaaaatgcactgagcggtgttacttgaaccgtgtgttgcctgcactccttaagaaacatgttatccgattgacaaagtttgattatagattagcaaacaggttgcaaactgacttgcaaaagttgagatgtagagtcaactatcatgcattgagatttactgctccaattcaagagatgggtgaaaaactaatacaaagaatgagggagaggagcgagtattttattgctcttcatttgagattcgaacctgatatgcttgccttttcggggtgctattatggtggtggagagaaagagaggagagaacttggtgctataaggaagaggtggaaaggcttgcatcctaacccagagaagggaagaaggcaaggtagatgccctctaactcctgaagaggtgggtctgatgttgagagccctgggctacagaaaggatgtccacatctatgtagcttctggagagatatatggaggtgcaaggactctggcacctcttaaagctctcttccccaatctccatacaaaagaaacaatatctagcaaagaggagctggctccattctctaaatattcttctcgcatggctgcacttgatttcattgtctgtgatgaaagtgatgcttttgtggctaacaacaacggcaacatggctaaaattttggctggacgaaggagatactttgggcacaagagaacgatccgaccaaatgccaaaaggctctatcccttatttttgaacagaggaaacatgtcatgggatgcattctccttaaaagtacacatggttcagaaaggatttatgggagagcccaaagagctgaggccagggaggggagaatttcatgagaacccctctacctgcatctgtgaaaggactgatggcaaagcagtagccagagccaaatctcaagatgatcaagtattgaatagtggtgctgaccaaggcaaaggcattggtgagccagttgttcctaatcgtactgacgaagaggtgggcgaacctgacgatgacgaagatgacccagcagagagagagattgttgatgctgaaatggacgacgatgtgttggtcggaccagaggatcctgagctagaacagattctttcagactagtatccggcatcaaagatgtttgcacaaactaatttttggcttgagtgattgacgaattttgccccgcccctctagattgtacatactttttgcgatgtaaatgtacgtatacatccgatctactctagcttagctcgcagccttcttaatggtcccttttgtaacatttgtggattgttatagcttgtatcatgggttttgcttttgtgtagcaactctttgatgccctttttgtgtaagcatcttagggcatgtagaatgtaaggtgcttacacacggataattaaggagagagaa

SEQ ID NO: 2635 - DNA, 2182 bp, Zea mays
aaaaaatctactgatctagaggcgggccggcctcccatgccgccaccgccgcctccaggaccacctcaccagcgccgtcgccgcggcgcttcttcgcagcttcgccctctggccgtgggatatggtccagtcacggcggcgcagcggcaactaccgttgcccgcgccgcgccgcactgccggcggcagcgctcctgctcttcctcctcgccgccgtcgcgctgctctacgtctccccgccgccgctcgcagaccaccccgtgctcgcttcctcccgccgccgccgctcggcccataccttgctgaacagctccggcgccggtagcatggaggagttcgagcgccgcgagatttcccgtgctccgacgaatggttcggccgtcagggatgacctttggggttcaaagcttgctagcaaattttatgggtgcagcaactcaagcagcaggtttcttgactcaaatattactacccaaccagagcgctatttgatgattgttacaagtggaggcctgaatcaacagagaacagggataatcgatgctgttgttgctgcacgcattttaaatgccacacttgttgttcccaaactagaccaagcatccttctggaaagattcaagcaatttttcggatattttttacgccgactggttcatctcatctctatcaaaagatgtaaagattgtgaaagagcttccacatataggaggtaaacttcgggctcctcacagaatgcgtgttccccgaaaatgtactgagcggtgttacttgaaccgtgttttgcctgcacttcttaagaaacatgttattcggttgacgaagtttgattatagattagcaaataggttgcaaactgacttgcaaaagttgagatgtagagtcaactatcatgcattgagatttactgctccaatacaagagatgggtgaaaagctaatacaaagaatgagggagaggagcatgtattttattgctcttcatttgagattcgaacctgatatgcttgccttttcggggtgctattacggtggtggagagaaagagaggagagaacttggtgctataaggaagaggtggaaaggcttgcatcctaacccagagaaaggaagaaggcaaggtagatgccctctaactcctgaagaggtgggtttgatgttgagagcgctgggctacagaaaggatgtccacatttatgtagcttctggagagatatatggaggtgcaaggactctggcacctcttaaagctctcttccctaatctccacacaaaagaaacaatatctagcaaagaggagctggctccattctctaaatattcttctcgcatggctgcacttgatttcattgtctgtgatgaaagtgatgcttttgtggctaacaacaacggcaacatggctaaaattttggctggacgaaggagatactttgggcacaagagaacgatccgaccaaatgccaaaaggctctatcccttatttttgaacagaggaaacatgtcgtggaatgcattctcctcaaaagtacacatggttcagaaaggatttatgggagagcccaaagagctgaggccagggaggggagagtttcatgagaaccctcctacctgcatttgtgaaaggactgatggcaaagcagtagccagagccaaatctcaagatgatcaagtattgaatagtgttgctgaccaaggcaaaggcattggcgagccagctgttcccaatcatacggatgaagaggcgggcgaacctgatgatgacgaagatgtccctgctgacaaagaggttgttgacgctgaaatggttgacgatgtattggccggggatcctgagttagaacagattctttcagactagtatccatcatcagagatgtttgcacaaaccaatttttggccgagtgattgatgaattttgccacgtccctcgaaattgtacatacttttttttttgcgatgtaaatgtacgtatacatccaatctactctagcttagctcgcagcctccttacacagtagctcttttgtaacgtttgtggattgttatagcttgtatcatgggttttgctttttgtgtagcaactctttgacgccctttttgtgtaagcatcttttggcatgtaggatgtgaggtgcttaagcacggataattaaggagagaacgttgtcaaaaaaaaaaaaaaaaa

SEQ ID NO: 2636 - DNA, 4032 bp, Oryza sativa Japonica Group
agatctccgggctccggaggatggcccagcctcgacggcgcggcggcggaggccacaacaagtgcccgcgcccggccctgctgccggcggcggcgctcctgctcttcctcctcgccgccgtcgcgctgctctacgtctccccgccgccgctcatcgatcacccggccctcgcttcctctcgccgccgctcccctcatgcccccctggtggtgttgcactagtaccccttcctacctgctccccacgcttatcccgatctaatttgtcttgctctgtgcattccgagtgcagctgaacagctccggcggcggaagcacggtggtgtccgagcacagcgagatttcgcgcgttccgataagcgtaagcttctttggttagattaagcgaactaattcctcgattaattgtcagaggttgcgtggttgtgctgttcagaaattagtagatacagtgcacttattccagttctagtgcctaactaattgtttctgggaaatggttgttttaattggtagataatgattcaggttccattccctgtgccatttttgaagcaaattagatgatggcaagctattaaattgagctcttttctattatatttacggagttagattaggatgttctagagtattttctaacttgttatcatgggtttatttatttcctttgaaacacaacttgttctcatgggttttctagatgtgatcctctgagatttgagttaaactgattttatttaatgcgctcaagagtcaagacactccctattttgaaatatagacccatgaaatatgtactcattttgctccatttttgtctaaagtagcatgaaaacttcattgcaatttctcatactgcagaaagaggcagatggcctttggggttctaagtttgcgagcagattctatgggtgcagcaactcaagcagcaggttccttggtgcgcattatttttccactgacggttaaaatttgctcgaactgagtagtgttttagatttgtagtgtgcatgtttctgaggcattctacatataggaggttttagtggcagtggtactattctttgttgtatggattacctgaaatagtcaatgttttaaattgtgcaggttcaagtgttatcacgcaaccagaccgttatttgatgatcgttacaagtggaggcctcaatcaacagagaacaggggtaatatatgtgccacactgttccgtatcaaatactgtgatgcgtgtggatggataggaaaaagaataaaagaaatcagtttgcaaatgtacatgaagaatcaacttgtacacatagattttatgtgatccattatgacaccatgttccatgtaactccgtggtagttatgtgtattctgttgttccatatgcataactatgaccatcttctgcttttcagataattgatgctgttgttgctgcacgtatcttaaatgccacacttgttgttcccaaattggatcaaacatctttctggaaagatgcaaggttaatttgagtattgagcgcttcctaccctaatattctaaggctgcccatgtttctatgaacacttacatttgtatgtgtactgtttctctgcagcaatttctctgaaatttttgacgtcgactggttcatctcgaatctatcaaaggatgtaaagattgtgaaagagcttccagagataggaggcaaactgcggactcctcatagaatgcgtgtgccccgaaaatgtactcagagatgttatgtgaaccgtgtgttgcctgcacttcttaagaaacatgtaagtcattgctagcagcatataatcccaagatacttttaaattatgtgctaattcaccgtcttgatgatatgaatttttgagatcaggaatagaaatttcatattcttggtaggtcaattgactgtactttcgttccactgactgaccattgaccaccttgtgtgacttcaaataaatttacttcttctgttcagagacactcataataccaataccaggataccttatatcattactttcacgtagtgcaggttgttcggctgacgaaatttgattatagactagcaaacaggttggacacagatctgcagaagctgagatgcagagtaaactatcatgggttgagatttactggcctaatagaagaaatgggtgaaaaattaatacaaagaatgagagagagaagcaaacattttattgctcttcatttaaggtacacgcatctcaagttctggtgcttgagctctcatattttggttttcctttaatacaaaactagagagtcttatattcttagtgctgtatttgtgaagaacatagtttctttttctcaggggattacttgaaacccattttaggtcataaggggggcaattttcatctctagcttggattagcaaatgttgggctccttagcatgtttcttttatcatgaataccccagttgagcatagcctggatttgagagggaggatgcacaaaataggatgcatgcacaaaatagtgaagggtgatatctaaaagttgtcaaccaatactgtccaaagtagcctttgtgcgggcacatactcatactagtagaacatatatatggagttccgaatggcatgtcaaaagagggtcctcctgtgctccatctatgtattgagaagattggtctcagatcttatcgataatatcagtcaatcacttgttggtcatgctagtaaagagagaaggccatcatatagcatgctcttgtcaggagaagttcagtttagtggattggctgtgacctttgcttcagaatagaccaccatcttggtctgaagttgtactggtttctgattttcttgtatgagtaatataagtatgttgtctatttagtttgtagtggtttccttttttttccttttccctaaacagtctttctcttgggttgccagatttgaacctgatatgcttgcattttcggggtgctattatggtggtggagaaaaagaaagaaaagagcttggtgcaatacggaagagatggaaaaccttgcatgtacgtatggcatatcattatagtgtattagtacgtacttaaaatggcatatatccttgaccgaactacctactgcaacctcttctttgtttaggctatcaaccctgagaaaggaagaaggcaaggtagatgcccattgactcctgaagaggtggggctgatgttgagggcactgggctacagaaatgatgttcacatttatgttgcatctggagagatatatggcggggcaaggacattagcacccctcaaagcgttcttcccaaatctccacacgaaagaaacaatatcaagcaaagaggagctggctccattctctaaatactcatctcgcatggctgcacttgattttattgtatgtgatggaagtgatgcttttgtgactaacaacaatggtaacatggctaaaattttggctgggcgaaggtatacttctcttctgctactggaagctccctgctgtcatcatgtacttcgttattagttctgaccatctatactgcttttgataggagatattttgggcataagagaacgatccggccaaatgctaaaaggctctattccttaatttcgaacagaagaaacatgtcatgggattcattctcctcaagagtgcgcatggttcagaaaggatttatgggagagcccaaggaactcaggccaggaaggggagaatttcatgagaacccttctacctgtatatgtgaaaaaaccgttagcaaaacagtagccaaatctaactcccaatctgagcaagtcttaagtaatgatactgagagaggaatagccattcaaactgagcaagtctcgagtaatgatactgagatgggaatagccactagtgagcccacagttcctgatcatactgatgaagaggcaggtgaatccgaggcagatgaagatgctcctggagagaaagaggagataattgatcctgaagcggatgatgatgtgcagttcagactagaggatccagagttagaagggattctttcagat

SEQ ID NO: 2637 - DNA, 2091 bp, Sorghum bicolor
atgggccagccgcggcggcgcggctacccgcacgggcacggccgccaccaccggtgcccgcgccgcattgcgctgccggcggccgggctgggcctgctctttctcgccgtctcgctcctctccgtctcactcctctccgcgccgccgctcgccgacccgcgcacgggcctcggcacttcctcttcctcccgacggttcctccgccgctatccgacaaacggctccggcggcgaactagagggctccgagagcggggatgcgttcagtgttacgacacatggatggactgggcaggatgatctttggcgatcgaagcttgctagcaatttccacagatgcagcaactctagcaataaatttcttgattctggtgttaccactcaaccagatcgatacttgattgttgttacaagtggaggtcttaatcagcagagaacggggatagtcgatgctgtagttgctgcacgtattttgaacgctacacttgttgttcccagactggatcaaacatctttctggaaagattcaagtaatttttcagaaatctttgatatggactggttcatctcatatcttgaaaaggatgtcagaattatcaaagagcctccagaaaaaggaggtaaagcaatgaaaccttataaaatgcgtgtcccccgaaaatgtactccacggtgttacttgaaccgcgtcttaccagcacttttgaaaaaacatgttattcgaatgactaaatatgattataggctctcaaataagttggacactgacctgcaaaaactacgttgcagagtcaactatcatgctttgagatttactgacccgatacaagaattggctgaaaagctaatacagcgaatgcgagaaaagagcagatattttattgctcttcacctgagatttgaacctgatatgctcgccttttctgggtgctattatggtggtggagaaaaggagaggagagaattagcttcaattcgcaaacgatggagaaccttgcatatacgtgacccggagaaaggaagaaggcaaggtaggtgtccactaactcctgaggaggtagggttgatgttgagggcattaggctacagaagtgatgtgtacatttatgttgcttctggtgagatatacggaggggaagatactttagcacccctcaaagcgctctttcctaatttccatacaaaagaaacactgtcaagccaagaggagcttgctccattcctaaagttctcatctcgcatggctgcaatcgatttcattgtctgtgatgaaagtgatgcttttgtggctaacaacattggtaacatggccaaaattctggctgggcaaaggaggtattttggccacaagagaacaatccggccaaatgctaaacagctctatcccttattcatgaagaggggaaatatgtcatgggatgcatttgcctcacaggtgcgaactatccagaaaggatatatgggagagcctatggaaatcacaccaggaagaggcgaatttcatgccaaccctgccgcctgtatatgtgaaaagagcggccgaaactcagtaatagtcaagtccatttctggaagtacccaggaacctgtaactgacaccagaataaggaaagccattgacattggtagaccaccataccctgtttatactgacgaagaggcagatggatctgatacagaagaagatccagatagcagcgggagaggagaggtgattgacactgaacctgacgatgattctgtggtcagacaggaggatcctgagctagaggagatcctgtcagattagttcagttgtgcggctatttcctccggttaagctatgcaaatctgactttgcatatacatgtgttgtatgtggcagaaatttcatggtttggacatctccgaactagcctagatctgcagccactggtgtacatagattttgtggtgtgcagctgtccatcctctttcccctagctgaatgagggcatgatcatgtttgtcacctcagcaagccagatttttcctccttttcttaacatcccgccatcgctaatccctcatgaaaatgtgtatatcctgcttagttttcttaacatctgttttt

SEQ ID NO: 2638 - DNA, 729 bp, Zea mays
gatcgtctctgacgtaccagtaccaatctggctccgctcgtcacaaatccgtctgtgcatcgcgtcggcgaccaggaggcgacgaggcaggcagagcgggcggcgactacagcggcagcagatctcacggcatggcggcgaaggcgatctcgagccccgtgccggtggagtggtatccgacgctggccgtcgtcatggtatccgtaggcctcatgttcaccgcctccttcttcatctatgaagctacttcatccaagcggagccgtagcctggcaaaggagatcacaacagcagctgttgcttctgttttactgggctttgggtctctgttcgtgctcctccaagtggtgtttatgtttgacgactgcgtatggggccgtgttcttggattcagcagacttagggcatgtacaagtctgagactccatttttctatgagacagctaagagactatatgacataactttaagactcagtattataaatgcagttaatagacaacatgcgtagagtcgtaaagaggcgggctcttagcgaagagcttggctcttgtattttttttcatatagtcccttagagaactctcaagagaccatatattaaatagggttgtacatgcacttagtaattgattgtaggatatgccagatcctcgaagcttgtgttgtcctaacggatatggagcatttgaactttcaaactttctagaaccaaaaaaaaaaaaaaaa

SEQ ID NO: 2639 - DNA, 1913 bp, Zea mays
cacataagaggcgacatcacatcgcgttccgccgcctcacacgctagttggagctgtagtattagccaaccagccagcctccgatctccatccatatggaggaggctgcgcccgcggcggtcatggagcgggagcgcctcacggccgagatggccttccgcggcgcggacgaagctcggcgggaaggcggcgacccggcgcccagcatcgtcatcaagatccgccgccggctcccggacttcgcccgcaacatcaagctcaagtacgtgaagctcgggatccgccacggcggcagccccacgtcgctgctgccggcgctctgcgtgccggcggtcgccgccgccgcctactcgttcgtccgcctcgacgtcatctactactccgtcgacctgctcacctgcgtcgcctggctcggcaccgcgctgctgctgctcaccgtctactacctcaagcggccccgccccgtgtacctcgtcgagttcgcgtgctacaagccggaggagcggctcaagatctccaagtcggccttcctcgagatgaccgagagcaccggctccttcaatgaggcggctctggacttccagaccaagatcaccagccgctccgcgctcggggacgagacgtacctgcccccgggcgtccaggcgcgcccgcccaggctaaacatggcggaggcgcggaaggaggccgaggcggtcatgttcgggtgcctggacgcgctgttcgagtccacggggatcgacccgcgccgcgacgtgcgcatcctcatcgtcaactgcagcctcttcaacccgacgccgtcgctggcgtccatggtcatcaaccactacaggatgagggaggacgtcaagtcgttcaacctcggcggcatggggtgcagcgccggcctcatcgccgtcgacctcgccaaggacatgctccaggcgaaccccggatcgtacgccgtggtgctcagcaccgagaacatcaccctcaactggtacttcggcaacgaccgctccatgctcctctccaactgcatcttccgcatgggcggggccgcggcgctgctgtccaacaggcgcgcggacgccgggcgcgccaagtaccggctgctccacacggtgcgcacccacaaggcgccaccgacgagtgcttcaactgcgtgtaccagcgcgaggacgaggccggcaaggcgggcgtctcgctggcgcgggagctcatggcggtggccggcgacgcgctcaagaccaacatcacgacgctggggcccctggtgctgcccctgagcgagcagctcaagttcctcaggtcgctgatgatgcgccgcgtgttccgcgtcaggggcgtgcgcccctacatcccggacttccggcgcgcgttcgagcacttctgcgtgcacgccggcgggcgcgcggtgctggaggaggtgcagcgcagcctgagcctgcgggacacggacatggagcccagcaagtgctccctccaccggttcggcaacaccagcagcagctcgctgtggtacgagctggcgtacgccgaggccaagggccgggtaaggcgcggccaccgcgtgtggcagatcggcttcggctcggggttcaagtgcaacagcgccgtgtggcgcgctctacgcgacgtgccgccgctgccgtcgtcgcccggcgccgcggcggggccgggggccaggaagggcgcgccgcagagctgctgcaatccctgggtggacgacgtggacaggtaccctcccaaggcgtacgtctgatgggccacgtcacgtggccacaacaattgcatgatcccaatcccattcggatttcctcacgacgaattaatgaagaagggcgtgtgagtgtgagggagaaagttatacttgtatgtattttttttttcagttttattttgtcgtttcgttttcaaaaaaaaaaaaaaaa

SEQ ID NO: 2640 - DNA, 1644 bp, Sorghum bicolor
atggaggctgcgcccgcggcggtcatggagcgggagcgcctcacggccgagatggccttccgcggcgccgacgaagctctgcgggacggcggcggcgagccggcgcccagcatcgtcatcaagatccgccgccggctcccggacttcgcgcgcaacatcaagctcaagtacgtcaagctcgggatccgccacggcggcagccccacgtctgtgctgcccatgctctgcgtccccgcgatcgccgccgccgcctactcgttcgtccgcctcgacgtcatctactactccatcgacctgctcacctgcgtcgcctggctcggcaccgcgctgctgctgctcaccgtctactacttcaagcggccccgccccgtgtacctcgtcgagttcgcgtgctacaagcccgaggagcagctcaagatctccaagtcggccttcctggagatgaccgagagcacggggtccttcaatgaggcggcgctggatttccagaccaagatcaccaaccgctccgcgctcggcgacgagacgtacctgcccccgggcgtccaggcccgcccgcccaggctcaacatggcggaggcgcggatggaggccgaggccgtcatgttcgggtgcctggacgcgctgttcgcgtccacggggatcgacccgcgccgcgacgtgcgcatcctcatcgtcaactgcagcctcttcaacccgacgccgtcgctggcgtccatgatcatcaaccactacaggatgcgcgaggacgtcaagtcgttcaacctcggtggcatgggttgcagcgccggcctcatcgccatcgacctcgccaaggacatgctccaggcgaacccgaactcgtacgccgtcgtgctcagcaccgagaacatcaccctcaactggtacttcggcaacgaccgctccatgctcctctccaactgcatcttccgcatgggcggcgcggcggcgctgctgtccaacaagcgcgcggacgccgggcgcgccaagtaccggctgctccacacggtgcgcacccacaagggcgccaccgacgagtgcttcaactgcgtgtaccagcgcgaggacgaggtgggcaaggtgggcgtgtcgctggcgcgggagctcatggcggtggccggcgacgcgctcaagaccaacatcaccacgctggggcccctggtgctgcccctgagcgagcagctcaagttcctcaagtccctcatgatgcgccgcgtgttccgcgtcaagggcgtgcgcccctacatcccggacttccgccgcgcgttcgagcacttctgcgtgcacgccggcggccgggcggtgctggaggaggtgcagcgcagcctgagcctgcaggacacggacatggagcccagcaagtgctccctccaccggttcggcaacaccagcagcagctcgctgtggtacgagctggcgtacgccgaggccaagggccgggtgcggcgcggcaaccgcgtgtggcagatcggcttcggctccgggttcaagtgcaacagcgccgtgtggcgcgcgctccaagacgtgccggcgctgtcgtcgtcgtcgtcgaccggagccgcagcagcggggaagggcgcgcagagcaagagctgctgcaacccctgggtggacgacgtggacagtaagtataggttggcgtga

SEQ ID NO: 2641 - DNA, 2097 bp, Oryza sativa Japonica Group
acgcgtcccgctctagtgctttagccttttccattcacgccaaaggcaacctcgagttcagctcggtacgtgtcggggagagtcaagagaaagagaaagagagggctagcttagctgtgagctccatggaggcggctgtcatggagcgggagcggctcacggcggagatggcgttccgcgacgacgcgcgggcggccgggggggagtgggcgccgagcatcgtgatcaagatccggcgccgcctcccggacttcgcgcggtccgtgaacctcaagtacgtcaagctcgggatccggcacggcggcagcgtcacgtcgtacctgcccatgctgtgcgtgccgctgctcgcctccgccgcctactccttcgtccgcctcgacgtcatctaccgctccatcgacctgctcacctgcgtcgcctggctcgggaccgccgtgctgctgctcaccgtctactacttcaagcgcccgcgcccggtgtacctcgtcgagttcgcctgctacaagccggacgaccagcacaagatctccaaggaaggcttcctcgagatgaccgagagcaccggctgcttcaatgacgccgcgctcgacttccagaccaagatcaccaatcgctccgcgctcggcgacgagacgtacctccctcccggcgtccaggcgcggccgccgaggctcaacatggccgaggcgaggatggaggccgaggccgtcatgttcgggtgcctcgacgcgctcttcgagtccaccgggatcaacccgaaacgcgacgtgggcatcctcatcgtcaactgcagcctcttcaacccgacgccgtcgctgtcgtcgatgatcatcaaccactacgagatgcgggcggacgtcaagtcgttcaacctcggcggcatggggtgcagcgccggcctcatcgccatcgacctcgccaaggacatgctccaggcgaaccccaactcgtacgcggtcgtcctcagcacggagaacatcaccctcaactggtacttcggtaacgaccgctcgatgctcctttcgaattgcatcttccgtatgggcggcgcggcggcgctgctctcgaaccgccgcgccgacgccggccgcgccaagtaccggttgctgcacaccgtgcggacgcacaagggcgccaccgacgagtgcttcaactgcgtgtaccagcgcgaggacgaggacgggaaggtcggggtgtcgctggcgcgggagctcatggcggtggccggcgacgcgctcaagaccaacatcaccacgctggggcccctcgtcctcccgctcaccgagcagctcaagttcctcaagtccctgatgatgcgccgcgtgttccgcgtcaagggcgtgcgcccctacatcccggacttccgccgcgcgttcgagcacttctgcgtgcacgccggcggccgcgccgtgctggaggaggtgcagcgcagcctcagcctggaggacagggacatggagccgagcaagtgctcgctgcaccggttcggcaacaccagcagcagctcgctgtggtacgagctggcgtacgccgaggccaagggccgcgtccagcgcggcaaccgcgtgtggcagatcggcttcggctcggggttcaagtgcaacagcgcggtctggcgcgcgctccgcgacgtgccggccgtgtcgccgccgccgaaggggaagaagagctgcaacccctgggtggactgcgtcgccaagtacccgcccaaggcgtacgtttgacggttacgttttcgtgacctcgcacaaattgtatgattcatttctcctcaccaaaacacacaaaaaaaagagggcatatgctggggaagactttttttttttgtcgttttttcttcttcgcataggtttgctgtagacattgccggttattggaattcagggatttatacggcgaattgaattccaaaagctagcagtgccattcttttcagtttttgtactagcagcatttgttttacacatcctggccttctagaagttggggggaaacagaatggaggacatcacaacatgccatactacatatgactagagaacaatattgccaagtgtaaattataaacgagaaatcaatgttacacgttgtttgtgt

SEQ ID NO: 2642 - DNA, 1907 bp, Hordeum vulgare subsp. vulgare
gacgcttccggttccggcgcctcggtccaactcacaccaaaggcgacactcgacgcgagtacgtctacgtctacgtacgactcgagatccatggagtctgcgccggcggcggcgttcatggagcgggagcgcctcacggcggaggtgaccttctccggggacgcgcaggctgcggcgtccactgaggggctgcccagcatcatcatcaagatccggcgtcgcctcccggacttcgcacgctccgtcaacctcaagtacgtcaagctcgggatccggcacggcggcagcctcacgtcctacctgcccatgctctgcgtgccggtgctcgccgcggcggcatactccttcgtccgcctcgacgtcatctacctctccatcgacctgctcagctgcgtcgcctggctcggcaccgccatgctgctcctcaccgtctactacatgaagcggcctcgcccggtgtacctcgtcgagttcgcgtgctacaagccggaggaccagaacaagatctccaaggaggccttcctcgacatgaccgagagcaccggctgcttcaacgacgagacgctcgcgttccagaccaagatcaccacccgctccgctctcggcgacgagacctacctgccctcgggcgtccaggcgcgcccgccgaggctcaacatggccgaggcgcggctggaggccgaggctgtcatgttcggctgccttgacgctctgttcgcgtccaccgggatcgacccgcgccgcgacgtgcgcatcctcatcgtcaactgcagcctgttcaacccgacgccgtcgctggcgtccatgatcatccaccattacaagatgcgggaggacgtcaagtcgttcaacctgggcggcatggggtgcagcgccggcctcatcgccatcgacctcgccaaggacatgctccaggccaaccccaactcgtacgcggtcgtgctcagcaccgagaacatcaccctcaactggtactttgggaacgaccgctccatgctgctctccaactgcatcttccgcatgggcggcgccgcggccctgctctcgaaccggcgcgccgacgccgggcgcgccaagtaccgcctcctccacacggtgcggacgcacaagggcgccacggacgagtgcttcaactgcgtgtaccagcgcgaggacgatgtgggcaaggtgggcgtgtcgctggcgcgggagctcatgacggtggccggcgacgcgctcaagaccaacatcaccacgctggggccactggtgctgcccctcagcgagcagctcaagttcctcaagtcgctcatgatgcgccgcgtgttccgcgccaagggggtgcgcccctacatccccaacttccggcgcgcgttcgagcacttctgcgtgcacgccggcgggcgcgccgtgctggaggaggtgcagcgcagcctgagcctggaggacaaggacatggagcccagcaggtgcgccctgcaccgcttcggcaacaccagcagcagctcgctctggtacgagctcgcctatgccgaggccaagggccgggtgaagcgcggcaaccgcgtctggcagatcggcttcgggtcgggcttcaagtgcaacagcgccgtgtggcgcgcgctccgcgacgtgccgcccgtgtcgcccccgcacgccggcgccgctgcgcctggaccggagaagaaggcggcctgcaacccgtgggtggactgcgtcgccaagtacccgcccaaggcgtacgtctgatgatcattacgccgccgctgctgctgctgcataactccacacgaagattacatgattcttttctccccaccgcagtgtaaaacatcacaagtgcggtggggagattatatactcctactatactttttctgtatttcctttcccgtagggtggctgtaattcaggttccatgggcgagc

SEQ ID NO: 2643 - DNA, 1608 bp, Sorghum bicolor
atggagtccgcgccgtcaacggcggcggtcatggagcgtgagcgcctcacggccgagctggacttggccgtggtggccgcggagcccagcagcttcgtcgtcaagatccggcgccggctgcccgatttcgcgcgcagcgtcaacctcaagtacgtccgccttggcctgcgctccggcggcatcccagccccctccacatgggtccccctcgcgctcgcgccgccgctcctcgccgcagcggtatactcgctcgtcggcgcggacaagctctactcgctcgacctgctcacctgcgtcgcgtggctcgccgcggcggtgctgctgctcacggtgtatttcctcaagcgcccgcggccggtgtacctcgtggacttcgcgtgctaccggcctgccgacgagcacgccatctccaaggagggcttcctcgacatgacggagagcacgggctggttcaacgcggaggcgctcgagttccagaccaagatcaccaggcgctccgggctgggagaccggacgtaccttccgccgggaatccaggcgcggccgccgcggctgtcgttgacggaggcgcgcgcggaggccgaggccgtcatgttcggctgcctggacgcgctgttcgcggccacgggcatcgacccgcgccgcgacgtgcgcgtgctcatcgtcaactgcagcctcttcaacccgacgccgtcgctggcgtccatggtggtgcaccgctacaagatgcgggaggacgtcaagtcgttcaaccttgctggcatggggtgcagcgcggggctcatcgccgtggacctcgccagggacatgctgcaggcgaaccccaggtgctacgccgtcgtggtgagcaccgagaacatcacgctcaactggtactttggcaacgaccgctccatgctgctgtccaactgcatcttccgcatgggcggcgccgccgcgctgctgtccaaccgtcgggccgacgcccggcgcgccaagtaccggctgctgcacacggtgcgcacccacaagggcgccgcggacgagtgctacagctgcgtgtaccagcgcgaggacggcgctggcagcgtcggcgtgtcgctggcgcgcgagctcatggccgtcgccggggacgcgctcaagacgaacatcaccaccctgggcccgctagtgctcccgctgtcggagcagctcaagttcctcaagtccctggtgctccgccgcgtcctccgctcccgcggcgtccgcccgtacatcccggacttccggcgcgcgttcgagcacttctgcgtgcacgccggcgggcgcgccgtgctggaggaggtgcagcgcagcctggggctcagggacgtggacatggagcccagcaggtgcaccctgcaccgcttcggcaacaccagcagcagctcgctctggtacgagctcgcgtacgccgaggccaagggccgcgtccgccgcggccaccgcgtgtggcagatcggcttcggctccgggttcaagtgcaacagcgccgtctggcgcgcgctccgtgacgtgccgcccgtgcacgccgacggcgccggcggtggcagcaactgcaacccgtgggtagacagcattcacaggtacccgccaaaagcgtacatctga

SEQ ID NO: 2644 - DNA, 1929 bp, Hemerocallis hybrid cultivar
ggtaatggaccgagaacgactgacggctgagatggccttcagagactcctccattgtcatcaagattcgccgtaaactccctgattttctccagtctgttaagctcaagtatgtcaagcttggctatcggtcgaccaccaaaccacccttctaccttctccttcctcttctacttattgccgctagcttaatctttcgtattcatactactctcacctttcctgccaacttctctatcgactttgtcactgctttctcctcctcttccatcgctcttcttctccttggtgtctactatactagacgccctagaccagtgtatcttgtcgactttgcttgttacaaaccagaagacgagcacaagatttcaaatgaaggtttcctagaaatgacagagagcacgactgcgttcaacgacaagtctcttgacttccaaacgaagatcacagtgcgttctgggctaggagatgagacttacttgccaccaggaatacaagctcgcccaccgaaactgtccatggcggaggcaaggcttgaagcagagacagtcatgtttggctgcctcgacgcgcttttcgaatccactggtattaaccccagtcgagatatcgggatattaattgtcaactgcagccttttcaatcccacgccttccctctctgcaatgatcgtaaaccattacaagatgagagaagatgtgaagagcttcaatttaggcgggatggggtgcagtgccgggctaatttcaattgacttagctaaagacatgttgcaggccaatcccaactcctatgcgctagttctcagtacagagaacattacactgaactggtactttggcaacgatcgatcaatgcttctatccaactgcatcttccgaatgggcggagcagcagtcttattatccaacaagagaaaagacgcaaagcgagccaagtataggctacttcacacggtgaggacccacaaaggagcagatgacagctgttacaactgcgtgtatcagagagaagacgaaggagggaaggtaggtgtttcactggcaaaggagttaatggcagtggctggagatgcattgaagacgaacattacgactttgggaccactagtgctgccgctgacggaacaggggaaatttctggcaactttgattacgagaaagttgcttaaactgaaaggggtgaggccgtacattccaaattttaaacgcgcatttgagcacttctgcgtgcacgctgggggcagagcagtgttggatgaggtcgagaagaatctggggttggagaagacagacatggaggcatcgagaagcgtgctccaccggtttgggaacactagtagcagctcgctgtggtatgagctggcttacaatgaggcaaaggggagagtcggaaagggtgatcgagtttggcagattgggtttgggtcggggttcaagtgtaacagtgcagtgtggaaggccatgaaagacgttccggcaattgatcgaacagctagtgggtcttctcgaatgtgcaatccgtggggggattgcattgaccgctacccagtcaagtgaggcgcgaaaattaaagacacgaacagtttctcattattgtggttcaactgtaaagagagctgggataggcacaggcaggctgtaactatttacatacagtttctcattattatggttcaactgtaaagagagctggaataggcacaggcaggctgtaactatttacatctgcgttttatttaatttatttattcattcacacgtgttatgtgcgtgtgcttgaaagtaaagcagcaggtaatggtttggctggacttttctctacaagagagagagaggttgtacgttaattatgagtagattttatcgtcaatcgggtaatttatggaaacttcaatcaataaatgttattcaaaaaaaaaaaaaaaaaa

SEQ ID NO: 2645 - DNA, 1671 bp, Oryza sativa Japonica Group
atggcgtccacggcggcagtgatggagcgcgagcgcctcacggcggagatggccttcccgccggccgtcgtggcggccggcggcggcgccagctgcaagccgggcgcggagccgcggagcatcgtgatcaagatccgccgccggctgccggacttcgcccgctccgtcaacctcaagtacgtcaagctcggcctcctctccgccggcttcccgatgccgccgtcgccgtcgtgggtggtgatgctcgcgctcgcggcggccgcggcgtacggcctgttcgacgttgccgcgctctacgccgtcgacctcgtcggctgcgccgcgtggctgtgcgcggcggcgctgctcgtcgccgtctggtacgccaggcggccgcggccagtgtacctcgtcgagttcgcctgctacaagccggacggcgacgagcacgagatcagcaaggacgggttcctcgagatgacggagagcacggggttcttcaatggcgaggcggtcgcgttccagaccaagatcacccgccgctccggcctcggcgaccggacgtacctgccgccgggcatccaggcgcggccgccgcggctgtccatggcggaggcgcgcgccgaggcggaggccgtcatgttcgggtgcctcgacaagctgttcgccgccacgggcgtcgacccgagccgcgacgtgggcatcctcatcgtcaactgcagcctcttcaacccgacgccgtcgctggcgtccatggtggtgaaccgctaccggatgcgcgaggacgtcaagtcgttcaacctcggcggcatggggtgcagcgccgggctcatcgccgtcgacctcgcccgcgacctcctccaggccaacgccggcgccctcgccgtcgtggtgagcaccgagaacatcacgctcaactggtacttcggcaacgaccgctcgatgctgctgtccaactgcatcttccgcatgggcggcgcggcggcgctgctgtcgagccgcggcggcgacgcgcggcgagccaagtaccggctgctccacacggtgcgcacccacaagggcgccgccgacgggtgcttcggcagcgtgtaccagcgcgaggacgaacgcgggagggtgggcgtgtcgctggcgagggagctcatggcggtcgccggcgacgcgctgaagacgaacatcaccaccctcggcccgctcgtcctcccgctcgccgagcagctcaagttcctccggtcgctggtgctccggcgggtgctccgccgcggcgcgcggcgcccctacatcccggacttccggcgcgcgttcgagcacttctgcgtgcacgccggcgggcgcgccgtgctggaggaggtgcagcggagcctcggcctcggcgacggcgacatggaggcgagcaagtgcgcgctgcacaggttcgggaacaccagcagcagctcgctctggtacgagctcgcctacgccgaggccaaaggccgcgtccgccgcggccaccgcgtctggcagatcggcttcggctccggcttcaagtgcaacagcgccgtctggcgcgcgctccgcgacgtgccgcccgtctcctccggcgccggcgacggcgaggaggagcgccgccgcgtaattgttattgtcgctattatacgacttttcgaaaaggaccaattgactcttcggaaccaaaacatcgtatctagatga

SEQ ID NO: 2646 - DNA, 921 bp, Zea mays
gtgaaaggggagaaaagagggcgggaaggaccgcggattttgctagggtttgcggtttctgcttcacactgcctcctcagtcctcaccaccacagccgtcgcgcgcaggaggtttgggaggatgccacgtaagatcaccttggtcaaggagggggagccgcagccggtggacgctgctcaaggggagcccgctccggcaccggcggcaccgacggccgcgttgacggaggcggaggtggacgagctgcccagggccatcgtgcgccgccttgtcaaggacaagctttcccacgtcgccggtggggaaggagccgaggtcatcgtcaacaaggacgccatggccgcgttcgccgagagcgcccgcatcttcatccactatctctccgccactgccaatgatatgtgcaaggaatcaaagaggcagaccatcaacgctgatgatgtcctcaatgctcttgatgacatggagttttcggagtttgtagagccccttaggacttcactgcaagagtttagaaacaaaaatgcagacaaaaggtcagaagcaaagaaacaacagaaggaaaagagaaggaaattaaatgaagagacacttccgcagaaagaaaatgatccagctgatgatgccaaggagaatggagtagcttaatcgcaagaaaaatgaagaatgaatacaattaacttctctgctggaggggcagtaacacgcagaatcaaaaccatggcagtatttgttggtagttgtatttgcttttgctccatgtagcctctactccaaaacactttcttgacttgatatgatgctgtataattctagtgtcctatcagttttcagcttgcttatggtgcaattaaaattctatgtgcctgatgaaattgttcttatgaatgaagaatgataccagcactatgttcgttggc

SEQ ID NO: 2647 - DNA, 519 bp, Sorghum bicolor
atgccacggaaggccaccaaggccaaggagggggagccgcagccggcggacgccgcgcaagaggagcccgttccggcgccggcggcacctgcggccgcgttgactgaggcggaggtgggcgagctgcccaaggccatcgtgcgccgccttgtcaaggacaagctctcccacgtcgccggcggggaaggagccgaggtcatcgtcaacaaggacgccatggcggcgttcgccgagagcgctcgcatcttcatccactatctctcggccacgtccgtaacatcccaaatcccattctctcgctcctcagtcccaccactctcagattcagatccagattgccccctgtttgcattgggggtttggaactcggaagagaatgccaagttcagaaacaaaaatgcagacaaaaggtcagaagcaaacaaaaaacaaaaggaaaagagaaggaaattaaatgaagagacacctccggagaaggaaaatgatccagctgatgatgccaaggagaatgacgagtag

SEQ ID NO: 2648 - DNA, 2221 bp, Zea mays
cagttccggcatgcttaatcttcgggtcaacggtttcgatggaaacccagtgagacactgcggccttcgcccttccatcttcatccagctggggaagataaccctccgatccggcgcaggcatgcttaatctgtccaggtataaagcacaaaaaagtgatcctctcatctaattgagactgttgagtatctcacatattcttgtgcttgcttgctgggatcggctttggctcaggagcatgagcgaaaagatatgattcttcatttctccttctggctataagttttagtttctttatgatgggaaataaaactggtaagcctgtcttcagtgagctcaaatccacagagtttagtttattggagagcactctagtacaggatcattgtgcaatcccgacttgtgtaccattggattttctgaaggccatcacgagtgatttctctaaggagcaagagctaggaagaggtgggtttggagttgtttataagggccttcttaaaaatgggaaggcgatagctgtgaagaagctttctgaaatgaacctagatgacgatcagttccataatgaagttacttatcttttcgggttgaagcacaaaaatattgtccagctaaaagcttattgtgctgaatcacggtgggaagcaatcgaattgcgcagaaaatatgtcatggctgaatctcggaaaaggctgctgtgctttgagtgtataaataataagagccttgataagcacctttctgctgaatctcatggggttgagtggcatatcagatatgagataatcaaaggaatttgccatggtttgcattaccttcacacagattgccaaattgttcatttggacctaaagcctgagaatatattgctagatgacaacatggagccaaaaattacagattttggtatgtccaggctctttggtctacaacaatccaaaatcatcaccaaaacttgtggaggaacacttggatacatggcaccagaatacttactaaaagggttgatttcagtgaaggccgacatattcagtttgggcgttataatcatagaggtgatgaccggaggccggaattatcccacttgtgaaaaatcttgcgagcaattcgctgttgatgtggttggacgttggaggaagaggttattggaggaggcaggaaggtacacacccttggaaaaatacgttgagcaagtagagacatgcatcttgataggattgatgtgtgtcgatgatgatcctaacaaaaggcccacgacattggacattatcgaaaggcttaccaaagtagatgtcacgaacacggacagagggccacccaaaactctggaggccgcgacagggcttacaggccaccccaacctcgcaactagatcatttcttgacaggttccgccgaaccatcgtgatagggatgctgaagaaggccctgaaaatccaggacgtatcgcagttggagcagctcctggccaaggaggtgctgctggagctccacaaaatcggcacgaatgcaactggaaacagatcgttcctggagaggctccacgcaagcatcaccatggctacgctggttcaggcgctgcattccttggacttggatccatcggcggcgctgcgtatggaggtgctgttcttggcgctggagaatatgcgtggaaaaaacaactcaaggcgaagaagcgaggacgtccttgagctggaggagcggccagagcagatccggtcggtgctagaggctggcaccagggccaggctcagtgatgaggaacacatgccgtcggtgtctgtgcaggctgaagaccaggcctttcccaaaccgaagttggccaaagtacgcgccaccgccccggtgtgcgtgtcagcagtgtggttggcggccggcataggattcctgtgtggattcaccctaggagagatgaggggattaaggcggacgagggtccacgaacgcacgtgatgccaatgtgcccacatgacatggccagaaaatgtcactgcggtggaccatgcatgcacgaattaaggagcaccagttagaatacgtattctagattcattttacaaattctgtatttaaaaggaacttgtgcattgtgacagaggcggcggactggatcaggttgtattgtttctgctggtgtcctgtcgtatgtataagccacggagtgtatcggatgaaattgaacagagaaatgtgcaatatagaaccgtgttgagggc

SEQ ID NO: 2649 - DNA, 1564 bp, Sorghum bicolor
aagcgacgcccggcgcagcaagcaaaaagcggccacgcaaaggaaagggacggccgccccggaactcggttccgtcggttcccccaattcgcgtcccgtccgtccgtccgtcgcctcctctcccttcctccctccaccgccctcccctcccctcccctctcctctcctctcctctcccgcacacggcacagggcacgcggatctgaccaaaaccgtccaggaggccctttccctcccgaccgcggccgaccgcgagcaacaaccggctccgcctgtcctgtgccatcggcttccaattcgatcgatgtgcccgatggagacggaggaggacgacagcggcgggtgtgacttcctcgactggctcggccccgacacctccaccaccgtcttcgagctcctcgacgaccccgccgacctcgcccgcgtcggcgccgtctcccgctcctggcgccgattcgtgaccgagaacgaattcagcaagcgcctgtgtcggcggatatgcccggaggccgccagcttcacccgcgcggtcgtggtgacccgttcgccgccgccgccgcagcccgccgcgtccgcgtccgagtccagccaggacgctgagtgcagggcccgcgagggggagcacgcggcctactcctacctcgccggcgcgatcgtctccgccaagcccgctatggacctcatcatgcgctgcgtcggcgcctccagcaccgacttcttccccgacgagagcatggagaacacgctcgtgccgcatgaatgggtgaaccaccgccactcgtactggtccagcggcggcaaggacaaccccgacgcccccgagagcttgacctacaggctctcctctgacctctgcgtgattgatgagatcagggtgcgcccctacaaagctgcttttcagcttggccatcctatttactcttccaaggcggtgaggatccggctgggtcattccaagcttgatcctggaacagagactttcgtgtcagctgagaatgagaacctgacagcaatcgctgatgaaaactacacgtggacatacacgtcgccagagttccctatgcttcaggaaaatgtgttgcaaaccttcaagcttccacgccctgccctttgcattggtggtatagtgaagattgaacttctggggagattacagaaacaatctacagatgataagtattacatatgtgtctgccatgtccaagtgatggggcgctcactttcaccagatttaatgatagacatctccgatcctgctgattactcaaacctcaagtatttgccgggtgccggtaacttgcgcccagaagacctactgagcagtgacgccaaggaggactcatcggactggcgctcgcttgtttctaggtacaggcagatgaggcaattggcgatggtgtatatgctgcttggacctgtgcagtttgcggatgaagaagacgaagctgaggctgacatgctgcacttgttgtaggctttgttttctctaaaccggatcttgtgtatcctaattgagtggagtttgttctgataaatataaaaacaaaaagatttgtgtcgtttc

SEQ ID NO: 2650 - DNA, 1381 bp, Zea mays
aacctcccctcccgcggtcccgcctcccgcacgggcacggcacgcggatctgaaccggccaggaggccctctcccagcggcgggcgcccgcgcgcagcaacctgctccccccctgtcctgtggcatcggcttaatccggtcgatgcgcccgatggagacggaggacagcgtcgggtgggacttcctcgactggctcggcccggacatctccaccaccatcttccagctcctcgacgaccccgcggacctcgcccgcgtcgccgccgtctcccgctcctggcgccgattcgtcgccgtgaacaaattcagcaagcacctgtgcaggcagatatgtccggaggccgccagcttcacccgcgcggtcgtggtggcccgattgccgccgccgccgccgccggcggcgcacgccgcgtgcgagtccagccaggtcgccgagtgcagggcccgcgatggggagcacgcggcctactcctacctcgccggcgcgctcgtctccggcaagcccgccacggacctcgtcatgcgctgcgtcggcgcctccagcaccgacaacttccccgacgagaccatcgagaacacgctcgtgccgcacgacatggttaacttccgcccctcctactggtccagcggcggcgaggacgaccccgatgtccccgagagcttgacctacacgctcgcctctgatctctgcgtcatcgaggagatcaggatacgcccgttcgaagctacttttcagcatggccatccgatttactcttcgaaggcggtgagaatccggctgggtcattccaagcttgaccctggaagagagacttttgtttcggatgaggatgagaacctgactgcgatcgctgatgagaactacatgtggacatacacgtcgccagagtttcctatgcttcaggaaaatgtgttgcaaaccttcaagcttccacgcccggctctttgcattggtggtatagtgaagattgaactactggggaggatacagaaacaatttacagatgataagtattacatatgtgtctgccatgtccaagtgacggggcgctcgctctcaccagatttaatgatagacctctccgatcctgctggttactcgaacctcaagtatctgccgggtgccggtaacttgcgcccagaagacctaatcagcattgacgccaaggactcaccggactggcgctcgcttgtttccaggtacaggcagatgaggcaactggctatggtgtacatgctgcttggacccgtgcagttgcagtttatggatgaagacgaagctgacttgcagatgtaggctttgttttccctgaatccgatcttgtgtatcctaattgaacagagcttgctctgataaatatagcgaaaaaaaaaaaaaaaa

SEQ ID NO: 2651 - DNA, 1068 bp, Sorghum bicolor
ttgtgcagaccaaaccccctccgccacttccaccaactccctccgatctcggccatggcaagggaggactgcagctccggcgctgaaatggacgcgctcgtccgacgcctgaggctccaccggccgcccccttccccctacgaccccgagccagacgcggcccccgtccccgccaccgccggcgacggccagctgttccggccgcggagggccgccgtgctcgtctgcctcttccggggcgacggcggcgagctccgcgtcatcctcaccaaacgctcgtcctccctctccacccactccggtgaagtttcattgccgggaggaaaggtcgaggagggtgatgctgatgatgcagcaacagcattaagggagtcaaaggaggagattgggcttgatccagctctggttacagtggttgcctctcttgaacactttttgtccaagcacctgctggtagttgttcctgttgttggcatactattagacagacaagcatttaaacctgctcttaatattgctgaggtagacgaaatatttgatgtacccctggagatgttcctcaaggatgagaacaggacatctgaggagcgagaaaagatgggccaggcattcacagtccattacttcacttacgagaaaggaatccagaagtacttaatctggggtctgacagcccgcatcttgatccatgctgcttcagttgtataccagcgaccgccggactttacagagcgaagtgcacatttcaaattaccaaagttcacaaaggactgctcttcaatgctagcaggacctgctaaacactagtgcctagtacgctgttatctcaactatatatgtgctatttggagtacaggatgttgcaccaacagagtttatagagtcaaagaggtgtccagatcacttgatgtgatattaatttagattctttccgcaatcttttacttaacacatagtggcatttatgtttagaacaatgttcatatatataccacaaatcgtccatgttgacgctgttgatgaggtcgagcacttgctcggacggatgcaattggatcatatattcgt

SEQ ID NO: 2652 - DNA, 980 bp, Zea mays
cccttcgccattttcaccaactccctccgatcccggccatggcgggggaggactgccgctccggcgcggaaatggacgcgctcgtacgacgcttgaagctccaccggccgtccccatccccctacgaccccgatccggccgcggcccccgtccccgccaccgccggcgacggcgagctgttccggccgcggagagctgccgtgcttgtctgcctcttccggggagacggcggcgagctccgcgtcatcctcactaagcgctcgtcctccctctccacccactccggtgaagtttcattgccaggaggaaaggtcgaggagggtgatgctgatgatgtagcaacagcgttaagagagtcaaaagaggagattggacttgatccagctctggtaactgtggttgcctctcttgaacacttcttgtccaagcatcttctggtagttgttcctgttgttggcatactgttagacagacaagcatttaaacctgctcttaatattgctgaggtagacgaaatatttgatgtacccctggagatgttcctcaaggatgagaacaggacatcggaggagcgagaaaagatgggccagacattcacagttcattacttcacttatgagaacggaatccagaagtacttaatctggggtctgaccgcccgcgtcttgatccatgctgcttcagttgtatacgagcgaccgccagactttacagagcgaagagcgcatttcaaattgccaaagttcacaaaggactgctcttcaatgctagcaggacctgctaaacattagtgcacactgcctacgctgctatctcagctacatgctatttggagtacaggatgttgcaccaacatagtttatagaatcgaagagacgtccaaatcacttgatgtcatatgaatttagattctttcgacaaaacactatagtggcatttatgttcagaacaatgttcatatatgaattatgatgcaccac

SEQ ID NO: 2653 - DNA, 1111 bp, Zea mays
aacaaattgaccgccattgtgcaaaccagaaccccttcgccattttcaccaactccctccgatcccggccatggcgggggaggactgccgctccggcgcggaaatggacgcgctcgtacgacgcttgaagctccaccggccgtccccatccccctacgaccccgatccggccgcggcccccgtccccgccaccgccggcgacggcrwgctgttccggccgcggagagctgccgtgcttgtctgcctcttccggggagacggcggcgagctccgcgtcatcctcactaagcgctcgtcctccctctccacccactccggtgaagtttcattgccaggaggaaaagtcgaggagggtgatgctgatgatgtagcaacagcgttaagagagtcaaaagaggagattggacttgatccagctctggtaactgtggttgcctctcttgaacacttcttgtccaagcatcttctggtagttgttcctgttgttggcatactgttagacagacaagcatttaaacctgctcttaatattgctgaggtagacgaaatatttgatgtacccctggagatgttcctcaaggatgagaacaggacatcggaggagcgagaaaagatgggccagacattcacagttcattacttcacttatgagaacggaatccagaagtacttaatctggggtctgaccgcccgcatcttgatccatgctgcttcagttgtatacgagcgaccgccagactttacagagcgaagagcacattttaaattgccaatgttcacaaaggactgctcttcaatgctagcaggacctgctaaacattagtgcacactgcctacgctgctatctcagctacatgctatttggagtacgggatgttgcaccaacatagtttatagaatcgaagaggcgtccaaatcacttgatgtcatatgaatttagattctttcgacaaaacactatagtggcatttatgttcagaacaatgttcgtatatgatgcaccacaaatcatccatgttgatgctgttaatgacatggagcacttgctcggatgcaattggctcgtatatacacataagattgttctactgaatcaaaaagaaaaaaaaaa

SEQ ID NO: 2654 - DNA, 1218 bp, Oryza sativa Japonica Group
gcagacccaagtgccaaagctttccatgtccaccgatctcaccatcccaccttccatggaggcacccggcgccgacatccaggcgctcatccagcgcctcaggctccaccgcccgcgcccctccccgtacgccgccgcggcggccccctcgcccgacgcggccgcgccgccggccgagctgctgttccgccctcggagggccgccgtgctgatctgcctcttccgcggcgccgccggcgagctccgtgtcctcctcaccaagcgctcctccaaactctcctcccactccggggaggtttctttgccaggaggaaaggctgaggagggtgatgctgatgatgcagcaacagcattaagggaggcaaaggaggagattggacttgatccagcttctgttactgttgttgcctctcttgagcacttcttgtcaaagcatcttctggtagttgtccctgttgttggcatactctctgatatacaagcatttaaacctgttcttaatgttgatgaggtggatagcattttcgatgtacccttggagatgtttctcaaggatgagaaaaggacatctgaggagcgtgaatggatgggacaagaattcacaattcattacttcaattacgagaaagggagtgagaagtacgtaatatggggtctgactgctggcatcctgatacatgctgcttcagttgtattccagcggccaccagactttcctgcacgaacagtgcaattcaacttgccgaagtactcaaaggagtgttcttcaatgccatgagcagcacctgtgaaacactaatgtttacaatacaatttcagttgtagaccattggggtgtacagcagagcagatttcatctcaaaagattggtactgaatcaaaaggttgttttatagtttatattctttgcacattttttgtacataatactatgagaacattaacatttatgaaaatgttaatgctattcgagtacaccccaaatccctgattagatgggagtaatccattataaatatgggtacccattagtccgctagttttactaaaaacacactttttctttatttctttatttgtaggtgaaatagagttgggcaatgggcacctatggattaaactactgtcatccctacccccagttgtcccaataagtattgatgtaaacaaagacttgtactaaaacagtttgtaatatgtcaaaatcaggttgagtcc

SEQ ID NO: 2655 - DNA, 906 bp, Sorghum bicolor
cttcgatcccggtttccgccgccatggaagaggaggtgggccccggcgcggacatggaggcgctcgtccgccgtctgaggctccaccgcccggccccctccccgtacgaactctcagccgcggtggcccctgcccctgctcctggcgccggcgagctgttccggccacggagggccgccgttctggtttgcctcttccggggcgcagccggagagctccgagtcatactcaccaagcgctcctcctcactctccacccactccggggaagttgcattaccaggtggaaaggccgaggaaggtgatgctgatgatgcagcaacagcattaagggagtcaaaagaggagattgggcttgatccagctctggtcacagtcgttacatcgcttgaacatgtcttgtccaaacatcttctggtagttgttcctattgttggcatactttcagacataaacacatttaagcctgttcctaatgctgctgaggtggacaaaatttttgatgtgcccctggagatgttcctcaaggatgagaaccggacatctaatgacctagaatggatggggcaggagtttacaatccatcacttcagttatgcgaaggagaacgagaagtacatgatttggggtctgacggctggcatcctgatccatgctgcttcagttgtttaccagcgaccaccagactttgcagagaaaagggcacagttcaacttgccaacgtacttcaatgccatggccagagcctgagcactaatctcgacagtaccagctcagctatatcaattgtaacatatatactgcatacaacagactatacattgaattgaattgttgtagaatctaatggaacttcaagtcatatggttccagacgattcatattctttttcacaatctttcacatg

SEQ ID NO: 2656 - DNA, 2084 bp, Sorghum bicolor
gtctcgcaccgtcgcggccacccattctcctcgtccctcacctccgactcccggcgccatcgatccatccatccacccgtcggctgctccttcttcccgtcggtccgtcggtccgtccccaggtgtgcttcagctatgcagttcagcagcgtgtttcccctagagggaaaagcatgtatgagcccagtgaggagaggcggtgaaggcgcttggagtgagagggtgaggattgggaactcctgcagcatcaggcgcaacaaggcattgaggaggatgtgttttggtgcaaggggtgctgtgagcagcgctcagtgcgtgctcacatcagatgctggcccagacactcttgtcgtccgaacatcctttcggaggaattatgctgatcctaacgaagttgccgccgttattttgggtggtggtactgggactcagcttttccctctcacaagcacaagggccactcctgctgttcctattggaggatgttacaggcttattgatatccccatgagcaactgtttcaacagtggcataaacaagatattcgtcatgactcagttcaactcagcttctcttaaccgtcacattcaccgtacgtatcttggtgggggaatcaacttcactgatggatctgttgaggtgctggctgcaacacaaatgcctggggaggctgctggttggttccagggcacagcagatgctgttagaaaatttatctgggtacttgaggattattacaagcataaagctatagagcacattttgattttgtcaggagatcagctctatcgtatggattacatggagcttgtgcagaaacatgtagatgacaacgcagacattactttatcgtgcgctcctgttggagagagtcgagcatctgactatggattagtcaagttcgacagttcaggccgtgtaattcagttctctgagaaaccaaagggggctgccttggaagaaatgaaagtggataccagctttcttaatttcgccattgacgacccaactaaatatccctatattgcttcaatgggagtttacgtttttaagagagatgttcttttagaccttctaaagtcaaggtatgctgaactgcatgactttggttctgaaattctgcccaaagctttacatgagcacaatgtacaggcgtatgtcttcactgactactgggaggacattggaacaatcagatcattctttgatgcaaacatggccctctgcgagcagcctccaaagtttgagttttatgatccgaaaacaccattcttcacttcccctcggtacttgccaccaacgaagtcggataagtgcaggattaaagacgcgatcatttcgcatggctgcttcttgcgtgaatgtgccattgagcattctattgtcggtgttcgttcacgcctaaactctggatgcgagctcaagaacaccatgatgatgggtgcggatttgtatgagactgaagacgagatttcacggctactatcagagggcaaggtgcccattggggtaggggagaatacaaagataagcaactgcatcatcgacatgaacgcgagggtcggaagaaacgtctctataacaaacaccgagggcgtccaagaagctgaccggccggagctaggatactacatcaggtctgggatcgtggtgatcctgaagaacgcaaccatcaaggacggcaccgtcatatagagacaatctacccatggtgcagtgcaaggctacaggttctcatcactcgtcgtcttgagagttagtttgaggcgcccaaccttgacttgagcttagggacaagaatagaggaagaagatgggctggtgccggatgcaatggaagacaagagaaatggtttgatgctatatcatcggttccagtagctcttcctgatgttatatgtagctgagtagtgtgaacagtgcaataagctgggcgagcaaagccgcagcaacttttggggatcgttggtgcatcttgtaaataaactcggacacaacaaatggaacttgcccgtcatctccatatctgattctttgttcactcgcagctatggcagctccagttcatcgtagcatatgcgttgt

SEQ ID NO: 2657 - DNA, 2120 bp, Zea mays
atttccatttgcctcgctcgccttcctcctccccactccactccattccaacgcaacggcctcgccccgctttataggccgccgcccgcgccacatcgccaccgtctcgcaccgtcgcggccacccattctctctcgtccatcgcatcgctccggctcccagcgcaatcgatccatccgtccctaggtgtgcttcagctatgcagttcagcagcgtgcttcccctagagggaaaagcgtgtatgagcccagtgaggagaggcagtggaggttatgggagtgagaggatgaggatcaactgctgcagcatcaggcgcaacaaggcactgaggaggatgtgtttcagtgcaaggggtgctgtgagcagcacgcagtgtgtgctcacatcagatgctggcccagacactcttgtcgtccgaacatcctttcggaggaattatgctgatcctaatgaagtcgctgccgtcattttgggtggtggtaccgggactcagcttttccctctcacaagcacaagggccacccctgctgttcctattggaggatgttacaggcttattgatatccccatgagcaactgtttcaacagtggcataaacaagatatttgttatgactcagttcaactcagcttctcttaaccgtcacattcatcgtacctatcttggtggggggatcaacttcactgatggatctgttgaggtgctggctgcaacacaaatgcctggggaggctgctggttggttccagggcacagcagacgccgttagaaaatttatctgggtacttgaggattattacaagcataaagctatagaacacattttgattttgtcaggagatcaactctatcgtatggattacatggagcttgtgcagaaacatgtcgatgacaatgcagacataactttatcatgcgctcctgttggagagagtcgagcatctgactatggattagttaagttcgatagttcaggccgtgtaattcagttctctgagaaaccaaagggtgctgccttggaagaaatgaaagtggataccagcttcctcaatttcgccattgattccccagctgaatatccctatatcgcttcaatgggagtttacgtttttaagagagatgttttgttagaccttctaaagtcacggtatgctgaactgcatgactttggttctgaaattctgcccaaggctttgcatgagcacaatgtacaggcatatgttttcactgactactgggaggacattggaacaatcagatctttctttgatgcaaacatggccctctgcgagcagcctccaaagttcgagttttacgatccgaaaacaccattcttcacttcccctcggtacttgccaccaacgaagtcggataagtgcaggattaaagacgcgatcatttcacacggctgcttcttgcgtgagtgtgccatcgagcactctattgttggtgttcgctcacgcctaaactctggatgcgagctcaagaataccatgatgatgggtgcggatttgtatgagaccgaagacgagatctcaaggctactggcagagggcaaggtgcccattggcgtaggggagaacacgaagataagcaactgcatcatcgacatgaatgccagggttggaaggaacgtctccataacaaacaaagagggcgtccaagaagccgaccggccggacgaaggatactacatccggtctgggatcgtggtagtcctgaagaacgcaaccatcaaggacggcaccgtcatatagagactaactttggccttacgcatggcgtgcaaggttacaggttagtcatcgtcttgagagttgagacttagtttgaggcgcgcgcccgaccttgacttgagccgtcggagggacaagaacatgaggaagaagggctggtggtgccggatgttgccatggacgacgagaaatggtttggtgcggtcgcatcggttccagtagctagctcttccgatgttattaatatatgtatctagtggagtagtgcgaacagtgcaataagctgggcgagcaaagccgcggcaactcttggcttggggattgttggtgcatcttgtaaataataaactcggacgcagcaaatgaaacaaaaaaaaaaaaaaaa

SEQ ID NO: 2658 - DNA, 2311 bp, Oryza sativa Japonica Group
cccccacatggggcgggcgaaacgccaaacgaaacgaggcgctgccctgccaccttcgcctcacgaacgccagcctcgctgtttcccctccctctcgcaccgctcgttcccgtttgccttctttctctcctcccccccgttcagcttcccgttcaggttcaggcaatcacgcctcctctcctctcctctcctctccttcttcactccactccaacgccccacgccctcccccgctttataagggggagctccacatcaccacccttcccacaccatcgcggcagccaccgcatctttcctcctctttccctggagccatttcctcccctaaagggcctttccttttcttgatctctcttctatcttcgatccatccatccatccggccatccttcctaggtgaatttcaacgatgcagttcagcagtgtgtttcccttagagggtaaagcatgcgtgagcccaataaggagaggtggtgagggctcagctagtgatagattgaagatcggggacagtagcagcatcaagcatgatagagcagtgaggaggatgtgtcttggttataggggcaccaaaaacggtgcacaatgtgtgctcacctcagatgctggcccagacactcttcatgtccgaacatcattccggaggaactttgcggatccaaatgaggttgctgctgttatattgggtggtggcaccgggactcaactttttcctctcacaagcacaagggccacgcctgctgttcctattggaggatgctataggcttatcgatatccccatgagcaactgtttcaacagtggcataaacaagatattcataatgactcaattcaactcagcatctcttaatcgtcacattcatcgtacgtaccttggtggtggaatcaactttactgatggatctgttgaggtattagccgctacacaaatgcctggggaggctgctggttggttccagggtacagcagatgcagttagaaaatttatctgggttcttgaggactattacaagcataaagctatagaacacattttaatcttgtcaggagatcagctttatcgtatggactacatggagcttgtgcagaaacatgttgatgacaatgctgacattactttatcatgtgctcctgttggagagagtcgagcatctgactatggactagtgaagttcgacagttcaggccgtgtaattcaattttctgaaaaacccaagggcactgacttggaagcaatgaaagtggataccagctttctcaattttgccatagacgacccgactaaatttccctacattgcttcgatgggagtttatgtcttcaaaagagatgttcttttaaaccttctaaagtcaagatatgcagaactacatgactttgggtctgaaatcctcccaagagctttacatgagcacaatgtacaggcatatgtcttcgctgactactgggaagacattggaacgatcagatcgttctttgatgcaaacatggccctttgcgagcagcctcccaagtttgagttttatgatccaaaaactcccttcttcacttcacctcgatatttgccgccaacaaagtcagataaatgcaggattaaagatgcgataatttcccatggctgtttcttgcgtgaatgtaccatcgagcattcgatagttggagtccgctcacgccttaactctgcatgtgagctcaagaataccatgatgatgggtgcggatttgtacgaaactgaagatgaaatttcaagactactgtcagaaggcaaggtccccattggtgtaggggaaaacacaaagataaacaactgcatcatcgacatgaacgcgagggttggaaggaacgtggtcatcacaaacagcgagggtgtccaagaaagtgatcggcctgaggaagggtactacataaggtcgggaatcgtggtgatcctgaagaacgcgaccatcaaggacgggaaggtcatataggagagctcgctgatgccacagatctctgaaccctgaacctgcaaatgcagtgcagtgcgtcttttcttgaggggttaggacatgcaagctcgttgattccacatggcagagaactcgagggaagatcccaggaagacggatgatcgagaaagattgtgtagtactagcagttcttcgctcgttaaaatgtgtgtactaaataactaataagctgccccgagtgaagtagcagcagcaactttttggagggtcgttggtgcatctcatgtgtaaataaactcaaaactggtaaaaaaatgtatccatcatgccattatctccattttctgtttcgctgct

SEQ ID NO: 2659 - DNA, 2065 bp, Oryza sativa Japonica Group
gaattcgcggccgcctttcctcctctttccctggagccatttcctcccctaaagggcctttccttttcttgatctctcttctatcttcgatccatccatccatccggccatccttcctaggtgaatttcaacgatgcagttcagcagtgtgtttcccttagagggtaaagcatgcgtgagcccaataaggagaggtggtgagggctcagctagtgatagattgaagatcggggacagtagcagcatcaagcatgatagagcagtgaggaggatgtgtcttggttataggggcaccaaaaacggtgcacaatgtgtgctcacctcagatgctggcccagacactcttcatgtccgaacatcattccggaggaactttgcggatccaaatgaggttgctgctgttatattgggtggtggcaccgggactcaactttttcctctcacaagcacaagggccacgcctgctgttcctattggaggatgctataggcttatcgatatccccatgagcaactgtttcaacagtggcataaacaagatattcataatgactcaattcaactcagcatctcttaatcgtcacattcatcgtacgtaccttggtggtggaatcaactttactgatggttctgttgaggtattagccgctacacaaatgcctggggaggctgctggttggttccagggtacagcagatgcagttagaaaatttatctgggttcttgaggactattacaagcataaagctatagaacacattttaatcttgtcaggagatcagctttatcgtatggactacatggagcttgtgcagaaacatgttgatgacaatgctgacattactttatcatgtgctcctgttggagagagtcgagcatctgactatggactagtgaagttcgacagttcaggccgtgtaattcaattttctgaaaaacccaagggcactgacttggaagcaatgaaagtggataccagctttctcaattttgccatagacgacccgactaaatttccctacattgcttcgatgggagtttatgtcttcaaaagagatgttcttttaaaccttctaaagtcaagatatgcagaactacatgactttgggtctgaaatcctcccaagagctttacatgagcacaatgtacaggcatatgtcttcgctgactactgggaagacattggaacgatcagatcgttctttgatgcaaacatggccctttgcgagcagcctcccaagtttgagttttatgatccaaaaactcccttcttcacttcacctcgatatttgccgccaacaaagtcagataaatgcaggattaaagatgcgataatttcccatggctgtctcttgcgtgaatgtaccatcgggcattcgatagttggagtccgttcacgccttaactctgcgtgtgagctcaagaataccatgatgatgggtgcggatttgtacgaaactgaagatgaaatttcaagactactgtcagaaggcaaggtccccattggtgtaggggaaaacacaaagataaacaactgcatcatcgacatgaacgcgagggttggaaggaacgtggtcatcacaaacagcgagggtgtccaagaaagtgatcggcctgaggaagggtactacataaggtcgggaatcgtggtgatcctgaagaacgcgaccatcaaggacgggaaggtcatataggagagctcgctgatgccacagatctctgaaccctgaacctgcaaatgcagtgcagtgcgtcttttcttgaggggttaggacatgcaagctcgttgattccacatggcagagaactcgagggaagatcccaggaagacggatgatcgagaaagattgtgtagtactagcagttcttcgctcgttaaaatgtgtgtactaaataactaataagctgccccgagtgaagtagcagcagcaactttttggagggtcgttggtgcatctcatgtgtaaataaactcaaaactggtaaaaaaatgtatccatcatgccattatctccaaaaaaaaaaaaaaaaaaaaaaaaaaaaaaaaaaaacaaaaaaaagcggcc

SEQ ID NO: 2660 - DNA, 3384 bp, Oryza sativa Japonica Group
atgcagttcagcagtgtgtttcccttagagggtaaagcatgcgtgagcccaataaggagaggtggtgagggctcagctagtgatagattgaagatcggggacagtagcagcatcaagcatgatagagcagtgaggaggatgtgtcttggttataggggcaccaaaaacggtgcacaatgtgtgctcacctcagatgctggcccagacactcttgtaagtttcatactgtcagttatcaaattggtggtttctcactgtccttttgctatcgaatgctattagctgttagcatatctaaaccctgtatgaaaaattattacagcatgtccgaacatcattccggaggaactttgcggatccaaatgaggttgctgctgttatattgggtggtggcaccgggactcaactttttcctctcacaagcacaagggccacgcctgctgtaagatgatacattcaatttctgaggtttattaagtttcaagttgataggctttttgcagtaaaggggtaccatttgcaaggaattctcagtttgatttgcctgctttgagtttgacaagtcgacatgaatcagaagcatggcaattgatatgcatgacaccagttaaaagtttagctaattcagtagcatgtttgagcattgtgtataaattagtatttggctgtggcccaatgattttggtagctggtccccatggtgccctccacggttccactttagccaacatgatttcttttcaagctcaacgctatcaaagactatcatgtggcttgttcagagttcagtcatcttgaaattcctggcctaatctttgtttctttccttttgttgcataacataggttcctattggaggatgctataggcttatcgatatccccatgagcaactgtttcaacagtggcataaacaagatattcataatgactcaattcaactcagcatctcttaatcgtcacattcatcgtacgtaccttggtggtggaatcaactttactgatggatctgttgaggtaattcaccttgacctgtgatgcttatgttcttcgatgatttgcgtggttgttgacttggtgaagaaacagtcacagctcacattaactgaaatgatttttgccaattgaaggtattagccgctacacaaatgcctggggaggctgctggttggttccagggtacagcagatgcagttagaaaatttatctgggttcttgaggtaaatactgtttagaagcacacggtggatctgcagctcatacttggatctgtatcactaaagtaatactcactatgttgtatgtaatgtttctgatgtatctgttcaggactattacaagcataaagctatagaacacattttaatcttgtcaggagatcagctttatcgtatggactacatggagcttgtgcaggtttgtcctggcctcattcttctgtacttttccacatgcttttcttttgaactggctgactcttcaatatatgccattcaccgtttgcagaaacatgttgatgacaatgctgacattactttatcatgtgctcctgttggagagaggtatatcgattgtacaatattccaaaagttagataatattatcagcatttgtcctcagaaaatgcagagcatcctgatttggttttctttattatggtagtcgagcatctgactatggactagtgaagttcgacagttcaggccgtgtaattcaattttctgaaaaacccaagggcactgacttggaagcaatggttagaattaaccttatcccatactcagatatatatttgaacttaattgcagtatctgaagtataagtcattgatcattgcagaaagtggataccagctttctcaattttgccatagacgacccgactaaatttccctacattgcttcgatgggagtttatgtcttcaaaagagatgttcttttaaaccttctaaagtaagaatcttattgcagtagtatggtttctcctacagggcacatgctatagaaatatagaattgtagtctaacagtgtcactttaggtcaagatatgcagaactacatgactttgggtctgaaatcctcccaagagctttacatgagcacaatgtacaggtaaaagtttttaagcttgagcactattatgtgatttcctttcacctgtttgggaagtcatgcctcatgttcaattcagtaatagtccacattcagtctgaattgcctacttgcaccaaatgtagtttgtgcaatcatgtccgccttgtggcgtgaactgaacatccatctgcttttgttgtttataggcatatgtcttcgctgactactgggaagacattggaacgatcagatcgttctttgatgcaaacatggccctttgcgagcaggtatttggtctgcttcaaaattttagcactctcaaactgtagaggtagttggattgtaacacatctgaataatgcatttaatagatctgtacaattgttaagtacagttcagactttgcaacatatttaatactttcattctctatttactcacaagttcctccattgcagcctcccaagtttgagttttatgatccaaaaactcccttcttcacttcacctcgatatttgccgccaacaaagtcagataaatgcagggtatgagtcgcatggaatgaactttctatatcaaactttaatatgcgtgtttcatatctgatttcggaatttgtgcgtgcagattaaagatgcgataatttcccatggctgtttcttgcgtgaatgtaccatcgagcattcgatagttggagtccgctcacgccttaactctgcatgtgagctcaaggtactctctttcaccaatgaaattaaactgaatccatatgcatatgcctgtatagcataattgaacaacactgggattgttgcaaacaacacctgcagaataccatgatgatgggtgcggatttgtacgaaactgaagatgaaatttcaagactactgtcagaaggcaaggtccccattggtgtaggggaaaacacaaagataaagtgagatactgacctgaaggcttgaaccacaatgcattatgaacacatctagcaatatcctgtttcgagcgcgatctaaacccgtcttttgatgcattgtagcaactgcatcatcgacatgaacgcgagggttggaaggaacgtggtcatcacaaacagcgaggtaagcgatcaagcgaaaaggaattccaaagttgcaacctcccaacccatgtttcatacaaaattctgaacactgcaacctgttgctgatagggtgtccaagaaagtgatcggcctgaggaagggtactacataaggtcgggaatcgtggtgatcctgaagaacgcgaccatcaaggacgggaaggtcata

SEQ ID NO: 2661 - DNA, 3337 bp, Triticum aestivum
catcgatgcagttcagcagcgtgctgcccctggagggcaaggcgtgcgtctcccccgtcaggagagagggctccgcctgcgagcgcctcaaggtcggcgacagcagcagcatcaggcacgacagggcctccaggaggatgtgcaatggcggcaggggccccgccgccaccggcgcgcagtgcgtgctcacctccgacgccagcccggcagacacccttgtaagtttgatgatcgagttgcaatgagacactctgttatgttagcatctctgatgttttcatgcaaaaaaaaataaaaatacctgcaggttctccggacgtccttccggaggaattacgccgatccgaacgaggtggcggccgtcatactcggcggtggcaccgggactcagctcttcccactcacaagcacaagggccacacctgctgtaagatgacacattcatcatccagttctatgtttttaactgtcttgctctttttctattacaggttgatagtttaacactagcacatctcagttgcagaaatgaattttagaaaatctgtgttacttacagatatgttgtaccgtagatttcgataaagggtgctttattacttaaaggaagttctaccgtagatgattcccagttttagatagataggaatgaggaagctttatttaaatttcacttgtcatctatcttcacatggcaattgatttggataggaccagttgaagtacagctcattcagtagcaagttttctgcattgtgctgtgttcaaatgttattagcagcagtggtttctgtagccggacccgatgatgccccccactttaaccgacatgatgtcaacctcaaggctatcagtggccatccatgtagcccgtccagtcatcttcggatcgccagcctgaacttgttcctttccctttgttgcattgctcaggttcctattggaggatgttacaggctcatcgacattcccatgagcaactgcttcaacagtggcatcaacaagatattcgtcatgacccagttcaactcggcctcgcttaatcgccacattcaccgcacctacctcggcgggggaatcaatttcactgatggatccgttgaggtaattgatctcagcttattaatttatacttgattttttcatcttgacgtcttgggcttttagctgactacagcacacattgactgatacacctttttgcaacaaataggtattggccgcgacgcaaatgcccggggaggctgctggatggttccgcggaacagcggacgccgtcagaaaatttatctgggtgcttgaggtgagaagagtactatctggatacttgtacatctgcatgtgttaaagtaatgctacttgtgttatgtgtacctctccaggactattataagaataaatccatagagcacattttgatcttgtcgggcgatcagctttatcgcatggattacatggagcttgtgcaggtttgtgatgtctctttaaccagctccagtgtatgttctgttttgaactggctgaccaagctgtggcatacatcctttacagaaacatgtggatgacaatgctgacattactttatcatgtgcccctgttggagagaggtattaactattgttctacatcccagatccttatttatgagtgtatcttccttttgttgaagttgcactgcatcctgatttgcttttctttgttttggaagccgggcatctgagtacgggctagtgaagttcgacagttcaggccgtgtggtccagttttctgagaagccaaagggtgacgatctggaagcgatggttagcactcgtctcagctcactgtgtcagatatctgcctaaagatatgactgtcttaaataagttgcagtatctgaaatttaagccatcgatcatgtgcagaaagtggacaccagttttctcaatttcgccatagacgatcctgctaaatatccatacattgcttctatgggagtctatgtcttcaaaagagatgttctgctcaaccttctaaagtaagaacctgctcttgtggtgacgccgtcgtcctgtcggtctgaattctaatatccgcattctcaggtcaagatatgcagaactacatgactttgggtctgagatcctcccgagagctctgcatgaccacaatgtacaggtaaactaacagtgtgagcttcattcgtttttctgttggggaggtagctctgcgtgaaatgcagtctgtaaaactatttcctatgtgttgcacgaagtggccgttcatttgacactgtttttgtcaggcttatgtcttcactgactactgggaggacattggacaatcagatccttctttcgatgcaaacatggccctctgcgagcaggtgccattatctttttgggtgcttcccaaatttgacttcagtagtgctactatgataatcgataaatgataaagttatattaagactcttcacttaatacatttttcagtataaacacacattttgttcattgcagcccccaaagttcgagttttatgatcccaaaactcccttcttcacctcgcctcgatacctgccaccaacaaagtcagacaagtgcagggtactggttagaatcaacctgccattcagactattccatacaagcattagctgtaagcatctgatatggatccttctgtgtgcagatcaaagaagcgatcatttcgcacggctgcttcttgcgtgaatgcaaaatcgagcactccatcatcggcgttcgctcacgcctaaactccggaagcgagctcaaggtatgccttttcgcaccgaataatggcatgtggtgcatgtcaactgtaaaatcatcctgtgtctgactgtcgctcttccaaatggtggtggtttgcagaatgcgatgatgatgggcgcggactcgtacgagaccgaagacgagatctcgaggctgatgtccgagggcaaggtccccatcggcgtcggggagaacacaaagatcaggtgagagagactgatctgtacctcaggaacgacacgtaccgttcgggcgcaagtgcccacattatctcttaacacgttttgcgtggatacgttgcagcaactgcatcatcgacatgaacgcgaggataggaagggacgtggtcatctcaaacaaggagtaagacaccctccttcagagttttaaacctggtccaaagttctgaagaaaacaacacttgtgtctgaaaccacgccgctttgtgccatttctgtcagggagtgcaagaagccgacaggccggaggaggggtactacatcaggtccgggatcgtggtgatccagaagaacgcgaccatcaaggacggcaccgtcgtg

SEQ ID NO: 2662 - DNA, 2123 bp, Zea mays
ggctcgctcgccttcctcctccccactccactccattccaacgcaacgcctcgccccgctttataggccgccgcccgcgccacatcgccaccgtctcgcaccgtcgcggccacccattctctctcgtccatcgcatcgctccggctcccagcgcaatcgatccatccgtccctaggtgtgcttcagctatgcagttcagcagcgtgcttcccctagagggaaaagcgtgtatgagcccagtgaggagaggcagtggaggttatgggagtgagaggatgaggatcaactgctgcagcatcaggcgcaacaaggcactgaggaggatgtgtttcagtgcaaggggtgctgtgagcagcacgcagtgtgtgctcacatcagatgctggcccagacactcttgtacgtccgaaccatccttttcggaggaattatgctgatcctaatgaagtcgctgccgtcattttgggtggtggtaccgggactcagcttttccctctcacaagcacaagggccacccctgctgttcctattggaggatgttacaggcttattgatatccccatgagcaactgtttcaacagtggcataaacaagatatttgttatgactcagttcaactcagcttctcttaaccgtcacattcatcgtacctatcttggtggggggatcaacttcactgatggatctgttgaggtgctggctgcaacacaaatgcctggggaggctgctggttggttccagggcacagcagacgccgttagaaaatttatctgggtacttgaggattattacaagcataaagctatagaacacattttgattttgtcaggagatcaactctatcgtatggattacatggagcttgtgcagaaacatgtcgatgacaatgcagacataactttatcatgcgctcctgttggagagagtcgagcatctgactatggattagttaagttcgatagttcaggccgtgtaattcagttctctgagaaaccaaagggtgctgccttggaagaaatgaaagtggataccagcttcctcaatttcgccacttgcactctcccagctgaatatccctatatcgcttcaatgggagtttacgtttttaagagagatgttttgttagaccttctaaagtcacggtatgctgaactgcatgactttggttctgaaattctgcccaaggctttgcatgagcacaatgtacaggcatatgttttcactgactactgggaggacattggaacaatcagatctttctttgatgcaaacatggccctctgcgagcagcctccaaagttcgagttttacgatccgaaaacaccattcttcacttcccctcggtacttgccaccaacgaagtcggataagtgcaggattaaagacgcgatcatttcacacggctgcttcttgcgtgagtgtgccatcgagcactctattgttggtgttccgtcacgcctaaactctggatgcgagctcaagaataccatgatgatgggtgcggatttgtatgagaccgaagacgagatctcaaggctactggcagagggcaaggtgccaattggcgtaggggagaacacgaagataagcaactgcatcatcgacatgaattgccagggttggaaggaacgtctccataacaaacaaagagggcgttccaagagtcccgaccggcctggacgaaggatactaatccggtctgggatcgtggtagtcctgaagaacgcaaccatcaaggacggcaccgtcatatagagactaactttggccttacgcatggcctgcaaggttacaggttagtcatcgtcttgagagttgagacttagtttgaggcgcgcccgaccttgacttgagccgtcggagggacaagaacatgaggaagaagggctggtggtgccggatgttgccatggacgacgagaaatggtttggctggtcgcatcggtccagtagctagctcttccgatgttattaatatatgtatctagtggagtagtgcgaacagtgcaataagctgggcgagcaaagccgcggcaactcttggcttggggattggttggtgcatcttgtaaataataaactcggacgcagcaaatgaaacatgcccctcatcttcttccaaaaa

SEQ ID NO: 2663 - DNA, 816 bp, Botryotinia fuckeliana B05.10
atgccggtaaccttcagctttgttcacaacacaaggactgaacatgttgtgtttgacattattgacatggaatatccttacaatgcaatcattggtcgtgggacacttaatgctttcgaagcaatacttcatccagcatatctatgtatgaagataccttcggaacaagggcctattgttgttcatgggagtcaggaagctgccaggaaagctgaaggaaattggacagacttaaaagcaattcataatatagatggagccgaagtttgtgaacagtacaaatacaaaagagagaaggctgcttcggcggatcagccgaagcctatgcttctatgtgaagacatagtagaccaaaaagtactgctggggtctcagctatctgaagaacaagagaaaactttgataagatttttattcaacaacaaagatgtctttgcttggtcagccaatgatctctgcggtgtcaacagagatgtcaatgaacattcactcaatgtggacccatctttcaggccaagaaagcagaggcttcggaatatgtctgatgataaagccgaaggtgctcggaatgaagtgaaaaggcttctcagtgctggtgttatcagagaggtaaaatacccagagtggttagccaatactatcatggtgaagaaggccaatggcaaatggagaatgtgcattgacttcacagatcttaacaaggcatgcccaaaagatgaattctcgctaccaagaatagactctcttgtagatgcagcagcttcttcagagctcatgagtctattggattgttattcaggctatcatcaaatctag

SEQ ID NO: 2664 - DNA, 2607 bp, Sorghum bicolor
ctaataattggcagaaggccgagaaaacccatcaccgttgccgcgcctcgcggggcttccgtctcccccgcgtcggcgcggcgtacctgtggtgtggtgtggtgtttcacgacgagtcgatgattcatctcactcttgcttgtatctacacacatagtgtatatatataaagcttcctcccccctcctgagctcggcctcgcacgccgagttcttcgtctagtagatagagaaactgagtgctagggaaaagcagcaaccacgccttcctcctcccgccctccctctcgtggattcttcacaaggcttcccttgggttccggggtgcgaagcggcgcggcggcggcggtggccgaggcggcggcgatagcgtcaccttcccaggagaggttgagaagagaagcgtgagcggcggcgccgacgagcaccgatgggcccactggagccgcgctaccgtccagccggcgcccctgaggacacaactaagagaagggcctccaaaagcaaaagtttcaaagatgttgaaaattttgaagttattgtccttgaaaagagctgtggttgcaagttcaaatctttgaggatcttgctcatagctatcatttctgcaacagttcttacgcttgtgactccaaccttatacgagcaccaattgcagtcagcctcccggtatgtagatgtcggttggatgtgggacaaaacaagttctgatccaagatatgtatcatctgttgatgttcggtgggaggatgtatataaagcacttggaaatctaagaagtggtaatcaaaatctcaaagttggactattgaattttaatagcactgagtatggctcttggacacaattgctctcagacagccatgtttccattataagacttgagcatgccaaggacagcattacttggcaaacactgtatcctgaatggatcgatgaggaggaagaaacagagataccctcttgcccatcacttccagagcctgatgtacgaagagatgtacgctttgatgttattgctgtaaagcttccttgtacccatgtggcaggttggtcaagagatgttgcacggctccatttgcagctctcagcagcaaaattggctgtgacatcttcgaagcgcaaccacaaggtccatgttctttttgtaactgagtgctttccaatcccgaatctcttcccttgcaagaaccttgtgagacatgaaggcaatgcttggctatatagccctgactcaaaagcattaagggaaaagctcaggcttccagtcggatcctgtgagcttgctgttccactcaaagcaaaatcgagacttttctcagtagatcgacgaagagaagcatatgcaacaatactgcattcagcgagtgaatatgtctgtggtgctatcacagcagctcaaagcattcgtcaagcaggatcaaccagggacctagtcatccttgttgatgagaccataagcgatcaccaccggagaggcttggaagctgcagggtggaaggtcagaataatccaaagaatcaggaatccgaaagcagagcgtgatgcatacaacgagtggaactacagcaagttcaggctgtggcagctgactgactacgacaagatcatcttcatagatgcagacctcctcatcctgaggaatgttgacttcctgtttgcaatgccagagatcacagcaactggcaacaatgcaacactcttcaactccggtgtcatggtcatagagccttccaactgcacattccagctgctgatggaccatatcaacgagataacttcatacaatggcggggaccagggatacctgaatgagatattcacctggtggcaccgcatccccaagcacatgaactttctgaagcacttctgggagggcgacagccaggccatgaaggcgaagaagactcagctgtttggcgcagacccaccaatcctctatgttctccactaccttggcctgaagccatggttgtgcttcaaagactatgactgcaactggaacaacgccggaatgcgtgaatttgcaagcgacgtcgcacatgcccgatggtggaaggtgcacgacaagatgccccggaagctccagtcctactgcctgctgaggtcacggcagaaggccagcctggagtgggaccggaggcaggctgagaaggccaactctgaagatggccattggcgccgcaacatcacggacaccaggctgaagacatgctttgagaagttctgcttctgggagagcatgctctggcattggggcgagaacaataacaggacgaagagcatccccatggcagtgaagacggcgagcttggcaaggtcatgatctgtagaatacaaacacccgatattgcaaccatacatgcatagcaatagcttgtataggtagctatgcttaggtcttcgctatacaaaatacaccactccctgttgctgtcatggctgcagctctatgtcgctgccagcctgcctcgacggctaacaattcttttgggttgactcttggctgctgaaataagtttcaggtaaatgtaaagttccctgctgaaattatgtgagcgtgtgagaaatgatttgtgtacagggcgccaaataataattggttagt

SEQ ID NO: 2665 - DNA, 2401 bp, Zea mays
tctccttctagtagtgggcagagagagatcgagtgctaggggagaagcaagcaagccaggcagcagcaaccgcgcctggtttcctcctcctcctcctcgtgggctcacacaaggcttccttcggttcgggggtgtgcgaagcggcgcaacggcggaggcggctctagcatcaccggccgacggtcctcctccttctcacgaaaggcactagaggagcggcggcggcggcggcgcatcaagcaccgcaccgatgggcccactggagccgcgctaccgtccaggcggcgcccccgaggacacgactaagagaagggcctccaagagcaagagtttcaaagacgccgagaacttcgaagtcctcgtccttgagaagagctgcggttgcaagttcaagtctttgaggatcttgctcatagccatcatctccgcgacagtccttacccttgtaaccccgaccttatacgagcgccagttgcagtcagcctcccggtacgtggatgtcgggtggatgtgggacagagcgagttccgatccgcggtacgcatcttctgccgatgttgggtgggaggatgtgtacaaagcactgggaaacctaagaagcggtaaccgccagagtcatctcagagttgggctcttgaatttcaacagcaccgagtatggctcctggacgcagttgctcccagctgacagccacgttatctccactgtaaggctcgagcacgccaaggacagcgtcacctggcagacgctgtaccctgagtggatcgacgaggaggaagagacggagataccctcttgcccgtcgctgccggagccaaacgtgccaagaggtgcgcgctttgacgtcgtcgccgtgaagctcccatgcacccgtgtggcgggctggtcgagagacgtcgcgcggctccatctgcagctctcggcagccaaactggctgtggcgtcctcgaagcgcaaccacgacgtccatgttctcttcgtcactgactgcttcccgatcccgaacctcttcccttgcaagaaccttgtcacacgtgaaggcagcgcctggttgtacagtcctgactccaaggcgttgagggaaaagctcaggcttccagtcgggtcctgtgagcttgccgttccactcaaagccaaatcgaggcttttctcggtagatcgacgaagagaagcgtacgcgacgatactgcattcagcgagcgaatacgtctgcggcgcaatctcggcagcgcaaagcatccgccaggcaggatccaccagggacctggtcatccttgtggacgagaccataagcgaccaccaccggagaggcttggaggcggcggggtggaaggtcagagtgatccagaggatcaggaaccccaaggcggagcgcgacgcgtacaacgagtggaactacagcaagttcaggctgtggcagctcaccgactacgacaaggtcatcttcatagacgccgacctcctcatcctgaggaacgtcgacttcctgttcgccatgccggagatcgccgcgacgggcaacaacgccacgctcttcaactccggcgtcatggtcgtcgagccctccaactgcacgttccgcctgctcatggaccacatcgacgagatcacctcgtacaacggcggggaccaggggtacctcaacgagatattcacgtggtggcaccgcgtccccaggcacatgaacttcctcaagcacttctgggagggcgacagcgaggccatgaaggcgaagaagacccagctgttcggtgcggacccgccggtcctctacgtcctccactaccttggcctcaagccgtggctgtgcttcagagactacgactgcaactggaacaacgccgggatgcgcgagttcgccagcgacgtcgcgcatgcccggtggtggaaggtgcacgacaggatgccccggaagctccagtcctactgcctgctgaggtcgcggcagaaggccaggctggagtgggaccggaggcaggccgagaaggccaactctcaagatggccactggcgcctcaacgtcacggacaccaggctcaagacgtgctttgagaagttctgcttctgggagagcatgctctggcattggggcgagaacagtaacaggaccaagagcgtccccatggcagccacgacggcaaggtcgtgatctgtagatatacgaacaccccatccccatatggcaaccatacatgcatagcaatagcttgtataggtagctatgctttagttcttcgctatatatacagaatacaccactcgatccctgttgttgtcaaggctgcagctctatgtcgctgccggcctgccaccatggctaacgattcttttgggttggctgctgtaataagtttcaggtacatgtaaatttccctgctgaaattacgtgaccgcgtgtgag

SEQ ID NO: 2666 - DNA, 2406 bp, Zea mays
atctttggtaaagcccgctagggcgggggttccgttggcctgcatgttttacatgacatttcgcccttctttttttttcattttgtttgcctcaggtgtgcgaagcggcgcaacggcggaggcggcgctagcatcaccggccgacggtcctcctccttctcacgaaaggcactagaggagcggcggcggcggcggcgcatcaagcaccgcaccgatgggcccactggagccgcgctaccgtccaggcggcgcccccgaggacacgactaagagaagggcctccaagagcaagagtttcaaagacgccgagaatttcgaagtcctcgtccttgagaagagctgcggttgcaagttcaagtctttgaggatcttgctcatagccatcatctccgcgacagtccttacccttgtaaccccgaccttatacgagcgccagttgcagtcagcctcccggtacgtggatgtcgggtggatgtgggacagagcgagttccgatccgcggtacgcatcttctgccgatgttaggtgggaggatgtgtacaaagcactgggaaacctaagaagcggtaaccgccagagtcatctcagagttgggctcttgaatttcaacagcaccgagtacggctcctggacacagttgctcccagctgacagccacgttatctccaccgtaaggctcgagcacgccaaggacagcgtcacctggcagacgctgtaccctgagtggatcgacgaggaggaagagacggagataccctcttgcccgtcgctgccggagcctaacgtgccaagaggtgcgcgctttgacgtcgtcgccgtgaagcttccctgcacccgtgtggcgggctggtcgagagacgtcgcgcggctccatctgcagctctcggcagccaaactggctgtggcgtcctcgaagcgcaaccacgacgacgtccatgttctcttcgtcactgactgcttcccgatcccgaacctcttcccttgcaagaaccttgtgacacgtgaaggcagcgcctggttgtacagtcctgactccaaagcgttgagggaaaagctcaggcttccagtcgggtcctgtgagcttgccgttccactcaaagccaaatcgaggcttttctcggtagatcgacgaagagaagcgtacgcgacgatactgcattcagcgagcgaatacgtctgcggcgcaatctcggcagcgcaaagcatccgccaggcaggatccaccagggacctggtcatccttgtggacgagaccataagcgaccaccaccggagaggcttggaggcggcggggtggaaggtcagagtgatccagaggatcaggaaccccaaggcggagcgcgacgcgtacaacgagtggaactacagcaagttcaggctgtggcagctgaccgactacgacaaggtcatcttcatagacgccgacctcctcatcctgaggaacgtcgacttcctgttcgccatgccggagatcgccgcgacgggcaacaacgccacgctcttcaactccggcgtcatggtcgtcgagccctccaactgcacgttccgcctgctcatggaccacatcgacgagattacctcgtacaacggcggggaccaggggtacctcaacgagatattcacgtggtggcaccgcgtccccaggcacatgaacttcctcaagcacttctgggagggcgacagcgaggccatgaaggcgaagaagacacagctgttcggcgcggacccgccggtcctctacgtcctccactaccttggcctcaagccgtggctgtgcttcagagactacgactgcaactggaacaacgccgggatgcgcgagttcgccagcgacgtcgcgcatgcccggtggtggaaggtgcacgacaggatgccccggaagctccagtcctactgcctgctgaggtcgcggcagaaggccaggctggagtgggaccggaggcaggccgagaaggccaactctcaagatggccactggcgcctcaacgtcacggacaccaggctcaagacgtgctttgagaagttctgcttctgggagagcatgctctggcattggggcgagaacagtaacaggaccaagagcgtccccatggcagccacgacggcaaggtcgtgatctgtagatatacgaacaccccatccccatatggcaaccatacatgcatagcaatagcttgtataggtagctatgctttagttcttcgctatatatacagaatacaccactcgatccctgttgttgtcaaggctgcagctytatgtcgctgccggcctgccmccatggctaacgattcttttgggttggctgctgtaataagtttcaggtacatgtaaatttccctgctgaaattacgtgaccgcgtgtgagaaatgaatttgtacagggcgtcaaaaaaaaaaaaaaaa

SEQ ID NO: 2667 - DNA, 2394 bp, Hordeum vulgare subsp. vulgare
ggagagctccgatacaccacctgactcgagctcttcttttgcgtgagcaaagcgcacagagagagagaagaaggagaggggagcggcccgtttctcgccgcccaccttccccttcgccggttcgcctgcgccgcggatgagaagcagcgcaccggcggcggcgtgaacctctccgctccccggggaagaaaggaggaggaggagaagaggaagagaggagggcccaagcccaagcccaagcccaggaccaatggagcagcgctaccgaccgggcggggccgctgatgacacaactaagagaaggaccaccaaaaccaaaagtttcaaagatgttgaaagctatgaagttcttgtccttgagaagaactgcggttgcaagttcaaatctttgcgctacttgcttatagctattgtttctgcgacatttcttaccctcctgactccgacgttgtatgagcgccaactacaatcaagttcacggtatgtggatgttgactggatatgggacaaaaccagtgctgatccgcgatatgtatcatctgctgatgttcagtgggctgatgtatatacagctatagaagatcttagtgctggtaaccaaaagctcaaaattggactcctgaattttaacagcaccgagtatggctcctggtcgcagatactccctgaaagccatgtttcaattataagacttgagcatgccaaggacagcattacttggcctacactatacccagaatggatagatgaggaggaagaatctgagataccttcctgtccatcatttccagagcctaatgtccgaagaggcgcatggttcgatgttattgctgtgaaacttccctgtacaagggtggcgggttggtcgagagatgttgcaaggcttcatttgcagctctcagcggcaaaactggccgtgtcctcttcaagaggcaaccggatggtccatgtgctttttgtgacggactgcttccccatccctaacctcttcccctgcaagaaccttgtgaaacatgaaggcaatgcttggttgtatagacctgatttgaaagcagtaagggaaaagcttaggcttcctgttggatcatgcgagcttgctattccacttaaagcaaaagcaagacttttctcagtagatcgaagaagagaagcctatgccacgatactgcattcagcaagtgaatatgtgtgtggtgctatcacagcagctcagagcatcaggcaagcaggatcaactagggacttggtcatccttgttgataacaccataagtgatcaccaccggaggggcttggaagccgctggctggaaggtcaggataatcgaaaggatcaggaacccaaaagctgagcgtgatgcctacaatgagtggaactacagcaagttcaggttatggcagctgaccgactacgacaagatcatattcatagacgctgacctcctcatcctgaggaatgtggacttcctgtttgcaatgccagagatcactgcaactggcaacaacgcgaccctcttcaactcgggtgtcatggtcatcgagccctcaaactgcacgttccagctgctgatggagcacatcaacgagataacatcgtacaacggcggtgaccaggggtacctgaatgagatattcacatggtggcaccgcatccccaagcacatgaacttcctgaagcacttctgggagggcgacagcgaggcagccaaggcgaagaagacccagctgtttggcgccgacccgccaaacctctatgtgcttcactacctgggcctgaagccatggctgtgcttcagggactacgactgcaactggaacaacttcatcatgcgtgagtttgcaagcgatgtcgcgcacaaccgttggtggaaggtgcacgacaagatgccccggaagctccagtcctactgccttctgagaacaaggcagaaggctgggctggagtgggaccggaggcaggccgagaaggcgaacctggaggacgggcattggcggcggaacatcaccgatccgaggctcaagacctgcttcgagaagttctgcttctgggagagcatgctgtggcactggggcgaggccaagaaccagaccaagagcatccccgcgcctaccacgacgagcttgtcatcaacctcgtgagctgtgtagataacccgagatatttatacagaagaaagctttatatgtatagcaccgtacctgcatagcggcagcttgtataggtagctactatgcttaggccttccccacacaaatacaaaccctcctctgttggctgttgccgccctcctggctgcagccttggtggccaacaattcttttgggtttgtttagctaataagttatctgtgcatgtaaattctcttactaagaacacggaatgtttttttcacgac

SEQ ID NO: 2668 - DNA, 3609 bp, Oryza sativa Japonica Group
atttggcgttttgacctcttcgtggaccaaccgctgaatctcttggatgatgcaatggtgccccggtattgttgatgatgatggcatgacatggtcggcgactgactcttgtgggatatgcaagtctgactttgtgccactggttttgtttccccaaaaaaaaaaaaatctttgtgctattagtgctggattgtcactgtgtgacgtgtaggggatgcaggctatggcttatgttgccgtcgggtgatctcagcgttcttggatcatctcatcgcctgtgtgctatactattagtagttgagtggttaggttcctgatttttgtttatgctttgtcaggattatgtttgcttttggttgtcatggttgcgaattctaattcgtgcgtcacaacgggtgttgaagggttgatcctactttgaattttgagttgattgaagccatgtgagtgtgtttggtgcaaagtgaccctttgtgattgtgtagtgatgatttttctgttcctcaaagaagtgtctgatgagtgaagcaggaaggttgtgaaatagatgtccatatgatattttttataagaatatttattagtgctgaggactttgcttttgttgtttcggtttccttattttattgggaaacatcttttagtgtatctcactttcacatccaactagcggatatactgcattttctcctctccttttttttttatagaagaacgcacttttggatacttttaatttggcattgctctgtgtttttgtaattaagtgctttgagtatttttatagcatactcaagggatgatataatagcacttcctgtatataaaaattattccatatctaccttgttgagctaatcattaggggaaagtaggtacctgtgagtgctatttttacgagtgtagctgctacatccttgctgctgtttttaggggtacctttatgcaagatttggttcactgaaacttccatttgtgcctctaaccttttagttaaagcatatgttcttcctatgagaatcctccatttgtgctctgcaaagaggtcctctatcatgcagaaccggtttttgctttgtagtgaccgtgcacttattgtctatatgattgtgatttaaatgaaagtgaaagggattaaaaaggacataatatgcattcatgtagtcgcagagagttcagaaattcacatattgtggaatctgcagctaacttatcatttatttcgctagcattctaggctaagaggaggctaaggctatcaatgagttgacacatttcttttaactaaatcttatttggcaaaagtagtccatttatgtctgaaactctgaatgtttctgaaaatatattgagactgaatatgtttctaccttctgcagtgatgacacaactaagaggaggacccccaaaagtaggatttacaaagatgtcgaaaattttggagttcttgtccttgaaaagaactctggttgcaagttcaaaactttgagatatttgctcctagctatcacttctgcgacgttccttaccctcctaactccaaccttttacgagcatcagttacaaagttctcggtgagcacaacttattcagaagtcccattgaattttcttatatagggtaaaaggaaagccaaatacctacatgctgttattattttctcatgtgaactcattttctctgcaggtatgtggatgttggttggatatgggacaaaccaagttatgacccacgatatgtatcatctgttgatgttcagtgggaggatgtatataaggcactggaaaatctcaatgatggtagccaaaagctcaaagttggactcttgaattttaacagcactgagtatggatcttgggcacagttgctcccaggaagtgctgtttccattgtaagacttgagcatgccaaagacagtattacttgggacaccctgtatcctgaatggattgatgaggaggaagaaactgatataccggcttgtccatcacttccagatcctaatgttcgaaaaggctcacactttgatgttattgctgtgaaacttccctgcacccgggtgggcggttggtcaagagatgttgcacgactccatttgcagctctcagcagcaaaactggctgtagcctcttcgaaaggcaaccagaaggtccatgtgctatttgttactgactgcttccctattcctaatctcttcccgtgcaagaaccttgtgaaacatgaaggcaatgcttggttgtatagccctgacttaaaggctttaagagaaaagctcaggcttccagttggatcctgcgagcttgctgttccgctcaaagcaaaaggttagttgcctttttagttaacaaattttggcctagagttttcaatcttattccacttatggttacctagatcaattgatatgcatgccaagagtcaggcaatctagaatgctgtcattaactaaaacatgtttagaactgttttctgcacatttagaatctaatagtacattgtaaatggcaagtctgtcgtggttatagtctccataaacacatgttaatgtcagcttttagtcttttctgaactgaattagaaactcagtagctaacatttgtttgtattgctgcagcaagactctactcagtggatcgaagaagagaagcatatgctactatcctgcactcagcaagtgaatatgtctgtggtgctatctcagcagctcaaagcattcgccaagcagggtcaactagggatctggttatccttgtcgatgacacgataagtgatcaccaccgaaaaggattggaggctgcaggctggaaggtgagggttatccaaagaatcaggaatccaaaagctgagcgcgatgcttacaatgagtggaactacagcaagttcaggttgtggcagctgaccgactatgacaagatcatattcatagatgctgatctccttatcctgaggaacgtcgacttcctgttcgcgatgccagagatcaccgcaactggcaacaatgcgacactcttcaactccggtgtgatggtcatcgagccgtcaaactgcacattccagctactgatggatcacatcaatgagataacatcgtacaacggcggtgaccaaggatatctgaatgagatattcacatggtggcaccgcatccccaagcacatgaacttcttgaagcatttctgggagggggacgacgattctgcaaaggcgaagaagactgagctgtttggcgcagacccgcctatcctctatgtcctccactacctgggcatgaagccatggctgtgcttcagagactatgactgcaactggaacatccccctgatgcgcgaattcgcaagcgatgtcgcgcacgcccggtggtggaaggtgcatgacaatatgcccgagaagcttcagtcctattgcttgctgagatcaaagctgaaggctgggctggaatgggaacggaggcaggctgagaaggcaaacctggaagatggacattggcggcgaaatatcaccgatccaagactgactatctgctacgagaagttctgctactgggagagcatgctgctgcattggggtgagaagaacccaacgaacaacaaccctgtgccagcgacaata

SEQ ID NO: 2669 - DNA, 2648 bp, Oryza sativa Japonica Group
cgcgagctctgcacagcgagagagagagagagagagtagagagagaggagtgagagagccggtggcacccagctaacccactcggccgccaccaactgcggccatttccgacgacgccgacgccggggcgcgcccgtcggtgctcccaagtccgccttctctgcggatgagaagctgctccaccgcggcggcgacagtgtggtcggccaccgcctgagaccggagagccatagctgacggctcgggggaagattcaggtgggctcgcagagaacgaaagagagtccccatgggttctttggagacgacgaacacgcggtaccggccggccggagcagcggatgacacagctaagagaaggacccagaaaagcaaaagtttcaaagaggtcgaaaaatttgatgtctttgtcctagagaaaagctctggttgcaagttccggtccttacaacttctgctcttcgcgatcatgtctgctgcatttctgacactattgtacactccatctgtgtacgaccatcaaatgcagtctagttctcggtttgtcagtgggtggatatgggacaagaccattcctgatccacgatatgtatcttcgcttggtgttcagtgggaggatgtatataaaaccgtcgaaaatctgaatgatggtgaacggaagctcaaagttggactattaaattttaacagcactgaaattggctcatggacacaattgctcccggatagtgatttttcgatcattaggctagagcatgccaaggaaagcatcacctggcagactctttaccctgaatggattgatgaggaggaagaaacagagataccatcgtgtccatcgcttccagatcctatttttccaagagggacacactttgatgttgttgctgtgaaacttccctgtacccgagctggtggatggtcaagagacgttgcacgtctgcatttgcaactatctgctgcaaaagtggcagtgactgcttcaagaggcaatcgtggtatccatgtgctgtttgtgacggattgcttccctattccaaatctcttctcttgcaagaaccttgtgaaacatgaaggcaatgcttggatgtacaagcctgacttgaaggcactaagggagaagctcagacttccagttggatcctgtgaacttgctgttccactcaaagcaaaagcacgactttactcggtagacagacggagggaagcatatgctactattctgcattcagcaagtgaatatgtctgtggtgcaatcacagctgcccaaagcattcgccaagccggatcaactagggattttgttattcttgttgacgagaccataagtaaccaccaccggaagggcttggaagctgctgggtggaaggttagaataatccaaaggatccggaatccgaaagctgagcgtgatgcatataatgagtggaactacagcaaattccgtctatggcagctcacagattacgacaagattatatttattgatgctgatctcctcattctgagaaatgtcgattttctgttcgcaatgccagaaatcactgcaaccggcaacaatgcgacactgttcaactctggagtaatggttattgagccttcaaactgcacattccagttgttgatggaccacatcaatgagataacatcctacaatggtggtgaccaaggatacctgaatgagatattcacatggtggcatcgaattccgaagcacatgaacttcttaaaacatttctgggagggggatgaagaggaagtgaaagtgaagaagactcggttgtttggtgctgacccaccaatcctctatgtccttcactatttgggtctcaaaccatggctgtgcttccgggattacgactgtaactggaataacccgatactgcgggagtttgccagtgatgttgcacatgcccgttggtggaaggtacatgacaagatgccaaagaaacttcagcactattgtcttttgagatcaaggcaaaaggctgggttggagtgggatcggaggcaggctgagaaagcaaacttcaccgatggacattggcggaggaacataactgatcctaggctgaaaacttgctttgagaagttctgcttctgggagagcatgttatggcactggggtgaatccaagaactcaacgaaggaaaaccctgtgccggccacacctaccgcgagcctcacaagttcatgagatgtgtagatagccctataccagatacaaacttctaagctccatacatacatagcaacagcttgtaaaggtagctatgcttaggtttctcgacaaaactataccttgtgtttgctatcatggcttcggctccactctggctgctttgatagctcacaatttttttggttttttggccaataattcatcagtataggtaaattttctgttcatgaattgtttggtcagtctggggttggttgttgctcggctgcaatagcctagttcgatgtatggtggttgaactgtttcggtgataaaatctggagtgacgcaacatgagattgctgaccagcaaacactgcctcattttgacatgaaatacagtattgttttaaaattgagttggattaatacggtcacggctgacatccacagatggttggacgttggagcagctggggccattttgc

SEQ ID NO: 2670 - DNA, 2445 bp, Hordeum vulgare subsp. vulgare
ggagccggagccacacaccagcgcacagccaccaccaccaccgactgcgtccgtccatccgtctcttcttcctcatcctgccatcgccattgccgccgccgcagcttcctcctccgcagctgcgatacggatgagaagcagcgcgaccggggcagcgactgcgcggtcggcctgaggaccggagaggcaggccggcgggctgcagagctcagctcagctcagaggaggcttcaaccaggcagactgaaaccgagcccccatgggctccctggaggcgcggtaccggccggccggagcagctgatgacacagctaaaagaaggacccagaaaagtaaaagtttcaaagaggttgaaaagtttgatgtatttgttctagagaaaagctctggctgcaagttccgttccttgcaacttttgctcttcgctatcatgtctgctgcatttctgacacttctatacacaccatctgtgtatgagcatcagttgcagtccaattctcggtttgttaatgtcggatggatatgggataagactatccctgatccgagatatgtatcttctatggccgtccagtgggatgatgtgtataaaactatcgaaagtctgaatggtggtgagcagaagctcaaagtcggactcttaaattttaacagcactgagttcgggtcttggacacaattgctcccagaaagtgagttttcgatcataaggttagagcatgctaatgaaagcattacctggcagacgctgtatcctgaatggattgatgaggaggaagaaacagagataccatcttgtccatcgctttcagagcctaatttcccaagaggcacgcattttgatgttattgctgtgaagcttccctgtacccgagttggggggtggtcaagagatgttgcgcggttgcatctgcagttgtcagcagcaaaattggccgtgagtgccgctagaggcaaccgtggggtacatgtgatgtttgtgacggagtgcttccctcttccgaatctcttctcttgcaagaatcttaagaaacatgaaggcaatgcttggctatacaagcctgatccgaaggctttaaaggagaagcttagacttccaattggatcttgtgagcttgctgttccactcaaagcaaaatcaagacttttctcggtagaccgacgcagagaagcatatgctaccatactgcattcagcaagtgagtatgtctgtggtgcaatcgcagcagctcaaagcattcgtcaagcaggatcaacaagggactttgttattcttgtcgatgacaccataagtgaccatcaccgaaagggccttgaatctgcgggttggaaggtcagaataattgagaggatccggaacccgaaggccgagcgtgatgcttacaatgagtggaactacagcaagttccggttgtggcagctcacggactatgacaagatcatattcatagatgctgatctgctcatcttgaggaacattgatttcctgtttacaatgccagaaatcagtgcaaccggcaacaatgcaacactcttcaactctggtgtcatggtcatcgaaccctcaaactgcacattccagctgttaatggagcacatcaatgagataacatcttacaatggtggtgatcagggctacttgaatgagatattcacatggtggcatcggattcccaagcacatgaacttcctgaagcatttctgggagggtgatgaagaggaggtgaaggcgaagaagacccagctgtttggcgccaacccaccgatcctctacgtcctccactacctgggccgcaaaccatggctatgcttccgggactatgactgcaactggaacgttccgatactgcgggagtttgccagcgacattgcgcacacccggtggtggaaggtgcatgacaagatgcccaagaagctccagagctactgcctgctgaggtcaaggctgaaggccgggctggagtgggagcggaggcaggcagagaaggccaacttcaccgacgggcactggaagcggaacatcacggacaagaggctcaagatttgcttcgagaagttctgcttctgggagagcatgctgtggcactggggtgaggcccccaactcgacgaagaaggcctcgacgccggcactgcccaccgcgaccctctcaagctcatgatgggatgttgtgtagatattatcctccccgagaaattttagcataccagaagatacagcagactcccagtctctccttgatacatacacaatagcaacagcttgtaaaggtagccatgctgctcctagggctttcctcaacagctatacattttgtttgctgccaatgccttggggtcgcgctctcgttgctgctgctgctgccgctccaaccgcgacggctaacgattttttggttgatggatggatggataataattcgtcgcgtgtaggtaaattttctcg

SEQ ID NO: 2671 - DNA, 1496 bp, Oryza sativa Japonica Group
gccgcaaaacccttctcccgccgccgccatcgccgccgccatggacccctcgcagccgtccgggagctccgccgacgcctcggcgtcctcctcctcctcctcctcctcctccgccgtggagaatctcgccgcggggatggcggccatgagcctccaggatcggttcgagttgctgcgggggatcggcgaggagtgcatccaggaggacgagctcatgaacctgctgcagaagaagcccgtccccatctgctacgacggtttcgagccctccggccgcatgcacattgctcagggcattgtgaagacaatcaatgttaacaagatggtcagagctggatgcaaagtgaaaatttggatagcagactggtttgctcagctaaacaacaagatggggggtgatataaaaaaaatacagactgtgggacgctacatgattgagatttggagagcggctggtatgaatcttgatggtgtggaattcttgtggtcctcagaggaaatcaataagcgtgcaaatgaatattggccacttgtaatggacattgctcgtaaaaataatgtcaaaagaataatgagatgttgtcagattatgggtcggaatgattcggatgagttgactgctgcccagatcttctatccttgcatgcagtgtgctgatatatttttcttaaaggcagacatttgccagttgggcatggaccaaaggaaggtcaatatgctagccagggagtactgtgatgacatcaaaaggagaaacaaaccaattattctgtcacatcatatgctccctggttttaaggagggccaagaaaagatgtcaaagagtgatccatcctcagccatttttatggaagatgacgaggctcaggtaaatttgaagataaaacaagcattttgccctcccaacattgttgatggcaatccatgcttggagtacatcaagtacattgttttcccttggtttgaaacgtttgaggtggttcggaaggaagaaaatggcggtaacaagacatttgccaacatgaatgaactcatcgctgattatgagagtggtgctttgcatcctgctgatgttaaaccagctcttgcaaaagcgataaaccaaatattgcagcctatccgtgaccacttcaaaaacaacagtgaagcaaaagttctgctcaacactgttaagaattacaaagtaaaaacggaggatactagttcaagccctcaagcatcttaagagttcatgatggtctacatggatatcttttaactttgtttacattatgcagttgtgtgatacacattctcttttggttagtgttatgtactttaaatgttcatgatcaccttataccgttatagtatgagaaaaaaggcaaaagttttgagtgcagacagtggaaatgccttgttgataccaaacatttgttctgctctgcatctgcacaaccactaaggtcttacctttgtggaaagaaatattaactggtgaagccctgtttggaatc

SEQ ID NO: 2672 - DNA, 1482 bp, Zea mays
ccatcccctccttgccgtctccgggcacggcctcgtcgaatcctttgctcctcctccgccgcagccgctgccatggactccacgccggcgcacgaggcggctcccggagcctcctcttccgccaccgccgccgccgaggatctggcgggtggcgtggcggcgatgaccctggatgagcggttcgctctgctgcgggggatcggggaggagtgcatccaggaggacgagctcaggcgcctgctcgagaacaagcccgtccccatctgctacgacggcttcgagccctccggacgcatgcacatcgcccagggcattgtgaagaccatcaacgtcaacaagatggtcagagccgggtgcaaggtgaaaatctggattgccgactggttcgcgcagctcaacaacaagatgggaggcgacctcaagaaaatccagacagtcgggcgctacatgatcgagatttggaaggcggccgggatgaacctcgacggggtggagttcctgtggtcctccgaggagatcaaccggcgcgcccacgagtactggccaatcgtgatggacattgcccggaaaaacaacgtcaaacggataatgagatgctgccaaattatgggcagaagtgaccaggacgacttgactgctgctcagattttctacccttgcatgcaatgtgctgatatatttttcttgaaggctgacatatgccagttggggatggaccaaaggaaggtcaatgtgctagctagggagtactgtgatgacatcaaaagaaagaacaaaccaattattctttcacatcatatgctccctggttttaaagaaggccaggagaaaatgtcaaagagtgacccatcctcggctatctttatggaagatgacgaagcccaagttaacgtgaagataaagcaagcattttgccctcccaaaattgttgaggggaatccttgtttggagtacattaaatacatcgttttcccttggtttggaaggtttgaggtggcccggaaggaaagcaatggcggtaacaagacatttacaagcatggatgaactaatttctgattatgagactggtgctttgcatcctgctgatgtcaaacctgcactggcaaaagcaataaatgaaattttgcagcctgttcgtgatcacttcaacaacaacaacgaagccaaagttctactaaacactgtcaagaagtacagagtaaccagttgaggagcggaaggtgttcatctttagggtgaatgtcgctgattgaaattcttatatgcttattctgttactaatgccaccactcattttagatcaagcattgagccattggttatcagtgtataatctctatgaaggcattttggtggcagtggccttgtctgtcattggctacaacgttctagataaaaaaacatttaaattttgtggaagttgaattatcttctcatgtgtgtatgactgaatgtgagactggttgaaagtgcaagcgat

SEQ ID NO: 2673 - DNA, 1572 bp, Zea mays
gtcatctcattttccttttcacgcccactcactcacccgccgcccccgccgccgccatcccctccttgccgtctccgggcacggcctcgtcaatcctttgctcctcctccgccgcagccgctgccatggactccacgccggcgcccgaggcggctcccggagcctcctcttccgccaccgccgctgccgaggatctggcggggggcgtggcggcgatgaccctggatgagcggttcgctctgctgcgggggatcggggaggagtgcatccaggaggacgagctcaggcgcctgctcgagaacaagcccgtgcccatctgctacgacggcttcgagccctccggacgcatgcacatcgcccagggcattgtgaagaccatcaacgtcaacaagatggtcagggccgggtgcaaggtgaaaatctggattgccgactggttcgcgcagctcaacaacaagatgggaggcgacctcaagaaaatccagacagtcgggcgctacatgatcgagatttggaaggcggccgggatgaacctcgacggggtggagttcctgtggtcctccgaggagatcaaccggcgcgcccacgagtactggccaatcgtgatggacattgcccggaaaaacaacgtcaaacggataacgagatgctgccaaattatgggcagaagtgaccaggacgacttgactgctgcccagattttctacccttgcatgcaatgtgctgatatatttttcttgaaggctgacatatgccaattggggatggaccaaaggaaggtcaatgtgctagctagggagtactgtgattacatcaaaaggaagaacaaaccaattattctttcacatcatatgctccctggttttaaagaaggccaggagaaaatgtcaaagagtgacccatcctcggctatctttatggaagatgacgaggcccaagttaatgtgaagataaagcaagcattttgccctcccaaaattgttgaggggaatccttgtttggagtacattaaatacatcgttttcccttggtttggaaggtttgaggtggcccggaaggaaagcaatggcggtaacaagacatttacaagcatggatgaactaatttctgattatgagactggtgctttgcatcctgctgatgtcaaacctgcactggcaaaagcaataaatgaaattttgcagcctgttcgtgaccacttcaacaacaataacgaagccaaagttctactaaacactgtcaagaagtacagagtaaccagttgaggagcggaaggtgttcatctttagggtgaatgtcgctgattgaaattcttctatgcttattctgttactaatgccaccactcattttagatcaagcattgagccattggttatcagtgtacaatctctctatacaggcattttggtggcagtggccttgtctgtcattggctacaacgttctagataaaaaaacatttaaattttgtggaagttgaattatcttctcatgtgtgtatgactgtatgtgagactggttgaaagtgcaagcgacaaggcatatatggccgaggaaaaaaaaaaaaaaaa

SEQ ID NO: 2674 - DNA, 1461 bp, Zea mays
cctgctctcggcagtctctgcacgacctcgtcgaatcattggctccctcctcctccgccgcttccatggactccacgccggcacccgaggcagcccccggcacgtcctcttcctccccggccgcggccgccgagggtcttgcggggggcgtggcggcaatgaccctggatgagcggttcgaaatgctgcggggcatcggggaggagtgcatccaggaggacgagctcagacgactgcttgagaacaagcccgtacccatctgctacgacggcttcgagccatctggacgcatgcacatcgctcagggcgttgtgaagaccatcaacgtgaacaagatggtcagcgccgggtgcaaggtgaaaatttggatcgccgactggttcgcgcagctcaacaacaagatgggaggcgacctgaagaagatccagacggtagggcgctacatgatcgagatttggaaagcggctgggatgaaccttgacggggtggagttcctgtggtcctccgaggagatcaacaagcgcgcacacgagtactggccaattgtgatggacattgcccggaaaaacaacgtcaaaaggataatgagatgctgccagattatgggcagaagtgaccaggacgacttgactgctgcccagattttttacccttgcatgcaatgtgctgatatatttttcttaaaggctgacatatgccagttggggatggaccaaaggaaggtcaacgtgctagctagggagtactgcgatgacatcaaacggaagaacaaaccaattattctttcccatcatatgctccctggttttaaagaaggccaggagaaaatgtcaaagagtgatccatcctcagctatctttatggaagatgatgaggcccaagttaatgtgaagataaagcaagccttttgccctcccaaaattgttgaggggaatccttgtttggagtatattaaatacattgttttcccttggtttggaagatttgaggtcatccgtaaggaaagcaatggtggtaacaagacatttacatgcatgaatgaactaatttctgattacgagactggtgctttgcatcctgccgatgtcaaacctgcactggcaaaagcaataaatgaaattttgcagcctgttcgtgatcacttcaacaacaacaacgaagccaaagttcttcttaacactgtcaagaagtacagggtaaccaattgaggagtggaagctgtccatctttagggcatgtttacattagggtggatatcgccgtttgaaattcttgtatgctattctgttactagttgcataggtagctcaaaagtttcatgtttctagatatataaaaagaatactttacttgttgactacttgatgtgcatcatagggctcaacctaaacagtgttgcactgtaagtattcgataaaagataaacaaagccaatatccaggagtaaaaaaaaaaaaaaaa

SEQ ID NO: 2675 - DNA, 1475 bp, Hordeum vulgare subsp. vulgare
gaaggcgcgtaaaaccctagctgtctccaaattcgccacccgccacccgcaccgccgccacctccatggactcttccgtggctgccgatgccgtcaacgcagaggcctccgcccccgctgccgcttcaatggaaccttccgcggctcccgaggcctccaacagagcctcctcctccgctgccgccgccgaagacctcgtggggggcgtggcgggattgagcctggacgagcggttcgacttgctgatgagcatcggcgaggagtgcattcagcccgacgagctcaagcggctgctgcagaacaagcccgtccctatctgctacgacgggttcgagccctccggccgcatgcacatcgcccagggtgttgtgaagacaattaatgttaacaagatgatcagagcgggatgcaaagtgaaaatctggatagcagactggtttgcacagctaaacaacaaaatgggtggtgatctgaaaaaaatccagactgtcgggcgctacatgattgaaatatggaaagcagctggtatgaaccttgatggcgttgaattcttatggtcttcagaggaaattaacaggtgtgcaaatgaatactggccacttgtaatggacattggcaggaaaaataatatcaaaagaataacgaggtgttgtacgattatgggtcgctctgacaacgaggaattgactgctgcacagatcttctatccttgtatgcagtgtgctgatatattcttcctgaaggcagacatatgccagttgggcatggaccaaaggaaggttaacatgttagcaagggaatattgcgatgacatcaaaaggaaaaacaagcccattattctgtcacatcatatgctcccgggtttcaaagaaggccaggagaagatgtcaaagagtgatccaacatcggctatctttatggaagatgatgaggctcaggtaaatttgaagataaagcaagctttctgtcctcccaaaattgttgataaaaatccgtgcctggagtacatccagtacattgttttcccttggtttgataagtttgaggttgtccgcaaagaaaacaatggcggtaacaagacatttttaaccatggatgaacttgttgctgattatgaagcgggtgatttgcatcctgccgacgttaagcctgctttggcgaaagcgataaatgaaatattgaagcctgttcgtgaccacttcaacagcagcagtgaagccaaagttctcctcaatactgttaagaagtacagggtaagcagctgaggagcaaataccttccgggtcactacatggacaccgaaccgacaatggaaccatacacattttggttgcaaaatttcttgggaataatttttggcatactaatacctgtctattgctgatatgcatcagaaactgtcgtgattatgttgatcagtgtacaatctttgtatgtgtcaccttcaattgagaagttaaaatgcttggccggac

SEQ ID NO: 2676 - DNA, 1549 bp, Nicotiana tabacum
attcttcctctccgcagaaaaatcccagttttgaaagatggataacaaagaagcttcagaagccattaatgcactctcctcaccgccttcttcagctgacactcctatttccacatctcagaatatggataatcaagagacttcagaagccattgatgcactctcattggcagcttcctcatccaacccttccatttcaacttcgcagatgagcttggaggagaagttcaagattgttaggagtattggcgaggaatgcatacaggaggatgagttgatgaatcttttggcaaagaagccacaaccggtttgctatgatggttttgagccttctggtcgaatgcacattgctcagggagttttgaaggcactaaacgtcaacaaactgacttcggctggctgcaaggtgaagatctggattgcagattggtttgcgcagctaaataacaagatgggtggtgatctgaagaaaattgaggttgttggtcagtatttgattgagatatggaaggctgtgggaatgaatcttgaagggggtcatgtggaatttctatggtcttcaaaagagattaactctagagctcatgagtactggccacttgttatggacgtagctcgaaggaacaagcttccccggattttaaggtgctgccaaattatgggtcggtctgagcaagatgagttgacagcggcccagattttttacccatgcatgcaatgtgctgacatattcttccttaaggctgacatatgtcaactaggtatggaccagcgaaaggttaatgtacttgcaagagagtactgtgatgacatcaggaggaaaaacaagcctatcatattgtcccatcatatgctccctggtttgcaggaaggtcaagagaagatgtccaagagtgacccctcttcttccatctacatggaggatgaagaggcagatgtaaatctcaagataaagaaggctttttgtccaccaaaggtcgtagaaaagaatccatgtctggagtacatcaagtatatcgtcctcccttggtttaatgagttcaaaattgagcgaagtgctgagaatggtgcggacaagacctataagaattttgaagaattagcggctgactatgaaagtgggaacttgcatcctgcagatctgaaacctgcattgtcaaaagcaatcaataagatattacagccagtgcgtgatcattttaagaatgatcagaaagccaaagaccttatgaaaagggtgaagagtttcaaagtaacgaggtgaggtctagctgaatgaagtgacgtggattaggagatggtgatggctgtctggaagttccatcccatttttctcctgtttcaaaactttactaccttggttttccaagagacgttaacgtcatagacatccaccattttgatcgaatacttcttattcttgtgttattgaaatgtccgaatcataagactagattttgtaaaccgtgatttcacagaggaattgcctctgatacatttgttagaatttagcaacatggtaatttccataaaaaaaaaaaaaaaaaaa

SEQ ID NO: 2677 - DNA, 1242 bp, Ricinus communis
atgtcaactgaggaagacaaaatcgcgccatctgaagaaatgcagtctctctctgttaactctgcgtctccctcatcttcttctcagactatgagtccagaggagagatttcaaattgtaagaggcattggagaagagtgtatacaagaagatgagctccttaatcttcttaccaaaaagccccaacccatttgctatgatgggtttgagccttctggtagaatgcacattgcccagggtgttatgaagaccataaatgtaaataaactgacttcggctggttgcaaggtcaaaatatggattgctgattggtttgcccagctaaacaacaaaatgggaggtgatctgaagaaaatccaaacagtagggcgttattttgttgagatatggaaggcggctggcatggatctcgatggaggtaaagtagaatttctgtggtcttctgaggaaattaactccagggcagctgagtactggcctcttgtaatggacattgctcgtaggaacaagcttcccaggattttgaggtgtgttcaaataatgggtcgtagcgaacaggacgagctgacagcagcccagattctctatccatgcatgcagtgtgctgacatattttttctcaaggctgacatttgtcagttgggcatggatcagaggaaagtgaatgttcttgcacgagaatactgtgatgacatcaagaggaaaaacaagcctatcattttatctcatcacatgcttcccggtttgcaagaagggcaagataagatgtcaaaaagtgacccatcttcttccatctttatggaggatgaagaggcagaagtaaatttgaagataaagaaagcattctgtccgccgcagcaggttgagaagaatccttgtctggaatacctcaaatacattatcttcccttggtttaatgaattcaaggtggaacggagtgaaaagaatggtggagaaaagacctatgaaagctttgaaaaacttgttgctgattatgaaagtggtgaattgcatcctggtgacctgaaacctgctttgtctaaagcgataaatatgatattgaagcctgtacgagatcacttcaacaatgatgctaatgctaaggatctcttgaaacgtgttaagagtaacacgataaggcagaagaggatgttcactgttggagtgaatcatcttaaggggaactctcttggcgttttgatgctgttatggatacactggagacaatgtcttgaatgttaa

SEQ ID NO: 2678 - DNA, 1592 bp, Vitis vinifera
ttgggaacgagttggcccaatcgggctaacccgcccatacaagcaaacaaagttttcaaatatccagttgaccagagccgtacaaagtccaaatcacgcagccgaaaccctactaacgattcctaacaaagaaatgaaagaatagagtccaagaagcggccaccatctgcagatccaatggagagcgaagcttcagaccctactccgaacatgcaatctctatctgtcaacgattctcagaatcacgactccgccagttcttccaatccagcgcccgcgatgacgttggaggagaagttcaggatcgtgaggagtgtgggagaggagtgtatacaagaggatgagctgatgaatctgctgaggaataaacctgaacccatatgctatgatggctttgaaccctctggcagaatgcatattgctcagggagttatgaagacaataagtgtgaacaaactcacatctgccgggtgcagagtgaagatatggattgcagattggtttgcacagctaaacaataaaatggggggtgatctgaagaaaattgaaacagttggacgatatctgattgagatatggaaagctgttgggatggatcttgacggaggcaaagttgagtttttgtggtcttcaaaagaaattaatgccagagcacatgagtactggcctcgtgtaatggatatagctagaaggaacaagctccctaggataatgaggtgtgttcaaattatgggtcgatccgagcaggaggaattgagtgcagctcagattctatacccatgcatgcaatgtgctgacatatttttccttaaggctgacatctgccagttgggaatggatcagaggaaagtgaatgtacttgccagagagtattgtgatgatatcaaaatgaagaacaagcctatcatcttgtcacaccatatgctacctggtctacagcaagggcaggagaagatgtcaaaaagtgacccctcatcctccattttcatggaggatgaagaggccgaggtgaatgtgaagataaagaaggcttactgccctccaaaagttgttgaaggaaatccatgcttggagtatgtgaattacatcattttcccatggtttaatgagttcaaagtagagcgcaaagctgaaaatggtggagataagatcttcaaaagttacgaagaattgattgctgactatgaaaatggggagctacatccaggcgatctcaaaccttctttgtctaaggctttaaataagatactacagcctgtgcgagatcactttgctaatgacagcaatgccaaagatctgttgaagcgggtcaaggcctacagagtcacccggtgatgtggaagaaagaaagaaagaggcatgaaacatattctgatttggtggctgatttaagtgtgattgtgagtcaggggagttcttcatggtcaaaaaaattagtctccacttcaactaggaagcgattgttttttcgtttgcaaatcttctaccttaactttctccaatacaaaatggttcgtatattcaaaatgtatggatatacaatcatgtagcgatattcactgaacgttgagccaataaggagtttttttaac

SEQ ID NO: 2679 - DNA, 2853 bp, Vitis vinifera
atggagagcgaagcttcagaccctactccgaacatgcaatctctatctgtcaacgwttctcagaatcacgactccgccagttcttccaatccagcgcccgcgtaagaatcaatctttcacctctctctccacatagaagcaattttttgtttttctactctttcgatttgtttgaatgctcggaaaataggtgaaaagggactaaaattgaaaatttgttgggtcttgagtgttccattgttgttgtttgatgaattcgtggaagtcggctcagctactcgaggcgggggtgtgaacagaattgaaaactagttttttttttttttttgcttccttttaattctcagttccaaaacagtgaaatagtggttcatcacggtgatttatgttgtatccttgtgaaaatttgtgcaaattttgagctttggagatgatgttctcttgaatcaggatgacgttggaggagaagttcaggatcgtgaggagtgtgggagaggagtgtatacaagaggatgagctgatgaatctgctgaggaataaacctgaacccatatgctatgatggctttgaaccctctggcagaatgcatattgctcaggtactattttcatattcagagtgttccctttcatcatttctagttatagtttgcgggattgacttatattaaatctgtactgtcctatctcttataatttacccataaaaacgtcaacatgaattgctatttttcttgttcctttgtagttggctggtttcggagttatattatgttcaatatggttgttttattttatgtggcagggagttatgaagacaataagtgtgaacaaactcacatctgccgggtgcagagtgaagatatggattgcagattggtttgcacagctaaacaataaaatggggggtgatctgaagaaaattgaaacagttggacgatatctgattgagatatggaaagctgttgggatggatcttgacggaggcaaagttgagtttttgtggtcttcaaaagaaattaatgccagagcacatgagtactggcctcgtgtaatggatatagctagaaggaacaagctccctaggataatgaggtacattaatttttgctgtcaatgatgcttacagtatttggtgaagttggaaattttcattttcttcatttgtaggtgtgttcaaattatgggtcgatccgagcaggaggaattgagtgcagctcagattctatacccatgcatgcaatgtgctgacatatttttccttaaggtgtgtgatgttttacaattagagtaatgaatgtatttttattttctgatgactatcacaakttgaagttaaatgtaatgtagcagtagtaagcaatgcctatgttgatggggatgtccatgccagcaaccaccttttcttctttcagaatttgggatccattttttcccaccttgtatatctcttcatacgcaaacacactgggttgcctaggttgattttatgttaacacatcactgagaatcacgtaaattggtttttcttttgaacaggctgacatctgccagttgggaatggatcagaggaaagtgaatgtacttgccagggagtattgtgatgatatcaaaatgaagaacaagcctatcatcttgtcacaccgtaacctccaactgttgctaattctgtatttacaatagcatttgtttcaatcagctactcattattggccttgcttatatgtgatttgcagatatgctacctggtctacagcaagggcaggaaaagatgtcaaaaagtgacccctcatcctccattttcatggaggatgaagaggtatagcatttttttaagggatttaaacaattcagaaagagcagagttgatttggttatcagaacctttgagggaaagggaaaaaaaaaaggaggaatcggtttttcttgtttggttttcatagaaaatgtgaagggaatgaagtaaaataagaattatgttgaatcttatgcattttcaacattcttattctgtgtttcaaatatgaatgaagtagaaggagaagagagaaagtttagtgagctcaaactttttttcccttccctttttctttcttttctattttccatttccttgccctttccctcacagtttcccagatggaatggagacctagtaggactcagatatataacatggatttagtgaggcattgaactgggatattttgagaatgtaacttatatttgggcacctactcttctaatgttttcattctccatgtcacaggccgaggtgaatgtgaagataaagaaggcttactgccctccaaaagttgttgaaggaaatccatgcttggagtatgtgaattacatcattttcccatggtttaacgagttcaaagtagagcgcaaagctgaaaatggtggagataagtgagttttatgcactctcagatcagatacttatttacaattctccatttatcatttgtatatatagttttgttaattrtcaatgcttgggttgaagatgccagtctcttgaactccaatatcaatggttttatcccatttctctgttgtccaggatcttcaaaagttacaaagaattgattgctgactatgaaaatggggagctacatccaggcgatctcaaaccttctttgtcgaaggctttaaataagatactacaggtaagcttttcctagtcttatccaatgtgcttcccaggtaaattttctctcaaattctaggaaaggtgtgccactaacctyaattatttattctgttctttgtatgttcagcctgtgcgagatcactttgctaatgacagcaatgccaaagatctgttgaagcgggtcaaggtacatac

SEQ ID NO: 2680 - DNA, 1417 bp, Zea mays
aactttgggctgtcgccaccagaaagccctcacgagtcctttgcctcctcactccgtcaggctcgtcgccacagggttttgttcctaactttttagcttcaatttttgtcttgaatggcaacacctctggatgttccactggatgatttgattaagagcagarctgggaggggaacaggaagaggcaggggacaaggagggggtcgaggcagaggtgatggccaaaggttggctcgtggttcgtggcgtgggcgtggtactggcaacttccgtgaaaggggacttggggtgtcttcgcggaggccacttggtgttaatacttggtcctcatcatttgctattgccaagtcattcaataaagcaaaggattttgtgtggagacatgatctctttgaggatagcatggtagcagctgggctttctgggatagaatctggaacaaagctttacatttcaaatttgcactatggagtgacaagtgaagatctacaggagcttttttcagaaatgggtcatttgaagcactgtgctgttcattatgacagttatagacacccaactggttcggctgaggtgatattcaccaggagaagtgaagctctcgcagcactgaagcgatataataatatgcgccttgatgggaaggccatgaagattgaagtaataggagcagaattgggtctatcagctgctgccgtaccccagattagtgttgttcctggtgcaagcagaagagggcagagagaagttgttatgatgcctggtggaagtgggtttggacaaggtgcatctggcccatctagttcgcttcctgggtggaagcgtggaggctttgttcgaagaggacaagggcgtgttagttttcctcaaagagggcgagggcaagtgcgcagccgtggccgtggccgtggccgcagtagccttgttcagagccgtggacgtggctatgtgcgcaggggtaatgcagagaaatcagccaaacaattggacaatgaacttgacaactacaactctggtgcgatgaatgtcgactaagttaatccatcgtgacatcattcaatccaacctggaagttggaactatgttgaagctaagcttgttttctgtcggtattctgtcaaatgtgcacacttctgtcatgctctagtggcatcagttgaagattagatattccattattcctactgcaatagtcttgtgatatcagaatttgctgtaattgaatgatgaattatgttttcaaccgttgaaaggtttgctgtcaaaatttcaatattatcctagttattgtcagaattttcagtaggcattagccaaaaagattggtgctgactactggtatatcagaatttgctgtaattgaatgatgaattatgttttcaaccgttgaaaggtttggtgaaaaaaaaaaawhwaa

SEQ ID NO: 2681 - DNA, 1565 bp, Zea mays
cgccagcccgcccacagaaaagccgttctcccctctttctcgattcgacgaggggaagactcgtcgagccgccggccagcccatctcggcgcattcccggagaatccctccggaaaccggtcgatcctgggtcatccaacacacagcacttcgcttctcccgcgtccccgacccgcgcgcaagccctcatgcggttagggctgtaacgatctcgtctcgctaccggcggccggctgcggaacgggccaccccacgcgttcctctgagttcgttcgactaatctaccgctgactgtactttgggctgtcgccaccagaaagccctcacgagtcctttgcctcctcactccgtcaggctcgtcgccacagggttttgttcctaactttttagcttcaatttttgtcttgaatggcaacacctctggatgttccactggatgatttgattaagagcagagctgggaggggaacaggaagaggcaggggacaaggagggggtcgaggcagaggtgatggccaaaggttggctcgtggttcgtggcgtgggcgtggtactggcaacttccgtgaaaggggacttggggtgtcttcgcggaggccacttggtgttaatacttggtcctcatcatttgctattgccaagtcattcaataaagcaaaggattttgtgtggagacatgatctctttgaggatagcatggtagcagctgggctttctgggatagaatctggaacaaagctttacatttcaaatttgcactatggagtgacaagtgaagatctacaggagcttttttcagaaatgggtcatttgaagcactgtgctgttcattatgacagttatagacacccaactggttcggctgaggtgatattcaccaggagaagtgaagctctcgcagcactgaagcgatataataatatgcgccttgatgggaaggccatgaagattgaagtaataggagcagaattgggtctatcagctgctgccgtaccccagattagtgttgttcctggtgcaagcagaagagggcagagagaagttgttatgatgcctggtggaagtgggtttggacaaggtgcatctggcccatctagttcgcttcctgggtggaagcgtggaggctttgttcgaagaggacaagggcgtgttagttttcctcaaagagggcgagggcaagtgcgcagccgtggccgtggccgtggccgcagtagctttgttcagagccgtggacgtggctatgtgcgcaggggtaatgcagagaaatcagccaaacaattggacaatgaacttgacaactacaactctggtgcgatgaatgtcgactaagttaatccatcgtgacatcattcaatccaacctggaagttggaactatgttgaagctaagcttgttttctgtcggtattctgtcaaatgtgcacacttctgtcatgctctagtggcatcagttgaagattagatattccattattcctactgcaatagtcttgtgatatcagaatttgctgtaattgaatgatgaattatgttttcaaccgttgaaaggtttgctgtcaaaatttc

SEQ ID NO: 2682 - DNA, 1702 bp, Sorghum bicolor
ccccacccacaccaaagccgtcctcgcctactcctcccctctcaattcgacgaggaggcgactcgtcgagtcgccggtcgtcgcaaccgccggccaaaaccaatctcggcgcttccttcccggaggaacccctccggaagtcagccgatcccggatcacccaacacaccgcacttggtttctcccgcaccggcgcgcaaaccctcatgcgactagggttgtagcgatctcgtctcgctaccgagcgggccggctgcggaacgggccacccacgccacgcactcctctgcttcgatagacttcacccgccgctgaaactgcgctttgcgctgtcgccactagaaagccctcgccagtcctttgcctcctcactccgtcagggtcgggcccgtcgcccgcagggttttgttcctaactttttagcctctatttttgtcttgaatggctacatctctggatgttccactggatgatttgattaagagcagaaatgggaggggaaggggaaggggcaggggacaaggaggccgaggcagaggtgatggccaaagattggctcgtggttcatggcgtgggcgtggtactggcaccttccgtggaaggggactaggggtgccttcgcgaaggccacttggtgttaatactcggtcctcatcatttgctattgccaagtcattcaataaagcaaaggattttgtgtggagacatgatctctttgaggatagcatggtggcagctgggctttctgggatagaatctggtacaaagctgtacatttcaaacttgcactatggagtgacaagggaagatatacaggagcttttttcagaaatgggtcatttgaagcactgtgctgttcattacgacagttacagacacccaactggttcggctgaggtgatattcaccaggagaagtgaagctcttgcagcactgaagagatataataatgtgcgccttgatgggaaggcaatgaagattgaagtaataggagctgatttgggtctatcatctgctgccgcaccccgaattagtgttgttcctggtgcaagcggaagagggcagagagaagttgttatgatgcctggtggaagtgggtttggactaggtgcatctggcccatctagttcgcttcctgggtggaagcgtggaggttttgttcaaagaggaggacaagggcgtggtggttttgctcaaagagggcgagggcaagtgcgtggccgcggacgcggccgtggccgtagtagctttggtcaggtccgtggacgtggctatgtgcgcaagggtaatgtggagaaatcagccgaacaattggacaaggaccttgacaactaccaccactctggtgcaatgaatgtcgactaaggtagcgaatccatcatccagtccaacctggaagttggaactatgttgaagctaagcttgttttctgtctgttggttttctgtcaaatgagcaaacttctgttctgctctcgttgcatcagttagattagattcgtactgcaatttcttgtttggagttagtcctgtgatcagaatttgctgttaaactgattgatgaattatgttttcaaccgttgaatggttttctgttaaattgtaagaattttcaataggcagtacccaaaatgttcggtgatgccgtttcaaaaaaaatgttgggtgaggaccacaggttggaggttctatttatgcttggtt

SEQ ID NO: 2683 - DNA, 3046 bp, Zea mays
cttacctattcgccgtccctctctcctgctgccctccccccgccgccgccctacggcccaccccgccgacgcgccacctccgtatctctcttccccgcctacgcgggcggcggatctccggatccgcgcgggggagggagatctggattggatggtcctctccggccgcggctagtccggcctgatctgatccgacccgtcccggcggcgcagtccgggcaggttgtctgggaaatttcggactcgggcggtgttgatcccggggagaggtcgtgcctcgctcgatctccgcataaaagctgtgattttgtggcggcgcggctgcgagttaccgggattttcccagggtttccggcggccgatccgcgctagttacgctattctgttccgtcagggcggcctcgtgttgggggctcgtttatttgccgcgtcccggaggagggttttgtgttcttctgtcgttggctccatggccagcggctctgatgccccgaagcagtatggaataaccaagccgttgtcgttgctcggaccggtggaggccgacctccagaggacggaggagctagagaagttcttgctcgagtcgggtctctatgagagccctgacgaatctgctaggcgggaggaggtgctggggaagcttgaccagattgtaaaagactgggtaaaacaattgactagtcagagaggatacactgatcaaatggttgaagaggcaaatgctgtactcttcacctttggctcataccgtcttggggttcatggacctggagctgatattgataccctctgtgttggaccttcatatgtgaaccgtgaggaagatttttttattgtactgcatgggatattagcacaaacagaggatgtgaccgagctgcagcctgtacctgatgcacatgtccctgttatgaaattcaagttccatggaatatctattgaccttctttatgccagtgtctccctcttagtagtaccagctgacttggatatctcccaaggatcagtgctttatgatgttgatgaagctactgtccgtagtcttaatgggtgcagagtagcagaccaaatcattagacttgttccaaattttgagaattttcgcacggcattaagatgtttgaagtactgggcaaaaaggagaggtgtttactctaatgttactggctttcttggtggtgtcaactgggctttactggttgcgcgtgtctgccagctctatcccaatgctgtgccaagtatgctggtctcacggttttttagagtttttacacaatggcagtggccaaacccggttatgctttgttctatagaagaggaagaacttggtttccctgtttgggatccacgcaaaaatcctcgagatagatgtcatcatatgcctattataacccctgcgtacccatgcatgaattcaagctataatgtttccacaagcacactgagggttatgttggaacaattccagtttggtaatagaatttgccaggaaattgaaatgaataagaccagctggcctgctctgtttgagccttttcaattttttgaagcatacaagaattatctacaggttgacatcattgctgaggatgatgaagaccttaggctttggaaaggatgggttgaatctcgattgcggcaactaactttgaagattgaacgtgatacatatggaatgctacagtgtcatccttacccacatgaatatgcagacccttctaggcagtgtgctcattgtgctttcttcatgggcttgtcaaggaaagaaggtgtgaaaatacaggaaggacaacagttcgatattcgaggaacggtggatgagttcaggcatgaaatcaacatgtatatgttctggaagcctgggatggagttagctgtttctcatgttcgtaggaagcaggtcccagcttatgtgtttccagagggttataaaagacctcgcccttcaagacatgtgaaccatcagtctgataaaaatgacactgaagatggcacagcgaccaggtctccagacagtcaactgaagagaaagcatgattctgttggaactgatgatatcaggtatgcaaagaggtcatcgaccagcccagttcatccgaaaaattcacctcaatctggaagcactggcgatgagactagatgtaacaaccaaataaaaagggctcctagcgatgcaagtggtggcagtccggcttcacctcaggcatcagagagaagcccagatactattctgtctgcccctaggtgcacgacaacaggagcagtgtgttctggtgatgcaattagtaagcatagtagtgttcctcttgttgagaactgcaccactccgactgtagcagtgtgcacaactttgaagcgcgtagctgagaaagttgtttcagagctagttggaagtgaaaggctggggagcaacaacagtgcggaattgttggagagtatggaaaaggaggatgtccttgctgaaaatgttcgttttggcgggaatggagttgcgcaaggtggccttccagaagagttagagccaaacaataggattgaagcggtttcttgagctgatgcagggttagtggcatcaaccacacaagattggggaaaaaatggtgtagagatggataagttctacccccttgctggagggaatggtaagtagctcaactcacaagtttccttctggacacagattcgcaattacgggggtttctatgatgatggatgatgggagattatcggatatcatgtcttgcacaacggcatggcaaaaaaaaaacgacgaagaagattttgtggaaggccatggtcgaatgtcatgtcttgctggtacactctagatgagcatgaaccttaagttttcgtttttttttaacttgttgagcagctgactcttgtgtatgaactgagctgcagcgggcttccctgagttgacttgtttgggtctgagatgcttctgccatgttctaggtctagaatagaactagatgcggtggtgtgttctctaccctaagtccccttttgtgccctttccttctgtaatataagatctttg

SEQ ID NO: 2684 - DNA, 3295 bp, Hordeum vulgare subsp. vulgare
ggagtccgcgagacaagacagataacccaaccgccccccccctctctgtttctctctccactctgccctgccctacctattccccccccctccccatcgcctccgtcccctccctccgcccacgccggagccggtgcggctgcccgccgtaccgcctcctcccccccccctccggccggccggatccgtgtccgtgcccgatctcgagccgcgtcctcgtctcccgcccgccgatccagccggggtttcgatccgatccgggcggcgcgatcccgtcgggctccgtgggggcgattctgcggccgggggctcggattcagggggtggggggtttccccgggtgatgaaggtttccgcgtccttcttgtttggacccgtctatcgcacgacccccctgctcgtgtccgactagtactcgtgcttcctttgagggtcaatatagaggtggcggtcgtgggctctggtttcatccgaggcaggtcgtgctctgttccgtttcgtgcgaaaagcttcgattttggggcggctagcctcgaattttgtcaacccttttcagtgctccgaggcgccgatctgtgcgatttagcgtttcctgttccgttagattttgtcatgaaggcggcttgtccgggagtgaggattacttgcttgcatcatcttagattagaggtgctgccgttgtgtgataaatggcgacctctaataagccaatatcactggctgggccattggacgctgatgtccagaggacagcggagttgaacaagtttttggttgaagccggcctatatgaaagtgccgatgagtctgctaggcgggaggaggtgctgggggagcttgacaagattgtaaaagtttgggtgaaacagttaactagtcagagaggatatactgatcaaatggttgaagaggcaaatgctgtgcttttcacctttgggtcataccgtctaggggtccatggacctggggctgacatcgatactctatgtgttggaccttcatatgtgaatcgcgaggaagacttcttcattgtactgcatgacatattagcacaaacggaggaagtcagtcaattgcaacctgtacctgatgcacatgtacctgtgatgaaatttaagttccatgggatatcgattgaccttctatatgccagcgtttctcttcttgtagtaccatctgatttggatatctctcaggaagcagtgctttatgacattgatgaggcaactgttcgtagtcttactggctgcagagtggctgaccaaattcttaggcttgttcctaatattgagagctttcgaacaacactaaggtgtttaaagcactgggcgagaagaagaggtgtttattctaatgttactggttttcttggaggtgtgaattgggctttactggtcgcacgagtctgccagctctatcctaatgctgtgccaagtatgctggtctcgagatttttcagggtttttacgcagtggcgctggccaactccagtgatgctttgtgccattgaggaggaggaacttggctttcctgtgtgggatccccgcaaaaatcctcgtgacagaactcatcatatgcccattatcaccccagcatatccttgcatgaactccagctataatgtttcgacgagcacactgagggttatgatagaacaattccagtttggcaataaaatatgccaggaaattgagatgaataaggctagttggtctgccctttttgagcctttcaatttttttgaggcgtataaaaattatttgcaagttgacatcatcgctgaggatgatgaagatctcagactttggaagggatgggtggagtctcgattgaggcaactgactttaaagattgaacgggacacctatgggaaattgcaatgccatccatacccatatgagtatgcggatccttctagacagtgtgctcattgtgctttcttcatgggcttatcaaggaaagaaggtgtgaaaatacaagaaggtcagcagtttgatattcgtggaacagttgatgagttcaggcatgagatcaacatgtatatgttctggaaacctgggatggagttggcggtttctcatgtccgtaggaaagagattccagcttatgtttttccagaaggatacaagagacctcgtcctcaaaggcatgtgaaccatcagcaccagtctgataaaaatgaccctggaaatggatctccagacagccagctgaagagaaagcatgattctactgggattgatgatactgaaccttgccaatctgttaagagggcttcaatcagcccaggtcacccaaaaacttcgtcacctcggtcaggcaatgttagtgatgagcccataagcaacagccaacagaaggttacttctaatgcaagtggtgggagtcaggattcacctggcagtggaaatcaagatcaaacaaagtgctcaggttcatcacatgcatctgagaaaagcttggattcagtcgcatcaggctccaagtgtgtgaaaattgaagctgtttgttccggtgacgtgactagcaagcatgttgattgtatttcacctgtcaaggacagcattgctccaaccgtagcagtgagtacaactttaaagcgtgttgccgagaaggtcgttttggagcttgttggaagtgaaagcatgggcggtaataatgcagagttactgcagattgcagaaacggacatgggaaatgtacttgttgaaaatctgcactttggtgggaatggagttcctcagagcggccttcctgaagaattagaggtgtgaagtcagatggattccagaagttgtcattgagagttagtttgacatcaacagcatgaggttccagagccgggtggaatggagggtctggtgtccctttggtaagttgttcaactcacaaactttccttttcgacacagatctgcaaacactggggacttgaaggcagatggtaaaatcatgtctagcaatggcatggcaaaaacaacaaacaagcgaagtttctttcatggaaggtcataagatctttgccaactctagtctagatctgtggcaagttcatttatggaaccagctcgctccgcagcttaatttgttgattctgtctggagttgcggtgtagccctaatgtaagctccagcaggctccttgggatgacttgttgacttcgcaaggattcttctgtaggtctagattagagagagatatgtgatactatccttcgttgtttctcaaggcccctttgtaccttcccaacctttgtaatatataagattgcaagttggtttcttgtactttggcat

SEQ ID NO: 2685 - DNA, 3042 bp, Oryza sativa Japonica Group
ttattcggatccgtgtgcaccgagggatccctctcctgatcctacccggagtcgtagttcttctcgggattttatcatatttattatatattggaagtgttagaggggatcgtgtgctcggtcgatttcgtggagaggatttgagtgccttttttggagtttgagggggaactgcttttttttttttaattggggttgcaggcgccaatctgccctgcttagggttcctccagtgagattggttctgttgcggaatcgccgatctgcgcgcgctggttcgggttcctccagtgaggttggttctgttgcggaatcggttttcgtgctctcttgtgaggggcttccatggcggcctgtaacgccgccgcagcggctgccgtcgccgagcagccacagaagcagtatggaattacgaaaccgatatcgttggctgagccggcggaggttgacctgcagaagacagcggagttggagaagttcttggttgaagccggtctgtatgagagtccggaggagtcggctaggcgagaggaggtgctaggggagctcgataagattgtaaaagattgggtgaagcagttaaccagccagagaggttacactgatcagatggttgaagaagcaaatgctgtactcttcacgtttggatcataccgtttaggggttcatggccctggagctgacattgatactttatgtgttgggccttcatatgtgaatcgtgaggaggatttctttattgtactacatgacatattggcacaaacagaggaagttactgagttgcaacctgtacctgatgcacatgttcctgttatgaaatttaaattccatggaatatcaattgaccttctttatgcgagtgtctctctcttagtagtaccaccagacttggatatctcgcaaggatcagtactgtatgatgttgatgaagtaactgttcgcagtcttaatgggtgcagagtagctgaccagattcttaggcttgttccaaatgttgagaactttcgaacaacgctaaggtgtttgaagtattgggcgaaaaaaagaggagtttactctaatgttactggttttcttggcggtgtcaattgggctttacttgttgcacgtgtctgccagctctaccctaatgctgtgccaagtatgcttgtctcaagattctttagagtttttactcaatggcaatggccaaatcccgtgatgctttgtgctattgaggaggatgaacttggttttcctgtgtgggatccacgcaaatatcaccgtgacagatctcatcatatgcccataataacccctgcttacccgtgcatgaactccagctataatgtttcaacaagcacacttagggttatgatggagcaattccagtttggtaacaaaatttgccaggaaatcgatatcagtaaggctaattggtctgctctttttgagcctttccaattttttgaagcatataagaattatctccaggttgacatcatcgctgaagatggagaagatcttagactttggaagggatgggttgaatctcggttaagacaacttactttaaagattgaaagagacacatatggaatgttacaatgccatccttacccacatgagtatgctgacccttccagacaatgtgctcattgtgcttttttcatgggtttatcaaggaaagaaggtgcaaaaatacaggagggtcaacagtttgatattcgtggaacagtagatgaatttaggcatgatatcggcatgtatgggtactggagacctgggatggagttggctgtatctcatgttcggaggaagcagattccatcttatgtgtttccagagggctacaagagacctcgtccttcgaggcatataaatcatccccagcagtctaataaaaatgatgttgaagatggcacagcgaatagatccccagatgggcagcccaagcgaaagcatgatacagctggggtttatgatagtgaacctggtagatctgttaagagggcctcaattagcccctcaattagcccagttcaccagaaaacttcatcgcctccatcaggcaatattgctgatgcttccggtgcaagtggtggaagtccggtttcacttgccaatggcaatctagaacaagcaaattgcttgaattcaccactggcatctgaaaaaagtctggactctgttacatcaggctccaagtgtgtgggagtggaagcggtttgtcctagtgatgctactaaagagcatgataactgtggttccaatatgaagaactgcaccactacaactgtagctgtatctttgaaacgtgtggcagaaaaggttgtgtcagagctcgttggaagtgaaagcttgggaggcaacaaaagtggggagctattggagagagccgaggacatgggaagtgccctggttgaaaatgtgcatttcggtggaaatggagtcgttcaaactggtcttcccgaagagttagaggtgtgaactcggatgcgccacagaaggcatcattgagggttagtctgacatcaactgcatgaggttggaaaacggtgtaaaaaggacaaaaagatagagagcatctgctggaggagtctatggtaagttgctcgacttacaaagtttccttttcgacacagatctgcaagcaaggggggctgttaagggaagatggcgataagatcatcatgtcaagcaatgataagggcagcaatcaggggagctttattacagggaagatcgtagaatcctgtgctgagaaccccctagatctacggcaagttttacagagctttgcttgtgctccataacgacatgtgtcgttttgtctttaaccgtggagcatctagcttctggcttcatcattgtatgggtgctgaattgaacttgtgtatggcatctctgggtcgacctgtttgcttctcagagatgcccttgcctctgctgtaggtctagattatagagatagctgctgtgctgctcatctttgtttctcaatgctcctgtgtactcggatcttcccttgtaatataagatatttgcagactggtcctt

SEQ ID NO: 2686 - DNA, 3041 bp, Oryza sativa Indica Group
ttattcggatccgtgtgcaccgagggatccctctcctgatcctacccggagtcgtagttcttctcgggattttatcatatttattatatattggaagtgttagaggggatcgtgtgctcggtcgatttcgtggagaggatttgagtgccttttttggagtttgagggggaactgctttttttttttaattggggttgcaggcgccaatctgccctgcttagggttcctccagtgagattggttctgttgcggaatcgccgatctgcgcgcgctggttcgggttcctccagtgaggttggttctgttgcggaatcggttttcgtgctctcttgtgaggggcttccatggcggcctgtaacgccgccgcagcggctgccgtcgccgagcagccacagaagcagtttggaattacgaaaccgatatcgttggctgagccggcggaggttgacctgcagaagacagcggagttggagaagttcttggttgaagccggtctgtatgagagtccggaggagtcggctaggcgagaggaggtgctaggggagctcgataagattgtaaaagattgggtgaagcagttaaccagccagagaggttacactgatcagatggttgaagaagcaaatgctgtactcttcacgtttggatcataccgtttaggggttcatggccctggagctgacattgatactttatgtgttgggccttcatatgtgaatcgtgaggaggatttctttattgtactacatgacatattggcacaaacagaggaagttactgagttgcaacctgtacctgatgcacatgttcctgttatgaaatttaaattccatggaatatcaattgaccttctttatgcgagtgtctctctcttagtagtaccaccagacttggatatctcgcaaggatcagtactgtatgatgttgatgaagtaactgttcgcagtcttaatgggtgcagagtagctgaccagattcttaggcttgttccaaatgttgagaactttcgaacaacgctaaggtgtttgaagtattgggcgaaaaaaagaggagtttactctaatgttactggttttcttggcggtgtcaattgggctttacttgttgcacgtgtctgccagctctaccctaatgctgtgccaagtatgcttgtctcaagattctttagagtttttactcaatggcaatggccaaatcccgtgatgctttgtgctattgaggaggatgaacttggttttcctgtgtgggatccacgcaaatatcaccgtgacagatctcatcatatgcccataataacccctgcttacccgtgcatgaactccagctataatgtttcaacaagcacacttagggttatgatggagcaattccagtttggtaacaaaatttgccaggaaatcgatatcagtaaggctaattggtctgctctttttgagcctttccaattttttgaagcatataagaattatctccaggttgacatcatcgctgaagatggagaagatcttagactttggaagggatgggttgaatctcggttaagacaacttactttaaagattgaaagagacacatatggaatgttacaatgccatccttacccacatgagtatgctgacccttccagacaatgtgctcattgtgcttttttcatgggtttatcaaggaaagaaggtgcaaaaatacaggagggtcaacagtttgatattcgtggaacagtagatgaatttaggcatgatatcggcatgtatgggtactggagacctgggatggagttggctgtatctcatgttcggaggaagcagattccatcttatgtgtttccagagggctacaagagacctcgtccttcgaggcatataaatcatccccagcagtctaataaaaatgatgttgaagatggcacagcgaatagatccccagatgggcagcccaagcgaaagcatgatacagctggggtttatgatagtgaacctggtagatctgttaagagggcctcaattagcccctcaattagcccagttcaccagaaaacttcatcgcctccatcaggcaatattgctgatgcttccggtgcaagtggtggaagtccggtttcacttgccaatggcaatctagaacaagcaaattgcttgaattcaccactggcatctgaaaaaagtctggactctgttacatcaggctccaagtgtgtgggagtggaagcggtttgtcctagtgatgctactaaagagcatgataactgtggttccaatatgaagaactgcaccactacaactgtagctgtatctttgaaacgtgtggcagaaaaggttgtgtcagagctcgttggaagtgaaagcttgggaggcaacaaaagtggggagctattggagagagccgaggacatgggaagtgccctggttgaaaatgtgcatttcggtggaaatggagtcgttcaaactggtcttcccgaagagttagaggtgtgaactcggatgcgccacagaaggcatcattgagggttagtctgacatcaactgcatgaggttggaaaacggtgtaaaaaggacaaaaagatagagagcatctgctggaggagtctatggtaagttgctcgacttacaaagtttccttttcgacacagatctgcaagcaaggggggctgttaagggaagatggcgataagatcatcatgtcaagcaatgataagggcagcaatcaggggagctttattacagggaagatcgtagaatcctgtgctgagaaccccctagatctacggcaagttttacagagctttgcttgtgctccataacgacatgtgtcgttttgtctttaaccgtggagcatctagcttctggcttcatcattgtatgggtgctgaattgaacttgtgtatggcatctctgggtcgacctgtttgcttctcagagatgcccttgcctctgctgtaggtctagattatagagatagctgctgtgctgctcatctttgtttctcaatgctcctgtgtactcggatcttcccttgtaatataagatatttgcagactggtcctt

SEQ ID NO: 2687 - DNA, 2099 bp, Sorghum bicolor
tccgaattccgatccgccccgagccggccggccatggcgattagggctggccgctcggtcctccacctcctcaccctcgccttcctcctcatcctcgccgcctcgccctgcctccaagctcgagtggaccatcgcaaacatatatctgactggagtaggcaacccaactttgaattgcagaatatctcctcgagtcggaaggatggccctcatctcctgagcagatcagaggaaataacacacaggaaattaagagggagaattggtgtaaggaagaaaatggaagtaatgcagcaggatgatgaagcattagttaaacttgagaacgcaggtatcgaacgctcaaaagctgttgattctgctgtgctgggaaaatacagtatctggagacgcgaaaatgaaaatgagaaggcagattcaagggttcgtctgatgcgagatcaaatgatcatggccagaatatattctgttcttgccaaatcgagggacaagcttgatctctatcaggagctgcttgcaaggctcaaggaaagccagcgctcccttggggaagctactgctgatgccgaacttcccaagagcgcttcggatagaataaaagcaatgggacaagttttatcaaaagcaagggatctattgtatgattgcaaggaaattaccgagcgtttgagagcaatgcttcagtcagcagatgagcaggtccggagcttgaagaagcagagcacctttcttagccagctggcagctaagacaatcccaaatggcatccattgtctttccatgcgcttaacaattgattattaccttctgtctccagagaaaagaaagttccccaatagtgagaatttggaaaatcctgatctttaccactatgctcttttctcggacaatgttttggcagcatcagttgtggtcaactcaaccatcatgaatgcaaaggagcctgaaaaacatgtatttcatcttgttaccgacaaactgaactttggggccatgaacatgtggtttttgctgaatccacctggggatgcaacaatccatgtggaaaatgttgatgacttcaaatggttaaactcttcttactgccctgttctgaggcagcttgagtctgcagccatgagagaatactatttcaaggccggtccgaaaacactctctgctggctcttctaatctgaagtatcgaaacccaaaatatttgtccatgctcaaccatctaagattttacctcccccaagtttatcccaagctgaataaaatccttttcctggatgatgacatagttgtccagagggatctaactggactctgggaggttgaccttaatggaaatgtaaatggagcggtggaaacatgtggagagagttttcatcgatttgacaagtacctcaatttctcaaacccaaatatttctcagaattttgatcctaatgcatgtggttgggcttatggaatgaacatgtttgatctggaagaatggaagaataaagacattactgggatttaccacaaatggcagaacatgaacgagaacaggctgctctggaaactggggacattgcctccagggcttctaactttttacaagctgacacaccctctggacaaatcatggcatgtgcttggcttagggtacaatccaaccattgagcgctcagagatagacaatgctgcggtcatccactacaatggtaacatgaagccgtggctggaaatcgcaatgacaaagtatcggccttactggacaaagtacatcaattatgagcacccgtacattcatggatgcaagatcagccaatagaaaccagctaaagtattcttctgtgatgaacattgaagttagacgggactcaaaaggaagtcctctgttagtagtaactatcacatgttctttattcgtgctatattagatttgttagctatcatgtgtatgtagtttcatcacccatttgtggtgctttctcccctagcccgttgttggttcttgtctccttttgtcatgaaaagaacgatgagctctatgattctcgtcagctgataaatgtaatgaatttctgttggtgacaaattaatgatgtcattcaattcatggcagcattt

SEQ ID NO: 2688 - DNA, 2196 bp, Zea mays
caccgacattccgacaataaggtgtggattgaccttgtcagtcacagaagggcggagcagtgccagtgtactggccgccaccactcgccactcgtccccctccccccgaaagccggcacgagccctcccttcccttcctccaacctgttccgatccgccccgagccggctggccatggcgatcagggctggccgctcggccctccacctccacgctctcgctttcctcatcctcgccgcctccccctgcctccaagtccaagctctagtggaccatcgcaaacagatatctgactggggtaggcaacccaactttgaactgcagaatatgtcctcgagtcaaagggatggctctcatctcttgggcagatcaaaggaaataacacacaggaaactaagggggagaattggtgtaaggaacaaaatggaagtagtgcagcaggatgatgaagcattagttaaacttgagaacacaggtattgaacgctcaaaagctgttgattctgcagtgctgggaaaatatagcatctggagacgtgaaaatgaaaatgagaaggcagattcaagggttcgtctgatgcgagatcaaatgatcatggccagaatatattctgttcttgccaaatctaggggcaaacttgatctctatcaggagctgctagcaagactcaaggaaagccagcgctcccttggggaagctactgctgatgccgaacttccgaagagtgcttcagatagaatcaaagcaatgggccaagttttatcaaaagcaagggatctgttgtatgattgcaaggaaattacccagcgtttgagagcaatgcttcagtcagcagatgagcaggtccggagcttgaagaagcagagcaccttccttagccagcttgcagctaagacaatcccaaatggcatccattgtctttctatgcgcttaacaattgattattaccttctctctccagagaaaagaaagttccccaatagcgagaacttggaaaatcctgatctttaccattatgctcttttctcagataatgttttggcagcatcagttgtggtcaactcaaccatcatgaatgcgaaggagcctgaaaaacatgtgtttcaccttgttactgacaaactgaactttggggccatgaacatgtggtttttgctgaatccacctggggatgcaacaatgcatgtggaaaatgttgatgacttcaaatggttgaactcttcttactgccctgttctgaaacagctcgagtctgcagccatgaaagaatactatttcaaggctgatcgtccgaaaacactctctgctggctcttctaatctgaagtatcgaaacccaaaatatctgtctatgctcaaccatctaagattttacctcccccaagtctatcccaagctgaataaaattcttttcctggatgatgacatagttgtccagagggacctaactggactctgggaggtagatcttaatgggaatgtaaatggagcggtggaaacatgtggagagagttttcaccgatttgacaagtacctcaacttctcaaacccaaatattgctcagaattttgatcctaatgcatgtggttgggcttatggaatgaacatgtttgatctggaagaatggaagaagaaagacattactggaatctaccacaaatggcagaacatgaacgagaacaggctgctctggaaattggggacattgccgccagggcttctaactttttacaagctgacacaccctctggacaaatcatggcatgtgcttggtttagggtacaatccaaccgttgagcgctcagaaatagacaatgccgcagtcatccactacaatggtaacatgaagccatggctggaaatcgcaatgacaaagtatcggccttactggacaaagtacatcaattatgagcatccttacattcatggatgcaagttcagccaataggaactacctaaacattcttctgtgatgaacactgaagttagagggcactcaaaatatagtcctctcttagtagtataactatcacatgttctttcttcgttttatattaagcttatcatgtgtatgtagtagtttcatcgcctttagtccgttgtcggttcttgtctttttttttgtcatgaaaaggacgatgagttcaaagattctcatcagctgataaatgcaatatatgaatttctgttggtagcc

SEQ ID NO: 2689 - DNA, 2138 bp, Zea mays
ggaccctcctcttcctcgccagcaagccggcacgatccctcccttccgggaaaaaggctcccaatctgttccgagccagccggccatggcgattagggctggccgctcgccccttctccacctcctcgccctcgccttcctcatcctcgccgcctctccctgcctccaagctcgagtggaccatcgcaaacagatatctcactggactgggcaacccaactttgacctgcagaatgtctcatcgggtcgaaaggatggccctcatctcctgggtagatcaaaggaaataacacacatgaaattaaggagagttgctgtaaggaagaaaatggaagtagtgcagcaggatgatgaagcgttagttaaacttgagaatgcaggtatcgaacgttcaaaagctgttgactctgctgtgctgggaaaatacagcatctggagacgtgaaaatgaaaatgaaaaggcagattcaagggtccgtttgatgcgagatcaaatgatcatggccagaatatattctgttcttgccaaatcgagggacaagcttgatctctatcaggagctgcttgcaaggctcaaggaaagccagcgctcccttggggaagctactgctgatgctgaacttcccaagagtgcttcggatagaaccaaagcaatgggccaagttttatcaaaagcaagggatctattgtacgattgcaaggaaattacccagcgtttgagagcaatgcttcagtcagcagatgagcaggtccggagcttgaagaagcagagcaccttccttagccagctagcagctaagacaatcccaaatggcatccattgtctttccatgcgcttaacgattgattattatcttctctctccagagaaaagaaagttccccaatagtgagaacctggaaaatcctgatctttaccattatgctcttttctcggacaatgttttggcagcatcagttgtggtcaactcaaccatcatgaatgctaaggagcctgaaaaacatgtatttcatcttgttactgacaaactgaactttggggccatgaacatgtggtttttgctgaatccacctggggatgcaacaatccatgtggaaaatgttgatgacttcaaatggttaaactcttcttactgccctgttctgaagcagcttgagtctgcagccatgaaagaatattatttcaaggctgatcgtccgaaaacactctctgctggttcttctaatctgaagtatcgaaacccaaaatatttgtccatgctcaatcatctaagattttacctcccacaagtctatcccaagctgaataaaattcttttcctggatgatgatatagttgtccagagggacctaactggactctgggaggttgatcttaatggaaatgtaaatggagccgtggaaacatgtggagagagttttcaccgatttgataagtacctaaatttctcaaacccaaatattgctcagaattttgatcctaatgcatgtggttgggcttatggaatgaacatgtttgatctggaagaatggaagaagaaagacattactggaatttaccacaaatggcagaacatgaacgagaacaggctgctctggaaactggggacattgccaccagggcttctaactttttacaagctgacacaccctctggacaaatcatggcatgtgcttggcttagggtacaatccaaccattgagcgctcagagatagacaatgctgctgtcatccactacaatggtaacatgaagccctggctggaaattgcaatgataaagtatcggccttactggacaaagtacatcaattatcagcattcctacattcatggatgcaagatcagccaatagaaaccaccctcagatattcttctgtgatgaacattgaagttggatgggactcaaaatgaaatcagtataactatcacatgttctttattcgtgttatattagatttgttagttatcacgtgtatgtagtttcgtcgcccttttgtggtgctttctcccctagctcattgttggttcttgtccctttttgtcatgaaaagaatgatgagctctatgattctcatcagctgataaatgtaatgtctgaatttctgtcggtggcaaattaatgatcccattcaaacggt

SEQ ID NO: 2690 - DNA, 2141 bp, Hordeum vulgare subsp. vulgare
tgggatatgatatgatccaccgccattagcaccggcgagggcagcgatcgatcttccgggcggcgactgctctcgcggatccggccggggaaatgccgcgcgcggtctccctggcggcgctctgcctcctcctcctcctcctccacctccacctccacctcgccgccgccgccggagctcgagtggacccaatttactctggcaagctggtaccggactggagcaggcaacccaagtttaaaccgcagaatttctccctgaatcgagaggatagcctagagcttctaagcaggccacgctatgtaactcgcaggaaattgggggagaggaccggtgtgataaagatggaaacggtgcagcaggatgatgaagccctagttaaacttgagaatgcaggtattgagcgttcaaaggcagttgattctgctgtgctgggaaaatatagtttatggagacgtgaaaatgaaaacgagaaggcggatgcaaatgttcgtctgatgcgggaccaaatgatcatggccagaatatactccgtgcttgctaaatccagggacaagctcgatctttatcgggagctacttgccaggatcaaggaaagccagcgctcccttggggaagctactgctgatgctgaacttcctaagagtgcttctgaaagagcaaaagcgatgggtcaagttttatcaaaagcaagggatcaattgtacgattgcaaggaaattacccatcgtttaagatcaatgcttcagtcagctgatgagcaggttcggagcttaaagaagcagagcaccttcctcagtcagttggcagctaagacaatcccaaatagcatacattgcttgtccatgcgcttaacaatagactattaccttctctctccagagaaaagaaagttccctaatagtgagaatttggaagatcctgatctttatcactatgctcttttttcggacaatgttctggcagcatcagttgtggtcaattcaaccatcgtgaacgcaaaggagcctgagaaacatgtcttccatcttgttactgacaaactgaactttggggcaatgaacatgtggttcttgttgaatcctcctggggatgccacaatccatgttgaaaatgtggatgacttcaaatggttaaactcttcgtactgccctgttttgaagcagctcgagtctgcggccatgaaagagtactactttaaggcggatcgtcaaaaaactctctccgccggttcctctaatctgaaataccgaaacccaaaatatctgtccatgctcaatcacttaagattttacctcccacaagtctatcctaagttgaataaaatccttttcctcgatgatgacattgtggtccaaaaggatttgactggactatgggaggttgatcttaatgggaatgtaaacggtgctgtagaaacatgtggggagagtttccaccgatttgacaagtacctcaatttttcaaacccaaatatttcacagaattttgatcctaatgcatgtggttgggcttatggaatgaatatgtttgatctggaagaatggaagaagaaggacattactgggatctaccataagtggcagaacatgaatgaaaacaggctgctgtggaaactggggacactcccgccaggtctcatgactttctacaagctgacgcaccccctggacaaatcatggcatgtgcttggattagggtacaacccaactgtcgagcacgcggagatcgacaccgccgccgtcatccactacaacggaaacatgaagccatggctggagattgcgatgacgaagtaccggccttactggacaaagtacattaactatgagcattcctatgtccggggctgcaagatcagtcaataggcggtagctagaagagaagcatttcttggttgagtcgcttcgacgggactacgaaagaaagtgttccctgttggtagtacagttatagcgcatgttcttcgttcgtgttattagatttgtttggttggtatcttttctgctgtatgtagcttcctcgcccgatttgttgtgctgcctcgactagtccagtgtggcacatgttaatgttattatcttgaaaagaatggtgaactcggtgacacatgtgaacaacttatagatgcaatgtttctg

SEQ ID NO: 2691 - DNA, 2404 bp, Hordeum vulgare subsp. vulgare
gacactccccgcaggcgagggcgagagaaggggggaaaggcagcgcgcgcacggcgacctcctcgccgccgccgcagcattccgaccggatcgggccagggcccctccccctccgcccacgcgtcgccggagatggcgtccccgaagcggctcccctactcctccgcgggcgctggcggcggcggcggagcgaggcgcggctccggcgcggtgccgccggtggtggtcctcgtcttcctcttcgtcgtcgcgccgtcgatcttcttcgtcgcgcgcagcggcggccacgtccacgtcgcgtccgatcccaggggtgctgatggcaaccaggaaacagattggcaagagcaactggcgacagacaatctgaaatctgttttgtctaaggaggtaattgatgctatagctgctagtcaacaagaaacaggcactctgaaccttgacttctttagggatcatccatctccttcctggaaaactgatgatctagttgatcacaagatgaatgctaatttggttgttgacgacaaggcaaaagctcaaaacagttccgcagaccatgttatacctctaacacataaagcacccaaggatggttcagatggacatcaagttgatacagcagcaaaaatggctcgaaggaaactacgggaggcgaggcgggaaaagagggcaattgatttggtacggaaagatgacgaagcacttgttaagctggagaatgcagctattgagcgatcaaaggctgtagattctgctgtccttgggaaatacagcatatggagaaaagagaatgagaatgagaactcagattcaacagtcaggttgatgagggaccaaattattatggcccgtgtttactctgtgcttgcaaaatcaaggaacaagcatggtatctatcaagaactgcagagccgaatcaaggaaagccagcgggctgtaggagaggctactgcagatgctgaccttcatcacagtgcacctgacaaaatcagagtgatgggtcaagttttaacgaaggccagagaagaattgtatgattgcaaggtgataagtcagagactaagagcaatgcttcagtcagcagatgaacaggtcaggagcttgaagaagcagagtacatttcttagccagttggctgcaaagacgattccaaacagcatccactgcttgtctatgcgcttaacaatagattactatctccttcctctggagaaacggaagttcccgaggagtgaaaacttggaaaatccagagctctaccactatgcacttttctcagacaatgtcttggctgcctctgttgttgtaaactcaaccatcatgaatgctaaggagcctgagaaacatgttttccatcttgtgaccgataagttgaactttggagccatgaacatgtggtttttgctgaacccacctggcaaggccactatccatgttgagaatgtggatgagtttaagtggttgaactcatcatactgtcctgttttacgtcaactggagtctgttgccatgaaagagtattatttcaaggctgaccgtcccgccactctttcagcaggttcttcaaacctaaaataccgcaaccccaagtacctctccatgctgaaccacttgagattttatctcccacagatctatccaaagttggataagatacttttcctcgatgatgacatagttgtgcagaaagatttgacaggattgtgggatgttgatctgaatggaatggtcaatggtgcagtgtttacctgtggagagagtttccaccgtttcgacaagtaccttaacttctcaaatccacacattgctcggaactttgatcctaatgcttgtggttgggcttatgggatgaacatctttgatctgaagcaatggaagaacaaagatattaccgggatctaccacaagtggcaaaacatgaatgaagacagggttctttggaagctcgggacacttccacctggcctcatgacgctctacaagctgacgcacccccttgataaatcgtggcatgtccttggactaggatacaacccaagcatcgaccgctcagagatagacaatgctgctgtcgctcattacaatgggaacatgaagccatggctggagctggcaatgaccaagtaccgaccatactggacaaggtatataaagtatgaccacccttacatccgtggatgcaacctgagtgagtagatgagatatgaagcgggccggagaaggtcacccgtctgaaacagaagtgtcccctttctccttaaggtatgtagattgagggaagtagtatcagctggagctatcaatcgcctgcgccctgaaaatttctgatggacgctctcatgaatgacgccgtaacagttcctttgttcaattgatgtgcagctaaatttgtttggccaac

SEQ ID NO: 2692 - DNA, 2480 bp, Oryza sativa Japonica Group
accacgccactcccctcctaccccactctcgtctcggagaaggcaacgtcgccctcgccgccgcggcggccggatccggcggatggcgaactcgaagcggctcccgtactccacggccggcggcggcgggggaggaggaggaggaggggggaggcgcggcggcgcctccggctccggcgtggtggcgccgctggtggtcctcgtgttcctcttcgtgctcgcgccgtcgatcttcttcgtcgcgcgcaatgggggccacgtccacgtcgcctcagatcccaaggatagggaaggtaatcaggaaacagattggcaaaaacaactggcaacaaacaacctgaaatctattttgtccaaggagatgatcgatgctttagcttctagtcaacaagaagcaggcactttgagtgttgattttttcagaaaacgtgcatctccctcttggaaaactgatgatctagtcaatgacctgagcaatgctagtttggatgttgatgacaaggttaaatctgaaaacagttctgcagaacatgagttatcactgacagataaaacacccaaggatgatactgctgaacatcaagtcgatgcacctgcaaaaaatgctcgaaggaaactaagggagaaaaggcgtgaaaagagggcaatggatttggtaaggaaagatgatgaagcacgtgttaagctggagaatgctgctattgaacgatcaaaggctgtagattctgctgtccttgggaaatacagcatttggagaaaagagaatgagaatgagaactcagattcaacagttagattgatgagagaccagattatcatggcacgtgtttattctgtgcttgctaaatcaaagaacaagaatgatctttatcaagagctgcaaaccaggatcaaggaaagccagagggctgttggagaggctactgctgattctgaccttcatcatagtgcacctgagaaagtcagagtaatgggtcaacttctatccaaggctagagaagatgtgtatgattgcaaggcggttactcagagacttagagctatgcttcagtcagcagatgaacaagtcaggagcttgaagaagcagagtacatttcttagccagttggctgcgaagacaattccaaacagcattcattgtttgtcgatgcgcttaacaatagattactatctcctcccgttggagaaaaggaagttcccgaggagcgagaacttggaaaatccagagctctaccactatgcacttttctcagacaatgtcttggcagcatctgttgttgtgaactcaaccataatgaatgctaaggagcctgagaagcatgttttccatcttgtgactgataagttgaactttggagccatgaacatgtggtttttgctgaacccacctgggaaggccaccatccatgttgagaacgtagatgaatttaagtggttgaactcatcgtactgtcctgttttacgacaacttgagtctgcagccatgaaagagtattatttcaaggctgaccgccccaccactctctctgcgggttcttcaaacctaaagtatcgtaaccccaagtacctctccatgctgaaccacttgagattttatctcccacaggtctatccaaagttggataagatacttttccttgatgatgacatagtcgtgcagaaagatttgacaggattatgggacgttgatcttaatgggaaggtcaatggtgcagtggagacctgtggggagagtttccatcgttttgacaagtaccttaacttttccaatccacatattgctcggaactttgatccaaatgcatgtggctgggcttatggaatgaacatctttgatctgaaggagtggaagaagaaagatatcactgggatctaccacaagtggcaaagcatgaatgaagaccgggttctttggaagcttgggacgcttccacctggcctcttaaccttctacaagttgacgcatccccttgacaagtcgtggcatgtccttggattaggatacaacccaagcattgatcgctcagagatagataatgctgctgttgttcattacaacggtaacatgaagccatggctggagttagcaatgaccaagtacagaccatattggacaaggtatataaagtatgatcacccttacatccgtggatgcaacttggcggagtagatatgatgtaaaaagctgacggagaagatcacccagcctgatcagaggtgcttctattaagtggagtaaatacacggccggtgtcagttgttctgaaaaaaataaaatgcgttaacggtagctttcaggcttgcctgccggcttaattttgatgaacctgtcactggaactttctctccagctgatcgatcgatcaccgcatgagttgatggatcgaatggatggttgagagataattttcggttttaattgcgtcattgctggaatctgcaactttgtctgcaaccgtgatgtggggcgtcttttttct

SEQ ID NO: 2693 - DNA, 2720 bp, Sorghum bicolor
ttcacacaccaatccccactccccaagggaagcgaagcgcacgcacactgccctccggcgacggcgaggccctcgccggcggaggatcggatcggatcggattgggtgggatccggatctaggtcagcactggcatcgccgttgcgccggtgatgccgactccgaagcagcggctcccctactccacctccggcgggggcggaggaggagggaggcgcgccgcctcgagctccgccgcgctgcctcccgtggtggtcctcgtgttcctcttcgtggtcgcgccttcgctcttcttcgtcgcgcgcaatggcggtcgcggccacgtccacgtagcctccgatcccaagggcaagaatgtcgatcaggaagcagcagcaatgaagaacctcaaatctattttgcctaaggaggtgtttgatgctataactgctagtcaacaagaatcaggcactttgagtcttgattttttcaggaatcatgcatctccctcttggaaaactgatgatctagtcaccgagaagagcatggatgttgatgacaaggctaaagctgaaaacagtttgccagaacatgatctaccaacaaatagatcacccaaagatccagacgaacatcaagttgataaagcagcaaaagtagctcgaaggaaacttagggagaaaaggcgtgagaagagaactatggatttggttcataaagatgatgaagcacgtgctaagctggagaatgccgctattgagcgatcaaaagctgtcgattctgctgtgcttggaaaatacagcatatggcgaaaagagaatgagaacgagaattcagactctacagttaggctgatgagggaccaagttattatggctcgtgtctattctgtgcttgctaaatcaaagaacaagaacgatctatatcaaaaactgcagacccgaatcaaggaaagccagcgggctgttggagaggcatctgctgatgctgacctgcatcacagcgcacctgagaaaatcagagcaatgggtcaagttttatcaaaggcgagagaagaactttatgattgtatggcaatcactcagagactaagggctatgcttcagtcagcagatgaacaggtcaggagcttgaagaagcagagtacatttcttagccagttggctgcaaagacaattccaaacagcattcactgcttgtctatgcgtctgacaattgattactatctcctcccccttgaggaatggaaattcccaaggagtgaaaatttagaaaacccaaatctctatcactatgcacttttctcagataatgtcttggcagcctctgttgttgtgaactcgaccatcatgaatgctaaggaaccagagaaacatgttttccatcttgtgactgacaagttaaactttggagccatgaacatgtggtttctgctgaacccacctggcaaggccaccatccatgttgagaatgtggacgaatttaagtggttgaactcatcatactgtcctgtgctgcggcaacttgagtctgctgccatgaaagagtactatttcaaagctgatcgtcccaccacactgtcagcaggttcttcgaacctaaagtatcggaaccccaagtacctctctatgctgaaccacttgaggttctatctcccagaggtctatccaaagttggataaaatactcttcctcgacgatgacatagttgtgcagaaagatttgacagggttgtgggatgttgatcttaatggaaaggtcaatggtgctgtggaaacctgtggggagagtttccaccgttttgacaagtatcttaatttttcaaatccacacattgctcggaactttgatccaaatgcatgtggctgggcttatgggatgaacatctttgatttgagggagtggaagaagaaagatattactgggatctaccacaaatggcaaaatctgaatgaagacagagctctttggaagcttgggacacttccgcctggcctcttgaccttctacaagttgacgcacccactggacaagtcatggcatgttcttggattaggatacaacccaagcatagaccgttcagagatagacagtgctgctgtggttcattacaatgggaacatgaagccatggttggagctagcaatgaccaagtaccgaccatattggaccaagtatatcaagtatgatcacccttacatccgtgggtgcaacttgagtgagtagatagtcgtgctgaaactgacagatgaggaagagcctgttggacagaagtgttccactaccatgtccttgcggtgcgttctttgatacagcaaagtggtactacctgaagctcttgattgctttcctcctcccctcccctcccctctcctcccctgaaaattcactggtggatgttctgacgagtttttttttatagcgatgtgtttttttattcaattattagtaatgtgtagttatattcttccgtcaaaattagcaggagaaaaacttctaaaatgtgcttatccggctggtgtcgcgtgctgcttagaggtatgtctagagaattgagtgttgccggaattggattgtcttttgtatcagatcagatgatataaagtaccaggagtacaatccaaagcgaaaggcatcaatcaagtggattacagggttaaccctgagtcctgaccaatgtaaaactattacaactacagtatcaagaaatgctggtatccttttgatgataactggtcttgt

SEQ ID NO: 2694 - DNA, 1927 bp, Sorghum bicolor
agtctttggtactccgttctgcttctgccgttcttcaatcgagagattacgatttctataatcaaaatccagacgcgaatcagagagagatagggggatttgggggaattagtagatacagtagaacagaagaggaggagcagcaggtcgaaggaagccccagctttcgccgatgattgcggcggcggcggagaagagccccgaaagggaggcggaggagtcgaacccgcgcgcggaggcgtttctggatatcatctgccgcgtcccggcgggggaggtggaggcggcgctgtccgcttgcggcatcggccccacggcggaggtcgcggaactggtgctcaagtcctgcgagtgctacaagcgccccaagtccgccgtccgcttcttccgctgggcggggctgtccctgtcgcacaccgcctacgcgtggaacctccttgtcgacatcctcggcaaggccgccatgttcgagcccatgtgggacgccatccgctccatgcaccaggagggcggtggccggctcgtctccgtcgccactttcgcctccgtcttcgcctcctactgcgccagtggcaacctcaaggatgccatcgcggccttggacgtcatggaccgctacggcctcaagcccgacgccgtcgcgctcaactcgctgctctcggcgatttgccgcgtcgagggccgcgcgcaggcagcgcacgacgtcttcgagcgcaccaaggccaccatcccgcccgacgccgacaccttcgcgatactgctcgaggcatgtgagaaggaggggaacgccatgcgcgccaagagcgtctttggcgagatggtcgtccgcgtcggctgggacgcggccaacgtgcccgcgtacgactccttcctctccactctcgtccgcggcggcctgttcgacgaggccttcaaattcctgcaggtgatgcggagcaagggctgcttgccggggatcaaattttttgctaccgctgtggatctggtcgtcctcaagcgtgactaccccaacgccgtagccatctggaacttgatggtctctgaagctggcctcgttcccaatttctcaatgtacaacgccatgattggcctctactgcaatgctggtgccatggactatgcccttgggatgcttgatgaaatgcccctcaacggtgtctttgcaaattctgtcacatacaataccatactggagggattcataaagcattgcaaggctcgtgaggctgaaagattcctaacagagatgagcaagaatgagcaactgcctactgcatccaattgcgctgctgctatcagcttgttctttaaggagtttaacccatctgcagcaattgacgtgtggcgctgtattgtggagcacaacattaccccagctgaggactctgccaaagagctaatagcagggctgcttgattttggcaggttaactgaggtggagaggcgtgccgatgagatgattgacatgagagttgagttgtcacggtctacaatggataatatgaagcgtgcttttgctaaggctcaaaggcaccagtcatatgaccgcattgctagaaggctgaagagacacacctgaatgctttaatcagctgaaacttttgaggctcacggggtagaagtttaacgcctggactgctgaattttctgattaccaaggtttttgactagcctggatcctgcaagcctggaactatactctgatcctacaagcagtggtcgggattttagtgtagctcttgtagattcctgaccccattttgtgctagttttcggctggttactgattctggtgtaataagggggctagtttagtcactatttatttttttcagaatatatggtatgaatatccaattgggctatgtaatatcagaaactcctggctctcagcgttaggcgcctatgctgatcctttgaccctatt

SEQ ID NO: 2695 - DNA, 1981 bp, Zea mays
agttccccaaattcccaacgccgccgcgacggcgctgctagctagtctttggtgttgtaggtgttcgattcctgattccaaattccagactccaaactcggttcttcaatcgacagattccgatttacatcccaaagctcttcggattgaaatccagccgcgacccaagagataagagtatttgggattagtagataggatagtagaatagaagaggaacactttcgctgatgattacggcggaggagaagagccccgaaagggaggaggaggaggaggcgaacccgcgcgcggaggcttttctggagatcatctgccgcgtcccggcgggggaggtggaggcggcgctgtccgcttgcggcatcggccccacggccgaggtcgaggaactggtgctcaagtcccgcgaatgctacaagcgccctaagtccgccgtccgcttcttccgctgggcggggcagtccgtgtcgcacaccgcctacgcatggaacctccttgtcgacatcctcggcaaggccgccatgttcgagcccatgtgggacgccatccgctccatgaagcaggagggcggcggcgggctcgtctccgtcgccaccttcgcctccgtcttcgcctcctactgcgccgctggcaacatcaaagatgcaatcgcggccttagacgtcatggaccgctacggcctcaagcacgacgccgtcgcgctcaactcgctgctctcggcgatttgccgcgtcgagggtcgcgcgcaggatgcgcaggacgtcttcgagcgtaccaaggccaccatcccacccgacggcgacacgttcgcgatactgctcgaggcatgggagaaggaggggaacgcggtgcgcgccaagagcgtctttggcgagatggtcgtccgcatcggctgggacgcagccaacgtatccgcgtacgactccttcctctccactctcgttcggggcggcctgttggacgaggccttcaaatttctgcaggtgatgcggagcaagggctgcttgccggggatcaattttttttctacagctgtggatctggtcgtccgcaagggtgactacctcaacgccgtagccatctggcacatgatggtctctgaagccggcctcgttcccaatttctcaatgtacagcgccatgattggtctccactgcaatgctggtagcatagacgatgctcttgggttgcttgatgaaatgcccctcaacggcgtctttgcaaattctgtcacatacaacaccatactggaaggattcatcaagcatcgcaaggctcgtgaggctgaaagtttcctaacggagatgagcaagaatgagcaactgcctactgcatccaattgcgctgctgctatcagcttgttctttaaggagtttaacccatctgcagcaatcgacgtgtggcgctgtattgtggagcacaacattaccccagctgaggactctgccaaagagctaatagcagggctgcttgattttggcaggtttactgaggtgacgaagcgtgctgatgagatgattgacatgagagttgagttgtcacggtccacaatggagaatatgaagcgtgcttttgctaaggctggcaggcaccaatcatatgacaacattgcaagaaggctaaagcgatattagctgcacatgaatgctttaatcagctgaaactttgcggctcacggggtagacgtttaacgcctggactgcttaattgcatgacaaccaagaatttggactagcctggatcctggaatgtaagtctggaaatctggaactgtactctgatcccacaagcagtggtcgggatgttagtgtagctcttgtagattccggaccccatttgttagctggttactcatcgagtgtaataagtggctagtttagtgaggctgcacattatcgctgtttatttttcatatatattttatgaatatgaaattgggttatgtaagtatcagatattcctggcgaaaaaaaaaaaaaaa

SEQ ID NO: 2696 - DNA, 2001 bp, Zea mays
cgccgccgcgacggcgctgctagctagtctttggtgttgcaggtgttcgattcctgattccaaattccagactccaaactcggttcttcaatcgacagattccgatttacatcccaaagctcttcggattgaaatccagccgcgacccaagagataagagtatttgggattagtagatagggagggtagataggatagtagaatagaagaggagcactttcgctgatgattacggcggaggagaagagccccgaaagggaggaggaggaggaggaggcgaacccgcgcgcggaggcttttctggagatcatctgccgcgtcccggcgggggaggtggaggcggcgctgtccgcttgcggcatcggccccacggccgaggtcgaggaactggtgctcaagtcccgcgaatgctacaagcgccctaagtccgccgtccgcttcttccgctgggcggggcagtccgtgtcgcacaccgcctacgcatggaacctccttgtcgacatcctcggcaaggccgccatgttcgagcccatgtgggacgccatccgctccatgaagcaggagggcggcggcgggctcgtctccgtcgccaccttcgcctccgtcttcgcctcctactgcgccgctggcaacatcaaagatgcaatcgcggccttagacgtcatggaccgctacggcctcaagcacgacgccgtcgcgctcaactcgctgctctcggcgatttgccgcgtcgagggtcgcgcgcaggatgcgcaggacgtcttcgagcgtaccaaggcaaccatcccacccgacggcgacacgttcgcgatactgctcgaggcatgggagaaggaggggaacgcggtgcgcgccaagagcgtctttggcgagatggtcgtccgcatcggctgggacgcagccaacgtatccgcgtacgactccttcctctccactctcgttcggggcggcctgttggacgaggccttcaaatttctgcaggtgatgcggagcaagggctgcttgccggggatcaattttttttctacagctgtggatctggtcgtccgcaagggtgactacctcaacgccgtagccatctggcacatgatggtctctgaagccggcctcgttcccaatttctcaatgtacagcgccatgattggcctccactgcaatgctggtagcatagacgatgctcttgggttgcttgatgaaatgcccctcaacggcgtctttgcaaattctgtcacatacaacaccatactggaaggattcatcaagcatcgcaaggctcgtgaggctgaaagtttcctaacggagatgagcaagaatgagcaactgcctactgcatccaattgcgctgctgctatcagcttgttctttaaggagtttaacccatctgcagcaatcgacgtgtggcgctgtattgtggagcacaacattaccccagctgaggactctgccaaagagctaatagcagggctgcttgaatttggcaggtttactgaggtgacgaagcgtgctgatgagatgattgacatgagagttgagttgtcacggtccacaatggagaatatgaagcgtggttttgctaaggctggcaggcaccaatcatatgacaacattgcaagaaggctaaagcgatattagctgcacatgaatgctttaatcagctgaaactttgcggctcacggggtagaagtttaacgcctggactgctgaattgcatgacaaccaagaatttggactagcctggatcctggaatgtaagtctggaagtctggaactgtactctgatcccacaagcagtggtcgggatgttagtgtagctcttgtagattccggaccccatttgttagctggttactcatcgagtgtaataagtggctagtttagtgagactgcacattatcgctgtttatttttcagatatattttatgaatatgaaattgggttatgtaagtatcagatattcctggctgtcagcagcgtcaggcgcctctgctgatcctttgacc

SEQ ID NO: 2697 - DNA, 3066 bp, Oryza sativa Japonica Group
aatttcacttttcctaaatcctaatcccttcgcttgtcgccgatgagcgcggcgacggaggaggggcggccggacggcgaggaggattcgccgcgcgcggaggcgttcctggagatcctcggccgggtccagccgggggatgcggaagcggagctctcctcctgcggcatcggcccgacggcggaggtcgcggagcaggtgctcaggtcccgcgtctgctactcccgccccaaatccgccgtccgcttcttcgtctggtcgggccggtcggtgaagcacaccggctacgcctggaacctcctcgtcgacatcctcggcaaggccgacatggaggagcccatgtgggacgccgtccgcaccatgaacaaggagggcggcggcctcgtcaccgtcgccaccttcgcctccatcttctcctcctactgcgccagcggcaacctcaggaaggccgtcgaggccttcgacgtcatggggaagtacggcgtggagccggacgccgtcgccctcaactccctcctctccgccatgtgccgcggggagggccgcgcgcaggcggcgcaggacctgttcgagcgcaccaaggccaccgtcgcgcccgacgcggacaccttcgggattctcctcgaggcgtgggagaaagaggggaacgcccagcgcgccaagagcaccttcggcgagatgattgtccgcgtcggctgggacgccggcaacatgcccgcgtacgacgccttcctctccacgcttgtgcgcggggatcaattcggcgaggcgctcaagttccttcaggtgatgcggtccaagggctgcctcccggggctcaagttcttcgccagggcaatcgaccttgtcgtccgcaagcgcgactatgcgaactctttggccatttggcaaatgatgatctcggatgctggccttgtaccaaacctccccatgtacaatgccatgatcgacctctgttgcagtgttggtgataccgactacgccctccgcatgctcgacgaaatgcccttcaatggcgtctttgcagattttatcacgtacaatgccatacttgaagggctcatcaagcagcgcaaggctcgtgaggctgaggctttcctcgcagagatgagcaagaacgagcagctgccctccccaaccaattgtgctgctgctatcagcatgttctctaaggagtttaacccgtcagcagcaatcgatgtgtggcactgcattgtggagcaccagattactccggctgatgagtcagccagagaactaatagttgggttgcttgattttggcaggtttgctgaggtgaagaaatatactgatgaaatgcttgacatgggaattgagttacctcagtcaaccattgataatatgaagcgcacatttgataaggttggcaagcaccacacatatgaccatattgctagaaggccaaagcggtgttagctatacatcaccaatttaatcataataggtatgccttctttcatatgggtgtttttggctgtgtcagtgaatgccatgaattgcatgaattcatctatcatcttgaccttatgccattcactaataagtcctcatgacttgctagtaagctacttggagtgaatgtcatcagttgcgtgaattcaccaattatcttgaccttatgacattcactaattagtcctcatgacttgcaattaagctacttggaattggaggttttatcctggactactagtttggttccctatgttcttgcatgagccaattccttgttcctcttggctgtcttgctctccttgtcttgttaatattggagtaccttttcttggcacggtgcacaaggccactaaaaatgactattccactgactatttatgtgcgctacttttatgcattttgataactttccttgcccctttggaagacactggacatctatgattccatcttcctttacaataggattcatagtgatgttgtatggaaatgtagctgtttggtgctcttcaatggaggaagaactcctaactcatatcttgggtatctagcggacatgcacttctatcacaacaactcatatcttgggttatctagcggacatgcacttctcttacaacaactccttgtcgatgtctacactactcaccccactttaagatagatatcttgtggtggctgtcggggtttacagacttatgtgccctcgcactaaagttgatgcaacccataagtcctgattgcagatggacacattgcattgactatcgtctatcttccaggacctaactattacacattggctatatgtctaggctgtggtctcccctcatctaattattgagtgagtcccttgtcccaaattacaatggccttacagatgtgttttgtgcttaacctttttctctctgatcacttccatcattgtaggtgtcgtgggcttcttagtgtttaagccaagtaaaatgtgattcaatcttctttgctcaaatctttgattcctggtacaacatagtcgagataaaacataatgttgttcactttagcctgtttgggttttgcaaaactccatagatatgcagaagagaaatgctatcccactccatcatggcttgacacttcttagtctgaactctgtagaattttaaggattgccttctaattttggcatattatggactcgagttcaagatgtggtgtactgcgtgtcatcttttttcccttaccaagttacccctgctatatagcttctccaaatgcttttgatcactctttgagaaaggcatgttggaaaacagaaacatgtggtcagtactgatcacacattgcacaagatggtactgtttcttcttcgttgaacctagattatcttctttagtgtttctctggaacaacaaacctcttgaattgttaaagattcagtagcattgagtaaaactacaacaggttatgtctactgttaccactgtttgatgcacttccatcctatagaaatcaatagctaatgtttctattcatgacgtgtctaccagggaggatttacataattagagtcggggacttttttggggccttttgtgggttgactcc

SEQ ID NO: 2698 - DNA, 1981 bp, Zea mays; identical to SEQ ID NO: 2695

SEQ ID NO: 2699 - DNA, 2001 bp, Zea mays; identical to SEQ ID NO: 2696

SEQ ID NO: 2700 - DNA, 1927 bp, Sorghum bicolor; identical to SEQ ID NO: 2694

SEQ ID NO: 2701 - DNA, 3066 bp, Oryza sativa Japonica Group; identical to SEQ ID NO: 2697

SEQ ID NO: 2702 - DNA, 1420 bp, Sorghum bicolor
ccctctctatctccccctctctctttctttcccagctctctctctctccctctccacccggccgccaccatgtcaggcctgtacagccagggcttctcccctgcaagaaccctctccccccagattaggagcaaccccgacgctgacagccagtacttggccgagcttctcgcggagcatcagaagctggggcccttcatgcaggtgctgcccatatgcagccggttgctcaaccaagaaatcatgcgggtatcaagcatggttcatgaccatggatttagtgatcttgacaggcgccggtttagaagccctagtcctatgtcttcaccaattgttcggcctaatctacatggcaatggatttggtccttggaatgggatgcaccaagagagattgggccttcctcctcctggaacaagtatggattggcaaggagcaccaccaagtcctggctcttatattgtcaagaagatcgtacgcttggaagttcctgtcgactcttaccctaatttcaactttgtggggcgcattctaggcccaaggggtaattctctaaagcgagtcgaagcatcaactggctgccgtgtttttattagaggaaagggttccatcaaagacacagaaaaggaggagaagcttaaaggaaaacctggctatgaacatctgaatgagccactgcatatattgatcgaggctgagttaccagcaaatgtcattgatacaagactgagacaggcacaagaagttatggaagaattgctaaagccggtggaagagtcacaagatttctacaagaggcaacagctgagggaattggctatgctaaactcaactctgagagaagatagccctcatcctggaagtgtctcccctttcagtaacggtggcatgaaacgcgcgaaaccaagccagtagagaagcttttggctctctgctcttcagtcgttcatggtgcagcaccagcaaggtgcccttgaacttgcgctgtccgtgtcgtgggtgcttgtgtaagaaaaggtatgcatttgctgctggacaggtagtctggtgccaagtgtgtcgtctccttgagatgaggagaaatcgatggctgttgaactgtctcgatctttggtggatccagccatgctgttgtaacttgtaaggtgatgaacattcgttttattcgttattgactgttaaccctaagtagatcatgatgctgaggataggtggtttcaggggagactagttatgcctgatagtgtgagctggttcgtttaggtgtttaattagcttgtattattcacattacattgtggagttgcaacatcacagatgatgacgcactctgctctctatgatagtttgatgacaactttgaatgaaccatgtgaattcagaatgttagtacttagtgaatcgatggggtgtttatata

SEQ ID NO: 2703 - DNA, 1533 bp, Zea mays
ctctctgtgtcatcaccctcattccgacagttccgctagaaggaaaagaagaaaaaaaaactctctttctctctctttcccagccctctctctccctctccacccggccgccaccatgtcaggcctctacagccagggcttctcccctgcaagaaccctctccccccagattaggagcaaccccgacgctgacagccagtacttggccgagcttctcgcggagcatcagaagctggggcccttcatgcaggtgctgccgatatgcagccggctgctcaatcaagaaatcatgcgggtatcaagcatggttcatgaccatggatttagtgatcttgacaggcgccggtttagaagtcctagccctatgtcctcaccaattgtccggcctaatctacatggcaatggatttggtccttggaatgggatgcaccaagagagattgggctttcctcctcctggaacaagtatggactggcaaggagcaccaccaagccctggctcttatattgtcaagaagatcgttcgcttggaagttcccgtcgactcttaccctaatttcaactttgtggggcgcattctagggccaaggggtaattctctaaagcgagttgaagcatcaactggctgccgtgtttttattagagggaagggttccatcaaagacacagaaaaggaggagaagcttaaaggaaaacctggctatgaacatctgaatgagccactgcatatattgatcgaggctgaattaccagcgaatatcgttgacacaagactgagacaggcacaagaagtcatggaagaattgctaaagccagtggacgagtcacaagatttctacaagaggcaacagctgagggaactggctatgctgaactcaaccctgagagaagacagtcctcatcctggaagcgtatcccccttcagtaacggcagcatgaagcgcgcgaagccaagccagtagagggaagcttctggctctcctccaacccttgagtcgtccacggcgcggcaccgacaaggtggtgcccttggaactcgcgctgtccgtgtctgtctcgtgggtgcttgtgtaatagaaggtatgcatctgctgctagacaggatagtctgggtaccaggtgcgtcgtcgtctcaaggagacgagggatcggtggccgatgaactgcctttgatcttggtgggtggatccggccgtgctgttgttgtaactgcttgtaagggtgatggacattattcgttttattcgttgttggctgttaaccctgagtagattatggtgctgaggagatagtggtttcagtgggagactagttaaaccctgatagtagtgtgagctgttcgtttaggtgtttaattagcttgtactattctcgaatatttgtcgtccgctagttcattttttgaactaagccgcgacaaataaaaaagaactcagggatagtattattattcgcgttaaaaaaaaaaaaaaaaaaaaaaaaaaaaaaaaaaaaaaaaaaaaaaaaaaaaaaaaaargaaaaaaaaaaaaaaaa

SEQ ID NO: 2704 - DNA, 1377 bp, Zea mays
ctctctttccgagctctctcgctgtctctcacccagccgccaccatgtcaggcctctacaaccagggcttctcccctgcaagaaccctctccccccagattaggagcaaccccgacgctgatagccagtacttggccgagcttctcgccgagcaccagaagttggggccattcatgcaggtgctgccgatatgcagccggctgctcaaccaagaaatcatgcgggtgtcaagcatggttcatgaccatggatttagtgatcttgacagacgccggtttagaagtcctagccctatgtcttcaccgattgtccggcctaatctacatggaaatggttttggtccttggaatgggatgcaccaagagagattgggctttcctcctcctggaacaagtatggactggcaaggagcaccaccgagccctggctcttatattgtcaagaagatcatgcgcttggaagttcccgtcgactcttaccctaatttcaactttgtgggacgcattctagggccaaggggtaattctctaaagcgagttgaatcatcaactggctgccgtgtttttattagagggaagggttccgtcaaagatacagaaaaggaggacaaacttaaaggaaaacctgggtatgaacatctgaacgagccactgcatatattaatcgaggctgagttaccagcgaacattgttgatacaagactgagacaggcacaagaagtcatggaggaattgctaaagccagtggacgagtcacaagatttgtacaagaggcaacagctgagggagttggctatgctaaactctactctgagagaagacagtcctcaccctggaagtgtctcccctttcagcaacggcggcatgaagcgcgcaaaaccaagccagtagagaaaggtttcaggctctcctccaccctcctccactccagtcgttcttggtgcagcaccagcaaggtgtgcctgcccttgaacctgcgctgcttcgtgtcgtgggtgcttgtgtaagaaaaaaaaggtatatgcattttgctgctgctggacggacaggtggtcgagacgaggaggaaatcgctggtcgttgaactgtctccatcttcggtggatccggccattttgctgctgtaaggtgatgggcattcgttctattcgttactgactgttgaccagattatgatgccgtggtttcaggggagactagctatgcctatggccctgataattagtgtgagctggttcgtttaggtgtttaattagtttgtattattattattcgcgttacgttgtggagtagtagcaaacgtcacagctggtgatgcactccgctctgacagtttgatgaggacagctttgaataaaccatgtgaattcagaatgtt

SEQ ID NO: 2705 - DNA, 1368 bp, Oryza sativa Japonica Group
cctcctcctcctctcctcgctcgtggccgccaccatgtcaggcggcctctacaaccaccagggtttctccccggcaagaaccctctcgccccagattaggagcaaccccgaggccgatagccagtacttgagcgagctgctcgcggagcatcacaagctggggcctttcatgcaggtgctgccgatatgcagccggctgctcaaccaagaaatcatgcgggtatcaagcatggtcaacgaccatggattcaacgattttgacaggcgtcgttatagaagtccgagtcccatgtcttcgccaattatgagacccaacctacatggcaatggatttgggccttggaatggcatacaccaagagagattaggctttcctcctcctcctcctcctgggacaagtatggactggcaaggcgcaccgccaagtcatggctcttatattgtcaagaagattgtacgcatggaggttccagttgatgcttaccctaatttcaatttcgtgggacgtattctaggaccgaggggtaattctctaaagcgggttgaagcatcaactggttgtcgtgttttcattagagggaagggttctatcaaagatgctgataaggaggagaagctgaaaggaaaacctggctatgagcacctcaatgatccactgcatatcttgattgaagctgagttgccagccaatatcattgatacaagattgaggcaggcacaagaaataatggatgaactgctaaaaccagtggatgagtcgcaagattactataaaagacaacagctgagggaactggcaatgctgaactctactctgagagaggacagtcctcatccaggaagcgtctcccctttcagcaatggtggcatgaaacgtgcaaaaccgagccattagcaaatatggttcgacctcaccgctttcatcaaggtcaaggagctcctacacggctatgcccctaggcatgccgtcgagcttgagtggttcgttgtatgggctattgtgtaaaaaacagtatgccttttactggatgattagtctggtaccaaatggttctctcctctggatgaggagatcgatggttaaagctgcctcaaatcttttggccggtccagatgtgttgttgtaacttgtaaggttcacattcattttgttctttatcgactgttaaccctgctagcttgtgatgctaagataggtggttttcccttttttcaggagagattagagaagtcttggtaatgtaagatttcagtttagaagttgagttagattgcatcatatttgcctgaacatcatggagttgcaaaatgcagatcatgaccgtgttatgcaatagtttgatgggaaaaatctttgaattaaccatg

SEQ ID NO: 2706 - DNA, 1352 bp, Zea mays
atctcctccacttccttcctgggctctgggctacgtattatccatccgtstcagtcacctcgcctcctcctcctcctcccccagtccccctccctcatcctcgattgcgcccctcactcgccatgtcggggctctacagccaggggttctcccctgcgcgaaacctctcccctcagattagaagcaatccggacgctgatagtcagtacctggccgagctgctcgccgaacaccacaaactggggcccttcatgcaggtgctgcccgtatgcaacaagctgctgagccaagagattatgcgggtatcaagcattgtgcacaaccatggatttggcgatttcgacaggcatcggtttagaagtcctagtccaatgtcttctccaaaccctagagctaatctccctggcaatgggttcagtccttggagcggactacaagagagattaggttttcctcaaggaaccagcatggactggcaaggagcacccccaagtcctagctcccatgttgtaaagaagattcttcgtctggaggttccagttgattcttatccgaatttcaattttgtggggcgcattttaggacctagaggtaattctctaaagcgagtagaagcatccactgggtgtcgtgttttcattagaggaaagggttccatcaaagattcagggaaggaggacaaactacggggaaaaccgggctatgagcacctgagtgatccgctgcatatcttgatagaggccgagttccctgccagtatcatcgatgcaaggctgagacaagcacaggagattatagaagaattgcttaaaccagtggacgagtcccaagatctctacaaaaggcagcagctcagggagctggcaatgctgaactcaaccctgagagaggacagccctcatccggggagtgtctctccattcagcaacggtggcatgaagcgtgcgaaaacaggacagtagagaaaacaactatgctcccatatctggccccgtcgtcatgggaacgccatgggcatgcgtgaaggaaggccatgcgccttcgctggcggagtccggtatcttctgctagctttcacctccggacaggggaaagatgagatgagatgagatgagatagtcgcggacccttggttggatccggcgttggttgttgtatggtctagaacattcgttctatttgttattgacggttaaccctagtatgttggtgagctgcaacctgcaaactgcatggtaaactagctagagaggcctgctgagtatgtgagctttaggtcttttcttgacattgtattataacctttttaacattatggagttgcaaaaataaaaaaaaaaaaaaaaaaaaaa

SEQ ID NO: 2707 - DNA, 1243 bp, Sorghum bicolor
atgtcggggctctacggccaggggttctcccctgcgcgaaacctctcccctcagattagaagcaatccggatgttgatagtcagtacttggccgagctgctggccgaacaccagaagctggggcctttcatgcaggtgctgcccatatgcaacaagctgctgagccaagagattatgcgggtatcaagcattgtccacaaccatggatttggcgatttcgacaggcatcggtttagaagtcctagtccgatgtcttctccaaaccctagagctaatctccctggcaatgggtttagtccttggagtggactacaagagagattaggttttcctcaaggaactagcatggactggcaaggagcaccaccaagtcctagctcccatgttgtaaagaagattcttcgtctggaggttccagttgattcttatccgaatttcaattttgtgggacgcattttaggacctagaggtaattctctaaagcgcgtagaagcatccactgggtgtcgtgttttcattagaggaaagggttccatcaaagatccagggaaggaggacaaactacgagggaaaccaggctatgagcacctgagtgatccgctgcatatcttgatagaggctgagttccctgccagtatcatcgatgcaagattgagacatgcacaggagattatagaagaattgcttaaaccagtggatgagtctcaagatttctacaaaaggcaacagctcagggagctggcaatgctaaactcaaccctgagagaggacagccctcatcctgggagtgtctctccattcagtaatggtgggatgaaacgtgcgaagacaggccagtagaggaacaactatgctctcctacctggccctgtccacttgtgttatgctgtcgtcgtgggaaacgccatgcctttgggcaatgtttgccatgggcatgcgtgaaggaagcaatgtgccttcactagcggagtccggtatcagctagttttcacccttcagacagggggaactgctgggaagatgagatagtcgctgatcgttggttgggtccagcgtttggttgttgtatggtctagaacattcgttctatttgttattgacggttaaccctagtatgtggtggactggtggtatgctggttaactgcaaactgcatgataaactagagaggcctgagtatgtgagctttaggtgctttattgaccttgtattataacctttaacattatggagttgcaaaaat

SEQ ID NO: 2708 - DNA, 1517 bp, Oryza sativa Japonica Group
ttgagaaagagtagaggagagaaccaaaagggtttccagagcggcagcggctgcctgcttagctgctgctgatgctgcaggctgcaccaaagcagcgagcctttttttacctctcctactataccaccaccaccatctcctctcctcggcttcacttctcgcctctccttgttggcacgggcggcgattgagcccgcggcggcgccatgtcggggctgtacagcccggggttctcgccagcgaggaacctctccccccagattaggagcaacccgacggatgttgatagtcagtatctggccgagttgctcgccgagcatcagaagctggggccgttcatgcaggtgctgcccatatgcagcaagctgctgagccaagaaattatgcgggtatcaagcattgtccacaaccatggatttggtgattttgacaggcatcggtttagaagtcctagccctatgtcttcgccaaacccaagatctaatcgctctggaaatgggtttagtccttggaatgggctacaccaagagagattaggttttcctcaaggaaccagcatggattggcagggagcaccaccaagccctagttctcatgttgtaaaaaagattctgcgtttggatgtcccagttgattcttatccaaatttcaattttgtgggacgcattctaggtcctagaggtaactctctaaagcgggtggaagcatccactggctgtcgtgttttcattagagggaagggttccatcaaagatccagggaaggaggacaaactccgtggaaagccaggctacgaacatctgagtgacccactgcacattttgatagaagctgagttcccagccagtatcattgatgcaagattgagacatgcacaggaggttatagaagaactgctaaaaccagtggatgaatcacaggatttctacaaaaggcaacagctcagggagctggcaatgctaaactcaaccctgagggaggacagcccccatcctgggagtgtctctccattcagtaatggcggtatgaaacgcgcgaaaacgggccagtagagaagcaactctaccaccacccatttgaggtggtatccaggtgccttatgcccttaaaaaggatggcattggcacaccttcaggcattgtttgccatgggtgtgtgtgaaggaagcaatgcaatgcaccttcactagatggagtttggtatcagtcagattttcgccttcaggcaggggaaaacttcagggacaatgacaatagtcgcagatcgtccggtcgatccacctttggtttgttgtaaggtctcaagaacatttgttttatttgttattgactgttaaccctagtatgtggtgctatggtaggttatctccatgacaagctagagaaggcctgggatgtgagcctttttttttcttccatttaccccccatttaggtgtttaattcaccttgtattatatcctttcacatttatggagctgtgaaaaataaaagaaggatgaagggtcatcctctttct

SEQ ID NO: 2709 - DNA, 1379 bp, Zea mays
ttttaccactcttcctgctaccaccccacacggcgcacacaccaccatctctcgtcgcctcgcctccacttcctgggctacgtacccatctcaatcgcttcgactcctccgccgccgccgccatgtcggggctctacagccagggcttctcccctgcgcgaaacctctcccctcagattagaagcaacccggatgtcgatagccagtacttggcggagctgctcgctgaacaccagaagctggggccgttcatgcaggtgctgcccatatgcaacaagctgctgagccaagagattatgcgggtgtcaagcattgtccacaaccatggatttggcgatcatgacaggcatcggtttagaagtcctagtccgatgtcttctccgaaccctagagctaatctccctggcaatgggttcagtccttggagcggactacaagagagattaggttttcctcaacgaactagcatggactggcaaggagcaccaccaagtcctagcacccaagttgtgaagaagattcttcgtctggaggttccggttgattcttatccgaatttcaattttgtggggcgcattttaggacctagaggtaattctctaaagcgtgtagaagcatccactgggtgccgtgttttcattagaggaaatggttccatcaaagatccagggaaggaggacaaactacggggaaaaccaggctatgagcacctgagtgatcctctgcatatcttgatagaggccgagttccctgccagtatcatcgatgcaaggttgagacatgcgcaggagattatagaagaattgcttaaaccagtggacgagtcccatgatttctacaagaggcaacagctcagggagctggcgctgctgaactcaaccctgagagaggacagccctcaccctgggagcgtttctccattcagcaacggcggtatgaaacgcgcgaaaacaggccagtagagaaacacccgtgctctcctacctggccctgtccaggtgtgttacgcggtcgtcgtcacgaaagacgccatgcctgccttggggagggcaatgttttgccatgggcatgcgtgaaggaagcaatgcgccttcactggcggagtccgtcgtccggtgccagctaggtttcacctccatacaggggaagctgctgctgggaaagatgagatagatagtcgcggtcgcggatcgttggttggttgttgtatggtgttagaacattccttctatttgttattgacggtttgaccctagtatgtggtggtacactgcgaagttgctaaactagaggcctaagctttatttaggtggttcattgaccttgtatcataaccttttgacattatcgagttgcaaaataaggaccatcagctttgt

SEQ ID NO: 2710 - DNA, 1424 bp, Hordeum vulgare subsp. vulgare
ggccaccccacccacacaccaccgccaccacccccgcctcggcctcggctgcggcgccctgtgtttccgcctctccggaggggccgccgccgccatgtccgggctgtacggccagcaggggttctcgccgtcgaggaacctgtccccccagattagaagcaacccagatgtcgtcgatagccagtacttggccgagctgctcgccgagcacgagaagctggggcctttcatgcaggtgctgcccatatgcagcaggttgttggtccatgaaattatgcgggtatcaaactcttcccacaaccctggattcagtgatttcgatagacatcgattcagaagtcctagtccaatgtcttcaccaaatccaagatccaatctctctggcaatgggttcagtccttggaatggactacaccaagagagaataggcttccctcaagcaaacagtatggattggcaaggagcgccaccaagccctagctctcatgtcatgaagaagattctacgcttggaggtcccagttgattcttatccaagtttcaattttgtgggacgcattctgggacctagaggtaattccctaaagcgggtagaagcgtctactggttgtcgtgttttcatcagaggaaagggttccatcaaagatcccgggaaggaggacaagctacgaggaaaaccaggctatgagcatctgagtgaacaacttcatatcttgatagaggctgagttcccagccaatattattgatgccagattgagacatgcacaggaaattctagaggaactgctaaagccagtggatgagacacaggatatctacaagaggcaacagctcagggagctggccatgctaaactcaacactgcgagaggacagccctcatccggggagcgtctccccattcagcaacggcggcatgaagcgtgcgaaaacaggccagtagggaaggagccaccccccatcgttaccggtattgtccaggtgccttatgcccctcaatggggacgcatgtctccgggcaatgtttgccgcgggcgcacttgaaggaagcgacgcctgcatttcgctagacgagtctgtacgagtcacggtttctcctgcggacaaggagaaacctctgggacaatggaagtagtagtcctgggtccgtgggtcatagtcctgggtcggcgggtcggcccagctttggttgctgtaaggtctagaacattcgctttatttgttaattgactgttaaccctagtaatgtggtgctatgatggtaggttatctccatgacagacagactagagaggcccgagtatgtgagctttcatgttttccttttcacccccttttaggcgtcggaacctccttgtatattatccacccttctacattatggagtcgcggataataataaaaagggtataaggatcattatc

SEQ ID NO: 2711 - DNA, 1573 bp, Sorghum bicolor
aaagatctctcgctctcttctcccctagtcctcacccgtgtggccgtgtgccgtctccgcgagcaagttctctcttcatccatccatccgtccatccgtcccccgtctcgcttcctgcggcctgtgggtggcggttgtcgatcagcttaccctcccccggccggcgagctctccctgacatggtcggccggatggagcggcagaccgcgtcgtcgtcagcgtcatgctccccctccgccgccgccgccgcctcctcttcctcctcctcggtctgcggcggcaagaagcgccctgatatcctcaacatgatccggaatgcagcctgtcttaattcatcatctactgataccggcaagggaaggagtaaattgtcaaccaacaaagttgcacatggattccacctggtggaaggcaagtccggccatgacatggaagactaccatgtggcagagtacaagtatgtgaagaaccatgagcttggtctctttgccatttttgatggccatttaggagataaggtgccatgttacctgaaagctaacctttttagcaacataatgaaagagcctctcttctggtctagtcctcaagaagcaataaagaatgcatactgctctacaaacaaatttattctagaaaatgccaaacaacttggaccaggtggttcaacagcagttactgctattgtagttgatggtaaggacatgtggatagcaaatgtaggtgactctcgagctgttgtgtgtgaaaaaggcgctgctaatcagctcactgttgaccacgagcctcatacaactaatgaaagacagaggattgaaaagcacggtggttttgtaacgacatttcctggcgatgttcctcgggtgaatggccagcttgctgttgctagggcatttggtgaccaaagcctcaaggcccacttgagctctgaacctgacattagacatgtaccaataagctcaaatatagagttcgtcatccttgccagtgatggattgtggaaggtaatgaagaaccaagaagcagtcgatctcgtaaagtcgatcaaggatccccaggcagcagcgaagcgattgacaactgaagcattggcaaggaagagcaaggacgatatctcttgcattgtcatccgtttccgctgctgagttacccactctccacggcactgatctccgatcttcgcctcatgatagcgattgagacaatttgtgtctgtaatcatctgcctttgccgaattttttttcgctgatagaatctgctgtacctatcgtagttgtggacaagtctggaactaattaggacagtgaagacttgagagctggttggtgagtgtgtgcagtgtgcccattcgcctgtgcatatatacaccagcgtagactgtgcatccgttgactgggactttgcgggagtctgtcaggacctagtgcttgtgtgcttgtgatggtaatggacctaatggtggctaaggaacttgttgatatgtaatttggttaaatttagttttcatggctcgcatttcgtagggtagatgcatctgatttcaatgaaacatattagtagttcaggccatct

SEQ ID NO: 2712 - DNA, 1574 bp, Zea mays
aagcaaccggggccgagagagacgagatgaggcctgcctcttctccctccgtcacacgcgagacggagacgcgtctgaagctgaggcctgtataaaagcgctaaagatccctcgctctcttcccccccgtgcgctgtgtcccgtctctgcagcaagttctgtcttcgtccatccatccgtccccgtctcactgcctgtggcccgtgggtagcggttgtcgatcagcttacccacgccggcgtgttctccctgacatggtcggccggatggagcggcagaccgcgtcgtcgtcagcgtcatgctcccccgccgccgccgccaccacctcctcctcgtcctgcggcggcaagaagcggcctgatatcctcaacatgatccggaatgcatcctgtcttaattcgtcgtctgctgataccggcaagggaaggagtaaattgtcgaccaacaaagttacacatggattccacctggtggaaggcaagtccggccatgacatggaagactaccatgtggcagagtacaagtatgtgaagaatcatgagcttggtctctttgccatttttgatggccatttaggagataaggtgccaagttacttgaaagctaacctttttagcaacataatgaaagagcctctcttctggtctagccctcaagaagcaataaagaatgcatactgctctacaaacaagtatattctagaaaataccaaacaacttggaccaggtggttcgacagcagttactgctattgtagttgatggtaaggacatgtggatagcaaatgtaggcgactctagagctgttgtgtgtgaaagaggctctgctaagcagctcactgttgaccatgagccccatgaaactaatgaaagacagaggattgaaaagcacggtggctttgtgacgacatttcctggtgatgttcctcgggtgaatggtcagctcgctgttgctagggcatttggtgaccaaagcctcaaggcccacttgagctctgaacctgatattagtcatgtaccaataaactcaagtatagagtttgtcatacttgccagtgatggattgtggaaggtaatgaagaaccaggaagccgtcgatctcgtgaagtcaatcaaggatccacaggcagcagcgaaacgattgaccactgaagcgttggcaaggaagagcaaggatgatatctcttgcattgtcatccgtttccgctgctgagttaccctctctccacggcactgatatccagtcttcacctcatgatttagattgagacaatttgtctttgccgaattttctgatagaatatgctgtacctatcatagctgtcgacaggcctggaactaattagggtagtgaagacttgagagctggttggtgagtgtgtgcagggtgcctattcgcctgtgcatatgttgactctgcatccgttgatccggacttgggcgactgtcaggaccttagtgcttgtgtgcttgtgatggtaatggacctaatggctaatggtggtaagggaacttgttgataccaaatttggttaatttagttttttttcatggctcgccaaaaaaaaaaaaaaaa

SEQ ID NO: 2713 - DNA, 1584 bp, Oryza sativa Japonica Group
aacttcttttttctcttcttcttctcctccattccattccatttctcctcacgctaccgccacaggtgtccgcgccgcgagaggcctcgggctcggctggtggtggaagaatcggatcaggagaagcaaaccaagggatagaaattcctccccccagaagatctctcatccccgtgcgctgctgctgctgtgtcgtcgtcgtcgtcgggagtggggagcgagcgagcgagctggtctgtgtccgtggtgattggacaggacatggtcgggcggatggagcggcagtcggcgtcgtcgtcggcgtcatgctccccctcctcctccgccgccggcacctcctcctcgtcttcggcctgcgggggcaagaagcggcccgacatactcaacatgatccggagtgcaacatgccttaattcgtcatctaccgataccggcaaggggaggagtaagcagtcaagcaacaaagtgactcatggattccacttggtggaagggaaatctgggcatgacatggaggactaccatgtggcagagtacaagtatgacaagagccatgagcttggtctctttgccatttttgatggtcacttgggagacagtgttccaagttacttgaaagctaaccttttctgcaacatactgaaagagcctatcttctggactaaccctcaggaagcaattaagaatgcataccgctctacaaacaaatatattttggagaatgccaaacaacttggacctggtggttcaacagcagttactgctattgtcgttgatggaaaggatatgtgggtagcaaatgtaggtgattcaagagctgttgtgtgtgaaagaggtgctgctaatcagctcactgttgaccatgaacctcatacaactaatgaaaggcagaggattgagaagcagggtggctttgtaacaacatttcctggtgatgttccccgggtaaatggtcagcttgctgttgcgagggcctttggggaccaaagcctcaaggcgcacttgagttcagaacctgatgttaggcatgtaccaataaattcaagcatagagttcgtcatacttgccagcgatggactatggaaggtaatgaagaaccaggaagccgtcgatcttgtgaagtcgatcaaggacccccaggcagcagcgaagcgactgacgaccgaagcgcttgcgaggaagagcaaggacgacatctcctgcatcgtcatccgattccgctgctgaacacccgcttcgcaacattgtctctgcgtttctcttcgttccgattgaatttgtgtggtggtgctgaaaaaagatggtttacctatagtatgtagctgttgtgaacagaccctagagatgagatatgttagcaaggacaaaactggagatgttcaaacttgtgggttcagtagcgagtagtgagtgtgtgcagggtggtggtgggcggtggtgattcgtctgtgcatacatacaccagcataaactgttttatcaatcgaacggggcgtgcaggttgttgccgttgtgtacatacattgttgcttggttttggctgtgagttgtgaaatggtagtagtcccagtcatgtgtcatggc

SEQ ID NO: 2714 - DNA, 1401 bp, Oryza sativa Japonica Group
cctgatttgtgtatggtcttaaagagtgcaacatgccttaattcgtcatctaccgataccggcaaggggaggagtaagcagtcaagcaacaaagtgactcatggattccacttggtggaagggaaatctgggcatgacatggaggactaccatgtggcagagtacaagtatgacaagagccatgagcttggtctctttgccatttttgatggtcacttgggagacagtgttccaagttacttgaaagctaaccttttctgcaacatactgaaagaggtaagcattacttttttggttttttttatgtgcctgcaaaactacgaatatgtgttattgacgttcattccttccatttaccttacaaatgtatcttttgctcaccatttgccttttctgatgttgcagcctatcttctggactaaccctcaggaagcaattaagaatgcataccgctctacaaacaaatatattttggagaatgccaaacaacttggacctggtggttcaacagcagttactgctattgtcgttgatggaaaggatatgtgggtagcaaatgtaggtgattcaagagctgttgtgtgtgaaagaggtgctgctaatcagctcactgttgaccatgaacctcatacaactaatgaaaggcagaggattgagaagcagggtggctttgtaacaacatttcctggtatgatttttgttgttcagctgtctcatcactgttcttggtcagaaaataaaaaagttcatgttacttaataatttattgtatgacctgtttacaggtgatgttccccgggtaaatggtcagcttgctgttgcgagggcctttggggaccaaagcctcaaggcgcacttgagttcagaacctgatgttaggcatgtaccaataaattcaagcatagagttcgtcatacttgccagcgatggactatggaaggttggtactataattccttaaaactcttgcctacattaatcttgtctttttaatgctaagagtttataagcatctccattttcctttcgcttcttctgtccttgtatactgcttgtttttaccatgcttcctctcggagcaaaaatatctattgtttagttaggacctgtacatatcatggtttcttgtgcacttaccatgtggcaaaatgcatgatcctcgtgatctccatgattagtcatcaatctatatttgagtattccgcccttaacaaagtacatccacaaatcagttgctaaatcttatgatcttgctcaactcaggtaatgaagaaccaggaagccgtcgatcttgtgaagtcgatcaaggacccccaggcagcagcgaagcgactgacgaccgaagcgcttgcgaggaagagcaaggacgacatctcctgcatcgtcatccgattccgctgc

SEQ ID NO: 2715 - DNA, 888 bp, Ricinus communis
atgagtaagcactcagttgcaggtgcttctcgcacctctaaacccccgaccttcttccaaaagatcaagagttcatgcctgaactcatcatccccagacacaggaaaaggaagaagtaaatcatcaagtaaaaagatgtcacatggatttcagcttgtagaaggcaaatcaggacatgatatggaagactaccatgttgctgaatatcgaaaaatcaagaatcatgagcttggcttatttgctatctttgatggtcatcttggggatcgtgttcctagttatttgaaagacaatcttttccttaatatacttcaagagccccagttctgggatgaccctaaaactgccattaaaaatgcttacaaaaacactgataagtttatattagagaattctatgcaattgggacctgggggctccaccgccgttactgctattgttatcgatggcaaggacttatgggttgccaatatcggtgattctagagctgttgtttgtgagagaggctctgccaatcagcttactgttgaccatgagccgcacactgagcgtaagaggattgagaagcaaggtggctttgtcactacccttcctggagatgttcctagagttaatggtcaacttgctgttgcacgtgcttttggagatcaaagtcttaaagcacatttaagttcagaacctgatgtaagacatgtgcctatagactcaaccatggagtttgttatattagcaagtgatgggttgtggaaggtaatgcaaaatcaagaggcagttgatttggtgaaacccattaaggatccgcaagcggctgccaagcgcttgacaactgaggcattagcaagaaagagcaaggatgatatatcatgcattgtgatccgttttggatga

SEQ ID NO: 2716 - DNA, 2167 bp, Sorghum bicolor; identical to SEQ ID NO: 1732

SEQ ID NO: 2717 - DNA, 2192 bp, Zea mays; identical to SEQ ID NO: 1730

SEQ ID NO: 2718 - DNA, 2096 bp, Zea mays; identical to SEQ ID NO: 1735

SEQ ID NO: 2719 - DNA, 2006 bp, Zea mays; identical to SEQ ID NO: 1731

SEQ ID NO: 2720 - DNA, 2064 bp, Oryza sativa Japonica Group; identical to SEQ ID NO: 1737

SEQ ID NO: 2721 - DNA, 2078 bp, Hordeum vulgare subsp. vulgare; identical to SEQ ID NO: 1738

SEQ ID NO: 2722 - DNA, 2265 bp, Sorghum bicolor; identical to SEQ ID NO: 1724

SEQ ID NO: 2723 - DNA, 1874 bp, Oryza sativa Japonica Group; identical to SEQ ID NO: 1740

SEQ ID NO: 2724 - DNA, 1401 bp, Oryza sativa Japonica Group; identical to SEQ ID NO: 2714

SEQ ID NO: 2725 - DNA, 1584 bp, Oryza sativa Japonica Group; identical to SEQ ID NO: 2713

SEQ ID NO: 2726 - DNA, 1573 bp, Sorghum bicolor; identical to SEQ ID NO: 2711

SEQ ID NO: 2727 - DNA, 1574 bp, Zea mays; identical to SEQ ID NO: 2712

SEQ ID NO: 2728 - DNA, 1264 bp, Oryza sativa Japonica Group
atggaggactaccatgtggcagagtacaagtatgacaagagccatgagcttggtctctttgccatttttgatggtcacttgggagacagtgttccaagttacttgaaagctaaccttttctgcaacatactgaaagaggtaagcattacttttttggttttttttatgtgcctgcaaaactacgaatatgtgttattgacgttcattccttccatttaccttacaaatgtatcttttgctcaccatttgccttttctgatgttgcagcctatcttctggactaaccctcaggaagcaattaagaatgcataccgctctacaaacaaatatattttggagaatgccaaacaacttggacctggtggttcaacagcagttactgctattgtcgttgatggaaaggatatgtgggtagcaaatgtaggtgattcaagagctgttgtgtgtgaaagaggtgctgctaatcagctcactgttgaccatgaacctcatacaactaatgaaaggcagaggattgagaagcagggtggctttgtaacaacatttcctggtatgatttttgttgttcagctgtctcatcactgttcttggtcagaaaataaaaaagttcatgttacttaataatttattgtatgacctgtttacaggtgatgttccccgggtaaatggtcagcttgctgttgcgagggcctttggggaccaaagcctcaaggcgcacttgagttcagaacctgatgttaggcatgtaccaataaattcaagcatagagttcgtcatacttgccagcgatggactatggaaggttggtactataattccttaaaactcttgcctacattaatcttgtctttttaatgctaagagtttataagcatctccattttcctttcgcttcttctgtccttgtatactgcttgtttttaccatgcttcctctcggagcaaaaatatctattgtttagttaggacctgtacatatcatggtttcttgtgcacttaccatgtggcaaaatgcatgatcctcgtgatctccatgattagtcatcaatctatatttgagtattccgcccttaacaaagtacatccacaaatcagttgctaaatcttatgatcttgctcaactcaggtaatgaagaaccaggaagccgtcgatcttgtgaagtcgatcaaggacccccaggcagcagcgaagcgactgacgaccgaagcgcttgcgaggaagagcaaggacgacatctcctgcatcgtcatccgattccgctgct

SEQ ID NO: 2729 - DNA, 1372 bp, Vitis vinifera
agagttcatactgaggaaaatctgtatttcgtttattattttgaattttagggtggttgtccctgacagtttccatcttgggtgtgtatgtattttctctttttcttcgcttgatatctgaagtaagaagtctgaagaagaggagaaagcagagtttgttgtttatgtttgagatatggataagaagaccagtttccttaacaagatcaagaaggccacatgcctagactcatctactccagactctggaaaagggaaatgtaaatcatgtagtaacattgttgctcacggattccacttggtagaagggaaatcaggtcatgatatggaggactaccatgttgcagaatacagaaataagaagagccatgtacttggattatttgccatctttgatggccatcttggtaacagtgtgccaagttatttgaaagataaccttttcaataatatacttgaggagccgaacttctggaatgaccccaagattgcaataaaaaatgcatatcgtgccactgataaatatattctggagaactccatgaaattaggtcctggtggctcaacggcagtaactgcaatagttattgatggcaaagacttatgggtagcaaacattggtgactccagagctgtcgtctgtgaaaggggcgctgccaatcagctaactgttgaccatgagccagacagtgaacgaagaagaattgagaaacaaggtggctttgtgactaatcttgctggagatgtgcctcgagttaatggccaattggcagttgcacgtgcttttggggatcaaagccttaaagcacatttaagttcggagcctgatgtaagacatgtgcctatagactcaactatagagtttgttatattagcaagtgatggcttatggaaggttatgaaaaaccaggaggcagttgatatggtgaaatccattaaagatcctcaagtagcagccaaacgtctaacaacagaagcattggaaagaaagagcaaagatgatatatcgtgcatcgtgatccgtttcggatgattgctgggacggggagcaccaccaccaccaccattgaaaccaacaccatttttggctagctttgctgcttgtggaattctgagctgattggttgcttggggaaggtggaaattgaaatgttatttgggttgtgtaaagatttatatgtatgtagtaatagcttttcttgtagtgccgataagtgatacttggtagagatagcggtgtgttgcatagataatttcttaacttcaatggtctcaacatagataattcattctggatgtgcgtatacagttgtggacatacataatatatatatgaatgtatttgtttgagagtgattcagaaatttcaaaa

SEQ ID NO: 2730 - DNA, 888 bp, Ricinus communis; identical to SEQ ID NO: 2715

SEQ ID NO: 2731 - DNA, 1167 bp, Vitis vinifera
atgagagttaaggagtctttttactcatctactccagactctggaaaagggaaatgtaaatcatgtagtaacattgttgctcacggattccacttggtagaagggaaatcaggtcatgatatggaggactaccatgttgcagaatacagaaataagaagagccatgtacttggattatttgccatctttgatggccatcttggtaacagtgtgccaagttatttgaaagataaccttttcaataatatacttgaggagccgaacttctggaatgaccccaagattgcaataaaaaatgcatatcgtgccactgataaatatattctggagaactccatgaaattaggtcctggtggctcaacggcagtaactgcaatagttattgatggcaaagacttatgggtagcaaacattggtgactccagagctgtcgtctgtgaaaggggcgctgccaatcagctaactgttgaccatgagccagacagtgaacgaagaagaattgagaaacaaggtggctttgtgactaatcttgctggagatgtgcctcgagttaatggccaattggcagttgcacgtgcttttggggatcaaagccttaaagcacatttaagttcggagcctgatgtaagacatgtgcctatagactcaactatagagtttgttatattagcaagtgatggcttatggaaggttatgaaaaaccaggaggcagttgatatggtgaaatccattaaagatcctcaagtagcagccaaacgtctaacaacagaagcattggaaagaaagagcaaagatgatatatcgtgcatcgtgatccgtttcggatgattgctgggacggggagcaccaccaccaccaccattgaaaccaacaccatttttggctagctttgctgcttgtggaattctgagctgattggttgcttggggaaggtggaaattgaaatgttatttgggttgtgtaaagatttatatgtatgtagtaatagcttttcttgtagtgccgataagtgatacttggtagagatagcggtgtgttgcatagataatttcttaacttcaatggtctcaacatagataattcattctggatgtgcgtatacagttgtggacatacataatatatatatgaatgtatttgtttgagagtgattcagaaatttcaaaa

SEQ ID NO: 2732 - DNA, 1712 bp, Oryza sativa Japonica Group
cccttccctcccatcccccgattcgccaccgcgaatcccaccaccacccgcagatctccgcctcggcgccattgcccaccctccacgcccccgccagattcgcccagatccacagccgggtgcatccggcggcgtggctggggcgccctcgatcgggaagctttgatcttcgtaccctttttgcggtgggcgggcggcgggcggcggaggaggaggagatgggtgtcggcggggagaagttccagctggggacggtgggggcgctgagcctctccgtggtgtcatccgtctccattgtcatctgcaacaaggcgctcatgagctccctcggcttcaactttgccactaccttgacgagttggcatcttcttgtcacattttgctccctccatgtagcattatggatgaagttcttcgagcacaagcctttcgactcgagaactgtcatgggatttggagtgctcaatggcatctccattggcctcctcaacttgagtcttggttttaattctgttggattttaccagatgacaaagctggctatcatcccatgcactgttattttggagactcttttcttcaggaagaagttcagccggagtatccaactgtccctttcagtgctcctctttggtgtcggtgttgcaacagtgactgatctgcaactcaatgctgtgggatccgtattgtccttgctggcaattattacaacctgcatcgcgcaaattatgacaaacactatccagaagaagttcaaggtttcttcaacccaattattataccaatcttgcccctatcaatcactgaccctcttccttattggtccattccttgatggatttttgactaaccaaaatgtatttgcattcgactacacatcccaagttgtgtttttcattgtattatcgtgcttgatatctgtctcagtgaacttcagcactttccttgtgatcggaaagacttctcctgtcacttaccaagtcctgggccatcttaaaacatgcctagtactgacctttggttatgttttgcttcatgacccatttagctggagaaacatactcggcatcctaattgcagtagttggaatggtcttatactcatacttctgcacattggagggccagcaaaaaaacgccgaagtctccccacaacaggcgaaagaaggcgattcggctcctttgatctcagactctctgagcaaagttgagaatggaggtggagtggttgatgatgagcctctcaaggtaccgatgtggagctcaaagtactcaagggcgtgaaaataccttccttttagaaggcggcattatacaggattcaatttggtaggcggatagtagggttggaagccaacccagattgtaatgaacattccagttacatttttgggtttatttaacattactatctagtatctactagcagtaaaagggttcttgggaggattttaccttcaagatagcagatctgccttgaaacttagacaacagatattgtatgattgtatctggatatgctccacatctttctcactgtaacttcctatgggaacatagatccacagatagacttcattcttttgtaccaaagatccagagaactagagatctgcaaggttcaagtttgtgactgtaagtttatgtttactttggacccagtgatggagcttttgtatatttaggaccaagtgcaaagaggggttcttttcc

SEQ ID NO: 2733 - DNA, 1065 bp, Oryza sativa (japonica cultivar-group)
atgggtgtcggcggggagaagttccagctggggacggtgggggcgctgagcctctccgtggtgtcatccgtctccattgtcatctgcaacaaggcgctcatgagctccctcggcttcaactttgccactaccttgacgagttggcatcttcttgtcacattttgctccctccatgtagcattatggatgaagttcttcgagcacaagcctttcgactcgagaactgtcatgggatttggagtgctcaatggcatctccattggcctcctcaacttgagtcttggttttaattctgttggattttaccagatgacaaagctggctatcatcccatgcactgttattttggagactcttttcttcaggaagaagttcagccggagtatccaactgtccctttcagtgctcctctttggtgtcggtgttgcaacagtgactgatctgcaactcaatgctgtgggatccgtattgtcctcgctggcaattattacaacctgcatcgcgcaaattatgacaaacactatccagaagaagttcaaggtttcttcaacccaattattataccaatcttgcccctatcaatcactgaccctcttccttattggtccattccttgatggatttttgactaaccaaaatgtatttgcattcgactacacatcccaagttgtgtttttcattgtattatcgtgcttgatatctgtctcagtgaacttcagcactttccttgtgatcggaaagacttctcctgtcacttaccaagtcctgggccatcttaaaacatgcctagtactgatttttggttatgttttgcttcatgacccacttagctggagaaacatactcggcatcctaattgcagtagttggaatggtcttatactcatacttctgcacattggagggccagcaaaaaaacgccgaagtctccccacaacaggcgaaagaaggcgattcggctcctttgatctcagactctctgagcaaagttgagaatggaggtggagtggttgatgatgagcctctcaaggtaccgatgtggagctcaaagtactcaagggcgtga

SEQ ID NO: 2734 - DNA, 1577 bp, Zea mays
cccgttccttattcgccagaccggagggaggggtacgagcttcaccgctttcatcccgcccgcgctcctccccagatctcgtctccattaaagccgaccttgcccagattcgcgccctcctcgctcatatctgaaagcggctctgattttccaagccgaccgcaggagcggtgcaccgggccgcgtgattccggcggcttgatttggaatttgtgatctttcggggcattcgtcggtttgtctgtcggtgacggtggtgctgcgtttcgagggcagcgaagatgggtgtcggcggagagaagttccagctggggacggtgggggcgctgagcctatccgtggtctcctccgtctccattgtcatctgcaacaaggccctcatgagctccctcggctttaacttcgccactaccttgacaagctggcatctgctggttacattctgctcccttcatgtggcattatggatgaaattctttgagcataagccttttgattcaagaactgtcatgggatttggagtacttaatggaatctccattgggctcctcaacttgagtcttggcttcaactctgttgggttttaccagatgactaagctggcgatcatcccgtgcactgtcatcttagagacacttttcttcaggaagaagttcagtcggagtatccagatgtccctttctgtgctccttcttggtgttggtgttgcaactgtcactgatctgcaactcaatgctgtgggatccatactctccttgctggcaattatcacgacttgcattgctcaaattatgacaaacactatccagaagaagttcaaggtctcatcgacccaactgctctaccagtcttgcccttatcaatcactgaccctgtttctcattggccccttccttgatggctttttgactaaccaaaacgtctttgcttttaattatacatcacaagttgtgtttttcattgtgttgtcatgcctgatatcggtctcagtgaacttcagcacttttcttgtgattggaaagacgtctcctgttacttaccaagtcctgggccatcttaaaacatgccttgttcttacctttggttatgttttgcttcatgacccatttagctggagaaacatacttgggatcctaattgcagtagttggaatggtcttatattcatacttctgcacagtggagacccagcataagaacactgaagtctccccacagcaggtgaaagaaagtgaggcagcccctttgatctcagactctttgagcaaagttgaaaatgggggcggtgttgttgatgacgagcctttgaaggtacccatgtggagctcaaagtattcgcgggagtgaaattttctcccgctagacggtggcatcatacaggattcagtttagtaggcagatagtagggttggaagccaacccagagtgtaatgaacatttgagttacattttttggccttttttagcgtcacgatctactactggtaaaagggtctgtttcttgggaggatcttaccttcaagattgccagatatacattgaaactagacggcagatattgtatgattgtatctggac

SEQ ID NO: 2735 - DNA, 1772 bp, Sorghum bicolor
ctaatcagctttcctcaccgacggcgaccgaccgaccagccatataataaagaaccaccctcctccccgtccctgattcgcgagaccggagaggggcacgagcgccaccgccttgatcccgcccgctcctcccccagatctcctcgccattgccgccgcgctacccagattcgcgccccctcctcgcccagatccgaccgcgggctctgcttggtttcccaagccgacggaggagcggtgcacccggccgcgtgattccggcggctcgattggaaattcgtgatctttcggcgggggcattcctcgggttggtctgtcggtgccggtggtgtggtggtgctgctgctgcgtttcgagggccgcggagatgggtgtcggcggggagaagttccagctggggacggtgggggcgctgagcctctccgtggtgtcctccgtctccattgtcatctgcaacaaggctctcatgagctccctcggctttaacttcgccactaccttgacaagctggcatctgctggttacattctgctcccttcatgtagcattgtggatgaagttctttgagcataagcctttcgattcaagaactgtcatgggatttggagtacttaatggaatctccattggactcctcaacttgagtcttggcttcaactctgttgggttttaccagatgactaagctggcaatcatcccgtgcactgtcattttagagacacttttcttcaggaagaagttcagtcggagtatccagatgtccctttctgtgctccttctcggtgttggtgttgcaactgtcactgatctgcaactcaatgctgtcggatccatactgtccttgctggcaattatcacgacttgcattgctcaaattatgactaacaccatccagaagaagttcaaggtctcgtcaacccaactgctttaccagtcttgcccttaccaatcactgaccctgtttctcattggcccctttcttgatggctttttgactaaccaaaatgtctttgcttttaattatacatctcaagttgtgtttttcatcgtgttgtcgtgcttgatatcggtctcagtgaacttcagcacttttcttgtgatcggaaagacatctcctgttacttaccaagtcctgggccatcttaaaacctgccttgttcttacctttggttatgttttgcttcacgatccatttagctggagaaacatacttggaatcctaattgcagtagttggaatggtcttgtattcatacttctgcacagtggagacccagcaaaaaaacaccgaagtctccccacagcaggtgaaagaaagcgaggcagcccctttgatctcagattctttgagcaaagctgaaaacgggggcggtggtgttgatgacgagcctttgaaggtacccatgtggagctcaaagtattcacgggagtgaaaatttctacctcttgacgatggcatcatacaggattcaatttagtaggcagatagtagggttggaagccaacccagagtgtaatgaacacatttcagttacatttttgggcttctttagcgtcacaatctactagcggtaaaaggatctgtttcttgggaggatgttaccttcagggttctcagatataccttgaaactagacagcagatattgtatgattgtatctggatatgctccacatcctcttactgtaacttccaactgggacatggcatgcttatatccaaagatagacttcattctttttgtatcaaaaagatcaggacaagacatgtgcc

SEQ ID NO: 2736 - DNA, 1716 bp, Zea mays
cgaccgaccgaccagccatataataaagaagcgaagctaagcgagaccggaggggcacgagcgccaccgccttgatcccgcccgctcctccccagatctcctcgccattgccgccgccctgccaggattcgcgccctactcgcccagatccgaccgcggctctgattttccaactgacgcaggagcggtgggtctgaccgggcgcgacccgtcttctcatgggcgagacagcgtgatccctgcggctcgattgtaaattcgtgatctttcggggcattccttggtttgtctgtcggtgctggtggtgctgcgtttggagggccgcggagatgggcgtcggcggggagaagttccagctggggacggtgggggcgctgagcctctccgtggtgtcctctgtctccattgtcatctgcaacaaggcgctcatgagctccctcggctttaacttcgccactaccttgacgagctggcatctgctggttacattctgctcccttcatgtagcattatggatgaagttctttgagcataagccttttgattcaagaactgtcatgggatttggagtacttaacggaatctccattgggctcctcaacttgagtcttggcttcaactctgttgggttttaccagatgactaagctggcaatcatcccgtgcactgtcattttagagacacttttcttcaggaagaagttcagtcggagtatccagatgtccctttctgtgcttcttcttggtgttggtgttgcaactgtcactgatctgcaactcaatgctgtgggatccatactgtccttgctggcaattatcacgacttgcattgctcaaattatgacaaacactatccagaagaagttcaaggtctcatcaacccaactgctttaccagtcttgcccttaccaatcactgaccctgtttctcattggccccttccttgatggctttttgactaaccaaaatgtctttgcttttaattatacatctcaagttgtgtttttcatcgtcctgtcatgcttgatatctgtttcagtgaacttcagcactttccttgtgatcggaaagacatctcctgttacttaccaagtcctgggccatcttaaaacatgccttgttcttgcttttggttatgttttgcttcacgatccgtttagctggagaaacatacttggaatcctaattgctgtagttggaatggtcttgtattcatacttctgcacagtggagacccagcaaaaaaatgttgaagtctccccacaacaggtgaaagaaagcgaggcaggccctttgatcgcagactctatgagcaaagttgaaaacgggggtggtggtgttgatgacgagcctttgaaggtacccatgtggagctcaaagtactcgcgggagtgaaaaggtcacgatggcatggcaccatacaggattcaatttagtaggcagatagtagggttggaagccaacccagagtgtaatgaacatttcagttacatttttgggcttctttagtgtcgcagtctactagcagttaaaggatctgtttcttggaaggatcctaccttcagggctctcagacctaccttgaaactagacagcaggtattgtatgattgtatctcgatatgctccacatcctcttactgtaacttccaactggtacatggcgtgcctatatccaaagatagacctcattctttttgtatcaagaagatccggat

SEQ ID NO: 2737 - DNA, 1695 bp, Hordeum vulgare subsp. vulgare
ggctgattcgcaaggccaaagctagagggggaggagcgccaccgcgaatcccatccccatccccgcaccgccgccgatcccgcccgcccgcccctccgcagatccccccggcattgcccgctctccggccggattcgcccagatccaccgacgcggcgcgcggtgctcccggcggcgtggcccgggccgtctgatcgggaaggcttgatctttttgttgttgttggcgctgagggtggtggcagcggagatgggcgtcggaggggagaagttccagctggggacggtgggggcgctcggcctctccgtggtgtcctctgtatccattgtcatctgcaacaaggccctcatgagctccctcggcttcacctttgctaccaccttgacaagctggcatctcctggtcactttctgctcccttcatgtggcactatggatgaagtttttcgagcataaggcttttgattcaagaactgtcatgggattcggagtgctcaatggcatctccattgggctcctcaatctgagtcttggtttcaattctgttggcttttaccagatgacaaagctggccatcatcccctgcactgttattttggagactcttttcttcaggaagaagttcagccggactatccagatctccctttccgtgcttcttttgggtgtcggtgttgcaactgtgactgatttgcaactcaatgctgtgggatccatactgtccctgctggcaattatcacgacttgcatcgctcaaatcatgacaaacactattcagaagaaattcaaggtttcttcaacccagttgctataccagtcttgcccttatcagtcattgacgcttttccttatcggcccgttccttgatggattcctgactaaccaaaacgtcttcgctttcaattacacatccaatgttgtgtttttcatcgtcttgtcgtgtttgatatcggtctcagtaaacttcagcacctttcttgtgattggaaagacatctcctgttacttaccaagtcctgggccatcttaaaacatgcttagttttgaccttcggttatgttttacttcatgatccatttagctggagaaacatacttggcatcctaatcgccgtagttgggatggtactatattcatacttctgctcaatcgagacccaaccaaaaaatacagaagtctcctcacagcaggcaaaagaaggtgactcggcacctttgatctctgattctttgagcaaagttgaaaatggaggtgatgacgacgagcctttgaaggtaccgatgtggagctcaaagtactcgaaggcgtgaaaaattcgtctcttagacgtcggatggcattatacaggattcagtttagtaggcagatagtagggatggaagctaactttccaacccaagtaatgaagcaatggacatttcaattacaaagtaatggacatgttacaaattttgtgtttaattagcgtcactatctaaaagcagtaaaatgatctgattctttggaggggtttcccttccaaaatttcagatctaccatgaaactagacaacagatattgtacaattgtatctggatattgtccacatcctctcactgtaacttcatgttgggacattggtccgcagatagactccattctttttgtaccaactgtgcaagattttaaagtatttataggttcaagattgtaactgt

SEQ ID NO: 2738 - DNA, 1765 bp, Zea mays
accacactctcgtctccctcctccccgttccttattcgccagaccggaggraggggtacgagcttcaccgctttcatcccgcccgcgctcctccccagatctcgtctccattaaagccgaccttgcccagattcgcgccctcctcgctcatatctgaaagcggctctgattttccaatccgaccgcaggagcggtgcaccgggccgcgtgattccggcggcttgatttggaatttgtgatctttcggggcattcgtcggtttgtctgtcggtgccggtggtgctgcgttttcgagggcagcgaagatgggtgtcggcggagagaagttccagctggggacggtkggggcgctgagcctattccgtggtctcctccgtctccattgtcatctgcaacaaggccctcatgagctccctcggctttaacttcgccactaccttgacaagctggcatctgctggttacattctgctcccttcatgtggcattatggatgaaattctttgagcataagccttttgattcaagaactgtcatgggatttggagtacttaatggaatctccattgggctcctcaacttgagtcttggcttcaactctgttgggttttaccagatgactaagctggcgatcatcccgtgcactgtcatcttagagacacttttcttcaggaagaagttcagtcggagtatccagatgtccctttctgtgctccttcttggtgttggtgttgcaactgtcactgatctgcaactcaatgctgtgggatccatactctccttgctggcaattatcacgacttgcattgctcaaattatgacaaacactatccagaagaagttcaaggtctcatcgacccaactgctctaccagtcttgcccttatcaatcactgaccctgtttctcattggccccttccttgatggctttttgactaaccaaaacgtctttgcttttaattatacatcacaagttgtgtttttcattgtgttgtcatgcctgatatcggtctcagtgaacttcagcacttttcttgtgattggaaagacgtctcctgttacttaccaagtcctgggccatcttaaaacatgccttgttcttacctttggttatgttttgcttcatgacccatttagctggagaaacatacttgggatcctaattgcagtagttggaatggtcttatattcatacttctgcacagtggagacccagcataagaacactgaagtctccccacagcaggtgaaagaaagtgaggcagcccctttgatctcagactctttgagcaaagttgaaaatgggggcggtgttgttgatgacgagcctttgaaggtacccatgtggagctcaaagtattcgcgggagtgaaattttctcccgctagacggtggcatcatacaggattcagtttagtaggcagatagtagggttggaagccaacccagagtgtaatgaacatttgagttacattttttggccttttttagcgtcacgatctactactggtaaaagggtctgtttcttgggaggatcttaccttcaggattgccagatatacattgaaactagacggcagatattgtatgatttgtatctggacatgttccacatcgtctaactgtaacttccaactggtacatggcatgcctatatccaaagatagatttcatttttttttgtatcagaaagatccggacaagacttgtgcaaaatttgtagtactattggttcgagtttgttgctttcaaaaaaaaaaaaaaaa

SEQ ID NO: 2739 - DNA, 1692 bp, Oryza sativa Japonica Group
aggagaggcgaggaggcgaagcagcagcagctgaagcgagccgagccgatccctcctgcccctgctcgcctcccagatctccccgccattgccagttccccgccaagattcgcgcgcccttctcccagatccagcttcgcctattccgaattccgcgcaaggctctgtcggtggtctgattcggcgggttttggttggggaattttggtgttcctgctcggttttgtgcttgctgctggttgtggtggttcttgggagcggtggagatgggggtgacaggggagaagttccagctggggacggtgggggcgctcagcctctcggtggtgtcctcggtctccattgtcatctgcaacaaggccctcatgagctccctcggcttcaacttcgccactactttgacaagctggcatctcctcgttacattttgctctcttcacgtggcattatgtatgaagctctttgagcacaaaccttttgatgcaaggactgtcatgggatttggtgtgctcaatggcatttcaattggtcttctcaacttgagtctaggtttcaattctgttggtttctaccagatgacaaagctggcaattatcccctgcactgttatacttgagactcttttcttcaggaagaagtttagtcggaatatccagctctcccttagtgttctcctttttggtgttggagttgcaactgtgactgacctgcagcttaatgctgtgggatctgtcctgtctttgctcgcaatcattacaacctgcattgctcaaatcatgacaaacacaattcagaagaaattcaaggtatcttcaacacagctgctgtaccaatcatgcccataccaagcattgaccttgttcatcgtcggccctttccttgatgggtttttgactaaccaaaatgtctttgcttttgattacacatctcaagttgtgtttttcattgtgctgtcatgcttgatatcagtctcagtgaacttcagcacttttcttgtgatcgggaaaacctctcctgtaacttaccaagtgcttggccatctcaagacatgcttggttcttgcctttggttatgttttgcttcacgatccatttagctggagaaatatacttggaatcctcattgctgtgattgggatggtatcgtactcatacttctgcacaaaagaggctccaccaaaacccactgaagcctccccacaactcaaccaggtaaaagaaagcgaatcggaccccttgatctcggactctttgagcactgctgaaaatgggggcaacgcaggcgacgacgaggctctgaaggtacctatgtggagctccaagtactcaaaggcatgaagaaactgctctgatgatactagtgtatggttctatacagagttcagcttagtaggcagatagtactagggttggaaggaagccaaccctgagtgtaatgaacgatgtctgttccatttttggtcttttttttttctttttgcttaccatgtggtgctgtcagtaaatgaaatctcactttgaagaggaaattatttacctctacactccagatggcagattggccttaaagctagacacaaaagggctagatctctttgtaatatttttcatgtgttcaacttcagcatctgcttcagcattgtaacaacttgccagcaggacataatatcaacacgtagtttacattcttttt

SEQ ID NO: 2740 - DNA, 1681 bp, Zea mays
gccaagaacccagccgcgaagccaagcccatctgatccggcccctgctgccctgccccagctcgtctctcaggtcgccttgccgttgccggttccgcgcccgggcccggctcagagtcgcgagctcgtctcgcagatccggcttcgcttgcttgaattctgttctttgggagcaaagaggtgctggccggtggcgtggcttggtgctctggggccggcgagtttttttttttttttgcgtccgctcgctctgcctgtagtcttcttgctgcggcggcggggtggagatgggggtggcgggggagaagttccagctggggacggtgggggcactcagcctctcggtggtgtcctccgtctccatcgtcatctgcaacaaggctctcatgagctcccttggcttcaacttcgccactactttgacaagctggcatctcctggttacattctgttctctccatgtggcattatgtatgaagctgtttgagcacaaacctttcgatgcaaggactgtcatgggattcggagtgctcaatggcatatctattggacttcttaacttgagtctgggtttcaattctgttggtttctatcagatgacaaagctggccataattccctgtactgttatactggagacccttttcttccggaagaaatttagccggaatatcaagctttcccttagtgtgctccttcttggtgttggtgttgcaactgtaactgatctgcaactcaacgttatgggatctgtactgtccctactggcaatcatcacaacctgcatcgctcagatcatgacaaatacaatacagaagaagttcaaggtatcttcaacacagctcctgtaccagtcatgcccataccaggcattgacgttgttccttgtcggtccattcctcgatggatttttgaccaaccaaaatgtctttgctttcgactacacaactcaagttctgtttttcatcgtgctgtcgtgcctgatttcagtctcggtgaacttcagcacttttctcgtgatcgggaagacgtctcctgtaacctaccaagtccttggccatctgaaaacatgcttggtcctcacctttggctatgtcctgcttcacgacccgtttagctggagaaacatacttgggatcctaatcgcggtaatcgggatggttctgtactcgtacttctgcactagagagactcagcaaaaaccagcagaagcctccccgcaagccgttcaggcaaaggagggtgaatcgaacccgctgatctcggactccctgagcgctgccgaaaatggaggcagtgccaccgacgatgaacctctgaaggtaccaatgtggagctcgaagtactcgaaggcgtgaagtggctgttctggtattagtgcacacggtgctatacagaattcagcgtggtaggcagatactagggttggaaggcaaccctgttcctgttccatttttggccttctattttttcttcttcctggcacaaatactataaatatgtgctgtcagtaaatggatctcactcttgagaggaatacctcagctcgagaccgagtgttctgttctgcctgaaagctagtatttgtttgtgctccactccacgtgtaaagtggtagatggacatgatctcaacagtagtagtttgcattcttttgtactagtgatatacaatatttatgt

SEQ ID NO: 2741 - DNA, 1697 bp, Zea mays
cgcgcggcaacaataatatcctttcctttcttttgtataaaaaacacccgcctccgtctccatctccggtgagcaggaagagggggagggaggaggccaagagcgcagcggcgaagccatagccaagctcacccgatccagtccctgccgctcccagcgtgccacagccagtcccgcgctagctcagctcagctcagattcacgagctcgtctcccagatccagcttcgtctggttgaattctcttctttggaagtgctggtgggcggcgtggtttggtgctttgggggcctgcgtgttaagtttctgcgttctccgggctatctgcctgtcttgctgcggcctgcggcggcggggtggagatgggggtggccggggagaagttccagctggggacggtgggggcgctcagcctctcggtggtgtcctccgtctccatcgtcatctgcaacaaggctctcatgagctccctccgcttcaactttgccaccactttgacaagctggcatcttctggtcaccttctgctctctccatgtagcattatgtatgaaactctttgagcacaaacctttcgatgcaaggaccgtcatgggattcggagtgctcaatggcatatctattggacttctaaacttgagtttgggtttcaattctgttggtttctatcagatgacaaagctggctattattccctgtactgttatactggagacccttttcttcaggaagaaatttagtcggaacatcaagctttcccttagtgtgctccttcttggtgttggtgttgcaactataactgatctgcaactcaaccttgtgggatctgtattgtccctactggcaatcatcacaacctgcattgctcagatcatgacaaatacaatacagaagaagttcaaggtatcttcgacacagctcctgtaccaatcgtgcccataccaagcattgactttgttcctcgtcggcccattccttgatgggtttttgactaaccaaaacgtctttgctttcgactacacaactcaagtcctgttcttcatcgtgctgtcgtgcctgatctcggtctcggtaaacttcagcactttccttgtgatcgggaagacgtcgcctgtaacctaccaagttctcggccacctgaaaacgtgcttggtcctcgccttcggctacgtcctgctccacgacccgtttagctggagaaacatacttggaatcctgatcgcggtgatcgggatggtcctgtactcgtacttctgcactagagagactcagcagaagccggcagaggcctccccgcaagccatcctgcaggcaaaggagggtgaatcgaaccctctgatcttggattccctgagcgccgccgaaaacgggggcagtgccaccgacgacgagcctctgaaggtgccaatgtggagctcgaagtactccaaggcgtgaaaggctgttctgttactggtgtactacggtgttatacagaattcagcttggtaggcagatactactactagggttggaaggcaatcctgttcctgttcctgttccatttttggccttctattttttttcttgttttcatcctttctggcatatactacaaatatatgtgttgctgttagtaaatggatctcactctttggaggatgatacctcagctcgagacgagtgatctgtctgaaagctatttccttgtgttccatcc

SEQ ID NO: 2742 - DNA, 2528 bp, Sorghum bicolor
cttcgttctaccctcccccgtcttctccctccctcgaagcactgcacggccgccgccccgcgcaggtgtttccttctgctgcagcgcctttattgcactcacctgccctgccaacgtcttcaagctccagcagtggaaggcggcggcggagctagcatagcacaccaagcggcgacacgacgtgcccccagctgccacagaaatctacatataattggagccccaaccaccttgttcctcttcctctgcttcccccttccccagctagcgcctagtagcccccctacaccgtcgcgactgtgtaatcaatcaatccgctttcctagctcctactcgccggagaagagaaggacacgccaaggagccgcggacctgctagtgctacctgcctgctcccttcagttctcagagtaaaagttccctgcagattcctctgacctgctgcatgttgagtttgagttccacaaggctaccgtaacaagtgtggatatgaattggtgttgtcttcctagtagaagagccaagaaagaagagaatccttactccaacagcataggcggtatttattctgagaagaacataaggctcttctcctatgctgagttaagatctgccacagacaacttcaaccgcacgaacaaagtaggccgaggtggcttcgggacagtttataagggaaccattcgaaatgggcgggaggtcgcggtaaaagttctttctgctgaatccaggcagggcatcagagaattcttgacagaaattgatgtcattactaacgtgaagcatcccaaccttgttgaattaattggctgttgcgttgaaggaaataacaggattttggtatatgaatatcttaaaaacagcagtcttgaccgtgcacttttgggttctaacagtgagcctgctgacttcacctggagcataagatctgctatatgccttggagttgctcgaggccttgcttacctgcacgaagagatcgcatcaccgattgtacacagagacatcaaggctagcaatatactacttgacagaaattacgtccccaagatcggggattttggtctggccaagctatttcctgataatgtcacccacatcagcacccgagtggctggaacaacaggctaccttgcacctgaatatgcatggcatggtcagctaaccaagaaagcagatatatacagctttggtatccttgtcctggagatagtgagtggcacaagtagttccaggagcatattgatggatgacaaggttctcctggagaagacatgggagctatatgaagcaaagagccttaaggaactggtggatccaacccttgtagattaccctgaggaagaagtcatcaggtacatcaaggtggccctcttctgcttacaggcggccgccgctcgccggccgacgatgccccaggtcgtgaccatgctgtccaagcccatcaggatcaacgacagcgagctgacggcgccaggttacctccacgagagcagcaggaggagccccgggtccagggccaccgtttccagcaactacaggttcaagaactcggcgtccgaggattccaacatgttcagcacggttgtgccaccaacggtgactgagatgagccccaggtgaagcaacaccaggcagatgtaaatgtgattgagtaattccttgcttgtgaactggcgactatgtagagctaccgatctgacggtataagagagtgagtgcaatgtgtgtggtgttgtttcctcctgcaaatgcggcaactagatcttgtacatatagattagtgaattcatgccagagcaatgcaagattgctgcttattgcacagcttgagattattatcatattagtgctgtagcatatcatagagtattcagttctctcggtaacagtttcagatctgaacttgagatcacaggcatctcagtgaaagacacgcttggacaagaggaaaacagtaaagatacaactgctgtggtgatactaattatgaatgttctgcgctgatataaagacatcctgatgcagatctctacaaaagatcagtacgggacaaacgggtctggaaatcatcaagaaataaaacacgcttccatctactgacagtcaaggctcttgtgtttctgtagtgctaccctttccggtcactctgacgctgcaggctgctctttctcggcctcagaggggccattggcgggggtttcttggctctctgctggctgcttggcgccgtttgctggggctgccgcgccttctttggcgccatcctttgcgccttctttggcaccatcctttgcgccctctttagcagcaggtgctggtggaggttgcaacatatgtggcggtggagcatgcttcagcttcactaagatatggcgcatccgggagaggtcggtgggcttgccaggcttggggccctgaataactgtgatggatggcttcttgtccttgtctttctttccccgcttctcaatggtggctatttcatgtgggatgagatctgaaatcgatttccagtactgcttgtc

SEQ ID NO: 2743 - DNA, 1758 bp, Zea mays
acatcacactcgcttcaatattgacaccaccaacgcacgcacgacccttcttcctcctcccggcggcggctaggctaccgctattgatttctccttgcatcgcctttattgcgctcacctgctctgccaagtgccaacgtcgtacacttccagcagtggagggagccggagcacgagctgcccgctggacgagccgtcgccgccacagaaatctacatataattgcagccccaaccacctcgttcctcttccccttccccctccccagccaaatccgctttcctagctctaatcgccgccgatctcgccggaggaactgctagctcgctgctcccttcacttctcagattaaaagttgcctcaagaagaagatccctctgcgccgctgcatgttgagcgagcctaccgtagcgacgagcgcggatatgaattggtgttgtgttcctaaggccaagagagaagagaacccttactccaacagcatcggcggcatctactccgagaagaacataaggctcttctcctatgccgagttaagatctgctaccgacaacttcaaccgcaccaacaaagtgggacgaggcggattcgggacagtctataagggaaccatccgaagcgggcgagaggtcgcggtgaaggtcctctccgccgagtccaggcagggcatcagggagttcctgacggagatcgacgtcatcagcaacgtcaagcaccccaacctcgtcgaactcatcggctgctgcgtcgagggaagcaaccggattctggtgtatgagtacctcaagaacagcagccttgaccgtgcgctgctggcttctaacagtgagcctgccgacttcacctggagcgtcaggtctgctatatgcctcggagtcgctcggggccttgcgtacctgcacgaagagatcgcggcgccgatcgtgcacagagacatcaaggccagcaacatactgctcgacaggaactacgtccccaagatcggggatttcggtctggccaagctgtttcctgacaatgtcacccacatcagcacccgcgtcgcgggaacaacaggctaccttgcgcctgagtacgcctggcatggccagctcaccaagaaagcggacatctacagctttggtgtccttgtcctggagatagtgagcggcactagtagctccaggagcatactcatggatgacaagattctcctagagaaggcatgggagctgtacgaagcgaagaggctcaaggaactggtggatccagcccttgtagactgccctgaggaagaagccatcaggtacatcatggtggccctcttctgcctacaggcggccgccgcgcgccggccgacgatgccccaggtcgtcaccatgctgtccaagcccgtccggatcaacgagagcgagctgacggcgccggggtacctccaggagtacagcaggcggagccccttgtccaaggccaccacttccaccgactccaggttcaagaacctggcgtcccaggaggactccaacatgttcagcacggtggtgccacccacggtgaccgagatgagccccaggtgaagcaaccgccatgtaattttgactgattccttccttgcgttttgtcaaccggcgactatatgatgtagtgccaagtgtgttttcctcctgcaaatgcggcaactagatcttgtacatatagattagtgaatccatgccagacccagagcaatgcaagattgctgtttgttgcaaaaaaaaaaaaacaaaaaaaaaaaaaaaa

SEQ ID NO: 2744 - DNA, 1746 bp, Oryza sativa Japonica Group
ttccctcgtaccattttcgctgttggtctttattgcagcagctgctgctgttgctcgtgctgagctgagctgaacctgccaatctgcaacactgcaatcgttagcaagttcgctcaactggccagctgctacagatatatctgctgataattgagccccaaccacctttctcttccccctttaaacttccctggtctccgtcctcttcgatctcctctgccgtcgatctcatcggaagagagcgccaagcaagaaagaataattattcctgaagattcctcttctgcatgttgaagtgtacaagacagccacaacaactgaggatatgagctggtggtgttgcattccaaaatccaagaaaggagagaatccttactctcatggcgttagcggtattccgcctgagaaaaacataaggcttttctcttattctgagttgagatcagcaacagaaaacttcaaccgcagtaataaaattggccgaggtggctttgggacagtatacaagggaactattagaaatgggcgagatgttgcggtgaaagttctttctgctgaatccaggcagggcgttcgagaatttttgacagaaattgatgttattaccaatgtgaagcatcccaaccttgttgaattaattggctgttgtgttgaaggaaacaatcgaattttggtatacgagtatttagaaaacagcagccttgaccgtgcattgttgggttctaatagcgaacctgcaaattttacttggagcataagatctgctatatgcataggaatcgccaaaggacttgcatacctgcatgaagagattgcgtcaccgattgtgcacagagatatcaaggctagcaatatacttcttgacaagctttacaaccccaagatcggggacttcggtttagccaagttattccctgataatatcacccacatcagtacccgtgttgctggaacgacaggctaccttgcaccggaatatgcatggcatggccaattgacgaagagagccgatatatacagttttggcgtccttgtacttgagatcgtaagtggcaagagtagttcaaggagtctcctggctgacgataagattctcctagagaaggcatgggagctacatgaggtagggaagctcaaggagctggtggattcagaaatgggagattaccctgaagaggaggtcctccggtacatcaagacggccctcttctgcacgcaggcggcggcggcgcggcggccgtcgatgccgcaggtggtgacgatgctgtccaagcccatccgcatcaacgagcgcgagctcacggcgccgggctacatccacgactacaatggcacggtctccaaggccaccaactccagcaactcgaggttcaagcactcggcgtccgacacctccgacatgttcagcacggtggtgccacccacggtgtccgagatcagcccaaggtgaaaatggaaggaaaacatcaccaggctgattgatgctgatgctgggtctatgtttcttgtcttacctttgcatgttgagttgagtgacagtgcatagagggcacacgtttagatgtgtgccaattgtgaatcgtgttgtttctttccattccttgtgcaaattgcggcatctagatcttgtaaatagtagtaggttgatcctgacttgtttacgtcagagcaattcaagatcgctgcttgttggacattaattttgggggcaattgaacagaacagcttctgtagacatggcacagg

SEQ ID NO: 2745 - DNA, 2040 bp, Oryza sativa Indica Group
gtgtacaagacagccacaacaactgaggatatgagctggtggtgttgcattccaaaatccaagaaaggagagaatccttactctcatggcgttagcggtacgaactgtatttgcttgcaaaatttatgctgaatttgcatagcagccaacagagtttatgaaatagaaacatgtatattgtccctatcacagattcgatcatattaggctagagaatgccagtactgaagctccattttaagatttcatgctttacttaactaaatgtaactaactttcaggtattccgcctgagaaaaacataaggcttttctcttattctgagttgagatcagcaacagaaaatttcaaccgcagtaataaaattggccgaggtggctttgggacagtatacaaggtaatgtttgtttttctttatatgtggaagggaggagtccattgagggttatatccctttcaaatctgaagccatcagtccttgcattcttaccaatgctttgatgtttcagggaactattagaaacgggcgagatgttgcggtgaaagttctttctgctgaatccaggcagggcgttcgagaatttttgacagaaattgatgttattaccaatgtgaagcatcccaaccttgttgaattaattggctgttgtgttgaaggaaacaatcgaattttggtatacgagtatttagaaaacagcagccttgaccgtgcattgttgggtatgaatattgatatgttacaatgactatttttctatataagtgcattgatttcgtttgttgcttaaccttttatcttgtgttctgtaggttctaatagcgaacctgcaaattttacttggagcataagatctgctatatgcataggaatcgccaaaggacttgcatacctgcatgaagagattgcgtcaccgattgtgcacagagatatcaaggctagcaatatacttcttgacaagctttacaaccccaagatcggggacttcggtttagccaagttattccctgataatatcacccacatcagtacccgtgttgctggaacgacgtgagtatttcagcatttagcagtttgtttgagtagaaagtaaccttgcagttgcagtaactgaactgatctatttgttcaatgcagaggctaccttgcaccggaatatgcatggcatggccaattgacgaagagagccgatatatacagttttggcgtccttgtacttgagatcgtaagtggcaagagtagttcaaggagtctcctggctgacgataagattctcctagagaaggtcagtcttactatcatctttactatccaaaattctgagatttgctttcaccttcagacatttgctctagagacattccaattaagccgtaatcgctggactctccatctaaatcttttattagagaatggaagtataattccagcctctgcaccaattaaggccgtgttaattacgcagctatatttcccaactcatctctatcgttttccatgcgcatgtcttttaaactgttaaacgctatttttttttttgcaaaagagaagttgtttttaaaaagaacatattaatccatattttgaaaaaaaaagttagttaattatgtactaatgagtcgctccgttttacgtgcgtgtgggggatgagttaccaactcttgctgccaaactcagcctagctttcacaattaacaggcatgggagctacatgaggtagggaagctcaaggagctggtggattcagaaatgggagattaccctgaagaggaggtcctccggttcatcaagacggccctcttctgcacgcaggcggcggcggcgcggcggccgtcgatgccgcaggtggtgacgatgctgtccaagcccatccgcatcaacgagcgcgagctcacggcgccgggctacatccacgactacaatggcacggtctccaaggccaccaactccagcaactcgaggttcaagcactcggcgtccgacacctccgacatgttcagcacggtggtgccacccacggtgtccgagatcagcccaaggtg

SEQ ID NO: 2746 - DNA, 1848 bp, Hordeum vulgare subsp. vulgare
gataattgtttccaacctgagggctacagagagagatctactccataactcaagctgaagcccccaaccaccaccaccccttcttcccccctagcttcccctccaacatctatccatttcatctgcctctgccgtgccgccgccgctgccgctcgctcgtcgccgatctgactcacccgggaagaacacgcacacaccaaggaagcaagcaagcgccgcccacgcccagccggctgctctcctgcctgcctgccaggcagactagagcgcggcgccgccttgctgaatgttcctgcaagcttgacgaggactgctgacaccatagcaaccgaggataatgagctggtgttgcctcccaagagccaagaagcagcagcacaatctctactcccacagacaacaggagattcttcactccaataccagcataagcggcatttcggcggagaagaacataaggctcttctcctatgcgcagttgagatcagcaacagacaacttcaaccacaacaataaagtcggccgaggtggattcgggatagtatataagggaaccctacaaaacaagcaagacgtcgcagtcaaggttctctctgccgaatccagacagggcatcagagaattcttgacagaaattgatgttatcagcaatgtgaagcaccctaacctggtcgaattgatcggctgttgtgttgaagcaaataatcgcattttggtgtatgagtacctagaaaacagcagcctcgaccgtgcactgctgggttctaccagcgatcctgctaattttacatggagcgtaaggtcttccatatgcattggtgttgctagaggtcttgcatacctgcatgaagagatcccgtcaccgatcgtgcacagagacatcaaggctagcaatatactcatggacaaaaattatgtccctaagatcggggactttggtctggccaaactatttccggataatatcacccacatcagtacccgagtagctggaacaacaggttatcttgcacctgaatatgcatggcatggtcaattgactaagaaagcagatatatacagcttcggggttcttgtcatcgaggtcataagcggcaagagtggttcgaggagcctgctggctgatgataagtttcttctagagaagacttgggagctgtatgaagcagggaaccttaaggaactggttgatccagaccttggagattaccctgacgaggaggccatcaggtacatcaaggtggccctcttctgcacgcaggcagcggcggcacggcgcccaacgatgctgcaggtggtgaagatgctgtccaagcccatccggatcaacgagagcgagctgacggccccggggtacatcaacgagtacaagagcagcggctccaaggaaatggcgaccacatccaccggctcgaggttcaagaactcgacggcttatgattcagacatgttcagcacggtcgtaccgcagacagtgaccgacatcagccctaggtgaaacaaggcaccagggagggtggtctgctttgtttactgccaatatgtagggtgacagtaccatagatcctgagtgcgtttgtgttaatgcggcaagtagaacttgtaaataaatagattagtgattcatgccagggcaatgtaaaattattgacagtatgagggtagtggaatagcaattccagagtgatcaatcaggcatgtcatcacatccagttaacttctcagcttttcgtttaggaccataatgtattcatccagccacagtctggaaccaggagaaaacagtaaagagtgcagttgtttgctgtgatactaatctgaatgttcagagctgatcgatacatagcc

SEQ ID NO: 2747 - DNA, 2589 bp, Sorghum bicolor
ctcctctcggtaaacctagccgctctacccatccgtacgccccaggcccccacccatcccgtggagagcaagcgcagccatggcgacggatcgggagaaggagcgcgaggcggagctggagaacgccatgtacactaactgcctactcctaggcctcgatcccgccgtccttggctccccctcctccccggccggccgcgtcggcctcttccgtcactccaacccccgccttggcgagcagctcctctacttcctcctctcctcgctccgcggccccgcgcagtccgcgaaggattttgacaaggtctggccaatcttcgactccgcccagtccagggagttcaggaagatcgttcaagggatcatcagcgagctggagcagcagggggcactgcctcggagcaattctagggtctcgtcgcttgccacatgctgcggaccgagatttgttgagcttttgtggcaactctctgtacatgccctgagagaagtccacaggagaacatttgcagctgatgttgcatcaaatccactacctgcagcactaacagatgtttcttatcttcatgctgcttctttactcccagtaaccaaggcaagaatagctctggagaggcgtaaatttcttaaaaatgcaaacatagctgttcagaggcaaacgacatggtcaaatttggcccatgagatgacagctgagttccgaagtctatgtgctgaagaggcatatttgcagcaagagctagagaaactacaagatatgagaaacaaagcaaaacttgaaggcgaactctgggatgaacagctctcaggctcatctgggcagaactctcatttggtttctaaggcaactcgtctttgggaatcaatattggctcgcaaaggccagcatgaggttttagcttctggaccaattgaagatcttatagcacatcgggagcacagataccggatatcaggatcacagttactagcagcgatggatatgagttcaagtgttccacattctgagttactatcatctcgagctggcgaaacttctccaattttgggcaagcaggaacagatttctcagctattccaaggaaaggaagaagccctttcaagatcagatgataggaatggacgtactcaacaaactgttgatgtagctgaaattcttcgccgctggactcatgctttacagcgtattcataaacaatctcttcatttggccaaagcgaatgatggagaggggcctgacttactgaggagtgcactcgacggagaggccagtactcattctgattcgttaactgcaacattagctgaacatcgccagcatttagtcagtatacagggtctaattaatcaactgaaggaggctattccggcaatgcagcagtctattgatgaactctcagaagaagtgaatagtgtatctattaactccatggatcaattgaactcgaggctaccactgtcagtacaaaacgcagggcttggaagatctgaagaaagaagcagtgaagtttcggagatcagttctaagctctcttctacacacttggacaagcctgggggcagtcctgctctaaagctacccccattatttagtctgactccaagttcttctggaaaaggaacacagacgcaaaaacggaatgcgctggctcgtcaacctagtcaggagatcacatcagaagagaaaacacttaccatcccctcaactaaagatcaaatgaatggttcaatgcatgaaaatgatgactattctgctcatgacattagacgttctattcgtgaagctgctttatcaaagccattgaggaatacagagaggccacaagataaaaatagtgatgatgcttcagagcacttctttattccgctgtcaactggtgctgcaaagaaggatatggattcagtgacaaatggacataaccgaagattaggcttgttgccatctcagatgaagttctcaaagagcacaagtggcatttactacaatgcggatagcccaatatacacaagtccagttctgttaagtgaactgaatgggcatgattcgatcagtgccatgagttttcttgacccggctggtggtctggcacatcagtcctttctcactgatgatgctctggatcaagtattctcccctcctctattattggaatcttcgttgtttcacgatgcagacgaggacctacttgcaccattgtcagagactgaggcagcattaatggaacattaagcttcacatgtacactatgtaatattttgaccactggctggacacagcccggaggttcttgtggcttatgtttgtcttattgaggatatattcggctagttgcttgcgagtgcaaccaggttgagatacaggtgcttccgcaccagaatttgggtgggttctattgcgggggataagttgactattgatgtggggaaaggtgatatagctgctggtgttttttctctggacaaggctatagatgccggtgttgtaccaagggtagtgtgcacagtaggaaagctcaatcttgtatatttagttactctacatcagctgtatttgtgctgtaataatctatcgacctgctcaagtttgtt

SEQ ID NO: 2748 - DNA, 2849 bp, Zea mays
gttttttctcccccttcccacctccgcgagatctgacggctcggcctccaatggcgcccttctccctgtaaacctagctgctctacctacccgcacccccaccccgtggagagcaagtgcagccatggcggcggatcgggagaaggagcgcgaggcggagctggagggcgccatgtacactaactgcctactcctcggcctcgatcccgcggtcctcggctctccctcttcccccgccggccgcgtgggcctatttcgtcactccaacccccgccttggcgagcaactcctctacttccttctctcctcgctccgcggccccgcgcagtccgcgaaggattttgacaaggtctggccaatcttcgactccgctcagtccagggagttcaggaagatcgtgcaagggatcatcagcgagctggaacagcatggggcactgcctcggagcaattctagggtctcgtcacttgccacatgctgcggaccgagatttgttgagcttttgtggcaactatctgtacatgccctgagagaagtccacaagagaacatttgcagctgatgttgtatcaaatccactacctgcagcactaacagatgtttcttatcttcatgctgcttctttactcccagtaaccaaggcaagaatagctctggagaggcgtaaatttcttaaaaatgcaaacatagctgttcagaggcaaatgacatggtcaaatttggcccatgagatgacagctgagttccgaagtctatgtgctgaagaggcttatttgcaacaagagttagagaaactacaagatatgagaaacaaagcaaaactggaaggcgaactctgggacgaacggctctcaggctcatctgggcagaactctcatttggtttctaaggcaactcgtctttgggaatcaatattggctcgcaaaggccagcacgaggttttagcttctggaccaattgaagatcttatagcacatcgggagcacagataccggatatcaggatcacagttactagcagcaatggatatgagttcaagtgttccacattctgagttactatcatctaaagctggtgaaacttctataattttggagaagcaggaagaattttctcagctattccaagaaaaggaagaagcccttacaaggtcagatgataggaatggacgtactcagcaaactgttgatgtagctgaaattcttcgccgctggacccatgctttacaacgtattcataaacaatctcttcatttggccaaagcgaatgatggagaggggcctgaattactgaggagtgcatccagcggagaggccagtactcattctgattcgttaactgcaacattagctgaacatcgccagcatttagtcagtatacagggtctaattaatcaactcaaggaggctattccagcaatgcagcagtctatagacgaactctcagaagaagtgaatagtgtatctattaactcaatggaccaattgaactcgaggctgccactgccagtacaaattgcagggtttggaacatcagaagaaagcagcagtgaagtttcggagatcaattctaagctctcttctacacacttggataagcctgggggcagtcctgctctaaagctaccaccattatttagtctgactccaagttcttctggaaaaggaatacagacacaaaaacggagtgcattggctcgtcaacgtagccaggacatcacatcagaacagaaaacgcttaccatcccctcaactaaggatcaaatgaatggttcaatgcacgaaaatgatgactattctgctcatgacattagacgttctgttcgtgaagctgctttatctaagccattgaagaatacagagagaccacaagataaaaatagtgatgatggttcggaacacttctttattccgctgtcaattagtgctgcgaagaaggaaatggattcggtggcaaatcgatgtaaccaaagattaggtttgtcacctcagatgaagttcccaaagagcacaagctacaatgcagataccccaatcaacaaaagtccaattctgttaagtgaactcaatggacatgattcgatcagtgccatgagtttccttgacccggctggtggtctggcacatcagtcctttatcactgatgatgctctggatcaagtattctctcctctattgatggaatcttcgttgttccatgatgcagatgaggatctacttgcacccttgtcagagactgatgcagcattaatggaatattaagcttcacatgtgcactatgtaatattttgaccactgcagacgcagcctggaggttattgtggcttatgtttgtcttattgactattcggctagttgcttgcgagttgcaaccatgttgagatacagatgcttcatcagaatttgtggggtatatgttgactattgatgcggggagaggtgatattgatgctgttttttccccttctggacaaggctctataggtgccggcgttgtaccaactgtagtggacgcaataggaaagcccaatcttgtatatttagttactatacatcagcagtatttgtgctgtaatactttttcgaattgctgaaatatgtgtttttctgctagttgcgtcctcctgagttttctcagtttcagtgtacgaaattgcaaatcacgaatctaatgaggttaagccaacggggactgtgttcagagttagatcgtatatggttacccaaaacactgtactgttgtacattgtatattgtaccgtttgtaaagtgaagtttgaatataaagatggatgtaggtaaactgctagggatagttttagcaatggtcactagaatagggtttctaggg

SEQ ID NO: 2749 - DNA, 2653 bp, Zea mays
gtaaacctagctgctctacctacccgcacccccaccccgtggagagcaagtgcagccatggcggcggatcgggagaaggagcgcgaggcggagctggagggcgccatgtacactaactgcctactcctcggcctcgatcccgcggtcctcggctctccctcttcccccgccggccgcgtgggcctatttcgtcactccaacccccgccttggcgagcaactcctctacttccttctctcctcgctccgcggccccgcgcagtccgcgaaggattttgacaaggtctggccaatcttcgactccgctcagtccagggagttcaggaagatcgtgcaagggatcatcagcgagctggaacagcatggggcactgcctcggagcaattctagggtctcgtcacttgccacatgctgcggaccgagatttgttgagcttttgtggcaactatctgtacatgccctgagagaagtccacaagagaacatttgcagctgatgttgtatcaaatccactacctgcagcactaacagatgtttcttatcttcatgctgcttctttactcccagtaaccaaggcaagaatagctctggagaggcgtaaatttcttaaaaatgcaaacatagctgttcagaggcaaatgacatggtcaaatttggcccatgagatgacagctgagttccgaagtctatgtgctgaagaggcttatttgcaacaagagttagagaaactacaagatatgagaaacaaagcaaaactggaaggcgaactctgggacgaacggctctcaggctcatctgggcagaactctcatttggtttctaaggcaactcgtctttgggaatcaatattggctcgcaaaggccagcacgaggttttagcttctggaccaattgaagatcttatagcacatcgggagcacagataccggatatcaggatcacagttactagcagcaatggatatgagttcaagtgttccacattctgagttactatcatctaaagctggtgaaacttctataattttggagaagcaggaagaattttctcagctattccaagaaaaggaagaagcccttacaaggtcagatgataggaatggacgtactcagcaaactgtttatgtagctgaaattcttcgccgctggacccatgctttacaacgtattcataaacaatctcttcatttggccaaagcgaatgatggagaggggcctgaattactgaggagtgcatccagcggagaggccagtactcattctgattcgttaactgcaacattagctgaacatcgccagcatttagtcagtatacagggtctaattaatcaactcaaggaggctattccagcaatgcagcagtctatagacgaactctcagaagaagtgaatagtgtatctattaactcaatggaccaattgaactcgaggctgccactgccagtacaaattgcagggtttggaacatcagaagaaagcagcagtgaagtttcggagatcaattctaagctctcttctacacacttggataagcctgggggcagtcctgctctaaagctaccaccattatttagtctgactccaagttcttctggaaaaggaatacagacacaaaaacggagtgcattggctcgtcaacgtagccaggacatcacatcagaacagaaaacgcttaccatcccctcaactaaggatcaaatgaatggttcaatgcacgaaaatgatgactattctgctcatgacattagacgttctgttcgtgaagctgctttatctaagccattgaagaatacagagagaccacaagataaaaatagtgatgatggttcggaacacttctttattccgctgtcaattagtgctgcgaagaaggaaatggattcggtggcaaatcgatgtaaccaaagattaggtttgtcacctcagatgaagttcccaaagagcacaagctacaatgcagataccccaatcaacaaaagtccaattctgttaagtgaactcaatggacatgattcgatcagtgccatgagtttccttgacccggctggtggtctggcacatcagtcctttatcactgatgatgctctggatcaagtattctctcctctattgatggaatcttcgttgttccatgatgcagatgaggatctacttgcacccttgtcagagactgatgcagcattaatggaatattaagcttcacatgtgcactatgtaatattttgaccactgcagacgcagcctggaggttattgtggcttatgtttgtcttattgactattcggctagttgcttgcgagttgcaaccatgttgagatacagatgcttcatcagaatttgtggggtatatgttgactattgatgcggggagaggtgatattgatgctgttttttccccttctggacaaggctctataggtgccggcgttgtaccaactgtagtggacgcaataggaaagcccaatcttgtatatttagttactatacatcagcagtatttgtgctgtaatactttttcgaattgctgaaatatgtgtttttctgctagttgcgtcctcctgagttttctcagtttcagtgtacgaaattgcaaatcacgaatctaatgaggttaagccaacggggactgtgttcagagttaaaaaaaaaaaaaaaa

SEQ ID NO: 2750 - DNA, 2967 bp, Oryza sativa Japonica Group
tacttgtaataaaatttggactcctttcccctccctcccctccttccctctgcgcacccaacccaacccatccgcagctttctcccacctccgcgcagccggtcatacccccattccaggccgctagggttcaccgctgccgcccgcgacggccgccgcgcgccgggcacacagcgcgctttcgccttcacgggctcccgttgccgtctcgcgtcgtgcccgcccccgcgcggaggcggagctatccaaagttatcgcgtccccctcgcatagatctgatattcgcgactggacccgctcctctcggctcgcaatgctttttggagttttgtttctctcccatcccaccacctcggcctcactgagatctccgactccgattacgccagccgccccctaaacctagccgcagcgcatccacccccgcgcgagactagcagcggcgggagtgcgcggccatggcgacggatcgggagaaggagcgggaagcggagctggagagcgccatgtacaccaactgcctcctcctcggcctcgatctcgccgtcctcggttccccctcgtcccccgccgccggccctcgcgtcggcctcttccgccactccaatccccgcctcggtgaacagctcctctacttcctcctctcttcgctccgcgggcccgcgcagtccgccaaggactttgataaggtgtggccgatcttcgactccgcacaatccagagagtttaggaagatcgtgcaaggaatcatcagcgagctggagcagcagggagctctgccacggagcaactccagggtatcttcactcgccacctgctgtgggccgagatttgttgagctattgtggcaactctctgtgcatgccttgagagaagtccacaggagaacatttgctgctgatgttgcatcaagcccgctgcctgcagcactcacagacgtctcttatctacatgccgctgcattactccctgtgactaaggcaaggatagctcttgagaggcgtaaatttctaaaaaatgcaaatattgctgttcaaaggcaaacaacctggtcaaatttagcccatgaaatgacagctgaattccgaagtctttgtgctgaagaggcctacctacagcaggagttagagaagctgcaagacatgcgaaacaaatccaaactggaaggggaactttgggatgaacgtatctcaagttcatctggacagaattcccatttggtgtctaaggcaactcgtttgtgggaaacaatattggctcgcaaaggccaacatgaggtcttagcttctggaccaattgaagatcttatagcacatcgtgagcataggtaccgtatatcaggatctcaattgctagcagcaatggatttgagttcaagcgttccacattctgagttactatcagctcgagctagtgaagcgtctccatttttggacaaacaagaacagatgtctgctctattccaaggaaaggaagaagccctctcaaggttagatgataggaatggacgtgctcaacaacagactgttgatgtggctgaaattcttcgccgttggactcatgctttacagcgtattcataaacagtctcttcatttggccaaagcaaatgatggagatggaccagaactactccgaagtgcatctgatggtgaaactagtacccatgctgactcattaacggcaacattggctgaacatcgtcagcacttagtcagtatacagggcctaattaatcaactcaaggaagctatcccggcaatgcagcagtcaatagcagatctgtcagaggaagtaaatagcgtatctagtaatccaatggataaaatcatctccagattgtctccgtcagtgcaaaattcagggtttggaagagcagaagaaagcagcagtgaactttcagagatgacttccaagctttcttctacacaccttgacaaggctgggagcagtcctgctctaaagctaccacctttatttagtctgactccaagttcttctggaaaaggaacacaggcacaaaaaaggaatgcgttaggacggcaacctagccaagaaatcctgtctgaagagaaaactcttccccttccctcaactaaagatgaaacaaatggctcaatacatgaaaatgagggttattttgctcataacatcagacgttctgttcgtgaagctgctctatcaaagccattaagaaacccagagaggccacatgaccagagtagtgatgatggttcagagcacttctttattcccctatcaacaggtgcttcaaagatggagattgatgccgtcgataataatagaagaatgcaaaaactgggtttttcatcaccacaaatgaagttcagtgatcttcacttcaatgttgacagcccaatgcatgcaactcctgttctgtcaagtaaacttaatgggcatgatgatcctaacactgtcacaagcatgcttgatccagtaagtggtctgggacatcagtcatttataactgatgatgctcttgatcaagtattctccccaccactgttgttggagacttctttatttcaggatgcatacgaggacttgcttgctccattatctgaaaccgatacagctttaatggaacactagagctcacatgtacattgtgtaatactttgaccactgccgtaagcttcagtgcttgatcacagcctggaggttcttatggtttggttctgactgctgctgggacatttttggtgaatttcttgctggttgtgttgcttgccagttgccaccagcttgtgagggatgtctgcgtcagaagaaggggtattattagggaaagttggggtatttggttttggggagaggaaaagagtgttttagcggtgatatagatgtctgtaatgttccagccgttgtgtgcacagtaagataagattcaaaatcgtgtgtatttagcgtacattgtatgtatttcttgtaataatttgcttcgctt

SEQ ID NO: 2751 - DNA, 2645 bp, Hordeum vulgare subsp. vulgare
gagttgccatttcgactcgacccggctggcctgcttttctttgtttgtttgttcgcctcccacctccacctccccctccccctccccctcgcgagatctcccgactccaatgccgcccgcctcctcccgctcctcccaaacctagccccaacccagccacccagtagaagccggcggccatgtcgacggatcgggagaaggagcggggggcggagctggagggcgccatgtacaccaactgcctcctcctcggcctcgatcccgccgtcctcggctcccccgccggcgccgtccccacgcgcgtcggcctcttccgccactccaaccctcgcctcggcgagcagctcctctacttcctcctgtcctcgctccgcggccccgcgcagtccgccaaggacttcgacaaggtgtggcccatctttgattccgcgcagtcgagggagttccgcaagatcgtgcagggcgtcatcagcgagctggagcagcagggggcgctgccgcggagcaactccagggtttcgtccctcgccacctgctgcgggccgaggttcgttgagcttttgtggcagctctctgtccatgccttaagggaggtccacaggaggacgtttccggctgatgcagcatcaaatccgctgccggcagcgctcacagatgtctcttatcttcatgctgccgcattgcttcctgtaaccaaggcaaggattgctctggagaggcggaaatttctggagaatgcaaatattgctgttcaaaggcaagcaacctggtcgaatttagcccatgaaatgactgctgaattccgaagtctatgcgctgaagaggcatgtctgcagcaggagttagagaagctgcaagctatgagaaacagagccaagctagagggtgagctgtgggatgaacgcatctcaagctcgtcgggacagaattcacatctggtatctaaggcgacacgtttgtgggaatcgatattggctcgccaaggccagcatgaagttttagcttccgggccaattgaagatcttatagcacatcgtgagcataggtaccgtatatctggatcgcagttgctagcagcaatggatatgggttcaagccttccacattctctaaatttggacaagcaggagcagatatctctgttccagggaaaggaagaagccgtttcttcaagattagatgataggaatgggcgtgcccaacaaactgtggatgtagctgaaattcttcgacgttggactcatgctttgcagcgtattcataaacaatctcttcatttggccaaagcaaatgatggggaggggccagaattactccgcagtgtgtctgacggcgaaactagtagccatgctgactcattaactgcaacgttggccgaacatcgccagcatttagtcagtattcagggtctaattaaccaactcaaagaagctattccagcaatgcagcagtcaatagcagaactttcagaagaagtgaatagtgtaccgagtaatccaatggatcaaacaaactctagacagttgtctgtgcgaaatacagtgctcggaagatcagaagaaagcagcagccaagtttcagagatgacttctaagctctcttcaatacacattgacaaggctgggagcagtcctgctctgaagcttcctcctttatttagcctgactccaagttcttctggaaaaggaatacagacacaaaggcggaatgccctaacacgccaacctagcaaagaaattatgccggaagagaaagcacttattcacccctcaaccaaagatcacgcaaatggttcagcgcacgaaaatgatggttattttgctcatgacatcagacgttctgttcgtgaagccgctctgtcaaagccattgagcagcatggagggtccacaagacaagagtagcgatgatggttcagagcactttttcattcccctgtcaacagttgcttcaaggaaggatgtgggtgctgtggcaaatcgaagaaaacaaaggacaggtctaccgtcatcacagtcgaaattgcccaagagcacaggtgacttttacttcaatcctgacagcccaatgcctgcagccccagctctgtcaggtaaactgaatggccatgacgatccaagcaatgctgcaaacttctttgatccagtcaatggtcggtcgtttatgacggatgatgctcttgatcaagtgttctccccgccacctatgttggagccttccttgttccacgacacgtacgcatacgaggacttgcttgcaccattatcagaaactgatgcggctttaatggagcattaggctttaagtgtacaatatgtaatgctttagccactgcctaaagcttcagtgcttaagtgcagcccagaggatttgatggcttatgttcaactggggtgaaccctttggacttgtgctggttaagttgcatgccagttgccaccagctcctgagagggatcagggatgctgctgcatccgatgttgtgcgattctgtttgaagagaagggcgccaagaggtgatgatatggatgcatgggatggtgtgtgcagtaaaaaaaatgcccgatcttatgtatttagtgtatacatcatttgtgtttgtgttgtggtgaatttatcctcttattcaagtgcctgttttgattt

SEQ ID NO: 2752 - DNA, 2006 bp, Zea mays; identical to SEQ ID NO: 1731

SEQ ID NO: 2753 - DNA, 2192 bp, Zea mays; identical to SEQ ID NO: 1730

SEQ ID NO: 2754 - DNA, 2096 bp, Zea mays; identical to SEQ ID NO: 1735

SEQ ID NO: 2755 - DNA, 2167 bp, Sorghum bicolor; identical to SEQ ID NO: 1732

SEQ ID NO: 2756 - DNA, 2064 bp, Oryza sativa Japonica Group; identical to SEQ ID NO: 1737

SEQ ID NO: 2757 - DNA, 2078 bp, Hordeum vulgare subsp. vulgare; identical to SEQ ID NO: 1738

SEQ ID NO: 2758 - DNA, 2265 bp, Sorghum bicolor; identical to SEQ ID NO: 1724

SEQ ID NO: 2759 - DNA, 1874 bp, Oryza sativa Japonica Group; identical to SEQ ID NO: 1740

SEQ ID NO: 2760 - DNA, 1356 bp, Zea mays
ctctgggaccgccctgtaacatccaccaactcgaggaggaggaggaggagaagagatccccccacctagcctcggtttccaagcgccagcagaagaagaagagacaggacacatggcggcaggtttcggcccgaggttcgccgccggcgatgctccggcgagacggtgtaacctggagcggttcctcgaggccaccacgcccgtcgttgcgtcctccagctgctcgtccaaggagaccgcgaacggttgggggcagcggcagtcagacgacgcagacggctcgtcgccgttcttcgctctgggcgacctctgggactcgttcaaggagtgcagcgcgtacggcaccgctgtgccccttgctctgaacggctgcagcgacggcgtcgttcagtactacgtcccctacctgtctgcaatccagctttacggagccctcagaaggcacatcggcccttcgaggacgggtgcagaggagagcgacagcgacgcggagcgcgagacgagctccagcacgaacacgttgtcggcccgggaggaggcgagcgagagcagcaccagcggcagcgaagcctccggcgacgagggcgagccgggaccggggagctggtgccaggagcggctcctcttcgagttcctcgagtccgagcctccctaccagcgcgagcctctggctgacaagatttgtagccttgcccagcggtttccggagctcaagactctcaggagctgcgacctgtctccggcaagctggatctccgtggcgtggtacccgatctaccggatcccgacggggccaacgctgcgcgacctggacgcctgcttcctcacctaccactccctgtccacgcagttcgcagcaggcgccagcagcaacgggcccagaccggcgacggcagccaccgcgacggcgatgatgtggctcccgacgttcgcgatggcgtcgtacaagctgaaggcggcggcgtggacgccgggctggcgcgaccggcaggttgccgcgtccctcgcgcaggccgccgacgcctggctcaggctcctgcgcgccgaccacccggaccaccgcttcttcgccgcccggcggcctcccaggagatggtgatcatttgagtgtatagagtactctctctctctctctctctctctctctctctctctctggcaagtctgaaggtagttgtcctgaaaaaggaaacggctgaggtagttagggttcactagcggaaccggagtgacaaagtatgttcatcctgtagtttcaatgttgttttcctttttttttgtatccgccatgttctcaggaaaaaaatgtatcagaaaacgtataataggtgtagagcaatactggtgtcattgtcc

SEQ ID NO: 2761 - DNA, 975 bp, Sorghum bicolor
atggcggcaggttctggccgaaggttcgccgccgccggcgatgctccggcgaggcggtgcaacctggagcggttcctcgaggccaccacgcccgtggttgcgtccagctgctcctccaaggagaccgtgaatggttgggggcaatcagatgcagatgaatcgttgccattcttcactctgagcgacctctgggactcattcaaggagtgcagcgcctacggcactgctgtaccccttgttctcaacagttgcagtgatggcgttgttcagtactacgtcccttacttatctgcaatccagctttatggcggattcaggaggcacatcggccctttgaggacgggtgcagaggagagcgacagcgacgtggagcgcgagacgagctccagcaccaacacgttgtcagcccaggaggcgagcagcagcagcggcagcagcgaagcttcttccagcgacgaaggcgagccgggaagctggtgccaggagcggctcctcttcgagttcctcgaatccgagcccccctaccatcgtgagccgctggctgataagatttgtagcctcgcccagcggttcccagagctcaacactctcaggagctgcgatctgtcgccgacaagctggatctccgttgcatggtacccgatctaccggatcccgacggggccaacgctgcgggacctggacgcctgcttcctcacctaccactccctgtccacgcagttcgccgcaggtgtgggcaacaacagcggcagccccaagccgacggcggcggcgcccgtgacggcgatgtggctcccgacgttcgcgatggcgtcgtacaaggtgaaggcggcggcgtggactcccggctggcgcgaccggcagatggccgcgtcgctcgcgcaggccgccgacgcctggctcaggctcctgcgcgccgaccaccccgaccaccgcttcttcgccgcccgccgcgctcccgccaggagatggtga

SEQ ID NO: 2762 - DNA, 1457 bp, Zea mays
caatcatccagaaggtcaaactctcccctgtttcgacttggttccctgctcctgccctgaaaggagttgtcttggttccctgcccctgccctgaaagcagcagttggagagtcgaatcgtccttcttctctccggcgggaggaggcgggcggtgggcggtgggcggcggcaggaccgtgatgacgagcagcagcaacaacggcggccggccagacgacggcggcgaggtggtcctggaccacgagtaccaagaggagtacgtgaggaactcgcgggggatgagcctcttcgcatgcagatggctgccggcagttgcaggcaagagggggagggctccagctccaaaggcgctcgtcttcctctgccacggctacgccgtggagtgcagcgtgacgatgcgcggcaccggcgagcgcctggcgcgtgccggctacgccgtctacggcctggactacgagggccacggccgctccgacgggctgcagggctacgtgccggatttcgacgcgctggtgctggactgcgacgagtacttcacctcggtggtggcggcggcggcgcagtcgcagtccaaggacgcccaccaacttccccggttcctgctcggggagtccatgggcggcgccgtggctctcctcctccaccgccggcgccccgagtactggagcggcgccgtgctggtggcgcccatgtgcaagatcgccgacgacatgcggcctcacccgctggtggtcaacatcctcagggccatgaccaccatcatcccgacgtggaagatcgtgcccagcaacgacgtcatcgacgcggcgtacaggagccaggagaagagggacgagatccgcagcaacccttactgctacaaggacaagccgcgactcaagaccgcctacgagctgctcaaagtcagcttggacctcgagcacaacctcctccaccaggtgtcgttgccgttcctgatcgtgcacggcggggcagacaaggtgacggacccgtcggtgagcgagctgctgtaccaatcggcggcgagccaggacaagacgctcaagttctatccgggcatgtggcacgccctcacctccggcgagtcgcccgacaacatccaagccgttttccaagacatcatcgcctggctcgaccacaggtcacccgacacggaacaggaggagctggtgtcgtcggaggtggagcagaaggccaagcacgacgaccagcgccaccaggagcagctccaggacggcaacaaatagctagctgcttgcttgcctgctgctttcttctctttacagaacgaaccgtttcatttggtcatgcatggatacacatcatgtctcagtgatacgtaccgactaaattaaattattagatcgaccgcgcttacctagaaattaaacaatcagctgttcgacatcatatatcatcaggtcctttattaattttagactccaacgtgatgcatt

SEQ ID NO: 2763 - DNA, 1417 bp, Sorghum bicolor
gcattggcattcgcccccccccccccccacatctctctccatataccaatcatctagaaagtcaactcctctcctctgtttcgtcttccctgccctgccgtgaaagcagttgaagagttgaatcgcaatcgtccttctccttgtccggcaggcggcggcggcagcggcaggaccgtgatggggaggagcagcagcagcagcggcggcggcggggcagatgatggcggcgaggtgctcctggaccacgagtacaaagaggagtacgtgaggaactcgcgggggatgaacctgttcgcatgcacatggctgcctgcaggcaagaggaagactccaaaggcgctcgtcttcctctgccatggctacgccgtggagtgcggggtgacgatgcgcggcaccggcgagcgcctggcgcgtgcgggctacgccgtgtacggcctggactacgagggccacggccgctccgacgggctgcagggctacgtgccggatttcgagttgctggtccaggactgcgacgagtacttcacctccgtggtgcggtcgcagtcaattgaggacaagggctgcaagctgcgccggttcctgctcggtgagtccatgggcggcgccgtcgctctccttctagacctcaggcggcccgagttctggaccggcgccgtgctggtggcgcccatgtgcaagatcgccgacgacatgcgtccccacccgctggtggtgaacatcctgagggccatgacctccatcgtcccgacctggaagatcgtgcccagcaacgacgtgatcgacgccgcctacaagacgcaggagaagagggacgagatccggggcaacccttactgctacaaggacaagcccagactcaagaccgcgtacgaactgctcaaggtcagcttggacctcgagcaaaacctcctacaccaggtgtcgttgccgttcctgatcgtacacggcggagcagacaaggtgacggacccgtcggtgagcgagctgctgtaccgatcggcagcgagccaggacaagaccctgaagctctacccgggcatgtggcacgccctcacctccggcgagtcgcccgacaacatccacaccgttttccaagacatcatcgcctggctcgaccacagatcatccgacgacacggatcagcaggagctgctgtcggaggtggagcagaaggctaggcacgacgaacaacatcaccagcagcaggatggcggcaacaaatagctgcttgcttgtaactcttcttcatagaacgaaccatttcatttggtgatgcatgggatgatacacatgtcagtgatacataccgactaaattatttagccgacttacctacaaatcagcagctagctatcaatatatatggaatcatatatatcatcaagtctaatataaatattgaatttgatactct

SEQ ID NO: 2764 - DNA, 1038 bp, Sorghum bicolor
atgagcagcagcagcagcaatggcggcgaggtgctcctcctggaccacgagtacaaagaggagtacgtgaggaactcgcgggggatgagcctgttcgcatgcacatggctgccaggcaagaggaggactccaaaggcgctcgtcttcctctgccatggctacgccgtggagtgcggggtgacgatgcgcggcaccggcgagcgcctggcgcgtgcgggctacgccgtgtacggcctcgactacgagggccacggccgctccgacgggctgcagggctacgtgccggatttcgagttgctggtccaggactgcgacgactacttcacctccgtggtgcggtcgcagccaaatgaggacaagggctgcaagcggcgccggttcctgctcggggagtccatgggcggcgccgtcgctctccttctggacctcaggcggcccgagttctggaccggcgccgtgctggtggcgcccatgtgcaagatcgccgacgacatgcgtccccacccgctggtggtgaacatcctgagggccatgacctccatcgtcccgacctggaagatcgtgcccagcaacgacgtgatcgacgccgcctacaagacgcaggagaagagggacgagatccggggcaacccttactgctacaaggacaagcccagactcaagaccgcatacgagctgctcaaggtcagcttggacctcgagcaaaacctcctacaccaggtgtcgttgccgtttctgatcgtacacggcggggcagacaaggtgacggacccgtcggtaagcgagctgctgcaccgatcggcggcgagccaggacaagacgctcaagctctacccgggcatgtggcacgccctcacctccggcgagtcttccgacaacatccacgccgttttccttgacatcatcgcctggctcgaccacagatcatccgacgatacggatcagcaggagcaggagcaggagctgctgtcgtcggaggtggagcagaaggccaggcacgacgaccaacatccccagcaggatggcggcaacaaatag

SEQ ID NO: 2765 - DNA, 1772 bp, Sorghum bicolor; identical to SEQ ID NO: 2735

SEQ ID NO: 2766 - DNA, 1577 bp, Zea mays; identical to SEQ ID NO: 2734

SEQ ID NO: 2767 - DNA, 1716 bp, Zea mays; identical to SEQ ID NO: 2736

SEQ ID NO: 2768 - DNA, 1712 bp, Oryza sativa Japonica Group; identical to SEQ ID NO: 2732

SEQ ID NO: 2769 - DNA, 1065 bp, Oryza sativa (japonica cultivar-group); identical to SEQ ID NO: 2733

SEQ ID NO: 2770 - DNA, 1695 bp, Hordeum vulgare subsp. vulgare; identical to SEQ ID NO: 2737

SEQ ID NO: 2771 - DNA, 1765 bp, Zea mays; identical to SEQ ID NO: 2738

SEQ ID NO: 2772 - DNA, 1692 bp, Oryza sativa Japonica Group; identical to SEQ ID NO: 2739

SEQ ID NO: 2773 - DNA, 1681 bp, Zea mays; identical to SEQ ID NO: 2740

SEQ ID NO: 2774 - DNA, 1697 bp, Zea mays; identical to SEQ ID NO: 2741

SEQ ID NO: 2775 - DNA, 1792 bp, Zea mays
ggccgcttctgcttctgcggcggcggaggagcggcgagggtggttcggctgcaatgcgtggcagcgctcgtgctcggggtggccgtgctgctgtcggcgctcttctggctcccgccctttgccgggtggggcggcggcaaggagggcccggatccgggcgacgagttcggagctgctatagcggcaagctttaggctacacaagacagttcctgagctgagtggaaataaatcccagctcgaattggatatatatgaggaagttggcattcctaattccacggtggttgtgaatatgatacatccattagatggatcaaactggacaaacatcatcttcaacattgtccctttcccagagaacgtgactatatcatcaacatggttgagcattcttagatcaaagttcatgtccttggttgtacggcagtcatcaatccacttgactgagcctctattcgggaatgcgtcagcctttgaagtaattaaatttccaggaggaataacaattatccctccacaaactgcttttcttcttcagaagccccatgcaacttttaattttactctgaactatccgatctacaaattacaagacagaactaacgagttaaaggatcaaatgaaggcaggattactgctcaatccatacgagaatctgtatatcaagttgacaaattcgcaaggttcaacgattctcccgccaacaatcgttgagacctccatcgtcctcgaagttggaaaccaccagccatctgtaccaaggatgaaacagttggcgcggacgatcaccaattcatcttcatcctcaggaaacctgggcctgaatcacactgtatttggcagggtgaagcagattagcctttcatcctatcttaggcattccttacacagtggacgtggttctgatgcaccgagtcctgcacccatgcaccatcatggtcaccacagccaccaccaccgccaccaccaccacagtcacgatgacaacaggcatcctgcagctcccgctcctgctccagtacattttcctgcgccacagcccagatacggtgctccacctccatccggtgggtgtccgtacagcaaaaacaagccaaagaaaagcgggcgtgctgcaccagctgccgagcctgcagctaatgaccaccgatctgcttccatcgccttaccaccgcatccatcatcgccttcgcctgctagttggtctcagcatgctcccagtacgccggctgttcctccccctcctgctctaccagagccacctctgcccaccatctcgtttgctcatccacgtcctccaagtgaacgtggaactgggacgagtcctgctccaagtgaagaggcgacacgagcgggtccttctgggatgtcacaagtggcaccggcgcctcattcatcttatgccaccaggatgcagggcgatgttccctgctgctgggtcctttttgtcctcgcgctatgcgtcctaacgagcctgctacgatgagaaggaagtgcacggccggccaacgagatgtacatcagcgaccgctggcgtacgtgctaaagaagagaaagaggacccacggggctccaccggcgcggcgcatctggttccggcccggccacgccaccatccagcagctcccgggggcggggggtggccaccaaaggcacaaggaagctgagagcctcatcccttgtcaacccctcggcgggctgtgtcatactcttgtcgttcgttgctagttgtcagctgtcatgtaaatatgaagggatgggtataaaaggcaaggaaaagccgcaagacg

SEQ ID NO: 2776 - DNA, 2096 bp, Zea mays; identical to SEQ ID NO: 1735

SEQ ID NO: 2777 - DNA, 2192 bp, Zea mays; identical to SEQ ID NO: 1730

SEQ ID NO: 2778 - DNA, 2006 bp, Zea mays; identical to SEQ ID NO: 1731

SEQ ID NO: 2779 - DNA, 2167 bp, Sorghum bicolor; identical to SEQ ID NO: 1732

SEQ ID NO: 2780 - DNA, 2064 bp, Oryza sativa Japonica Group; identical to SEQ ID NO: 1737

SEQ ID NO: 2781 - DNA, 2078 bp, Hordeum vulgare subsp. vulgare; identical to SEQ ID NO: 1738

SEQ ID NO: 2782 - DNA, 1874 bp, Oryza sativa Japonica Group; identical to SEQ ID NO: 1740

SEQ ID NO: 2783 - DNA, 2265 bp, Sorghum bicolor; identical to SEQ ID NO: 1724

SEQ ID NO: 2784 - DNA, 1584 bp, Oryza sativa Japonica Group; identical to SEQ ID NO: 2713

SEQ ID NO: 2785 - DNA, 1401 bp, Oryza sativa Japonica Group; identical to SEQ ID NO: 2714

SEQ ID NO: 2786 - DNA, 1573 bp, Sorghum bicolor; identical to SEQ ID NO: 2711

SEQ ID NO: 2787 - DNA, 1574 bp, Zea mays; identical to SEQ ID NO: 2712

SEQ ID NO: 2788 - DNA, 1264 bp, Oryza sativa Japonica Group; identical to SEQ ID NO: 2728

SEQ ID NO: 2789 - DNA, 1372 bp, Vitis vinifera; identical to SEQ ID NO: 2729

SEQ ID NO: 2790 - DNA, 888 bp, Ricinus communis; identical to SEQ ID NO: 2715

SEQ ID NO: 2791 - DNA, 1167 bp, Vitis vinifera; identical to SEQ ID NO: 2731

SEQ ID NO: 2792 - DNA, 2871 bp, Zea mays
ctatgtcgcgagctcggccggcattagccatggcggcggaggcggaggcggcgctcctgctgctgctgctcctgtgcgcggcggcgttcgtggagcgcggcgcggcgctgcacctctgcacggaccggctgttcaacgacacgaaggggcggcacgacgacggcctgccgcacctgaccccgacggaggaggccacgtggatgtccctcctcccgcgcaggctccgcggcggcggccgggccgagttcgactggctggcgctgtaccgcagcctgacgcgcggcgacgggccggacggtggcgccggcaaggccgcgggccccgaggggctgctgtcgccggcgtccctgcacgacgtccgcctccacggcgacggcagcctctcctccatgtactggcgggcgcagcagaccaacctcgagtacctgctctacctcgaccccgaccgcctcacctggaccttccgccagcaggctggcctgcctaccgtcggggacccctacggcggctgggaggcgccggacgggcagctccgcggccatttcgtagggcactacctgagcgcgagcgcgcacgcgtgggcggccacgcacaacggcaccctgagggagaggatggcgagggtggtggacattctccacgcctgccagaagaagatgggcacggggtacctctcggcgtaccccgagaccatgttcgacctgtacgagcagctggacgaggcgtggtcgccatactacaccacccacaagatcatgcagggactcctcgaccagtacacgctggccagcaacgagaaaggccttgacgtggtgctgcggatggccgactacttcagcaaccgcgtgaagaacctggtgcagatccacactatccagaggcactgggaggcgatgaacgaggagaccggcggcttcaacgacgtcatgtatcagctgtacactataacgagagatcagaaacacctgacgatggctcatcttttcgacaagccatgcttcctcggaccacttggtctccataaagacgacatctcgggcttgcatgtgaacacgcatctccccgtcctcgttggtgcgcagaagagatacgaggtcgttggcgatcgtctctacaaggacatctcgacttacttgtttgatgtggtgaattcttctcacactttcgcaaccggaggcacatctaccatggaacactggcatgacccaaagaggctggtggacgagatcaagatcagctcgaacgaggagacctgcgccacctacaacttcctcaaggtgtcgcggaacctgttccggtggacgaaggaggccaagtacgcggaccactacgagaggctgctcatcaacgggatcatgggcaaccagagggggacgcagcccggggtcatgctctacttccttcccatggggcctgggcggtccaagagcgtcagtggccagtcaccgtctggcctcccgcccaagaacccaggggggtggggaggtcccaacgacacgttctggtgctgctatggcacggggatagagtcgttctcaaagctaggggactccatatacttcctggaggaaggtgacacccctgggctctacatcatccagtacataccgagcaccttcgactggaaagccacgggcctcactgtcaaccagcgggcgaaacctctgctgtcaacggaccccttcttcaaagtttcgctcaccatttctgcaaagagaggtgcccgacaagcgaaggtgagtgtccggatcccatcgtggacgacaaccgatggcgcaacggcgatcctgaacggccagaagctcaacctgacacccactggcaactcgactaatggtggtttcctgacgattaccaagctctgggccaatgacaccttgaccctccatttccccattacccttagaactgaggcaatcaaggatgaccggccggagtacgcgtccatccaagcggtgctgttcggaccgcacctcctcgccggcctgacacacggcaagctgccagtgacagacagcagccactccaacgacggcctgaccgcaggcatctgggaagtggacgccacaggcgccgcctccgtcgccggctgggtcaccccgctccactccgagacgctcaactcacagctcgtcaccctgaaacagagcattggcgggcgcaccctcgtcttgtcggtgtccatcgctgacgcgaagctggagatgcaggagcagcccgcccccgggaccgacgcgtgcgtgcacgccacgttccgcgcctacggccaggcgggcggcagcagccagctgctgcgagggcccaacgtgacgatcgagccgttcgacagaccgggcatggcggtcaccaacggcctcgccgtcggctgccgtggaggccgcgacacgctcttcaacgccgtgccggggctggacggcgcgccgggctccgtgtccctggagcttgccaccaggccggggtggttcgtggcgacggcccccacagcgatgcacgcgaacgccaccacgcaggtcgtctgccgagccaacaagggcggcgcggcgttccggcgagcggcgagcttcgcgcgcgcgccgccgctgaggcgttaccacccgctgagcttcgcggcgcgcgggacggcgcggaacttcctgctggagccgctgcggagcctgcaggatgagttctacaccgtctattttagcctcgtctccgacggcgagagctgattgatcggtgtgctcctgaacgaacgctccgctagtttcgctgtgcaatgagccattgacgctctgtatcccccatgaactatgtgcaatttggagtggagtaaaaatgtatggcgctagttccatgaatccatcaaaattcccttaccgttaatagctt

SEQ ID NO: 2793 - DNA, 2922 bp, Sorghum bicolor
atggctcgagctcggccggcattagccatggtgtcgacggcggcggctctgctgctgctgctgctgtgcgcggcggcgttcgtggagcgcggcgcggcgctgcaactgtgcacggaccgcctcttcaacaacacgcaggggcggcacaacgacggcctgccgcacctcaccccgacggaggaggccacgtggatggcgctcctcccgcgcaggctccgcggcggtggtggtggcggcgcccgggcccgggccgagttcgactggctggcgctctaccgcagcctcacgcgcggcggtggcccggacgacgacgccgacgccggcaagccgggcccgggggagctgctgacgccggcgtccctgcacgacgtccgcctccacggcgacgacgacgacgacgaccgcgtcctcaccggctcgtcctcctcctccgccgccatgtactggcaggcgcagcagaccaacctcgagtacctgctctacctcgacccggaccgcctcacctggaccttccgccggcaggctggcctgcccaccgtcggggacccctacggcggctgggaggcgcccggcggccagctccgtggccatttcacagggcactacctgagcgcgagcgcgcacatgtgggcggccacgcacaacagcaccctcagggagaggatgacgagggtggtggacattctctacgactgccagaagaagatgggcacgggatacctggcggcgtatcccgagaccatgttcgacttgtacgagcagctggacgaggcatggtcgccatactacaccatccacaagatcatgcagggacttcttgatcagtatatgttggccagtaacaagaaaggtctggacgtggtggtgtggatgactgactacttcagcaaccgtgtgaagaatctgatacagaagtacactattcagagacattgggaggcaatgaacgaggagaccggtggattcaacgacgtcatgtatcagctgtatactataacgaaaaaccagaaacatctgacaatggctcatcttttcgacaaaccatgcttccttggaccacttggtcttcataaagatgacatatcaggcttgcatgtaaatacgcatctccctgtcatcattggtacacagaagagatatgaggttgttggtgatcatctttacaaggacatctcaacttacttgtttgatgtggtgaattcttcccatacattcgcaactggaggtacatctaccatggaacactggcatgacccaaagcgtctggtggacgaaatcaaaatcagctcgaatgaggaaacctgcgccacctacaacttcctcaaggtgtcacggaacctgttccggtggacaaaggaggccaagtacgcagaccactacgagaggctgctcatcaacgggatcatgggcaaccagaggggaacacagcctggtgtcatgctctactttcttcccatggggcctgggcgatcgaagagtgtcagtggcctttccccctctggccttccgccgaagaatccagggggatggggaggtccgaacgacacgttttggtgctgctatggcactgggatagaatcattctcaaagctaggtgattccatatatttcctggaggagggtgaagcaccagggctctacatcatccagtacataccgagcaccttcgattggaaagccacaggcctcactgtcaatcagcaggccaaacccctgttatcaacagacccctttttcaaagtttcgctcaccttttctgcaaagggagatgcccaactagcaaaggttagtgtcaggatcccgtcatggacatcaactgatggcacaacggcaactctgaatggccagaagctcaacctgacatccactggcaactcgactaatggtggtttcctgacggtgaccaagctctgggccgaagataccttgaccctccaatttcccattacccttaggactgaggcaatcaaagatgaccggccggagtacgcgtccatccaagcggtgctgttcgggccgcatctcctcgccggcctgacacacggcaagctgccagtgaccgacagcaaccactccaacgacggcctgaccccgagcatctgggaagtgaacgccacaagcgccaccgccgtcaccgactgggtcactccgctcccctccgagacgctcaactcacagctcgtcaccctgacgcagaccgccggcggacggaccctcgtcctgtcggtgtcgatcgccgacgcgaagctggagatgcaggagcagccggcccccgggaccgacgcgtgcgtgcacgccacgttccgcgtctacggccaggcgggcagcagcagcagcgagtcgctgctgccgatgcaagggccgaacgtgacgatcgagccgttcgacaggccgggcatggcggtcaccaacggcctcctcgccgtcggccgccctgctggaggccgcgacacgctcttcaacgccgtgccggggctggacggcgcgccgggctccgtgtccctggagctcgccaccaggccggggtgtttcgtggcgacggcccccgcagcgggcgcgaacgccgccacgcaagtcgtctgccggggcaacaagaacaatggcggcagcgcgagcggcgacggcgcggcgctccggcgcgcggcgagctttgtccgcgccgcgccgctgaggcggtacaacccgctgagcttcgcggcgcgcgggacggcgcggaacttcctgctggagccgctgcggagcctgcaggacgagttctataccgtctacttcagcctcgtcgtctccgacgccgggagctgattgatcggtgtgcacgtgagccaactggaggactggatactgatcacgctagtttcgctgtaccattgacgcactgtatcccctatgaacaatgagcaatgagcaatgtggagtaaaagg

SEQ ID NO: 2794 - DNA, 3126 bp, Zea luxurians
gcggaggcggcaggggagtgctggagcgaagcgctcaagtcgttcctggaccacatccccgtctcctccgtcccgggcgcgctccaacccactgcctccccaggtatcacgacacgaggcccagggttgcttcctctcgcttcctgtatgtgtaggtaggcgttgggtcggacgaggacgatccattccattccatatacccgaccactaaccatctcgcgttcgtgtttgttccgcacgcagcggtggaggtcaagctccacggctccgtcctgggcgccctcgacgccatgtacagcagcaacgccgcgggcgcggtgatcatcgacgtggtgcacagcagtctaggcaagtacgtcgatcgcgatattggcttcgtcgagttctcgagcctagtactgtgggcgcttgaggtaacctgacgatctaggactaggagtacatgtttttcaagtcactaaatttttcggtttgccggcggagatcgaaacgttgctctgaaattcgtcttatagacagttcatgtggcctgtttttttttggttgaagaatgaacgatcattacttttggttgccatccgatcttgacaaattcatctgttgcgttggccattcataggaacttggcaaagtggaaagtgaaccaacagacagtacttctgatttcctctctactctgaaacagcaccatcagattgcagaaacgaaggtactccacatatcgaatgtgacacttcacttatgttagtacactggaatggatgggacgtatatgtattccgaatatctttctcttacgccccgtttggatcattggaattgaattccattctaataatagtaatttaggcatatatcaattaagctaattcggttttatgcaaaatatatttgtatactattattagcaagatgtcgtagatatttatgtgctacatttttactatagggaagtgagacgaagagtgtcatgtaagttatagattagaaaccaattctagtaatgcataaaatcatttcccaccctccaccccatgaatttgagataggcttatatctgaactttagaaagtggtgaaatgtcaaattccaaactaaataagttactttattaagtgaattccaattcctctaaaatgaagggatccaaacgccccgttagcgaaataggacgaatggtggggataaaaatggtgatttttttcctatttttaacattgcggctgttactctgatgaaacaaaacagatcgcctggttagcgaagttgttcctgtgggagccattcttccctgttcggacccatgacacgctgttccacgcaatgcttctcttctcgaagcaccacaggctcaacgtggcaccggttgttgagtcgatgaactcgagtgttattggatttgtcacacaggtaactgcccggtgccttccttgatgctctgtcagtgctctttttatgctcggtgattatggatacagcactcaatcgtgatgctaacggccggccggtcggcgtattgcactagaacgcagtgatggagctgcttctccagtcaagtggccttgagtggcttgataaaattgcagacaagcagctttctgaatttaggtatgccctgagcctgaataagaagtgcttcggtacagttaggtggaaatggttatcagagtgtttgaatgcactaagctaatagttagtgactaaaattagttgaaacatccatacatcataattaatagtttagctattagctatttttagtaaattagttaatagtcaggtagttatttgttagctagctaattttaccatcattttttaaccaactaactattaattctagtgcattcaaacactccttcagttgtatgcctaactactatttagaatatcctgtatgcgtcatgaatatgtaaggaagtgaactgtgtgtatgaggtatgctttgtagtgcgaacaggtcaaatgtttcttaggtttcattaatttcttttttctagagcataaaaaggagcaaactgagagcttcttcagttagaagtggattgaatgaaattggagagaaataaatcccttcctaatcaaaattgaataaaatatgatttaatctttctcaatctcactcgatctctgtgggaccgaataagacgtggggtggggtcttgggaaggtatataccttgagggttaattggaaactcaaatcctctctaggattggattggaggggattgatgccccaatgcccttcaatcatggaggagatttgagttttaaaactagccgtgacaaggcatataccttaaactagccctgacaagggatatgcttataaaagaagtaccttgtggggaaatatcctgaaaagcagtcagctagatgcaagcttgtcaagcccgtacctgcatgtggtcaacatgcatgataccaccgcgaacataacttctgcaagtctaaaatgctgcatttgacttgtcgacaggtttgcaaatgttaggaagcctgttttggtgtactcagatcaaactctagctgatgggctgcatattctctcaaaggaaaaaacgggggttgcagtcattgacaggaaaaccagccgtctaattggatcattacagtgcagtgatctctacctgtttctagatgacagcacccttttcagcaagcgaacgtaagtactgccatctccttttcccaagttttccgaaataattaagaattcccctccatatttcctgatgatccatacaggacaactactctggaagaatttatcagcctgaataacaagaccgacaggaaatgcagcaccgctgaaaattcatgtgcgcctggccgaaacatcctcgcgctcaggagcaggcagtcaggcatggtgggcctaccagccaccaacctggaatccgacaccttaaagcaagcgatggagaagctgacaactttaaggagcagctgcagcttcatcgtcgacgagcacgggcgcgtccaaggagtggtgaccacaagggacatcatctccgtgttctccccgccgtgcatggactcgaggattgacggggccacgttcttctcggctgcgctcgagcaggctggctgccgcgttgagaatgggcagatgtttcagaac

SEQ ID NO: 2795 - DNA, 2989 bp, Zea mays subsp. mexicana
tggagcgaagcgctcaagtcgttcctggaccacatccccgtctcctccgtcccgggcgcgctccaacccactgcctccccaggtatcacgacacgaggcacagagctgcttcctctcgcttcctgtatgtgtaggtaggcgttgggtcggacgaggacgatccattccattccatatacccgaccactaaccatctcgcgttcgtgtttgttccgcacgcagcggtggaggtcaagctccacggctccgtcctgggcgccctcgacgccatgtacagcagcaacgccgcgggcgcggtgatcatcgacgtggtgcacagcagtctaggcaagtacgtcgatcgcgatattggcttcgtcgagttctcgagcctagtcctgtgggcacttgaggtaacctgacgatctaggagtacatgtttttttcaagtcactaaatttttcggtttgccggcggagtttttttttcccgaaaggacggcaagagggttgccgaatatattaatagaaggagaaaaaaccaaatacagggactactggccaacaaggtaccaactacagccaattcaagaaaaaagaagagagcgaaaagaagagaaaaaaagaaccaccactaagaaaaaacaaaaccaccactagagaactctctgatcaaaagatagagaaagccgcactgtattgtaagacatccttcttgatttgatgggcgacgacaagttaatcattcccggaattttgaaaaattcgtctatttctttctttccaaatattccaccaaaaatagactactagcccgtcaaataaccttcgtcttggcttatcaattctgagtctacatcttctccaccaagtatgtaactggccatcatggtttaggtttgctaaagagttgagattggtttgccggcggagatcgaaacgttgctctgaaattcgtcttatagacagttcatgtggcctgttttttttttgggtgaagaatgaacgatcattacttttggttgccatccgatcttgacaaattcatctgttgcgttggccattcataggaacttggcaaagtggaaagtgaaccaacagacagtacttctgatttcctctctactctgaaacagcatcatcagattgcagaaacgaaggtactccacatatcgaatgtcacccttcacttatgtttgtacactggaatggatgggacatatatgtaatgtattctgaatacctttctcttagcgaaataggacgaatggtggggataaaaatggtgattttttcttctatttttaacattgcggctgttactctgatgaaacaaaacagatcgcctggttagcgaagttgttcctgtgggagccattcttccctgttcggacccatgacacgctgttccacgcaatgcttctcttttcgaaacaccacaggctcaacgtggcaccggttgtcgagtcgatgaactcgagtgttattggatttgtcacacaggtaactggtgccttccttgatgctctgtcagtgctctttttatgctcggtgattatggatacagaactcaatcgtgatgctgacggccggccgatgtattgcactaggatgcagtgatggagctgcttctccagtcaagtggccttgagtggcttgataaaattgcagacaagcagctttcggaatttaggtaagccctgagcctgaataagaagtgcttcagtacagttaggtgaaaatgcttaccatgattcagttgtatgcctaactactatttagaataccttgtatgcgtcatgaataggaaacaaatgtaaggaagtgaactgtgtgtatgaggtatgctttgtagtgcgaacaggtcaaatgcttcttaggtttcattaatttcttttttctagagcataaaaaggagcagattgactcccgcataagagcttgttcaattagaagtgaattgaaaggaattggaggggaataaatcccttcataatcaaaattgaataaaagatgtttaatcctcctcaatttcctccgatctctgcgcggccgaataagacctagggtggggtcttgggaaggtatagccttgagggctaattggaaactcaaatcatcttcaggattggattcgaggggattgaggccccaatcccctccaatcttggaggagatttgagtttttaaactagccgtgacaaggggatatgcttataaaagaagtatcttgtggggaaatatcctgaaaagcagtcagctataaatgcaagcttgtcaaagcccgtacctgcatgtgctcaacatgcatgataccaccgcgaacataacttctgcaagtctaaaatgctgcatttgacttgtcgacaggtttgcaaatgtgaggaagcctgttttggtgtactcagatcaaactctagctgatgggctgcatattctctcaaaggaaaaaacgggggttgcagtcattgacaggaaaaccagccgtctaatcggatcattacagtgcagtgatctctacctgtttctagatgacagcacccttttcagcaagcgaacgtaagtactgccatctccttttgccaagttttccgaaataattaagaattcccctcgtatttcctgatccatacaggacaactactctggaagaattaattagcctgaataacaagaccgacaggaaatgcagcaccgctgaaaattcatgtgcgcctggccgaaacatcctcgcgctcaggagcaggcagtcaggcatggtgggcctaccagccaccaacctggaatccgacaccttaaagcaagcgatggagaagctgacaactttaaggagcagctgcagcttcatcgtcgacgagcacgggcgcgtccaaggagtggtgaccacaagggacatcatctccgtgttctccccgccgtgcatggactcgaggattgacggggccacgttcttctcggctgcgctcgagcaggctggctgccgcgttgagaacgggcagatgtttcagaat

SEQ ID NO: 2796 - DNA, 3887 bp, Zea mays subsp. parviglumis
gtatcctgtatgcgccatctgtcccggcgcacccgcagacgtgtcccggcaacctctcgcgaaactgcagaaggacgctgagtcgctgaaggagcagggcgaaaagctcagagacctgtccgttacacttgcaccgcagccagagtccgggagcgcagagatcgctggggagatggcgagagaagcagcgagcgaagccaccgcaagccgcgaaagcggggcggaggcggcaggggagtgctggagcgaagcgctcaagtcgttcctggaccacatccccgtctcctccgtcccgggcgcgctccaacccactgcctccccaggtatcacgacacgaggcacagagctgcttcctctcgcttcctgtatgtgtaggtaggcgttgggtcggacgaggacgatccattccattccatatacccgaccactaaccatctcgcgttcgtgtttgttccgcacgcagcggtggaggtcaagctccacggctccgtcctgggcgccctcgacgccatgtacagcagcaacgccgcgggcgcggtgatcatcgacgtggtgcacagcagtctaggcaagtacgtcgatcgcgatattggcttcgtcgagttctcgagcctagtcctgtgggcgcttgaggtaacctgacgatctaggagtacatgtttttcaattcactaattttttcggtttgccggcggagatcgaaacgttgctctgaatttcgtcttatagacagttcatgtggcctgtttttttttttggcgaagaatgaacgatcattacttttggttgccatccgatcttgacaaatccatctgttgcgttggccattcataggaacttggcaaagtggaaagtgaaccaacagacagtacttctgatttcctctctactctgaaacagcatcatcagattgcagaaacgaaggtactccacatatcgaatgtcacccttcacttatgtttgtacactggaatggatgggacatatatgtattctgaatgcctttctcttagcgaaataggacgaatggtggggataaaaatggtgattttttcttctatttttaacattgcggctgttactctgatgaaacaaaacagatcgcctggttagcgaagttgttcctgtgggagccattcttccctgttcggacccatgacacgctgttccacgcaatgcttctcttttcgaaacaccacaggctcaacgtggcaccggttgttgagtcaatgaactcgagtgttattggatttgtcacacaggtaactggtgccttccttgatgctctgtcagtgctctttttatgctcggtgattatggatacagaactcaatcgtgatgctgacggccggccgatgtattgcactaggatgcagtgatggagctgcttctccagtcaagtggccttgagtggcttgataaaattgcagacaagcagctttcggaatttaggtaagccctgagcctgaataagaagtgcttcagtacagttaggtgaaaatgcttaccatgattcagttgtatgcctaactactatttagaataccttgtatgcgtcatgaataggaaacaaatgtaaggaagtgaactgtgtgtatgaggtatgctttgtagtgcgaacaggtcaaatgcttcttaggtttcattaatttcttttttctagagcataaaaaggagcagattgactcccgcataagagcttgttcaattagaagtgaattgaaaggaattggaggggaataaatcccttcataatcaaaattgaataaaagatgtttaatcctcctcaatctcctcctatctctgagcggccgaataagacctagggtggggtcttgggaaggtatagccttgagggctaattggaaactcaaatcatcttcaggattggattcgaggggattgaggccgcaatcccctccaatcttggaggagatttgagtttttaaactagccgtgataaggggatatgcttataaaagaagtatcttgtggggaaatatcctgaaaagcagtcagctataaatgcaagcttgtcaaagcccgtacctgcatgtgctcaacatgcatgataccaccgcgaacataacttctgcaagtctaaaatgctgcatttgacttgtcgacaggtttgcaaatgtgaggaagcctgttttggtgtactcagatcaaactctagctgatgggctgcatattctctcaaaggaaaaaacgggggttgcagtcattgacaggaaaaccagccgtctaatcggatcattacagtgcagtgatctctacctgtttctagatgtcagcacccttttcagcaagcgaacgtaagtactgccatctccttttcccaagttttccgaaataattaagaattccccccgtatttcctgatccatacaggacaactactctggaagaattaatcagcctgaataacaagaccgacaggaaatgcagcaccgctgaaaattcatgtgcgcctggccgaaacatcctcgcgctcaggagcaggcagtcaggcatggtgggcctaccagccaccaacctggaatccgacaccttaaagcaagcgatggagaagctgacaactttaaggagcagctgcagcttcatcgtcgacgagcacgggcgcgtccaaggagtggtgaccacaagggacatcatctccgtgttctccccgccgtgcatggactcgaggattgacggggccacgttcttctcggctgcgctcgagcaggctggctgccgcgttgagaacggccagatgtttcagaactagtttcagacaaaactggaatgcagggaggctttagtttgttgcagtgaggaggaagatgtacatggtccttacaggtgctctggctcctgcacctctgcgagagcataggagttaaactttctagctcatgtaaatataaaacaatacctaaacggttagcgctgatggatttacaatttactgaatcttgtaccaactttgccaactttagcagctagtttcactgaagatgctttcatcgatcgaagacgatgtttcgtgctgaagccgtgctctcttttacgctaactatcttggtaactgtttcgcagtcactgatggttgcagcggttcggaacttcaggctggttcccaccgcagcctgtaccaaccggttactacgttgatcggttcagtctgtatcgatctaattagggctagtttaggattctatttttcaagaaaaaaatattactggaaaataaaaaccccttaagaaaataggttctcaaactatcctagctctgatgatgttagctttagattaaaactgactgtttagactgctacagttgtaatatataaagatgaaaacattatagagatagtataaatcggtacacattaaaaccaaactaacatacggtaatatcgaccacagcttctcaatcggtaccgaaatatttcggtcggtcggtatcgactggatagagacttgtcgtgttagcgtttatcctcacgtgcggcatttcggttatttttttttctaaaaatagtttgaaaccccaaaattctaaaaaaatatatatttatgaattatataatttctcagctaaaaaagtagtttgaaacccaaaaattctaaaatattggaaaattctaaaaaattatatttatgaattatgtaatttttcagcttgagaaaatatgtagtttttatttatattttataaattatgtatttttcacctgtattttatgaattatgtaaattttatttactcaattatgtagatgtagtcgactctatttttgttttagcaaaatgacgtgtttcatattaactaaagatctataaagaaaacttgatatgacgagtgatagtaaagactggaacgatatgatagttgggagc

SEQ ID NO: 2797 - DNA, 2526 bp, Zea mays
ggagcgaagcgctcaagtcgttcctggaccacatccccgtctcctccgtcccgggcgcgctccaacccactgcctccccaggtatcacgacacgaggcacagagttgcttcttctcgcttcctgtatgtgtcggtaggtgttgggtcggacgaggacgatccattccattccatatacccgaccactaaccatctcgcgttcgtgtttgttccgcacgcagcggtggaggtcaagctccacggctccgtcctgggcgccctcgacgccatgtacagcagcaacgccgcgggcgcggtgatcatcgacgtggtgcacagcagtctaggcaagtacgtcgatcgcgatattggcttcgtcgagttctcgagcctagtcctgtgggcacttgaggtaacctgacgatctaggagtacatgttttttcaagtcactaaatttttcggtttgccggcggagatcgaaacgttgctctgaatttcgtcttatagacagttcatgtggcctgttttttttttttggcgaagaatgaacgatcattacttttggttgccatccgatcttgacaaattcatctgttgcgttggccattcataggaacttggcaaagtggaaagtgaaccaacagacagtacttctgatttcctctctactctgaaacagcatcatcagattgcagaaacgaaggtactccacatatcgaatgtcacccttcacttatgtttgtacactggaatggatgggacatatatgtaatgtattctgaatacctttctcttagcgaaataggacgaatggtggggataaaaacggtgattttttcttctatttttaacattgcggctgttactctggtgaaacaaaacagatcgcctggttagcgaagttgttcctgtgggagccattcttccctgttcggacccatgacacgctgttccacgcaatgcttctcttttcgaaacaccacaggctcaacgtggcaccggttgttgagtcaatgaactcgagtgttattggatttgtcacacaggtaactcgtgccttccttgatgctctgtcagtgctctttttatgctcggtgattatggatacagaactcaatcgtgatgctgacggccggccgatgtattgcactaggatgcagtgatggagctgcttctccagtcaagtggccttgagtggcttgataaaattgcagacaagcagctttcggaatttaggtaagccctgagcctgaataagaagtgcttcagtacagttaggtgaaaatgcttaccatgattcagttgtatgcctaactactatttagaataccttgtatgcgtcatgaataggaaacaaatgcaaggaagtgaactgtgtgtatgaggtatgctttgtagtgtgaacaggtcaaatgcttcttaggtttcattaatttcttttttctagagcataaaaaggagcagattgactcccgcataagagcttgttcaattagaagtgaattgaaaggaattggaggggaataaatcccttcataatcaaaattgaataaaagatgtttaatcctcctcaatttcctccgatctctgcgcggccgaataagacctagggtggggtcttgggaaggtatagccttgagggctaattggaaactcaaatcatcttcatgattggattcgaggcgattgaggccccaatcccctccaatcttggaggagatttgagtttttaaactagccgtgacaaggggatatgcttataaaagaagtatcttgtggggaaatatcctgaaaagcagtcagctataaatgcaagcttgtcaaagcccgtacctgcatgtgctcaacatgcatgataccataacttctgcaagtctaaaatgctgcatttgacttgtcgacaggtttgcaaatgtgaggaagcctgttttggtgtactcagatcaaactctagctgatgggctgcatattctctcaaaggaaaaaacgggggttgcagtcattgacaggaaaaccagccgtctaattggatcattacagtgcagtgatctctacctgtttctagatgacagcacccttttcagcaagcgaacgtaagtactgccatctccttttgccaagttttccgaaataattaagaattcccctcgtatttcctgatccatacaggacaactactctggaagaattaatcagcctgaataacaagaccgacaggaaatgcagcaccgctgaaaattcatgtgcgcctggccgaaacatcctcgcgctcaggagcaggcagtcaggcatggtgggcctaccagccaccaacctggaatccgacaccctaaagcaagcgatggagaagctgacaactttaaggagcagctgcagcttcatcgtcgacgagcacgggcgcgtccaaggagtggtgaccacaagggacatcatctccgtgttctccccgctgtgcatggactcgaggattgacggggccacgttcttctcggctgcgctcgagcaggctggctgccgcgttgagaacgggcagatgtttcagaat

SEQ ID NO: 2798 - DNA, 2890 bp, Zea mays
ggagcgaagcgctcaagtcgttcctggaccacatccccgtctcctccgtcccgggcgcgctccaacccactgcctccccaggtatcacgacacgaggcacagagttgcttcctctcgcttcctgtatgtgtaggtaggcgttgggtcggacgaggacgatccattccattccatatacccgaccactaaccatctcgcgttcgtgtttgttccgcacgcagcggtggaggtcaagctccacggctccgtcctgggcgccctcgacgccatgtacagcagcaacgccgcgggcgcggtgatcatcgacgtggtgcacagcagtctaggcaagtacgtcgatcgcgatattggcttcgtcgagttctcgagcctagtcctgtgggcacttgaggtaacctgacgatctaggagtacatgttttttcaagtcactaaatttttcggtttgccggcggagatcgaaacgttgctctgaaattcgtcttatagacagttcatgtggcctttttttgtgtgaagagtgaacgatcattacttttggttgccatccgatcttgacaaattcatctgttgtgttggccattcataggaacttggcaaagtggaaagtgaatcaacagacagtactgatttcctctctactctgaaacagcatcatcagattgcagaaacgaaggtactccacatatcgaatgtcacccttcacttatgtttgtacactggaatggatgggacatatatgtaatgtattctgaatacctttctcttacgctccgtttggatcattagaatcgaattccattctaataatagtaattagccatatatcaattaagataatttggttttatacaaaatatatttgtatattattattagcaagatgtcgaagatatttatgtgttacatttttactataaaggagtgagacgaagagtgttgtataagttacatagtcgaaacaaattctactaatgaataaaatcattttccatcctccacccaataaatttgacatatgtttatatctgaactttggaatgtggtggaatgccaaatttcaaactaaataagttattttattgagtgaatttcaatttctctaaaatgaagggatctaaacgccccgttagcgaaataggacgaatggtggggataaaaatggtgatttttcttcttctatttttaacatgcggctgttactctgatgaaacaaaacagatcgcctggttagcgaagttgttcctgtgggagccattcttccctgttcggacccatgacacgctgttccacgcaatgcttctcttctcgaaacaccacaggctcaacgtggcaccggttgtcgagtcaatgaactcgagtgctattggatttgtcacacaggtaactggtgccttgcttgatgctctgtcggtgctctttttatgctcggtgattatggatacagaactcaatcgtgatgctgacggccggccgatgtattgcactaggatgcagtgatggagctgcttctccagtcaagtggccttgagtggcttgataaaattgcagacaagcagctttcggaatttaggtaagccctgagcctgaataagaagtgcttcagtacagttaggtgaaaatgcttaccatgattcagttgtatgcctaactactatttagaataccttgtatgcgtcatgaataggaaacaaatgtaaggaagtgaactgtgtgtatgaggtatgctttgtagtgcgaacaggtcaaatgcttcttaggtttcattaatttcttttttctagagcataaaaaggagcagattgactcccgcataagagcttgttcaattagaagtgaattgaaaggaattggaggggaataaatcccttcataatcaaaattgaataaaagatgtttaatcctcctcaatttcctccgatctctgcgcggccgaataagacctagggtggggtcttgggaaggtatagccttgagggctaattggaaactcaaatcatcttcaggattggattcgaggggattgaggccccaatcccctccaatcttggaggagatttgagtttttaaactagccgtgacaaggggatatgcttataaaagaagtatcttgtggggaaatatcctgaaaagcagtcagctataaatgcaagcttgtcaaagcccgtacctgcatgtgctcaacatgcatgataccaccgcgaacataacttctgcaagtctaaaatgctgcatttgacttgtcgacaggtttgcaaatgtgaggaagcctgttttggtgtactcagatcaaactctagctgatgggctgcatattctctcaaaggaaaaaacgggggttgcagtcattgacaggaaaaccagccgtctaatcggatcattacagtgcagtgatctctacctgtttctagatgacagcacccttttcagcaagcgaacgtgagtactgccatctccttttgccaagttttccgaaataattaagaattcccctcgtatttcctgatccatacaggacaactactctggaagaattaatcagcctgaataacaagaccgacaggaaatgcagcaccgctgaaaattcatctgcgcctggccgaaacatcctcgcgctcaggagcaggcagtcaggcatggtgggcctaccagccaccaacctggaatccgacaccctaaagcaagcgatggagaagctgacagctttaaggagcagctgcagcttcatcgtcgacgagcacgggcgcgtccaaggagtggtgaccacaagggacatcatctccgtgttctccccgccgtgcatggactcgaggattgacggggccacgttcttctcggctgcgctcgagcaggctggctgccgcgttgagaacgggcagatgtttcagaac

SEQ ID NO: 2799 - DNA, 3085 bp, Zea mays
tccccgtctcctccgtcccgggcgcgctccaacccactgcctccccaggtatcacggcacgaggcacagagctgcttcctctcgcttcctgtatgtgtaggtaggcgttgggtcggacgaggacgatccattccattccatatacccgaccactaaccatctcgcgttcgtgtttgttccgcacgcagcggtggaggtcaagctccacggctccgtcctgggcgccctcgacgccatgtacagcagcaacgccgcgggcgcggtgatcatcgacgtggtgcacagcagtctaggcaagtacgtcgatcgcgatattggcttcgtcgagttctcgagcctagtcctgtgggcgcttgaggtaacctgacgatctaggagtacatgtttttcaattcactaattttttcggtttgccggcggagatcgaaacgttgctctgaatttcgtcttatagacagttcatgtggcctgttttttttttttgggaaatttggatccataccattaaaagatcaccactttggatccataccattactatctcacttacatgtgggtccacatgagtcaatgacatgtggggtccatggtatatatctaaagtttggatcttttaatggtatagatccaattgttccttttttttttggcgaagaatgaacgatcattacttttggttgccatccgatcttgacaaattcatctgttgcgttggccattcataggaacttggcaaagtggaaagtgaaccaacagacagtacttctgatttcctctctactctgaaacagcatcatcagattgcagaaacgaaggtactccacatatcgaatgtcacccttcacttatgtttgtacactggaatggatgggacatatatgtaatgtattctgaatacctttctcttagcgaaataggacgaatggtggggataaaaaggtgattttttcttctatttttaacattgcggctgttactctgatgaaacaaaacagatcgcctggttagcgaagttgttcctgtgggagccattcttccctgttcggacccatgacacgctgttccacgcaatgcttctcttttcgaaacaccacaggctcaacgtggcaccggttgtcgagtcgatgaactcgagtgttattggatttgtcacacaggtaactggtgccttgcttgatgctctgtcggtgctctttttatgctcggtgattatggatacagcactcaatcgtgatgctaacggccggccggtcggcgtattgcactagaacgcagtgatggagctgcttctccagtcaagtggccttgagtggcttgataaaattgcagacaagcagctttctgaatttaggtaagccctgagcctgaataagaattgcttcagtacagttaggtgaaaatggttaccatgattcagttgtatgcctaactactatttagaataccttgtatgcgtcatgaataggaagcaacatatgcaaggaagtgaactgtgtgtatgtctgtatgaggtatgctttgtagtgcgaacatgtcaaatgcttcttaggtttcattaatctcttttttctagagcataaaaaggagcagactgagtgtggaggctcctacgtggccgtggaggcttgttcagttagaagtagattgaagggaattggaaggttcctagtcaaaattgactagaaggtgatttaaggagtgtttgaatacactagaactaatagttagttagctaaaaaaatgttagtgaaattagctagctaacaaatagctagctaactattagctaatttactaaaagtaggtaataactgaactattagctagaatgtttggatatctttatctaattttaacagttaactatttgttctagtacattcaaacacccctccaatctttgtgcgcccgaacaaggccctggggtggggtcttcggaaggtatttcccttgagggctaattggaaactcaaatctcctctatgattggattggagcggatttgagtttacaaactagccttttttattgaaaaatgtacagcaggggcctgatgtggtagatatttattaatataaagaagaaggcggacaaagagcattagcagtcgctcccaagacataaatcagaagaaatctaactaaagtacaaggaaaagaactatcgacataaatcagaagaaatctaactaaagtacaaggaaaagaactatctcctatctataggaatttaaaagagaggagaaaagagttgatttctcttcagaaaagcggttagcttgtagaagagcttcgacgcggaattcttttttcaagccttgagatggatatgtttatagaagaagtaacttgtcaaaacccgtacctgcatgtgctcaacatgcatgataccaccgcgaacataacttctgcaagtctaaaatgctgcatttgacttgtcgacaggtttgcaaatgtgaggaagcctgttttggtgtactcagatcaaactctagctgatgggctgcatattctctcaaaggaaaaaacgggggttgcagtcattgacaggaaaaccagccgtctaattggatcattacagtgcagtgatctctacctgtttctagatgacagcacccttttcagcaagcgaacgtgagtactgccatctccttttgccaagttttccgaaataattaagaattcccctcgtatttcctgatccatacaggacaactactctgggagaatttatcagcctgaataacaagaccgacaggaaatgcagcaccgctgaaaattcatgtgcgcctggccgaaacatcctcgcgctcaggaacaggcagtcaggcatggtgggcctaccagccaccaacctggaatccgacaccctaaagcaagcgatggagaagctgacagctttaaggagcagctgcagcttcatcgtcgacgagcacgggcgcgtccaaggagtggtgaccacaagggacatcatctccgtgttctccccgccgtgcatggactcgaggattgacggggccacgttcttctcggctgcgctcgagcaggctggctgccgcgttgagaacgggcagatgtttcagaat

SEQ ID NO: 2800 - DNA, 1311 bp, Oryza sativa Japonica Group
ctgaacagtagtactacagagtctcactcacggcgttggacatggagactggagcggcgggacaggccggcggcggaggaccggcggcggcggcggcggcgggggagtactggagcgaggcgctcaagtcgttcctggaccatatccccgtctcgtccgtcaacggcgcgatccagccctctccctccccagcgctggagatcaggctcgatggctccgtgccggacgccatcgactccatgtaccgcagcgatgtcgccggcgcggtgatcgtcgacgatgtgcggactagtttcggcaagttcgtcgatcgcgacataggattcgtcgagttcccaagcctcgtcttgtgggcgattgaggaatttgacaaactgggaagtggagcaggtgacaaaaactccgacttcctgacaagtctaaaacagcatcctcagattgcagaaacaaagattgcctggttagcaaagtcgttcctatgggagccattcttccccgttcgatcccatgatacactcttccatgcaatgcttctcttctcaaagcaccgcaggatcaatgtggtacctgttgttgagttgatgaactccagtgttattggatttgtaacgcagaatgcagtaatggaattgcttctcagttcaagtggtcttgagtggctcgataaaattgcagacaaacaactttctgaatttaggttcgcaaatacgaccaagcctgtttcagtctactcggatcagactctcgctgatgcattgcatattctttcaaaggagaaaataggagttgcagttgttgacaggaaaaccagttgtctgattggatcaatacagtgcagcgatctttatcagcttctggacgatagctccctatttaggaacaggaagacattaagtgcggaagaattcgtcaaactgaagagcaaggatgaggacatcagcacagaaaattcatcagcttctggtggccaaaatgtcctcagcctcagaacagggcagaggataacagcaggcctgcctgttaccaaccgcaagtctgacaccctgaagcaagcaatggagaagctgacagcgtcaagaagcagctgcagcttcatcgtcgacgagcacgggcgagtcgaaggagtagtcacggcaagggacatcatctccgtcttctccccgccatgcatggactcgaggatcgacggaggcaccttcttctcggctgcgcttgcgcagaccggctgccgcgttgagcatgggcagatgattcagaactcatagtttctacctcatcatctaaaacaatgtttacagttttgttgcctgc

SEQ ID NO: 2801 - DNA, 1080 bp, Sorghum bicolor
atggcgagagaagcagcgagcaaagccaccgcaagccgcggcagcggggcggaggcggaggcggaggcggcagcgggggagtactggagcgaagcgctcaagtcgttcctggaccacatccccgtctcctccgtcccgggcgcgctccaacccaccgcctccccagcggtggaggtcaagctcgacggctccgtcctgggcgccctcgacgccatgtacagcagcaacgccgcgggcgcggtgatcgtcgacgtggtgcagagcagcttcggcaagtacgtcgatcgcgatattggcttcgtcgagttctccagcctagtcctgtgggcgcttgaggaacttggcaaagtggaaagtgaaccaacagacggtacttctgacttcctctctagtctaaaacagcatcatcagattgcggaaacgaagaatgcagtgatggagctgcttctccagtcaagtggccttgagtggcttgataaaattgcagacaagcagctttctgaatttaggtttgcaaatgtgaggaagcctgttttggtgtactcagatcaaactcttgctgatgggctgcatattctctcgaaggaaaaaatgggggttgcagtcattgacaggaaaaccagctgtctaattggatcaatacagtgcagcgatctctacctgtttctggatgatagctcccttttcagcaagcgaacgacaactactttggaagaattcatcgacctgaataacaaggccaacagcaaatgcagcactgctgaagattcatctccacctggtcagaacatcctcgccctcagaaacaggcagccaagtatggtgggcctaccagccaccaacctgaaatccgacaccctgaagcaagcgatggagaagctgacgacttcgaggagcagctgcagcttcatcgtcgacgagcaagggcacgtcgaaggggtggtgacgacaagggacatcatctccgtgttctccccgccgtgcatggattcgaggattgacgggggcacgttcttctcggctgcgctcgagcaggctggctgccgcgttgagaatgggcagatgattcagaactcctag

SEQ ID NO: 2802 - DNA, 2247 bp, Sorghum bicolor
atgaacccgttatgctgcatcgcgccggtctcgctcgagcacgctgcggaccagctccacgagcacccgacgcgcatccacgccggcgccccgccgccgacgccggccccccagcaggatgcggttgcgggggtgctgcacaagtgggtcaactacgggaaggggtggcggtcgcggtggttcgtgctcgaggatggggtgctatcctactacaagctccgaggcagcggaggggcaggcggagctggtgctggggaggtggccgcgtcgtccgctgctgctgcagccagagtgatcggggacgggagtgcgctgcagcaggcgcaggaggtggccgcgggggcaggaaagctgtggaagccattcggcgagatacacctcaaggtctcatctgttcgtgcaagcaaatctgatgataagaggctgtacatattcagtggaacgaagactctacacttgaggtgtgaaactgaggaagataggaatgcgtggatagatgcattgctggcagcaaaggatcagttcccacggtcactgactattagtgatcttggtccggcagacattatgttgtcctttgagaagcttagggcacggctgctgcaggagggtctgagcgaagcagtggtcagggagtgtgagtctatcattatgagcgagctgctggaactgcacaagcagataaagtctcagcagcagcagcattctattttgatagaccgcctccggcaactggagacggagaaagttgagctggagagaacagttgtccatgagactaaggagcgggaaacacttggctatgctaacagaagacaaagtgatttctattcagttttatcaggaggaagtacaactgaatcagaccctgacactgcaagccacatggctgaagttgaaactgaggaagatgaagttacatactttgatacaagagactttttatctgtagagtctttacggagtgcttcatgtcaaaggagggaactaactgcactaggttttggatcagaatatgttggagtttctgttacaaatactgtcaaaactactaaatatccctttgtgctacgtagggataagctaccagagcctaaggaaaaagagaagcatataggattatggtcaataattagagaaaatatagggaaagacctttcaggtgtttgtctacctgtttatttcaatgagcctctttcttctttacaaaaatgttttgaagatttggagtactcttacttggttgaccatgcactacactggggaaaacagggtgacagcttaatgaggatacttcatgtagcagcatttgcagtatcaggttatgcttcaaccgaaggtcggcaatgcaaacccttcaatcccctactgggggaaacatatgaagcggactatccggataaaggacttcgttttttctctgaaaaggtcagtcatcacccaatggttgttgcatgccactgtgacggtagaggttggagattctggggtgattccaatctgaaaggaaagttctggggtcgatccattcagcttgacccaataggcgttcttaccctccaatttgatgatggagaaacatttcagtggagtaaagtgactacttccatttacaatatcataattggcaaaatttactgtgatcattatggcacaatgcgcatcaatggaagtggccagtactcctgcaagcttaaatttaaagaacagtcaattatagatcgcaatccacaccaggtgcacggatttgtgcaagataatagaacagggcaaaaagtagctatgttaattggaaaatgggatgaagctatgtattatgtccttggggatccaagtgttaatcccaaggggtatgacccaatgtcagaagcagttcttttatgggagagagacaagtctcttaatcagacacgttacaatctttctccttttgcaatttctctaaatgaattgacaccacatttgttgaacaagttggctcctactgattctcgtttgagaccagaccaaaggcatctggaaaatggtgaatatgagatggcaaatgcagagaaagttaggcttgaagaactgcaacggcaggctcgacaactgcaagaaaaaggatggagaccaaggtggtttaagaaggattttgatggcagttaccgctatgtgggtggatactgggaagcgagggagaaggggaactgggacggtattccggacatctttgcccagaatagtttgtctacatggctgcactaa

SEQ ID NO: 2803 - DNA, 2825 bp, Zea mays
ctccgacagccacttcgctgctgctgctatgtcctgcgcgcagccgatgcggcgccgatctccatggttgtgcgaaacctaggcggcgggcgcgagcgaggccacaaggcggcatctgcctcctgagtggggagcgggctcccccgatccacatcgtgcgggctggtggctgcgtcgcgatgaacccgttatgctgcatcgcgccggtctcgctcgagcacgctgcggatcagctccacgagcacccgcagcgcatcctcgctggtgcaccgccggcgacgccggccccaaagcaggatgcggttgtgggggtgctgcacaagtgggtcaactatgggaaggggtggcggtcgcggtggttcgtgctcgaggatggggtgctatcctactacaagctccgcggagctggtgctgggggggtagccgtgtcgcccgctgctgctgcagccagagtgatcggggacgggagtgccgtgcagcaggcgcgggaggtggccgcgggggcaggaaagctgtggaagccgtttggcgtgatacacctcaaggtctcgtctattcgtgcaagcaagtctgatgataagaggctgtacatattcagtggaacaaagacactacatttgaggtgtgaaactgaggaggataggaatgcgtggatagatgcattgctggcagcgaaggatcagttcccacggtcacagactagcaatgatgttggttctatggcagatattatgttgtcctctgagaagcttagggcacggctgcttcaagagggtctgtgtgaagcagtggtcagggagtgtgaatctattatgatgagtgagctactggaactgcacaatcatataaagtctcagcagcagcagcattctattttgatagaccgccttcggcaactggagacggagaaagttgaactggagagaacagttgtccatgagactaaggagagggaaacacttggctatgccaacagcagacaaagtgatttctattcagttttatcaggaggaagtacaactgaatcagaccctgacactgcaagccacatggctgaagttgaaactgaggaagatgaagttacatactttgatacaagagactttttatctgcagagtctttacggagtgcttcatgtcaaaggagggaactaattgcacatggttttggatcagaatatgttggagattctgttacaaatactgtcaaaactactaaatatccctttgtgttacgtagggataagctaccagagccgaaggaaaaagagaaacatataggattatggtcaataattagagaaaatatagggaaagacctgtcaggtgtttgtctacctgtttatttcaatgaacctctttcttctttacaaaaatgttttgaagatttggagtactcttacttggttgaccatgcactacactggggaaaacagggtgacagcttaatgaggatacttcatgtagcagcatttgcagtatcaggttatgcttcaaccgaaggtcggcaatgcaaacccttcaatcccctactgggggaaacatatgaagctgattatccagataaaggacttcgttttttctctgaaaaggtcagtcatcacccaatggttgttgcatgccactgtgacggcagaggttggagattctggggtgattccaatctgaaagggaagttctggggtcgatccattcagcttgacccaataggcgttcttacgctccaatttgatgacggagaaacatttcagtggagtaaagtgactacttccatttacaatatcataattggcaaaatttactgtgaccattatggcacaatgcgcatcaatggaagtggccagtactcctgcaagcttaaatttaaagaacagtcaattattgatcgcaatccacaccaggtgcatggatttgtgcaagataatagaacagggcaaaaagtagctatgttaattggaaaatgggatgaagctatgtattatgtgcttggggatccaagtgttaaacccaagggatatgacccaatgtcagaagcagttcttttatgggagagggacaagtctcttaatcagacacgttacaacctttctccttttgcaatttctctaaatgaattgacaccacatttgttgaacaagttggctcctactgattctcgtttgagaccagaccaaaggcatctggaaaatggtgaatatgagatggcaaattcagagaaacttaggcttgaacaactgcaacggcaggcacgacaactgcaagaaaaaggatggagaccaaggtggtttaagaaggatgatggcgacagttaccgctatatgggtggatactgggaagcgagggagacggggaactgggacggtattccggacatctttcgccagaatagtttgtctccaggactgcactaactacccttcttccctatgttatacttgtgtatctccaccaaacatttaacgaagttatggtggcaacaaggcagagccaaagcatagcgtttcttcgtgggcatggtcaacctcgtgtcggctggggttggacaagtggttggaaacgtaggtttcatttttgaatttcaggactaattttgtcttggaatgcggttagtttagatttgttttttatgccttggcggctaatccacggatggtaggctttgccgcgcgctctagtgtcttgggccatgtatggagtattatctatggacatcgggtgatttcaatcgtcgtcacaatacttcttgactgttacaatcgaatttacacaacataagatgtgatatctggctcaatttggattgaatctataattgtccttgtgtc

SEQ ID NO: 2804 - DNA, 2786 bp, Oryza sativa Japonica Group
attactccgccacacccaagccacggtacggcctcctccgccgcggcgatctccatggcctcgcaaaccctagccaccggcggcggcggcggcggtggaggcggcgcggcattcttctgagaggctccgatccgggggcggagggtggtggtggggggtttcgtcgatgaacccgctctgctgcatcgcgccggtctcgctcgacagcgccgtcgagcaccaccaccagccgccgcgcatcctcgcggcggcggccgcggcgccgacgtcgcccactccgccagcggcggcggtggctgcgcaggtggtgctggatgcggcgcaggcggcggttgcgggggtgctgcacaagtgggtgaactacgggaaggggtggcggctgaggtggttcgtgctcgagggcggggtgctgtcctactacaagctccgggttggagggggcggtgattccgcggcgtcgccggcggtggcggcgagggtgatcggggagggtggcgcgctgcggcgggcgcgggaggaggccgcggcggcggggaagcagtggaagccgttcggggagatacacctcaaggtttcgtcaatccgtgcaagcaagtcggatgataagaggttgtatatattcagtggaacaaagacgttacacttgaggtgtgaaactgaggaagataggaatgcctggatacaggctctgcaagcggcaaaggatcgcttcccacgttcactaacgagcaatgattttagtcccatgtctgatgttttgttgtccacggagaagctgagggtgcggctgctgcaggaggggctgaatgaaacagtggtcaaggaatgtgagtctattatgatgactgagcttttggaactgcacaaccagatgaagtcacagcagcagcagtattctattttgatagatcggctccgacaactagagacagagaaagttgagctggagagaactgttgtgcatgaaactaaggagagggaagcacatggatatgctaatggcagatatagtgatttttattcagttttatcaggaggaagtgcaagcgagtctgatccagatactgcaagtcaagtggcagatgttgaaactgatgaagatgaagtgatgtactttgatacaagagacttcttgtctgcagagtctcttcgaagtgcttcatgtcgaaggagagaacttttgacaaatggttgcaatggattagaacatacagaccctgctgcaaatgtcgtcaaaactactcagtatccctctgttaaacgtcgagataagttacctgagccaaaagaaaaagaaaacccagtagggttgtggtcaataattaaagaaaatattggaaaagatctctcgggtgtttgtctgcctgtttatttcaatgagccactgtcttctttgcaaaaatgttttgaagatctcgagtactcttacttggttgaccatgcactacagtggggaaaacagggcgatagcttgatgaggacacttcatgttgcggcatttgcagtatcaggctatgcttcaactgaaggtcggcaatgcaaaccgttcaatcctttactgggtgaaacatatgaagctgattatccagataaaggacttcgatttttctctgaaaaggtcagtcatcacccaatggttgttgcatgtcactgtgaaggaagaggttggaagttttggggggattcaaatctgaaagggaagttctggggtcgatcaattcaacttgatcctattggtgttctaactctccagtttgatgatggggaaacgtttcaatggagtaaagtaactacttccatatacaatatcataataggcaaaatttattgtgaccactatggtacaatgcgcatcaaaggaagtggcgactactcttgcaagcttaaattcaaagagcagtcaataattgatcgaaacccacaccaggtgcatggatttgtgcaagataatagaacagggcagaaagttgctatgttaatcggaaaatgggatgaagctatgtattatgttcttggggatccaagtgcaaaacccaaggggtatgacccaatgtcagaagcagttcttttgtgggagagagacaagtctctgaaccaaacacgatacaacctttccccttttgcaatttcactaaatgaattgacagctaacctggcgaagaagttgcctcctactgattctcgtctgaggcctgatcaaaggcatcttgaaaatggtgaatatgagatggctaatgcagagaaacttaggcttgaacaactgcagcgacaggcccgaaggttacaagagaaaggatggcaacccaggtggtttagcaaggatgacgacgacagctaccgctacattggcggttactgggaagcaagggagaaggggaactgggatgggattccagacatcttcggtcagcgcagcgcttcacctgggtggtcatagcttacctaccccctctccctgtgtagtgtaatcccacatttctttacagaaaaaaagtatgttaccttctatatatacatatattgaagcaatgtccatatgtgtgccgatgtactggattcagagagccgagatgtactggtaaaaacacggcaagattacgttagtaggaattcggaccccaagtaggttagattaatccaaagtttgagtataattttattgtcggccagaagatgtcctggttttgaggctactcttgtacatttaaattttctcaactcacgagtacttgagagctgtttcctgctagaacctcaagtacaaggcaatatattagttgtttcct

SEQ ID NO: 2805 - DNA, 2638 bp, Vitis vinifera
atgaatccgctgtgctgcattgctccggtttccatcgatcgggaccgggccaacccgggtccgtgtcagttagggctggagagttcagtgaagaatgttaacatcggttccaagcagggattctcagctcaagtttcgtcgatcaatgctgagtcggatgcggtgagccacgatgttgaggacgcttttccggaggccagggacgggaaggtgttcggtgcaggtggaggcgtggctgggattctctacaagtgggtgaattacggcaagggttggaggtcgaggtggttcgtgcttgaagatggggttctttcgtattacaagattcatggtccggacaagattttgatgagtccagcaagggagaagagcttgaaggtaattggagaggattcattgaggtgtatgaagaagaacagttggagtaatcatcaccgtcttgctgggtctgcgaagcagtggaagccgtttggggagattcatttgaaggtgtcctcaattcgtgcaagcaaatcagatgataaaaggctgtccatattcacgggaacaaaaactcttcacttgcgttgcatatctagggaggatagatctgcatggattgaggcactgcaggctgctaaagatcttttccctagagttttgacaagcagtgattttgcaccatctgaagatattgttgtttcaactgagaagctacgtttacgattagtgcaggaaggtgttggtgaggtagtcattaaagactgcgaatctatcatgctttccgaactctctgagctgcaaaatcagtttaaggctcttcaacggaagcatattatcctgctagatacattgagacagttggagacagagaaaatagaactggaaactactgtagtggatgaaacaaaggaacgggagtcatactgtggccaaggaaatagaagattcagtgacttctattctatcatgtcagagggcagtggaagtgattctgatgcagataatgaaagtcaggatggagtagatgttgaaactgatgaagatgatatagtatttttcgacacaaatgattttttgtcttcagaatctcttagaagtgcttcttacaggagcagagaaaccttgggaaatgggactttgataaataatagagatcctttcctttctgatcatttgcatgatgagatggagatcaggacagttgaatatccatacatcaaaagaagggatagtttgccagaaccaaaggagaaagagaagccagtcggtctatggtcaataatcaaggataatattggaaaggacctgtctggagtttgtctccctgtttacttcaatgaaccactttcttcattgcagaagtgctttgaagatttggagtattcctacttggttgatcgagcaatggaatggggaaagcagggaaatgacttgatgagaattctgaatattgccgcttttgctgtatctggctatgcatcaacagaaggtcggcagtgcaaaccctttaatcctctccttggggaaacctatgaggctgattatcctgataaaggtcttcgcttcttctctgaaaaagtgagtcaccacccaatgattgttgcttgccactgtgaggggagaggctggaagttctgggcagactctaatctcaaagggaagttctggggccgttccattcagcttgatcctgtgggtgtccttaccctgcagtttgatgatgatgagacattccaatggagcaaagtcactacttctatatacaatatcatactaggtaaaatctattgtgatcactatggaaccatgcgcatcaagggcagtggaaattactcctgtaagctgaagttcaaggagcagtctattatagaccgaaatccacatcaggttcatggatttgtgcaagataatcgaactggagagaaggtagctatgttggtggggaaatgggatgaggcaatgtattatgtgttgggagatccaacaacaaagccaaaagggtatgatccaatgacagaagctgtgttgctgtgggaaagagaaaaatttgttaccaagacaagatacaacctcacaccttttgcaatatctttaaatgaactgacaccaggcttattggaaaaattgccacctactgactcaaggctgcggccagatcagaggcatttggagaatggagaatatgagctggcaaatgcggagaagctcagactcgaacacttgcagagacaggcaagaaagttgcaggaaagggggtggcagcctagatggttccgtaaggacaaggaggatggttgttaccgttacataggtggatactgggaaacaagagagaaaaggtactgggatgggattccaaatatatttggccagggtagtgattcaccctcatgtttaatagaggagtaaatcttgtaatggcccagcttgcttcaagttgttttggttcccttgtatggtatcttttttactctgcttattcggggaacattttagtggctggtttagatgtagcacttgtttaagttataaagaagctcctttaaggtgcaatgtgtagttctccaggagatcggttttgacttttccaaagtttgttctgacatactgtcaggggtgtacgaggcagtaactatattcatacttcctttcacca

SEQ ID NO: 2806 - protein, 462 aa, Oryza sativa Japonica Group
MAVTIQSVKARQIFDSRGNPTVEVDVGLSDGSFARGAVPSGASTGIYEALELRDGGSDYLGKGVLKAVSNVNTIIGPALIGKAVSNVNTIIGPALIGKDPTEQVDIDNFMVQQLDGTSNNWGWCKQKLGANAILAVSLAVCKAGAMVKKIPLYQHIANLAGNKTLVLPVPAFNVINGGSHAGNKLAMQEFMILPTGASSFKEAMKMGVEVYHHLKSIIKKKYGQDATNVGDEGGFAPNIQENKEGLELLKAAIAKAGYTGKVVIGMDVAASEFYSEKDKTYDLNFKEDNNDGSHKISGDSLKDVYKSFVSEYPIVSIEDPFDQDDWATYAKLTDEIGQQVQIVGDDLLVTNPTRVAKAISEKTCNALLLKVNQIGSVTESIEAVRMSKRAGWGVMASHRSGETEDTFIADLSVGLSTGQIKTGAPCRSERLAKYNQLLRIEEELGDAAVYAGEKFRAPVEPY

SEQ ID NO: 2807 - protein, 446 aa, Oryza sativa Japonica Group
MAVTIQSVKARQIFDSRGNPTVEVDVGLSDGSFARGAVPSGASTGIYEALELRDGGSDYLGKGVLKAVSNVNTIIGPALIGKDPTEQVDIDNFMVQQLDGTSNNWGWCKQKLGANAILAVSLAVCKAGAMVKKIPLYQHIANLAGNKTLVLPVPAFNVINGGSHAGNKLAMQEFMILPTGASSFKEAMKMGVEVYHHLKSIIKKKYGQDATNVGDEGGFAPNIQENKEGLELLKAAIAKAGYTGKVVIGMDVAASEFYSEKDKTYDLNFKEDNNDGSHKISGDSLKDVYKSFVSEYPIVSIEDPFDQDDWATYAKLTDEIGQQVQIVGDDLLVTNPTRVAKAISEKTCNALLLKVNQIGSVTESIEAVRMSKRAGWGVMASHRSGETEDTFIADLSVGLSTGQIKTGAPCRSERLAKYNQLLRIEEELGDAAVYAGEKFRAPVEPY

SEQ ID NO: 2808 - protein, 446 aa, Zea mays
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 2809 - protein, 446 aa, Zea mays
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDNTYDLNFKEENNDGSKKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWEVMASHRSGETEDTFIADLSVGLSTGQIKTGAPCRSERLAKYNQLLRIEEELGDAAVYAGAKFRAPVEPY

SEQ ID NO: 2810 - protein, 446 aa, Zea mays
MAATIQSVKARQIFDSRGNPTVEVDVFCSDGTFARAAVPSGASTGVYEALELRDGGSDYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPY

SEQ ID NO: 2811 - protein, 446 aa, Zea mays
MAATIQSVKARQIFDSRGNPTVEVDVFCSDGTFARAAVPSGASTGVYEALELRDGGSDYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVASSEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPY

SEQ ID NO: 2812 - protein, 445 aa, Populus trichocarpa
MVTIKAVKARQIFDSRGNPTVEADILLSDGSYARAAVPSGASTGVYEALELRDGGSDYLGKGVLKAVGNVNSIIGPALIGKDPTEQVQIDNFMVQELDGTVNEWGWCKQKLGANAILAVSLAVCKAGAMVKKIPLYQHIANLAGNKTLVLPVPAFNVINGGSHAGNKLAMQEFMILPVGASSFKEAMKMGVEVYHHLKSVIKKKYGQDATNVGDEGGFAPNIQENKEGLELLKTAIAKAGYTGKVVIGMDVAASEFYNDKDKTYDLNFKEENNDGSQKISGDSLKNVYKSFVADYPIVSIEDPFDQDDWEHYAKMTGEVGEQVQIVGDDLLVTNPKRVEKAIKEKSCNALLLKVNQIGSVTESIEAVKMSKHAGWGVMASHRSGETEDTFIADLSVGLSTGQIKTGAPCRSERLAKYNQLLRIEEELGSAAVYAGAKFRAPVEPY

SEQ ID NO: 2813 - protein, 446 aa, Zea mays
MAATIQSVKARQIFDSRGNPTVEVDVFCSDGTFARAAVPSGASTGVYEALELRDGGSYYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPY

SEQ ID NO: 2814 - protein, 445 aa, Elaeis guineensis
MATIKCIKARQIFDSRGNPTVEVDCCLSDGTFSRAAVPSGASTGIYEALELRDGGSDYLGKGVLKAVTNVNSIIGPALIGKDPTAQAEIDTFMVQQLDGTSNEWGWCKQKLGANAILAVSLAVCKAGASVKKIPLYQHIANLAGNKNLVLPVPAFNVINGGSHAGNKLAMQEFMILPVGASSFKEAMKMGVEVYHHLKAVIKKKYGQDATNAGDEGGFAPNIQENKEGLELLKTAIAKAGYTGKVVIGMDVAASEFYSDKDKTYDLNFKEENNDGSQKISGDSLKNVYKSFVSGYPIVSIEDPFDQDDWTHYAKMTEEIGEQVQIVGDDLLVTNPTRVAKAIKEKTCNALLLKVNQIGSVTESIEAVKMSKRAGWGVMTSHRSGETEDTFIADLAVGLATGQIKTGAPCRSERLAKYNQLLRIEEELGAAAVYAGAKFRAPVEPY

SEQ ID NO: 2815 - protein, 449 aa, Hordeum vulgare subsp. vulgare
MAAAAATIQSVKARQIFDSRGNPTVEVDVCCSDGTFARAAVPSGASTGVYEALELRDGGSDYLGKGVSKAVGNVNSIIAPALIGKDPTAQTELDNFMVQQLDGTKNEWGWCKQKLGANAILAVSLAVCKAGASVKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGEQVQIVGDDLLVTNPTRVAKAIQEKSCNALLLKVNQIGSVTESIEAVKMSKHAGWGVMTSHRSGETEDTFIADLAVGLSTGQIKTGAPCRSERLAKYNQLLRIEEELGDAAVYAGLKFRAPVEPY

SEQ ID NO: 2816 - protein, 318 aa, Zea mays
MAAAWAVLALFLVAAQVAAAAPVTAPAFLWAPKNYGFSSDDAKEVVHYQTISPKSLAKSVLEEGGWSNFMCSREDTQNNVDVAIVFIGSKLQSSDISKDKQVDPALADTLKLSFTRSEFSMAFPYVSTTVDERLEDSLLSSFAENCNNGFGRNRVTYTDTCTGQDLKKYHNMDAINDLVVSGVASRRVNHPSGQTDVIVFCSGGFENPGTAKSEGELLSQLVDLLDLSGAKYTVLYASQPSGLLESPSGLPLGRHLAEKKTNGTKAVQGEKCDGECLVKSSLLEGTFVGIVLLIILISGLMCMMGIDTPSRFEAPQES

SEQ ID NO: 2817 - protein, 318 aa, Zea mays
MAAAWEVLAVLLVAAQVASAAQVTAPAFLWAPKKYGFSSDDAKEVVHYQTISPKSLAKSVLEEGGWSNFMCSREDTQNNVDVAIVFIGSKLQSSDISKDKQVDPALADTLKLSFTRSEFSMAFPYVSTTVDERLEDSLLSSFAENCNNGFGRNRITYTDTCTGQDLKKYHNMDAINDLVVSGVASRRANHPSGQTDVIVFCSGGFENPGTAKSEGELLSQLVDSLDLSGAKYTVLYASQPSGLLESPSGLPLGRHLAEKKTNGTKAVQGEKCDGECLVKSSLLEGTFVGIVLLIILISGLMCMMGIDTPSRFEAPQES

SEQ ID NO: 2818 - protein, 315 aa, Zea mays
MAAAWAVLAAVLVAAQVASAAPVTAPAFLWAPKNYGFRSDDAKEVVHYQTISPKNLAKSVLEEGGWSTFMCSREDTEKHVDVAIVFIGSKLQSSDISKDKQVDPALADTLKLSFTESEFSMAFPYVSTSDDEKLEESLLSGFTENCKSGFGRNRITYTDTCAVSGQDLKTYHNMDAINDLVVSGRTNPSGQTDVIVFCSGGFEKLGTTESEGELLSQLVDLLKLSGARHTILYASQPSGYLLENPSGSPVARHLAERTNGTKTGLLSKCDGECLVKSTLLEGTFVGIVLLIILISGLMCMMGIDTPSKFEAPQES

SEQ ID NO: 2819 - protein, 317 aa, Sorghum bicolor
MAAAWAVLAVLLVAAQVASAAPVTAPAFLWAPKNYGFRSDDAKEVVHYQTISPKSLAKSVLEEGGWSNFMCSREDTQKSIDVAVVFIGSKLQSSDISKDKQDDLTLADTLKLSFTDSEFSMAFPYVSTSDDEKLENSLLSSFAENCNSGFGRNRITYTDTCTVSGQDVKKYTNMDAIDDLVRYGVGSRRINPSEQTDIIVFCSGGFENFFTPKSEGELLSQLVLLLEQSGAKYTILYASQPSGLLENPSSLPLGRYLAEKTKGTKTGEGKCDGECLVKSTLLEGTFVGIVLLIILISGLMCMMGIDTPSRFEAPQES

SEQ ID NO: 2820 - protein, 312 aa, Oryza sativa Japonica Group
MAAAWAAVVAVMLLLAQVSAAAPVMGPAFLWAPKNYGFSSDEAKEIVHYQTVSPKSLVKSVLEEGGWSNLVCSREDHAKSVDVAVLFLGSKLQSSDISKDKQADSTLVDTLKNSFASSEFSMAFPYIAMSDDDKLEKSLLSGFAENCNNGFGDNHITYTDTCSVSEDLNKHHNMDSIHGLVASQTKKNPSGQTDLIVFCDGGFKDNTKSEGELLSELVTLLKKSGAKYTILYASQPFGLLENPSNLPLGRYLAEKTNTTKPGRGKCDGECLVKSTLLEGSFVGIVLLIILISGLKCMMGIDTPSKFDAPPES

SEQ ID NO: 2821 - protein, 312 aa, Oryza sativa Indica Group
MAAAWAAVVAVMLLLAQVSAAAPVMGPAFLWAPKNYGFSSDEAKEIVHYQTVSPKSLVKSVLEEGGWSNLVCSREDHAKSVDVAVLFLGSKLQSSDISKDKQADSTLVDTLKNSFASSEFSMAFPYIAMSDDDKLEKSLLSGFAENCNNGFGDNHITYTDTCSVSEDLNKHHNMDSIHGLVASQTKKNPSGQTDLIVFCDGGFKDNTKSEGELLSELVTLLKKTGAKYTILYASQPFGLLENPSNLPLGRYLAEKTNTTKPGRGKCDGECLVKSTLLEGSFVGIVLLIILISGLKCMMGIDTPSKFDSPPES

SEQ ID NO: 2822 - protein, 803 aa, Sorghum bicolor
MAAASAAVRMLPDGGADDEERWLAEGIAGVQQNAFYMHRALDSNNLKDALKYSAQMLSELRTSRLSPHKYYELYMRAFDEMKKLEMFFREETRRGSCSVVDLYELVQHAGNVLPRLYLLCTVGSVYIKSKEAPAKDVLKDLVEMCRGIQHPLRGLFLRSYLSQISRDKLPDIGSEYEGDAESINDAVEFVLQNFIEMNKLWVRMQHQGPVREKEKRGKERNELRDLVGKNLHVLSQIEGVDLDMYKETVLPRILEQVVNCKDDLAQFYLMDCIIQVFPDEYHLQTLETLLSAFPQLQPSVDIKTVLSQLMDRLSNYAASSPEVLPEFLQVEAFAKFSSAIGKVIEAQPDMPVVGAVTLYVSLLTFTLRVHPDRLDYVDQVLGACVKKLSGKAKLEDSRATKQIVALLSAPLEKYSNIVTALELSNYPRVMDYLDNATTKVMAVVIIQSIMKNTTCISTSDKIESLFDLIKGLIKDMDGAQDDELDEEDFKEEQNSVARLIHMLHNDDPEEMLKILCTVQKHILQGGPKRLTFTVPSLVFSALKLVRRLQGQDGDVTGEDVPATPKKIFQILHQTIEALSCVPSPELALRLYLQCAEAANDCDLEPVAYEFFTQAFILYEEEIADSKAQITAIHLIIGTLQRMNIFGVENRDTLTHKTTGYSAKLLKKPDQCRAVYACSHLFWTDDQDGIMDGERVLLCLKRALRIANAAQQMASATRGSSGSVTLFIEILNKYLYFFEKGIPQITNTVIQDLIELIRTEKQSDNSVADPSTEAFFSSTLRYIEFQKQKGGSIGEKYEQIKTSS

SEQ ID NO: 2823 - protein, 803 aa, Zea mays
MAAASTSVRVLPDGGADDEERWLAEGIAGVQQNAFYMHRALDSNNLKDALKYSAQMLSELRTSRLSPHKYYELYMRAFDEMKKLEMFFREETRRGSCSVVDLYELVQHAGNVLPRLYLLCTVGSVYIKSKEAPAKDVLKDLVEMCRGIQHPLRGLFLRSYLSQISRDKLPDIGSEYEGDVENINDAVEFVLQNFIEMNKLWVRMQHQGPAREKEKRGKERNELRDLVGKNLHVLGQIDGVDLDMYKETVLPRILEQVVNCKDDLAQFYLMDCIIQVFPDEYHLQTLETLLSAFPQLQPSVDIKTVLSQLMDRLSNYAASSPELLPEFLQVEAFAKFSNAIGKVIEAQPDMPVVGAITLYVSLLTFTLRVHPDRLDYVDQVLGACVKKLSGKAKLEDSRATKQIVALLSAPLEKYSNIVTALELSNYPRVMDYLDNATTKVMAVVIIQSIMKNTTCISTSDKIEALFDLIKGLIKDMDGAQDDELDEEDFKEEQNSVARLIHMLHNDDPEEMLKILCTVQKHILQGGPKRLTFTVPSLVFSSLKLVRRLQGQDGDVTGEDVPATPKKIFQILHQTIEALSCVPSPELALRLYLQCAEAANDCDLEPVAYEFFTQAFILYEEEITDSKAQITAIHLIIGTLQRMNIFGVENRDTLTHKTTGYSAKLLKKPDQCRAVYACSHLFWTDDQDGIMDGERVLLCLKRALRIANAAQQMASATRGSSGSVTLFIEILNKYLYFFEKGIPQITNTVIQDLIELIRTEKQSDNSVADPSTEAFFSSTLRYIEFQKQKGGTIGEKYEQIKTSS

SEQ ID NO: 2824 - protein, 803 aa, Zea mays
MASASTAVRMLPDGGADDEERWLAEGIAGVQQNAFYMHRALDSNNLKDALKYSAQMLSELRTSRLSPHKYYELYMRAFDEMKKLEMFFREETRRGSCSVVDMYELVQHAGNVLPRLYLLCTVGSVYIKSKEAPAKDVLKDLVEMCRGIQHPLRGLFLRSYLSQISRDKLPDIGSEYEGDAETINDAVEFVLQNFIEMNKLWVRMQHLGPAREKEKRGKERNELRDLVGKNLHVLSQIEGVDLDMYKETVLPRILEQVVNCKDDLAQFYLMDCIIQVFPDEYHLQTLETLLNAFPQLQPSVDIKTVLSQLMDRLSNYAASSPEVLPEFLQVEAFAKFSNAIGKVIEAQPDMPVVGAVTLYVSLLTFTLRVHPDRLDYVDQVLGACVKKLSGKAKLEDSRATKQIVALLSAPLEKYSNIVTALELSNYPRVMDYLDNATTKVMAVVIIQSIMKNTTCISTSDKIEALFDLIKGLIKDMDGAQDDELDEEDFKEEQNSVARLIHMLHNDEPEEMLKILCTVQKHILQGGPKRLTFTVPSLVFSALKLVRRLQSQDGDVTGEDVPATPKKIFQILHQTIDALSCVPSPELALRLYLHCAEAANDCDLEPVAYEFFTQAFILYEEEIADSKAQITAIHLIIGTLQRMNIFGVENRDTLTHKTTGYSAKLLKKPDQCRAVYACSHLFWADDQDGIMDGERVLLCLKRALRIANAAQQMASATRGSSGSVTLFIEILNKYLYFFEKGIPQITNTVIQDLIELIRTEKQSDNSVADPSTEAFFSSTLRYIEFQKQKGGSIGEKYEQIKTSS

SEQ ID NO: 2825 - protein, 793 aa, Oryza sativa Indica Group
MLPDGGADDEERWLAEGIAGVQQNAFYMHRALDSNNLKDALKYSAQMLSELRTSRLSPHKYYDLYMRAFDEMRKLEMFFREETRRGSCSVVDLYELVQHAGNVLPRLYLLCTVGSVYIKSKEAPAKDVLKDLVEMCRGIQHPLRGLFLRSYLSQISRDKLPDIGSEYEGDADSINDAVEFVLQNFIEMNKLWVRMQHQGPVREKEKRGKERNELRDLVGKNLHVLSQIEGVDLDMYKETVLPRILEQVVNCKDELAQFYLMDCIIQVFPDEYHLQTLETLLSAFPQLQPNVDIKTVLSQLMDRLSSYAAASPEVLPEFLQVEAFAKFSNAIGKVIEAQVDMPVVGAVTLYVSLLTFTLRVHPDRLDYVDQVLGACVKKLSGNAKLEDSRATKQIVALLSAPLEKYSNIVTALELSNYPRVMDYLDNSTTKVMALVIIQSIMKNTTCISTSDKIEALFDLIKGLIKDMDGAQNDELDDEDFKEEQNSVARLIHMLHNDDHEEMLKILCTVQKHILQGGPKRLPFTVPSLVFSALKLVRRLQGQDGDVIGEEVPATPKKIFQILHQTIEALSCVPSPELALRLYLQCAEAANDCDLEPVAYEFFTQAFILYEEEIADSKAQITAIHLIIGTLQRMNIFGVENRDTLTHKTTGYSAKLLKKPDQCRAVYACSHLFWTDDQDGIMDGERVLLCLKRALRIANAAQQMANVTRGSSGSVALFIEILNKYLYFFEKGIPEITNTVIQDLIELIRTEKQSENTVADPSTEAFFASTLRYIEFQKQKGGSIGEKYEQIKTT

SEQ ID NO: 2826 - protein, 793 aa, Oryza sativa Japonica Group
MLPDGGADDEERWLAEGIAGVQQNAFYMHRALDSNNLKDALKYSAQMLSELRTSRLSPHKYYDLYMRAFDEMRKLEMFFREETRRGSCSVVDLYELVQHAGNVLPRLYLLCTVGSVYIKSKEAPAKDVLKDLVEMCRGIQHPLRGLFLRSYLSQISRDKLPDIGSEYEGDADSINVAVEFVLQNFIEMNKLWVRMQHQGPVREKEKRGKERNELRDLVGKNLHVLSQIEGVDLDMYKETVLPRILEQVVNCKDELAQFYLMDCIIQVFPDEYHLQTLETLLSAFPQLQPNVDIKTVLSQLMDRLSSYAAASPEVLPEFLQVEAFAKFSNAIGKVIEAQVDMPVVGAVTLYVSLLTFTLRVHPDRLDYVDQVLGACVKKLSGNAKLEDSRATKQIVALLSAPLEKYSNIVTALELSNYPRVMDYLDNSTTKVMALVIIQSIMKNTTCISTSDKIEALFDLIKGLIKDMDGAQNDELDDEDFKEEQNSVARLIHMLHNDDHEEMLKILCTVQKHILQGGPKRLPFTVPSLVFSALKLVRRLQGQDGDVIGEEVPATPKKIFQILHQTIEALSCVPSPELALRLYLQCAEAANDCDLEPVAYEFFTQAFILYEEEIADSKAQITAIHLIIGTLQRMNIFGVENRDTLTHKTTGYSAKLLKKPDQCRAVYACSHLFWTDDQDGIMDGERVLLCLKRALRIANAAQQMANVTRGSSGSVALFIEILNKYLYFFEKGIPEITNTVIQDLIELIRTEKQSENTVADPSTEAFFASTLRYIEFQKQKGGSIGEKYEQIKTT

SEQ ID NO: 2827 - protein, 793 aa, Hordeum vulgare subsp. vulgare
MLPDGGGDDEERWLAEGIAGVQQNAFYMHRALDSNNLKDALKYSAQMLSELRTSRLSPHKYYELYMRAFDEMRKLEMFFREETRRGSCSVVDLYELVQHAGNVLPRLYLLCTVGSVYIKSKEAPAKDVLKDLVEMCRGIQHPLRGLFLRSYLSQISRDKLPDIGSEYEGDADSINDAVEFVLQNFIEMNKLWVRMQHQGPVREKDKRGKERNELRDLVGKNLHVLSQIEGVDLEMYKENVLPRISEQVVNCKDDLAQFYLMDCIIQVFPDEYHLQTLETLLSAFPQLQPSVDIKTVLSQLMDRLSNYAATSPEVLPEFLQVEAFAKFSNAIGKVIEAQVDMPVVGAVTLYVSLLTFTLRVHPDRLDYVDQVLGACVKKLSGKEKLEDSRATKQIVALLSAPLEKYSNIVTALELSNYPRVMDYLDNATTKVMALVIIQSIMKNTTCISTSDKIEALFDLIKGLIKDMDGAQDDELDEEDFKEEQNSVARLIHMLHNDDHDEMLKILCTVQKHILQGGPKRLPFTVPSLVFSALKLVRRLQGQDGDVTGEEVPATPKKIFQILHQTIEALQCIPCPELSLRLYLQCAEAANDCDLEPVAYEFFTQAFILYEEEIADSKAQITALHLIIGTLQRMNIFGVENRDTLTHKTTGYSAKLLKKPDQCRAVYACSHLFWTDDQDGIMDGERVLLCLKRALRIANAAQQMANVSKGSSGSVILFIEILNKYLYFFEKGIPQITNTVIQDLIELIRTEKQNDSSASDPSAEAFFASTLRYIEFQKQKGGSIGEKYEQIKAS

SEQ ID NO: 2828 - protein, 790 aa, Vitis vinifera
MISNIAEDEDKWLAEGIAGIQHNAFYMHRSVDSNNLREVLKYSAQMLSELRTSRLSPHKYYELYMRAFDELRKLEIFFKDESRHGCSIIDLYELVQHAGNILPRLYLLCTVGSVYIKSKEAPPKDVLKDLVEMCRGIQHPIRGLFLRSYLSQVSRDKLPDIGSDYEGDADTVMDAVEFVLQNFTEMNKLWVRMQHQGPGRAKEKQEKERSELRDLVGKNLHVLSQIEGIDLEMYKDTVLPRVLEQVVNCKDELAQYYLMDCIIQVFPDEYHLQTLETLLGACPQLQPTVDIKTVLSQLMERLSNYAASSAEVLPDFLQVEAFAKLSSAIGKVIEAQVDMPVFGAITLYVSLLTFTLRVHPDRLDYVDQVLGACVKKLSGKPKLEDSKATKQIVALLSAPLEKYNDIVTALTLSNYPRVMDHLDNGTNKIMAMVIIQSIMKNSTCISTADKVEALFELIKGLIKDLDGFPVDELDEEDFKDEQNSVARLIHMFYNDDPEEMLKIICTVKKHIMTGGLRRLPFTVPPLIFSALRLVRRLQGQEGDVVGEEEPATPKKIFQLLNQTIEALSSVPSPELALRLYLQCAEAANDCDLEPVAYEFFTQAFILYEEEIADSKAQVTAIHLIIGTLQRMNVFGVENRDTLTHKATGYSAKLLKKPDQCRAVYACSHLFWVDDQDGIKDGERVMLCLKRALRIANAAQQMATVARGSSGPVILFVEILNKYIYFFEKGNSQVTSSAIQGLIELITSEMQSESTTPDPPSDAFFASTMRYIQFQKQKGGAMGEKYDSIKA

SEQ ID NO: 2829 - protein, 787 aa, Vitis vinifera
MISNIAEDEDKWLAEGIAGIQHNAFYMHRSVDSNNLREVLKYSAQMLSELRTSRLSPHKYYELYMRAFDELRKLEIFFKDESRHGCSIIDLYELVQHAGNILPRLYLLCTVGSVYIKSKEAPPKDVLKDLVEMCRGIQHPIRGLFLRSYLSQVSRDKLPDIGSDYEGDADTVMDAVEFVLQNFTEMNKLWVRMQHQGPGRAKEKQEKERSELRDLVGKNLHVLSQIEGIDLEMYKDTVLPRVLEQVVNCKDELAQYYLMDCIIQVFPDEYHLQTLETLLGACPQLQPTVDIKTVLSQLMERLSNYAASSAEVLPDFLQVEAFAKLSSAIGKVIEAQVDMPVFGAITLYVSLLTFTLRVHPDRLDYVDQVLGACVKKLSGKPKLEDSKATKQIVALLSAPLEKYNDIVTALTLSNYPRVMDHLDNGTNKIMAMVIIQSIMKNSTCISTADKVEALFELIKGLIKDLDGFPVDEEDFKDEQNSVARLIHMFYNDDPEEMLKVIDLFKKHIMTGGLRRLPFTVPPLIFSALRLVRRLQGQEGDVVGEEEPATPKKIFQLLNQTIEALSSVPSPELALRLYLQCAEAANDCDLEPVAYEFFTQAFILYEEEIADSKAQVTAIHLIIGTLQRMNVFGVENRDTLTHKATGYSAKLLKKPDQCRAVYACSHLFWVDDQDGIKDGERVMLCLKRALRIANAAQQMATVARGSSGPVILFVEILNKYIYFFEKGNSQVTSSAIQGLIELITSEMQSESTTPDPPSDAFFASTMRYIQFQKQKGGAMGEKYDSIKA

SEQ ID NO: 2830 - protein, 790 aa, Jatropha curcas
MILDGIEDEEKWLAEGIAGVQQNAFYMHRALDANNLREVLKYSALMLSELRTSKLPPHKYYELYVRAFDELRKLEIFFTDESRHGVSVVDLYELVQHAGNILPRLYLLCTVGSVYIKSKEVSAKDVLGDLVEMCRGVQHPMRGLFLRSYLAQVTRDKLPNFGSEYAGDTNTAMDAVEFVLQNFIEMNKLWVRMQYQGPARVREKQEKERSELRDLVGKNLHVLSQIEGVDLEVYRDTVLPRVLEQVVNCKDDLAQYYLMDCIIQVFPDEYHLQTLDTLLGACPQLQPTVDVKTVLSQLMERLSNYAASSEDVLPEFLQVEAFTKLSSAIGKVIEAQVDMPIFGATTLYLSLLTFTLRVHPDRLDYVDQVLGACVKKLSELPKLEDSRAIKQIVALLSAPVERYNNVVTALTLSNYPRVMDRLDNETNKLMAMVIIQSIMKNNTCISSADKVEVLFELIKGLIKDLNGTTVDELDEEDFKEEQNSVARLIHMLYNDDPEEMLKIICTVRKHVMVGGPKRLPFTVPPLIFASLRLIRQLNSQDGEVVGEELPATPKKIFQLLNQTIEALSSVPSPELALRLYLQCAEAANDCDLEPVAYEFFTQAFVLYEEEIVDSKAQVTAIHLIIGTLQRMNVFGVENRDTLTHKATGYSAKLLKKPDQCRAVYACSHLFWVDDQDGIKDGERVLLCLKRALRIANAAQQMANVTSGSNGPVILFVEILNKYLYFFEKGNPQVTSAVIQGLVELINTEMQSDSSTPDPAAKAFFACTLRYIQFQKQKGGAMAEKYEPIKV

SEQ ID NO: 2831 - protein, 789 aa, Vitis vinifera
MVERAEDEEKWLAAGIAGLQQNAFYMHRALDSNNLRDALKYSAQMLSELRTSRLSPHKYYELYMRAFDELRKLEMFFKEEARRGCSIIDLYELVQHAGNILPRLYLLCTVGSVYIKSKEAPAKDVLKDLVEMCRGIQHPVRGLFLRSYLSQVSRDKLPDIGSEYEGGADTVMDAVEFLLQNFTEMNKLWVRMQHQGPAREKEKREKERSELRDLVGKNLHVLGQLEGVDLDMYKETVLPRVLEQVVNCKDEIAQFYLMDCIIQVFPDEYHLQTLETLLGACPQLQPSVDIKTVLSQLMERLSNYAASSAEVLPEFLQVEAFAKLSNAIWKVIEAQVDMPIFGAVTLYSSLLTFTLHVHPDRLDYVDQVLGACVTKLSSAGKLEDSKSTKQIVALLSAPLEKYNDIVTVLKLSNYPRVMEYLDNRTNKVMAIVIIQSIMKNKTCIATAEKVEALFELIKGLIKDLDGDLHDELDDEDFKEEQNSVARLIQMLYSDDPDEMLQIICAVRKHFLTGGPQRLPYTIPPLVFSSLKLIRKLQGQDENVVGEEASASPKKIFQLLNQTIEALSAVPASELALRLYLQCAEAANDCDLEPVAYEFFTQAYILYEEEIADSKAQVTALHLIVGTLQRMHVFGVENRDTLTHKATGYSAKLLKKPDQCRAVYACSHLFWVDDQDSIRDGERVLLCLKRALRIANAAQQMANVTRGSSGSATLFVEILNKYLYFFEKGNPQITIAAIQSLIELITTEIQSDTMSQDPAADAFFASTLRYIQFQKQKGGALAEKYESIKV

SEQ ID NO: 2832 - protein, 273 aa, Sorghum bicolor
MAKKFSYIYEGRPKTNSGLFMQSLFLHCIGHLTSQSSLPQRLAGLYCLYCLYECQPYKPQFKIYLSLEESRQLKDFVVMAKQNGLQLVPALVKRMLDKGMFLLGYMNLIDDNGDKQVEELTALQNKRVKFACDKLFANTQAESYMHMDLGAEFELDSIKKLSKEYAEAKELALAEASQIVEVEDAKHLLQSDKLLGDKIDEVVKEWDAQKEGFYERTGLTPRNQLMVVDNDEPGVQAHEDASHSNQIMAIYNDESGVQNHEEDDFDDLDQLLE

SEQ ID NO: 2833 - protein, 295 aa, Zea mays
MDRENCTSLFEFKRVWMGKKFSYIYEGRPKTNSGLFMQSLFLHCIGYLTSQSSLHQRLAGLYCLYCLYECQPYKPQFKIYLSLEECRQLKDIVVMAKQNGLQLVPALVKRMLDKDMFLFGYMNLIDDNGDKQVEELTALQNKRVKFACDKLFANTQAERYLHMDLGAEFELDSIKKLSKEYAEAKELALAEASQTVEVDDAKHLLQSERLLGDKIDEVVKEWDVQKEGFYERTGLSSSPGDQLMAIDNDESGAQCHEDGSRGDQLMAVDNDESGVQDHEDLDDDDGFAELELLLE

SEQ ID NO: 2834 - protein, 315 aa, Zea mays
MPLNIDIDLFKLDIDELIADYSKENCTSLFEFKRVWMGKKFSYIYEGRPKTNSGLFMQSLFLHCIGYLTSQSSLHQRLAGLYCLYCLYECQPYKPQFKIYLSLEECRQLKDIVVMAKQNGLQLVPALVKRMLDKDMFLFGYMNLIDDNGDKQVEELTALQNKRVKFACDKLFANTQAERYLHMDLGAEFELDSIKKLSKEYAEAKELALAEASQTVEVDDAKHLLQSERLLGDKIDEVVKEWDVQKEGFYERTGLSSSPGDQLMAIDNDESGAQCHEDGSRGDQLMAVDNDESGVQDHEDLDDDDGFAELELLLE

SEQ ID NO: 2835 - protein, 315 aa, Zea mays
MPLNIDIDLFKLDIDELIADYSKENCTSLFEFKRVWMGKKFSYIYEGRPKTNSGLFMQSLFLHCIGHLTSQSSLHQRLAGLYCLYCLYECQPYKPQFKIYLSLEECRQLKDVVVMAKQNGLQLVPALVKRMLDKDMFLFGYMNLIDDNGDKQVEEMTALQNKRVKFACDKLFANTQAERYLHMDLGAEFELDSIKKLSKEYAEAKELALAEASQTVEVDDAKHLLQSERLLGDKIDEVVKEWDVQKEGFYERTGLSSSPGDQLMAIDNDESGAQCHEDGSRCDQLMAVDNDELGVQDHEDLDDDDGFAELELLLE

SEQ ID NO: 2836 - protein, 286 aa, Hordeum vulgare subsp. vulgare
MDLAPFKMDIDELLDDYTKENCTSFTDFKRVWMAKKFSYIYEGRPKTNSGVFMQSLFLHCIGHMTSQSSLLQRLPGLYCLYCLYECQPYKPHFKIYLSLEESKKLKDFVIEAKQNGLGLVPALVKRMLDKGMFLFGFINLLGDIVAKEVDEMNASQNKRVEFACDKLFANTQIGSYTHTDLGVEFELDSIKKLSMDYAKAKESAFAEASQTVDVEDAKHILQNDKLLGDKVEEIVKEWDAQKEEFYQKTGVSPHDEMVVVDNDESGEFYDENETDAFDELEQLLLE

SEQ ID NO: 2837 - protein, 491 aa, Sorghum bicolor
MKTRSSARGEPRRLGNAALLALMLCSVVALSLIRGRFAPIGSTAGDAIKSEDDAAAAAVAVSKAAAVNVDTGDGADEAAAEAAAEEKDKEEVQPKPAADGSRGGAAKPVCYETSRRSDTCEAAGDVRVLGSSQTVYVDSLDREWKTKPYCRKHDNFALAHVKEWSLKPLPSGAAPQCTVNSSATAFVLSTGGFTGNPFHDYTDVLIPAFITAHPLRGEVQFLVSSYKSWWMNRYIQIFQQMSRHEVVDIDADDEVRCYRNVVVGPTFHRELGVDASKSPSPGYSTADFRKMLRDAFGLERATATPSGDRWDIRRRPRLLIISRRPSRGRAFMNERAMADMAASLGFDVRIGEPDSSTDTSKFARLVNSADVMVGVHGAGLTNMVFLPAGAVVVQVVPYGRLEWLARNTFAEPSAGMEVHYLEYVVQLDETTLSEQYPSDHPVLRDPMAIHKQGWNALKTTYLDKQNVRPHLGRLKNTFLQALKMLPHGRDD

SEQ ID NO: 2838 - protein, 492 aa, Zea mays
MKTRSSARGEPRRLGNAALLALMLCSVVALSLIRGRFAPIVTTAGDAIKSEDDAAAAALSVSKAAVNVDTGDSADEAAAEAAAEEKEKEEVQPKPADSSGSGSGGSAAKPVCYETSRRSDTCEAAGDVRVVGSTQTVYVDSLDREWKTKPYCRKHDNFALAHVKEWSLKPLPSGAAPQCTVNSSATAFVLSTGGFTGNPFHDYTDVLIPAFITAHPLRGEVQFLVSSYKSWWMNRYIQIFQQMSRHEVVDIDADDEVRCYRSVVVGATFHRELGVDASKSPPGYSTADFRKMLRDAFGLERATATPSGDRWDIRRRPRLLIISRRPSRGRAFMNERAMADMAASLGFDVRIGEPDTSTDTSKFARLVNSCDVMVGVHGAGLTNMVFLPAGAVVVQVVPYGRLEWLARNTFAEPSAGMEVHYLEYVVQLDETTLSEQYPSDHPVLRDPMAIHKQGWNALKTTYLDKQNVRPHLGRLKNTFLQALKMLPHGRDD

SEQ ID NO: 2839 - protein, 484 aa, Saccharum officinarum
MKTRSSARGEPRRLGNAALLALMLCSVVALSLIRGRFAPIGDAIKSEDDAAAAAVAVSKVAINVDTGDGADEAAVEAAAEEKQKEEVQPKPADGSGGGAAKPVCYETSRRSDTCEAAGDVRVVGSSQTVYVDLLDREWKTKPYCRKHDNFALAHVKEWSLKPLPSGAAPQCTVNSSATAFVLSTGGFTGNPFHDYTDVLIPAFITAHPLRGEVQFLVSSYKSWWMNRYIQIFQQMSRHEVVDIDADDEVRCYRSVVVGPTFHRELGVDASKSPSGYSTADFRKMLRDAFGLERATATPSGDRWDIRRRPRLLIISRRPSRGRAFMNERAMADMAASLGFDVRIGEPDSSTDTSKFARLVNSCDVMVGVHGAGLTNMVFLPAGAVVVQVVPYGRLEWLARNTFAEPSAGMEVHYLEYVVQMDETTLSEQYPSDHPVLRDPMAIHKQGYRALNRTYLDKQNVRPHLGRLKNTFLQALKMLPHGRDD

SEQ ID NO: 2840 - protein, 498 aa, Hordeum vulgare subsp. vulgare
MKSRSSARGEPRRFGNVALLALMLCSLVALSLIRARFSPIGNTPVVETIKVEDPKPVLPSKPAVAAQAGDGADEAAAVAVEEDKEEEIQPKTEQAVGATVRPAKAAVVVDASKPVCYETSRRSDTCEAAGDVRLVGRSQTIYIDTLEREWKTRPYCRKHDTYALSHVKEWSLKPFPSGDDAAPKCTSNSSATAFVISTGGFTGNPFHDYTDVLIPAFITAHRFAGEVQFLVSSYKSWWMSRYIQIFQQMSRYEVVDIDADDEVRCYPSAVVGPTFHKELGVDPSKAPSGASMADFRKMLRNAFGLERATATPSGDRWDIRRRPRLLIISRRTSRGRAFMNERAMADMAGSLGFDVRIGDPDTTSDTSKFARLVNSCDVMVGVHGAGLTNMVFLPAGAVLVQVVPYGRLEWLARNTFAEPSAGMEVHYLEYVVQLDETTLSEQYPSDHLVLKDPMAIHKQGWDALKTTYLDKQNVRPHLGRLKKTFLQALKMLPHGRDD

SEQ ID NO: 2841 - protein, 500 aa, Oryza sativa Japonica Group
MKTRSSGRGGGEPRRRLRNAAVMALMLSSLVALSLVRARFSPIASDGGEALKLKADESKLVVTTNHAVVNTESGDSSSSSSSAAAEEEEEVAAPAKPAAAGGGGARPVCYETSRRSDTCEAAGDVRVVGGSQTVYADTLDREWKTKPYCRKHDAFALSHVKEWTLRPLPSGDGGGGGAAVAPRCTTNSTATAFVLSTGGFTGNPFHDYTDVLIPAFITAHRFGGEVQFLVSSYKSWWMNKYIQIFQQMSRHDVVDVDADGDEVRCYRSAVVGPEFHRELGVDPTKTPSGYSVLDFRKMLRGAFGLDRATATPSGDRWDIRRRPRLLIISRRAARGRAFMNERAMADMAASLGFDVRVGEPDASTDTSKFARLVNSCDVMVGVHGAGLTNMVFLPAGAVLVQVVPYGKLEWLARNTFAEPSSAMEIHYLEYAVQLDETTLSEQYPADHPVLRDPMAIHKQGWEALKTTYLDKQNVRPHLGRLKNTFLQALKLLPHDKETMN

SEQ ID NO: 2842 - protein, 504 aa, Oryza sativa Indica Group
MKTRSSGRGGGEPRRRLRNAAVMALMLSSLVALSLVRARFSPIASDGGEALKLKADESKLVVTTNHAVVNTESGDSSSSSSSSAAAEEEEEVAAPAKPAGGGGGGGGGARPVCYETSRRSDTCEAAGDVRVVGGSQTVYADTLDREWKTKPYCRKHDAFALSHVKEWTLRPLPSGDGDGGGAAVAPRCTTNSTATAFVLSTGGFTGNPFHDYTDVLIPAFITAHRFGGEVQFLVSSYKSWWMNKYIQIFQQMSRHDVVDVDADGDEVRCYRSAVVGPEFHRELGVDPTKTPSGYSVLDFRKMLRGAFGLDRATATPSGDRWDIRRRPRLLIISRRAARGRAFLHERAMADMAASLGFDVRVGEPDASTDTSKFARLVNSCDVMVGVHGAGLTNMVFLPAGAVLVQVVPYGKLEWLARNTFAEPSSAMEIHYLEYAVQLDETTLSEQYPADHPVLRDPMAIHKQGWEALKTTYLDKQNVRPHLGRLKNTFLQALKLLPHDKETMN

SEQ ID NO: 2843 - protein, 506 aa, Triticum aestivum
MKSARSLSRGDGRRLGNASLIAFMLASLVLLSVIRTRLSPMEKTGDAIKAEERHGMSKGSVKVEVAHEAVVTTPDSAAEEEEEEETPPKPADTSSRGGVSVPVPVSTSTTPVPVAVIDRQGKPVCYESGRRSDTCEAAGDVRVQGRSQTIQVRPLDREWKVKPYCRKQDAYALSHVKEWTLRPLSGGGPHCTVNSSATAFVISTGGFTGNLFHDYTDVLVPAFITAHRFGGEVQFLVSSFKSWWTNRYLEIFQQLSRHEVIDIDNDDEVRCYGSVVVGPTFHKELGVDASKTPTGASMVDFRAMLRGAFGLSRAAAEPSGDRWDIRRRPRLLIISRKNSRAFLNERAMADMAMSLGYDVRVGEPDTNTEVSRFARLVNSADVMVGVHGAGLTNMVFLPAGAVLIQVIPYGGLEWLARGTFEEPSKDMQLHYIGYKIQLDETTLSEQYPKDHPVLTDPLSIHKQGWEALKTVYLEKQNVRPHLGRLKLTFLEALKLLPHGRQAKANN

SEQ ID NO: 2844 - protein, 519 aa, Hordeum vulgare subsp. vulgare
MKSTRNLARGDGRRLGNASLIAFMLASLVVLSVIRARISPMEKAGEAIKAEERQGMRKVSVKMEVAHEAVLPTADSTAKEEEDEEEEEEEVRPKPADTSSGGVVPVPVPVPVPVSTSTSTTPVPVAAVGLPGKPVCYESGRRSDTCEAAGDVRVQGRSQTIQVRPLDREWKVKPYCRKQDAYALSHVKEWTLRPLSSSGPVPHCTVNSSATAFVLSTGGFTGNLFHDYTDVLVPAFITARRFGGEVQFLVSSFKSWWTNRYLEIFQQLSKYEVIDIDNDDEVRCYGGVVVGPTFHKELGVDASKTPAGYSMVDFRAMLRGAFGLSRAAAEPSGDRWDIRRRPRLLIISRKNSRAFLNERAMADMAMSLGYDVRVGEPDSNTDVSKFARLVNSADVMVGVHGAGLTNMLFLPAGAVLIQVVPYGGLEWLARGTFEEPSKDMQLHYIGYKIQLDETTLSEQYPKDHPVLTDPLSIHKQGWEALKTVYLEKQNVRPHLGRLKLTFMEALKLLPHGRQAKANN

SEQ ID NO: 2845 - protein, 504 aa, Oryza sativa Japonica Group
MKSNRNLTRGDGRRLGNAALIAFMLGSLLVLSLVRARFSPIGKPGEAIKTEEQEAMRKGSVKMETLEAADEAAASAAAAEEEEETQPKAGDTTAGGGGGGASSAAVAAASTTATDHLTKPVCYESSRRSDTCEATGDVRVHGRSQTIHISPLEQEWKVKPYCRKHDAFALSHVKEWALRPLSTADTYPAVPHCTVNSSATAFVLSTGGFTGNPFHDYTDVLIPAFITAHRFAGEVQFLVSSFKSWWTNRYMQIFQRLSKYELVDIDNDDEVRCYRSVVVGPTFHKELGVDASRTPSGYSMVDFRTMLRGALGLERAVAEPSGDRWDIRRRPRLLIISRRNSRAFLNERAMADMAMSLGFYVRLGEPDISTDVSKFARLVNSADVMVGVHGAGLTNMVFLPAGAVLIQVVPYGGLEWLARGTFKEPAADMQIHYLEYMIQLDETTLSEQYPKDDPVLKDPYSIHKQGWNALKMVYLDKQNVRPHLGRLKNTFMEALKLLPHGHTN

SEQ ID NO: 2846 - protein, 149 aa, Zea mays subsp. mays
MIAFQGHPDKGTERVDMGLFLIKAYIGGWYDSKSFPTDVFSRWLDSPPGVNWKGQGFTMKQIAYNLHGDTNSIEFLHSLYADLVSQGKGCIANTSFSEVATNHGVGGSNPLLSGLAAPPGASLLKESFIVELLFLSNIYLLFGKTKPTY

SEQ ID NO: 2847 - protein, 134 aa, Zea mays subsp. mays
MIAFQGHPDKGTERVDMGLFLIKAYIGGWYDSKSFPTDVFSRWLDSPPGVNWKGQGFTMKQIAYNLHGDTNSIEFLHSLYADLVSQGKGCIANTSFSEVATNHGVGGSNPLLSGLAAPPGASLLKESFIVELLF

SEQ ID NO: 2848 - protein, 484 aa, Saccharum officinarum; identical to SEQ ID NO: 2839

SEQ ID NO: 2849 - protein, 492 aa, Zea mays; identical to SEQ ID NO: 2838

SEQ ID NO: 2850 - protein, 491 aa, Sorghum bicolor; identical to SEQ ID NO: 2837

SEQ ID NO: 2851 - protein, 498 aa, Hordeum vulgare subsp. vulgare; identical to SEQ ID NO: 2840

SEQ ID NO: 2852 - protein, 500 aa, Oryza sativa Japonica Group; identical to SEQ ID NO: 2841

SEQ ID NO: 2853 - protein, 504 aa, Oryza sativa Indica Group; identical to SEQ ID NO: 2842

SEQ ID NO: 2854 - protein, 519 aa, Hordeum vulgare subsp. vulgare; identical to SEQ ID NO: 2844

SEQ ID NO: 2855 - protein, 506 aa, Triticum aestivum; identical to SEQ ID NO: 2843

SEQ ID NO: 2856 - protein, 503 aa, Oryza sativa Japonica Group
MKSNRNLTRGDGRRLGNAALIAFMLGSLLVLSLVRARFSPIGKPGEAIKTEEQEAMRKGSVKMETLEAADEAAASAAAEEEEETQPKAGDTTAGGGGGGASSAAVAAASTTATDHLTKPVCYESSRRSDTCEATGDVRVHGRSQTIHISPLEQEWKVKPYCRKHDAFALSHVKEWALRPLSTADTYPAVPHCTVNSSATAFVLSTGGFTGNPFHDYTDVLIPAFITAHRFAGEVQFLVSSFKSWWTNRYMQIFQRLSKYELVDIDNDDEVRCYRSVVVGPTFHKELGVDASRTPSGYSMVDFRTMLRGALGLERAVAEPSGDRWDIRRRPRLLIISRRNSRAFLNERAMADMAMSLGFYVRLGEPDISTDVSKFARLVNSADVMVGVHGAGLTNMVFLPAGAVLIQVVPYGGLEWLARGTFKEPAADMQIHYLEYMIQLDETTLSEQYPKDDPVLKDPYSIHKQGWNALKMVYLDKQNVRPHLGRLKNTFMEALKLLPHGHTN

SEQ ID NO: 2857 - protein, 504 aa, Oryza sativa Japonica Group; identical to SEQ ID NO: 2845

SEQ ID NO: 2858 - protein, 341 aa, Sorghum bicolor
MPRYDDRYGGTRLYVGRLAPRTRSRDLEYLFGRYGRIREVELKRDYAFIEFSDHRDADEARYQLDGRDVDGSRIVVEFAKGVPRGPGGSREYMGRGPPPGTGRCFNCGIDGHWARDCKAGDWKNKCYRCGERGHIERNCQNSPRSVRRERSYSRSPSPRRGRGRSPSYSRSRSRSRSRSYSRSRSLSGSPRGGRRDRDDRRSRSLSYSRSPMRSASPPPKEKERSPTPDGSRSPRSRSPQDQVMSPPPKDNGEGNGSDRGESPRGRETSRSRSRSRSPSGDNRSPAANGRSPSPRGDRSPSPRADRSPSPKADRSPSPKGNGNNDDDDAARGASPAGSKSP

SEQ ID NO: 2859 - protein, 333 aa, Zea mays
MPRYDDRYGGTRLYVGRLAPRTRSRDLEYLFGKYGRIREVELKRDYAFIEFSEHRDADEARYQLDGRDVDGSRIVVEFAKGVPRGPGGSREYMGRGPPPGTGRCFNCGMDGHWARDCKAGDWKNKCYRCGERGHIERNCQNSPRSVRRERSYSRSPSPRRGRGRSPSYSRSRSRSRSRSYSRSRSLSGSPRGGRRDRDDRRSRSLSYSRSPMRSPPAKEKERSPTPGGSRSPRSRSPQDQVMSPPPKDNGDRNGSDRGDSPRGRENSRSRSRSRSPSGGNRSPAANGRSPSPRGDRTPSPMADRSPSPKGNGNNDGGDDDTGRGGSPTGSKSP

SEQ ID NO: 2860 - protein, 330 aa, Oryza sativa Japonica Group
MPRYDDHYGSTRLYVGRLSSRTRSRDLEYLFGRYGRIREVELKRDYAFIEFSDPRDADEARYNLDGRDVDGSRILVEFAKGVPRGAAGGSREYMGRGPPPGTGRCFNCGIDGHWARDCKAGDWKNKCYRCGERGHIERNCQNSPRNLRRERSYSRSPSPRRGRGHGRSRSYSRSRSRSYSRSRSRSLSGSPRGRRDRDDRRSRSLSYSRSPRRSISPAANGKERNPSPNGRRSPRSPQDRVSPPPKDNDERNGDSPWGRENSRSPSDGYRSPVAANGRSPSPRNNGSPSPMDNNSRSPRDNGSPSPRDGNGDGGSRGGSRSPRASESPEA

SEQ ID NO: 2861 - protein, 294 aa, Oryza sativa Indica Group
MPRYDDHYGSTRLYVGRLSSRTRSRDLEYLFGRYGRIREVELKRDYAFIEFSDTRDADEARYNLDGRDVDGSRILVEFAKGVPRGAAGGSREYMGRGPPPGTGRCFNCGIDGHWARDCKAGDWKNKCYRCGERGHIERNCQNSPRNLRRERSYSRSPSPRRGRGHGRSRSYSRSRSRSYRGRRDRDDRRSRSLSYSRSPRRSISPAANGKERSPSPNGRRSPRSPQDRVSPPPKDNDEHNGDSPRGRENSRSPSDGYRSPVAANGRSPSPKNNGSPSPMDNNSRSPRGQRQPEP

SEQ ID NO: 2862 - protein, 314 aa, Zea mays
MPRYDDRHGNTRLYVGRLAPRTRSRDLEYLFSKYGRIREVELKRDYAFIEFSDPRDADDAQYNLDGREVDGSRIIVEFAKGVPRGSGGSREYMGRGPPPGTGRCFNCGMDGHWARDCKAGDWKNKCYRCGESGHIERNCQNSPRNLRRDKSYSRSPSPRGGRGRSRSYSRSRSYSRSRSPSGSPRGGRRERDERRSRSLSYSRSASPRRSVSPAKEKERSRTPNGSRSPRSPSPRAEVSPPLKDNGARNGSDHEGNPGGGENSKRSRSPSDGYRSPVANGRSPSPRDDRSPSPKGNNEDDERRGSPRGSQSPLN

SEQ ID NO: 2863 - protein, 333 aa, Triticum aestivum
MPRYDDRYGNARLYVGRLSSRTRSRDLEYLFSKYGRIREVELKRDYAFIEYSDPRDADEARYNLDGRDVDGSRIIVEFAKGVPRGSGGSREREYVGRGPPPGTGRCFNCGIDGHWARDCKAGDWKNKCYRCGERGHIERNCQNSPRSLRRERSYSRSPSPRRGRARSRSYSRSRSYSRSRSRSYSESPRGRRTERDERRSRSISYSRSPRRSLSPGGKEMDRSPTPDRSRSPRRSISPVAKDNGDSPRGRETSRSPSDGYRSPVANGRSPRSPVNNGSPSPTRDNRASPSLRGNNGSPSPKGNGNGGSPSPRGNGDDDGRRGSGSPRGRSVSP

SEQ ID NO: 2864 - protein, 332 aa, Sorghum bicolor
MRQPHLSPQLSPSPVLSSHFSPPATGASPWRRRLHRGRAFQPPLSSLREPNKATLRKASPNVPFRLGGGGGGSGSPKDRRPAADDKEEEAEGSGGGGGAGALTGTLIAGALLVGFVGGFGAAGYVYKDQINTFLTQFSGFIDGYGPAGYALFVLVYAGLEVLAIPAIPLTMSAGLLFGNVTGTIIVSVGGTLAAAVAFLIARYFARERILKMVEGNKKFLAIDKAIGENGFKVVTLLRLSPLLPFSLGNYLYGLTSVKFLPYVLGSWLGMLPGSWAYVSAGAFGRAIIQDESEIGLGGNGQLWTLGVGLLFTAIAATYVTRLAKDAVKEIDD

SEQ ID NO: 2865 - protein, 327 aa, Zea mays
MGQPHLLPQLSPSPVLYSLFSPPETGATPWRRPLNRGRAFQPPLSSLRETNKATLRKATPNAPFRLGGGGGGSPKDRRPAADDKEDEDEGRGGAGALTGTLIAGALLVGFVGGFGAAGYVYKDQINTFLTQFSGFLDGYGPAGYALFVLVYAGLEVLAIPAIPLTMSAGLLFGNVTGTIIVSVGGTLAAAVAFLIARYFARERILKLVEGNKKFLAIDKAIGENGFKVVTLLRLSPLLPFSLGNYLYGLTSVKFLPYVLGSWLGMLPGSWAYVSAGAFGRALIQDESEIGLGGNEQLWTLGVGLLFTAIAAAYVTRLAKDAVKEIDD

SEQ ID NO: 2866 - protein, 328 aa, Zea mays
MRQLHLSPQLSPSPVLSSYFSPPPAEASSWRRRLHRGRAFQPPLSSLRDPNKATLRKASSNVPFRLGGGGSGSPKDRRPADDDKAEEEAEGEGGAGALTGTLVAGALLVGFVGGFGAAGYVYKDQINTFLTQFSGFIDGYGPAGYALFVLVYAGLEVLAIPAIPLTMSAGLLFGSVTGTIIVSISGTLAAAVAFLIARYFARDRILKLVEGNKKFLAIDKAIGENGFKVVTLLRLSPLLPFSLGNYLYGLTSVKFLPYVLGSWLGMLPGSWAYVSAGAFGRAIIQEESEIGWGGNGQLWTLGVGLLFTAMAAAYVTRLAKDAVKEIDD

SEQ ID NO: 2867 - protein, 328 aa, Zea mays
MRQLHLSPQLSPSPVLSSHFSPPPAEALSWRRRLHRGRAFQPPLSSLRDPNKATLRKASSNVPFRLGGGGSGSPKDRRPADDDKEEEEAEGEGGAGALTGTLVAGALLVGFVGGFGAAGYVYKDQINTFLTQFSGFIDGYGPAGYALFVLVYAGLEVLAIPAIPLTMSAGLLFGSVTGTIIVSISGTLAAAVAFLIARYFARERILKLVEGNKKFLAIDKAIGENGFKVVTLLRLSPLLPFSLGNYLYGLTSVKFLPYVLGSWLGMLPGSWAYVSAGAFGRAIIQEESEIGWGGNGQLWTLSVGLLFTAMAAAYVTRLAKDAVKEIDD

SEQ ID NO: 2868 - protein, 340 aa, Oryza sativa Japonica Group
MRQPHLLSPQQLSPSPVLSSHFSPPAPGGSPAWRRGRHHHHRRAFHPPLSSLRDPDKATLRKASPNVPFRLGGGGQGGGSSKDRRPAADQEEEEEEEAAEDKGDGGAGAITGTLLAGALLVGVVGGFGAAGYVYKDQINTFLTQFSGFIDGYGPAGYALFVLVYAGLEVLAIPAIPLTMSAGLLFGSITGTVIVSISGTLAAAVAFLIARYFARERILKLVEGNKKFLAIDKAIGENGFKVVTLLRLSPLLPFSLGNYLYGLTSVKFLPYVLGSWLGMLPGSWAYVSAGAFGRAIIQDESEIGLGGNSQLLTLGIGLLFTAIAATYVTRLAKDAVKEIDE

SEQ ID NO: 2869 - protein, 346 aa, Oryza sativa Indica Group
MRQPHLLSPQQLSPSPVLSSHFSPPAPGGSPAWRRGRHHHHRRAFHPPLSSLRDPDKATLRKASPNVPFRLGGGGGGGGGQGGGSSKDRRPAADQEEEEEEEAAAEDKGDGGAGAITGTLLAGALLVGVVGGFGAAGYVYKDQINTFLTQFSGFIDGYGPAGYALFVLVYAGLEVLAIPAIPLTMSAGLLFGSITGTVIVSISGTLAAAVAFLIARYFARERILKLVEGNKKFLAIDKAIGENGFKVVTLLRLSPLLPFSLGNYLYGLTSVKFLPYVLGSWLGMLPGSWAYVSAGAFGRAIIQDESEIGLGGNSQLLTLGIGLLFTAIAATYVTRLAKDAVKEIDE

SEQ ID NO: 2870 - protein, 337 aa, Hordeum vulgare subsp. vulgare
MRQPHLLSPQQLSPSPVLSSHFSPPCAARGCSPWRWRHRRAFHPPLSSLRESDKGTLRKASPNLPFRFGGGGGGPSPDDRRSAADQEKKKGKEEEEEEGGGVSGALTGTLLAGAVLVGVVGGFGAAGYVYKDQINTFLTHFSGFIEGYGTAGYALFILAYAGLEVLAIPAVPLTMTAGLLFGSVTGTIMVSISGTLAAAVAFLIARYFARERILKMVEGNKKFLAIDKAIGENGFKVVTLLRLSPLLPFSLGNYLYGLTSVKFIPYVLGSWLGMLPGTWAYVSAGAFGRAIIQDETEIGLGGNNQLLTLGIGLLVTAVAATYVTRLAKDAVKDIDDE

SEQ ID NO: 2871 - protein, 766 aa, Oryza sativa Japonica Group
MASHIVGYPRMGPKRELKFALESFWDGKSSAEDLEKVATDLRASIWKQMADAGIKYIPSNTFSYYDQVLDTAAMLGAVPERYSWTGGEIGFSTYFSMARGNATVPAMEMTKWFDTNYHFIVPELGPNTKFSYSSHKAVNEYKEAKALGVDTVPVLVGPVSYLLLSKPAKGVEKSFALLSLLSSILPVYKEVIAELKAAGATWIQFDEPTLVLDLDSHQLAAFSAAYTELESALSGLNVLIETYFADIPAESYKTLTSLNSVTAYGFDLIRGAKTLDLIKSAGFPSGKYLFAGVVDGRNIWADDLAASLTTLESLEAIVGKDKLVVSTSCSLMHTAVDLVNETKLDSEIKSWLAFAAQKVVEVNALAKALAGQKDEAYFAANAAAQASRRSSPRVTNEEVQKAAAALKGSDHRRATNVSARLDAQQKKLNLPVLPTTTIGSFPQTVELRRVRREYKAKKISEEEYISAIKEEISKVVKIQEELDIDVLVHGEPERNDMVEYFGEQLSGFAFTANGWVQSYGSRCVKPPIIYGDVSRPNPMTVFWSKLAQSMTSRPMKGMLTGPVTILNWSFVRNDQPRFETCYQIALAIKKEVEDLEAGGIQVIQIDEAALREGLPLRKAEHAFYLDWAVHSFRITNCGVQDTTQIHTHMCYSNFNDIIHSIINMDADVITIENSRSDEKLLSVFREGVKYGAGIGPGVYDIHSPRIPSTEEIADRVNKMLAVLDTNILWVNPDCGLKTRKYNEVKPALTNMVSAAKLIRTQLASAK

SEQ ID NO: 2872 - protein, 766 aa, Oryza sativa Japonica Group
MASHIVGYPRMGPKRELKFALESFWDGKSSAEDLEKVATDLRASIWKQMADAGIKYIPSNTFSYYDQVLDTAAMLGAVPERYSWTGGEIGFSTYFSMARGNATVPAMEMTKWFDTNYHFIVPELGPNTKFSYSSHKAVNEYKEAKALGVDTVPVLVGPVSYLLLSKPAKGVEKSFALLSLLSSILPVYKEVIAELKAAGATWIQFDEPTLVLDLDSHQLAAFSAAYTELESALSGLNVLIETYFADIPAESYKTLTSLNSVTAYGFDLIRGSKTLDLVKSAGFPSGKYLFAGVVDGRNIWADDLAASLTTLESLEAIVGKDKLVVSTSCSLMHTAVDLVNETKLDSEIKSWLAFAAQKVVEVNALAKALAGQKDEAYFAANTAAQASRRSSPRVTNEEVQKAAAALRGSDHRRATNVSARLDAQQKKLNLPVLPTTTIGSFPQTVELRRVRREYKAKKISEDEYVSAIKEEISKVVKIQEELDIDVLVHGEPERNDMVEYFGEQLSGFAFTANGWVQSYGSRCVKPPIIYGDVSRPNAMTVFWSKMAQSMTSRPMKGMLTGPVTILNWSFVRNDQPRFETCYQIALAIKKEVEDLEAGGIQVIQIDEAALREGLPLRKAEHAFYLDWAVHSFRITNCGVQDTTQIHTHMCYSNFNDIIHSIINMDADVITIENSRSDEKLLSVFREGVKYGAGIGPGVYDIHSPRIPSTEEIADRINKMLAVLDTNILWVNPDCGLKTRKYTEVKPALTNMVLAAKLIRTQLASAK

SEQ ID NO: 2873 - protein, 766 aa, Oryza sativa Japonica Group
MASHIVGYPRMGPKRELKFALESFWDGKSSAEDLEKVATDLRASIWKQMADAGIKYIPSNTFSYYDQVLDTTAMLGAVPERYSWTGGEIGFSTYFSMARGNATVPAMEMTKWFDTNYHFIVPELGPNTKFSYSSHKAVNEYKEAKALGVDTVPVLVGPVSYLLLSKPAKGVEKSFALLSLLSSILPVYKEVIAELKAAGATWIQFDEPTLVLDLDSHQLAAFSAAYTELESALSGLNVLIETYFADIPAESYKTLTSLNSVTAYGFDLIRGSKTLDLVKSAGFPSGKYLFAGVVDGRNIWADDLAASLTTLESLEAIVGKDKLVVSTSCSLMHTAVDLVNETKLDSEIKSWLAFAAQKVVEVNALAKALAGQKDEAYFAANTAAQASRRSSPRVTNEEVQKAAAALRGSDHRRATNVSARLDAQQKKLNLPVLPTTTIGSFPQTVELRRVRREYKAKKISEDEYVSAIKEEISKVVKIQEELDIDVLVHGEPERNDMVEYFGEQLSGFAFTANGWVQSYGSRCVKPPIIYGDVSRPNAMTVFWSKMAQSMTSRPMKGMLTGPVTILNWSFVRNDQPRFETCYQIALAIKKEVEDLEAGGIQVIQIDEAALREGLPLRKAEHAFYLDWAVHSFRITNCGVQDTTQIHTHMCYSNFNDIIHSIINMDADVITIENSRSDEKLLSVFREGVKYGAGIGPGVYDIHSPRIPSTEEIADRINKMLAVLDTNILWVNPDCGLKTRKYTEVKPALTNMVLAAKLIRTQLASAK

SEQ ID NO: 2874 - protein, 766 aa, Zea mays
MASHIVGYPRMGPKRELKFALESFWDGKSTAEDLEKVATDLRASIWKQMADAGIKYIPSNTFSYYDQVLDTTAMLGAVPERYSWTGGEIGFDTYFSMARGNATVPAMEMTKWFDTNYHFIVPELGPNTKFSYASHKAVNEYKEAKALGVDTVPVLVGPVSYLLLSKPAKGVEKGFPLLSLLSSILPVYKEVIAELKAAGASWIQFDEPTLVLDLDSDKLAAFSAAYAELESVLSGLNVLVETYFADVPAESYKTLTSLSSVTAYGFDLVRGTQTLGLVTSAGFPAGKYLFAGVVDGRNIWADDLATSLSTLQSLEAVVGKDKLVVSTSCSLMHTAVDLVNETKLDSEIKSWLAFAAQKVVEVDALAKALAGQKDEAYFAANAAAQASRKSSPRVTNEEVQKAAAALKGSDHRRGTNVSARLDAQQKKLNLPILPTTTIGSFPQTVELRRVRREYKAKKISEEEYVTAIKEEINKVVKLQEELDIDVLVHGEPERNDMVEYFGEQLSGFAFTANGWVQSYGSRCVKPPIIYGDVSRPNPMTVFWSKTAQSMTSRPMKGMLTGPVTILNWSFVRNDQPRFETCYQIALAIKKEVEDLEAGGIQVIQIDEAALREGLPLRKAEHAFYLDWAVHSFRITNCEIQDTTQIHTHMCYSNFNDIIHSIIDMDADVITIENSRSDEKLLSVFREGVKYGAGIGPGVYDIHSPRIPSAEEIADRIDKMLAVLDTNILWVNPDCGLKTRKYTEVKPALTNMVSAAKLIRTQLASAK

SEQ ID NO: 2875 - protein, 766 aa, Zea mays
MASHIVGYPRMGPKRELKFALESFWDGKSTAEDLEKVATDLRASIWKQMADAGIKYIPSNTFSYYDQVLDTTAMLGAVPERYSWTGGEIGFDTYFSMARGNATVPAMEMTKWFDTNYHFIVPELGPNTKFSYASHKAVNEYKEAKALGVDTVPVLVGPVSYLLLSKPAKGVEKGFPLLSLLSSILPVYKEVIAELKAAGASWIQFDEPTLVLDLDSDKLAAFSAAYAELESVLSGLNVLVETYFADVPAESYKTLTSLSSVTAYGFDLVRGTQTLGLVTSAGFPAGKYLFAGVVDGRNIWADDLATSLSTLQSLEAVVGKDKLVVSTSCSLMHTAVDLVNETKLDSEIKSWLAFAAQKVVEVDALAKALAGQKDEAYFAANAAAQASRKSSPRVTNEEVQKAAAALKGSDHRRGTNVSARLDAQQKKLNLPILPTTTIGSFPQTVELRRVRREYKAKKISEEEYVTAIKEEINKVVKLQEELDIDVLVHGEPERNDMVEYFGEQLSGFAFTANGWVQSYGSRCVKPPIIYGDVSRPNPMTVFWSKTAQSMTSRPMKGMLTGPVTILNWSFVRNDQPRFETCYQIALAIKKEVGDLKAGGIQVIQIDEAALREGLPLRKAEHAFYLDWAVHSFRITNCEIQDTTQIHTHMCYSNFNDIIHSIIDMDADVITIENSRSDEKLLSVFREGVKYGAGIGPGVYDIHSPRIPSAEEIADRIDKMLAVLDTNILWVNPDCGLKTRKYTEVKPALTNMVSAAKLIRTQFASAK

SEQ ID NO: 2876 - protein, 765 aa, Zea mays
MASHIVGYPRMGPKRELKFALESFWDGKSSAEDLEKVATDLRSSIWKQMSEAGIKYIPSNTFSYYDQVLDTTAMLGAVPERYSWTGGEIGLSTYFSMARGNATVPAMEMTKWFDTNYHFIVPELGPSTKFTYASHKAVSEYKEAKALGIDTVPVLVGPVSYLLLSKPAKGVEKSFSLLSLLGSILPIYKEVVAELKAAGASWIQLDEPTLVKDLDAHELAAFSSAYAELESSFSGLNVLIETYFADIPAESYKTLTSLSGVTAYGFDLIRGAKTLDLIRSSFPSGKYLFAGVVDGRNIWADDLAASLSTLHSLEAVAGKDKLVVSTSCSLMHTAVDLVNETKLDDEIKSWLAFAAQKVVEVNALAKALAGQKDEVYFAANAAAQASRRSSPRVTNEEVQKAAAALRGSDHRRSTTVSARLDAQQKKLNLPVLPTTTIGSFPQTVELRRVRREYKAKKITEDEYISAIKEEISKVVKIQEELDIDVLVHGEPERNDMVEYFGEQLSGFAFTANGWVQSYGSRCVKPPIIYGDVSRPNPMTVFWSKMAQSMTPRPMKGMLTGPVTILNWSFVRNDQPRFETCYQIALAIKKEVEDLEAAGIQVIQIDEAALREGLPLRKSEHAFYLDWAVHSFRITNCGVQDTTQIHTHMCYSNFNDIIHSIIDMDADVITIENSRSDEKLLSVFREGVKYGAGIGPGVYDIHSPRIPSTEEIADRVEKMLAVLDTNILWVNPDCGLKTRKYTEVKPALTNMVSATKLIRTQLASAK

SEQ ID NO: 2877 - protein, 765 aa, Zea mays
MASHIVGYPRMGPKRELKFALESFWDGKSSADDLEKVASDLRSSIWKQMSEAGIKYIPSNTFSYYDQVLDTTAMLGAVPERYSWTGGEIGLSTYFSMARGNATVPAMEMTKWFDTNYHFIVPELGPSTKFTYASHKAVSEYKEAKALGIDTVPVLVGPVSYLLLSKPAKGVEKSFSLLSLLGSILPIYKEVVSELKAAGASWIQFDEPTLVKDLDVHELAAFSSAYAELESAFSGLNVLIETYFADIPAESYKTLTSLSGVTAYGFDLIRGAKTLDLIRSSFPSGKYLFAGVVDGRNIWADDLAASLSTLQSLEAVAGKDKLVVSTSCSLMHTAVDLVNETKLDDEIKSWLAFAAQKVVEVNALAKALAGQKDEAYFAANAAAQASRRSSPRVTNEEVQKAAAALKGSDHRRATTVAARLDAQQKKLNLPVLPTTTIGSFPQTVELRRVRREYKAKKISEEEYISAIKEEISKVVKIQEELDIDVLVHGEPERNDMVEYFGEQLSGFAFTANGWVQSYGSRCVKPPIIYGDVSRPNPMTVFWSKTAQSMTARPMKGMLTGPVTILNWSFVRNDQPRFETCYQIALAIKKEVEDLEAAGIQVIQIDEAALREGLPLRKSEHAFYLDWAVHSFRITNCGVQDTTQIHTHMCYSNFNDIIHSIIDMDADVITIENSRSDEKLLSVFREGVKYGAGIGPGVYDIHSPRIPSTEEIADRVNKMLAVLDTNILWVNPDCGLKTRKYTEVKPALTNMVSATKLIRTQLGSAK

(The sequence listing continues in the following parts.)

What is claimed is:

1. A method of improving nitrogen use efficiency, abiotic stress tolerance, biomass, vigor or yield of a plant, the method comprising expressing within the plant an exogenous polynucleotide which downregulates an activity or expression of a polypeptide having an amino acid sequence 100% homologous to SEQ ID NOs: 312 and 317, wherein said polypeptide is capable of regulating nitrogen use efficiency of the plant, thereby improving nitrogen use efficiency, abiotic stress tolerance, biomass, vigor or yield of the plant.

2. A transgenic plant exogenously expressing a polynucleotide which downregulates an activity or expression of a polypeptide having an amino acid sequence 100% homologous to SEQ ID NOs: 312 and 317, wherein said polypeptide is capable of regulating nitrogen use efficiency of the plant.

3. A nucleic acid construct comprising a polynucleotide which downregulates an activity or expression of a polypeptide having an amino acid sequence 100% homologous to SEQ ID NOs: 312 and 317, wherein said polypeptide is capable of regulating nitrogen use efficiency of a plant, said nucleic acid sequence being under the regulation of a cis-acting regulatory element.

4. The method of claim 1, the transgenic plant of claim 2 or the nucleic acid construct of claim 3, wherein said polynucleotide acts by a mechanism selected from the group consisting of sense suppression, antisense suppression, ribozyme inhibition, gene disruption.

5. The nucleic acid construct of claim 3, wherein said cis-acting regulatory element comprises a promoter.

6. The nucleic acid construct of claim 5, wherein said promoter comprises a tissue-specific promoter.

7. The nucleic acid construct of claim 6, wherein said tissue-specific promoter comprises a root specific promoter.

8. The method of claim 1, further comprising growing the plant under limiting nitrogen conditions.

9. The method of claim 1, further comprising growing the plant under abiotic stress.

10. The method of claim 9, wherein said abiotic stress is selected from the group consisting of salinity, drought, water deprivation, flood, etiolation, low temperature, high temperature, heavy metal toxicity, anaerobiosis, nutrient deficiency, nutrient excess, atmospheric pollution and UV irradiation.

11. The method of claim 1 wherein the plant is a monocotyledon.

12. The method of claim 1, wherein the plant is a dicotyledon.

* * * * *